United States Patent 9,050,297 (MODIFIED POLYNUCLEOTIDES ENCODING ARYL HYDROCARBON RECEPTOR NUCLEAR TRANSLOCATOR) - sequence listing, part 3

SEQ ID NO: 1702 - DNA, 1392 bp, Homo sapiens
agtgggagctgccgggagttggagcctgcggagttcgagaccatgctgctgttctgccccggctgcgggaacgggctgatcgtggaggagggacaacgctgccaccgcttctcctgcaacacgtgcccctacgtgcacaacatcacccgcaaggtaacaaatcggaagtacccaaaactgaaagaagtggatgatgtgcttggtggagcagctgcctgggagaatgttgactctactgcagagtcgtgtcccaaatgcgaacatcctcgtgcttacttcatgcagcttcagacccgctctgcagatgagccgatgaccaccttctacaagtgctgcaatgctcagtgtggacaccgctggagggattagggccaggatggcccagctgccctagtgtgtgcttgccttgtccctcggggtagatgcttagctggcagtatgagttgtgtgtcctgagggtctttgctagtgtggtggaaagataaaccttttgaggtgaagagccagggggtcaggaaatatggcctatctgccaggcagggtggatgaagtcatgaatgtctgggagtttttctgtgtggggaggagacagagacccataactaaatatgctctgtgtaaagtcctattctttcatcttccactttattggcagttgacattcccttactcccaatcaacactcttaaatatttgtactgtttgtaaaacttagtacatgtccctaaatatttaactgttacttgtaaacttgtgtaatttattatttattttaatcaaaattctgaatatttcatttaaatgaaagttggaatattgccttctcagtgttttaaatagcttaagaggtagaaagcaaaccccaaatcacagtgatcccagaatagactacatacttacatttgaacaggctacgaaaatgttaatcaccgggatttcaatttctttctttattcctattcttactcccttattcatttttttgaacctcccctgatttgcttcctcgggttgctttaaatgtataagatactatttatttatttatttattttatttatttatttatttatttaagacagagtcttgttctgtcgcccaggctggagtgcagtggtacgaattcagctcactgcaacctctgccttccgggttcaagggattctcctgtctcagcctcccaagcagctgggactacaggcatgcaccaccacacctgggtaattttgcatttttagtagagatggggtttctccatgttggtcgggctggtctccaactcctgacctcagataatctgtctgcctcggcctcctaaagtgctgggattacaggcgtgagccactgtgtcccaccaatctttacatttaatatgactattttcttattgtt

SEQ ID NO: 1703 - DNA, 734 bp, Homo sapiens
ggcgaggtggggcgagcggccgacggcgggtgcacgcgtcggtacacgtctgggcggcgacctggtcgcaagccatggtcccacgcggggtcccagggccgccgcgggacttggccgaggtctcccgacttgtgctgtgagatacgttaacgctttctcgacaccaggggtctggacttagtgaccatggacgcttccccctcacctttctctctccccaagaaacttaatgaattatctgcccgtcggggatctgatgagcttctttcttctggcatcattaacggaccttttaccatgaatagttctactccttctacagctaatgggaatgacagcaagaaatttaaacgagatagacctccctgttcgccttcccgtgttctccatcttcgaaaaattccatgtgatgtcaccgaagcagagatcatatcattaggtctaccatttggcaaagtaactaatcttttgatgttgaaaggaaaaagccaggctttcttagaaatggcttctgaggaagctgccgttactatggtgaattattacactcctattactcctcaccttcgaagccagcctgtttatattcagtattccaatcacagagaacttaagactgacaatctacctaatcaagctcgagcccaagctgcactgcaggctgtcagtgccgtccaatcaggaagcctggccctttctggaggtccttccaatgaaggcacagtcctacctgg

SEQ ID NO: 1704 - DNA, 7271 bp, Homo sapiens
ggcgcggcggtggcgggagcgtgcccggtccccgcccctgttcccactctccttccacctcggaccggccggggctccgcagagccaaagctcgcttgtccccggaaccgccctgctgccgccgcctgcttcctctgctcgcggttagcccgtcagtccctgctctgtgcgcgcctccatctgggccatggatggtgttgttacagatcttataacagtcggtttaaagcggggatctgatgagcttctttcttctggcatcattaacggaccttttaccatgaatagttctactccttctacaggtgtgtatgctaatgggaatgacagcaagaaatttaaacgagatagacctccctgttcgccttcccgtgttctccatcttcgaaaaattccatgtgatgtcaccgaagcagagatcatatcattaggtctaccatttggcaaagtaactaatcttttgatgttgaaaggaaaaagccaggctttcttagaaatggcttctgaggaagctgccgttactatggtgaattattacactcctattactcctcaccttcgaagccagcctgtttatattcagtattccaatcacagagaacttaagactgacaatctacctaatcaagctcgagcccaagctgcactgcaggctgtcagtgccgtccaatcaggaagcctggccctttctggaggtccttccaatgaaggcacagtcctacctgggcagagccctgtgcttcgaataattattgaaaacctcttttaccctgttaccctggaagttcttcatcagatattttctaaatttggcacagtcttgaagattatcacctttacaaagaataatcagtttcaagccttgcttcagtatgctgacccagtaaatgcacattatgccaaaatggctctggatggccagaatatctataatgcatgctgcactctgcgcattgacttctccaagctcaccagccttaatgtgaaatataataatgacaaaagcagagacttcactcgcttagaccttcctactggtgatggccagccatcccttgaaccccctatggctgctgcttttggtgcaccgggtataatttcttcaccatatgcaggggctgctggatttgccccagccattggatttcctcaagctacaggtctatcagttccagctgttcctggagctcttggtcctctcacaatcacctcttctgctgtcactggaaggatggccattcctggggctagtggtataccaggaaattctgttctactcgtcacaaatctcaatcctgatcttatcacaccacatgggctttttatcctatttggagtctatggtgatgtacatcgagtgaagattatgtttaataagaaagaaaatgccttggttcagatggcggatgcaaatcaagctcagctagcaatgaaccatctaagtggtcagagactttatgggaaagtgcttcgtgctacactgtccaaacatcaagcagtacagcttcctcgagagggacaagaagaccaaggtctgactaaggatttcagcaatagtcctttgcatcgctttaaaaagccgggctctaaaaacttccagaatatctttccaccatcagccactctgcatctttccaacattcccccttctgttacagtggatgatctgaagaaccttttcatagaagctggatgttcagtgaaggcttttaaattctttcagaaagatcgcaaaatggcgctcattcaattgggatctgtggaagaagcaattcaggccctcattgagcttcataaccatgaccttggagaaaatcaccacctcagagtttccttctcaaaatctacaatctgacttttctgtgaatttttctcctaaaactggaccataatttcagtaaaaccttcagacatagactgaagcagctcaagaccaattttgcctctttcacaaaaataactctgagtttgatattcaagtatattttaaaaatcaagggattttttttttttgtattccccctgcccccgccagtcaaaggtttcttttccctttttaccatggtttctacaaaaataaccttcaggaaaaagaaaatcaggaaaaaaattttttttcaataatcttattccctatattaaattagatttgaagaggattaacgttgttttagtttgggtccagatcagccttatacaacatttctaaactcatttgtacttttaaaaaatttaaacacagacttctaaaattacttgatgtaagtaatttaaatcacttatgaccaagttattaaccttatgaatcagaagtctgacccttgtaggaaattatattcacatataaagtacatcagatctttgccatatattgatggttattatgcataaacacattgagttgtgttggaagcagatttataaacctgcatgttttctttgaatgatttctttttttcactgtaagacactcctttaaataatgcctatctttaactttttaagactatttggaaaaatgcagtgtctcagctgtccccagggaaattaagtggaattcaactaagatctgttaataagatgtcagaataactaataattttattaggaaaaaatcatgttttaaatttcaaaatgacacttatttgtcaagtaatatgatcttggaaaattttaaagaaaaataatcctacttataaactacttttttataattgttttcagaaaaaaagtttacagtcttaaggaaaatattcaggtctatcatatggtttgacagattttttaaaagttatttttggtaaggtcttcttttagaaaaaaattaatctcaagggttttttgtaccactataatctctaatacttactcagaattactgtgtatttacttaatttcttattatgtgccttattatgtgcttaagatacaataggttagagtttaatctaaatatcttgaaagctatattgtgggcttggtaagcattttgttttttctttctctgttttggtaaggatttaaaatttttttcattgcaattttaagtggttttcaataagtaatagtttttatcaaatttttggtgcttggtgcagagacggtgtggggaagggtgaatggttttgggaataattcagtgcacacctgtaggcctctttacattgtgactgataggggttattgcatatcaatttggggctgtagagtgcaatctcagtttcatctttttcacccatcagaatttgtctcaggattacttggtttttctcagtcctcaagcgagaacttgcttttctttgttaatgtgactttcattactgagtacccacgtatttggagtatgagaaggtgggttatttctcatactctgtccctctctttttcattgaatgtaagagtacattttaatgttgcttcagtgattgtataatgtaaaattgtttctttttaataagaaactttgctattatttcttcaattgttgatcagaattttttaaagcagaatttgtcaaaagggtcatttttttgtctaccccttttacacttttcagattctcaaagtgtctcatctcaacttttaaaagaataaagaatatcttgctgggcatggtggtgtgcgcctgtgcgcctgtagtcccagctacaggctgagcctgtaggcaggaggctacaggcaggaggatcacttgagcccaggagttcaaggctgcagtgcgctatgatcacatttgtgaatagccacttcactccagccctggaacatagtgtgaccccttctcttaaaagtaaaaattaagaaaatctcaatctctttgctgtattccagtgattaatttgaacatagggaggtttttacagaagaaattttaccaaaaaatagagactgcaagagatgatacagattgtttaaaaagcagaattcactcaccactgagcaacacttagttggtagaatagaaaggagggatactaagttaagacttttcaaatggatcagtttggctgaatagatagatatactcatgtatgtagttgtgggagtttttagttttttgtttttttacttatgaaataagttttgacctagacacaaggggtatatgaaggaggaaaaaaatttctttgcaaaatctcccaaaacttgcttttttttcccttccacacaggcactattataattttcagtgccatgttaaattggattatttcatttactttaagttaggaattactgtgtaatttattaattcatgattctcataacattcagcataagtgtagcaaagttgctaataacggaaggggatcatagtggtgttgaatgtaactttgaagtagggaatggccttttaagtctgagagagaacatttgaatccttttcagggatttgtgtaggggtgtgtttgtgtgtgtgtgtgaatgtgtgtgtgtgtagataagtgtatatacataaatacactcttctaaagttgtatatacatatgcacattacatacattttaatttattgacaaaattaaccaaattaagatttggagatgtgggatgttcttgttttaaaatagcatgtttgaaaccatcagtttgtgtctaaaattagctgtagcacatggatgttgtccatattaagctatttgctgtttgaattatagaggtctacagtatttgtgttggcatagtttttgtaaaaaaaagattaaaaaatatcaggatggtggaaaaactagatctgtgtatctctgttttggcatgcatttattcagtatcttctagcaatggtttttctctgttgatctaccgtagtatcctatttttaagtttattttatttttaaggagtattgtcatcacttttcaaggtgtcttgacttctacacaaagtatatatattcaggactttaaaaaatagcagtacacatttaacagtagcgaattacaccaaaatgatttactttgagatttgaataatttgcatagcagtaaaatgtgttttgtgtaacatacaaatagaaaaatgacccagtatcttaattgatacttactggagagtatcagaattacccagcagctcttacagaatgccataaattctttaagactaaatattgaaatcaattatttgaagtaatgtttctgatttactgttaaaagttgctgagctcagtttttggagatatcatttatgcctgcctgttcccttatgacagtgaggccttctttggctccacctagtatgataatcatgggttctgttttagttgatgagaagtggctcctatgaatgcctctgctcaatttctttttattttactttattttatttttaggggtctcgccaactcctgggctcaagtgattctcctgcttccacctccccacagtgctgggattacaggcatgagccaccacgcctggctctctgttcttttcagtgtctccgtgccatcagtcagcagtgcttacatgtttagcatattgtcatgcagtttctcttctgttcccacgagatatttttggacaaaaaattgacaaaagtacatgtgtttttccccacctatcccttagaaaacctaatgtgtactgctatttttaaaaccaaaaagagacagcgtgacgatgcgtaaagcatttttcttagcctttcctttgtcttgatctgttaatgagaacaaaactgccagactcaaaatactctactattgtgctgaaagaaatacaatttagattgcacaaaatttgaaaatataactcagctgtcttttaaaagagttgtgttgttatctacaagactattagcagtcttttttcagagcaaattttaacagctagttgtgagtggtttaaaatatagaaaattattaaaatcttagtttgaggggttttatagtgggagaaaaaacaggaccaaagtttatgtgccttcttcagtagtcttaattgaccttttcttcctatttgagactaaagtagtatcagtattctggttttcaggaaatatgtactatatagttttaaaagaatgttgtcccaccaactattcatccaagcaaagaattgtaactataaataaagtctcagttacacttttgcctttatcacataatattcattgtagagcattgtgcaggtccaagaatagagctgctcaaaatctttgtggtagtttccttagtttttgtaacctgaggcatatgttccagagaacagggatatttgtctggtccagtgaccttggtgatcatagtcataattgaaagatgcctatggcatgcttaaatcagcattgtcaactgatttgttgttgtattattttcacttcttggatctatgtagtagttgtaataacaaatatttaaatagctatttttttgatgccattaaaaaaatcatactctggccttttttcccccttactgttgtttcccagatcttttaaaaattcatcccatatccagaaagtaccagttataaagattgctgaccaagcaaagttttgcatcaaagtgtcacctcattgctctgaccaaagactgactgttgtggttttaactcctctctgtaaagcattttgcattttccccaagctcctttctgaaagaagaaccagtgcagagcggcctttactttcaatttctactgctgaatagactacttagagaaaatgtgagtttcagtgtgaacagaatggattaggatgacgagtttgatgggcattttcagtactgtatctaagaaaaaaaaaatagcacagctaggagcctctgacattgtctggtgttttacgtggtctgttcatcaaaattccccttttcagtttttaagaatgttcgtctaacagaagaaaatgctgtaaatatttgtaacaacattttttttaacaaggccaaaaaagaaaaaaaggtttttgggaacaaatgaacttataaagtggttttatataaaacatcaattgtcttgtatattttggataagcagcagtaccagctttcatttgtaacagtctgtggcattggaaaaaaaggagtctgtgattgttgaagtgaattatgttataaatgcaaagagaagataaaatattaaaaaacatattttctaaatgcgtagtgcatggttaattcaagcttctgtacactacagtatattccattttcgttcagtttgtatatttgctgactattacttgatatctctaatctcttttcctaacaaatatagcattgtagcatgccttttaataaatgtcatgacatctgtactctcttaaaa

SEQ ID NO: 1705 - DNA, 2755 bp, Homo sapiens
aaagctcgcttgtccccggaaccgccctgctgccgccgcctgcttcctctgctcgcggttagcccgtcagtccctgctctgtgcgcgcctccatctgggccatggatggcggggatctgatgagcttctttcttctggcatcattaacggaccttttaccatgaatagttctactccttctacaggtgtgtatggctttcttagaaatggcttctgaggaagctgccgttactatggtgaattattacactcctattactcctcaccttcgaagccagcctgtttatattcagtattccaatcacagagaacttaagactgacaatctacctaatcaagctcgagcccaagctgcactgcaggctgtcagtgccgtccaatcaggaagcctggccctttctggaggtccttccaatgaaggcacagtcctacctgggcagagccctgtgcttcgaataattattgaaaacctcttttaccctgttaccctggaagttcttcatcagatattttctaaatttggcacagtcttgaagattatcacctttacaaagaataatcagtttcaagccttgcttcagtatgctgacccagtaaatgcacattatgccaaaatggctctggatggccagaatatctataatgcatgctgcactctgcgcattgacttctccaagctcaccagccttaatgtgaaatataataatgacaaaagcagagacttcactcgcttagaccttcctactggtgatggccagccatcccttgaaccccctatggctgctgcttttggtgcaccgggtataatttcttcaccatatgcaggggctgctggatttgccccagccattggatttcctcaagctacaggtctatcagttccagctgttcctggagctcttggtcctctcacaatcacctcttctgctgtcactggaaggatggccattcctggggctagtggtataccaggaaattctgttctactcgtcacaaatctcaatcctgatcttatcacaccacatgggctttttatcctatttggagtctatggtgatgtacatcgagtgaagattatgtttaataagaaagaaaatgccttggttcagatggcggatgcaaatcaagctcagctagcaatgaaccatctaagtggtcagagactttatgggaaagtgcttcgtgctacactgtccaaacatcaagcagtacagcttcctcgagagggacaagaagaccaaggtctgactaaggatttcagcaatagtcctttgcatcgctttaaaaagccgggctctaaaaacttccagaatatctttccaccatcagccactctgcatctttccaacattcccccttctgttacagtggatgatctgaagaaccttttcatagaagctggatgttcagtgaaggcttttaaattctttcagaaagatcgcaaaatggcgctcattcaattgggatctgtggaagaagcaattcaggccctcattgagcttcataaccatgaccttggagaaaatcaccacctcagagtttccttctcaaaatctacaatctgacttttctgtgaatttttctcctaaaactggaccataatttcagtaaaaccttcagacatagactgaagcagctcaagaccaattttgcctctttcacaaaaataactctgagtttgatattcaagtatattttaaaaatcaagggattttttttttttgtattccccctgcccccgccagtcaaaggtttcttttccctttttaccatggtttctacaaaaataaccttcaggaaaaagaaaatcaggaaaaaaattttttttcaataatcttattccctatattaaattagatttgaagaggattaacgttgttttagtttgggtccagatcagccttatacaacatttctaaactcatttgtacttttaaaaaatttaaacacagacttctaaaattacttgatgtaagtaatttaaatcacttatgaccaagttattaaccttatgaatcagaagtctgacccttgtaggaaattatattcacatataaagtacatcagatctttgccatatattgatggttattatgcataaacacattgagttgtgttggaagcagatttataaacctgcatgttttctttgaatgatttctttttttcactgtaagacactcctttaaataatgcctatctttaactttttaagactatttggaaaaatgcagtgtctcagctgtccccagggaaattaagtggaattcaactaagatctgttaataagatgtcagaataactaataattttattaggaaaaaatcatgttttaaatttcaaaatgacacttatttgtcaagtaatatgatcttggaaaattttaaagaaaaataatcctacttataaactacttttttataattgttttcagaaaaaaagtttacagtcttaaggaaaatattcaggtctatcatatggtttgacagattttttaaaagttatttttggtaaggtcttcttttagaaaaaaattaatctcaagggttttttgtaccactataatctctaatacttactcagaattactgtgtatttacttaatttcttattatgtgccttattatgtgcttaagatacaataggttagagtttaatctaaatatcttgaaagctatattgtgggcttggtaagcattttgttttttctttctctgttttggtaaggatttaaaatttttttcattgcaatttt

SEQ ID NO: 1706 - DNA, 3413 bp, Homo sapiens
gttcccactctccttccacctcggaccggccggggctccgcagagccaaagctcgcttgtccccggaaccgccctgctgccgccgcctgcttcctctgctcgcggttagcccgtcagtccctgctctgtgcgcgcctccatctgggccatggatggtgttgttacagatcttataacagtcggtttaaagcggggatctgatgagcttctttcttctggcatcattaacggaccttttaccatgaatagttctactccttctacagctaatgggaatgacagcaagaaatttaaacgagatagacctccctgttcgccttcccgtgttctccatcttcgaaaaattccatgtgatgtcaccgaagcagagatcatatcattaggtctaccatttggcaaagtaactaatcttttgatgttgaaaggaaaaagccaggctttcttagaaatggcttctgaggaagctgccgttactatggtgaattattacactcctattactcctcaccttcgaagccagcctgtttatattcagtattccaatcacagagaacttaagactgacaatctacctaatcaagctcgagcccaagctgcactgcaggctgtcagtgccgtccaatcaggaagcctggccctttctggaggtccttccaatgaaggcacagtcctacctgggcagagccctgtgcttcgaataattattgaaaacctcttttaccctgttaccctggaagttcttcatcagatattttctaaatttggcacagtcttgaagattatcacctttacaaagaataatcagtttcaagccttgcttcagtatgctgacccagtaaatgcacattatgccaaaatggctctggatggccagaatatctataatgcatgctgcactctgcgcattgacttctccaagctcaccagccttaatgtgaaatataataatgacaaaagcagagacttcactcgcttagaccttcctactggtgatggccagccatcccttgaaccccctatggctgctgcttttggtgcaccgggtataatttcttcaccatatgcaggggctgctggatttgccccagccattggatttcctcaagctacaggtctatcagttccagctgttcctggagctcttggtcctctcacaatcacctcttctgctgtcactggaaggatggccattcctggggctagtggtataccaggaaattctgttctactcgtcacaaatctcaatcctgatcttatcacaccacatgggctttttatcctatttggagtctatggtgatgtacatcgagtgaagattatgtttaataagaaagaaaatgccttggttcagatggcggatgcaaatcaagctcagctagcaatgaaccatctaagtggtcagagactttatgggaaagtgcttcgtgctacactgtccaaacatcaagcagtacagcttcctcgagagggacaagaagaccaaggtctgactaaggatttcagcaatagtcctttgcatcgctttaaaaagccgggctctaaaaacttccagaatatctttccaccatcagccactctgcatctttccaacattcccccttctgttacagtggatgatctgaagaaccttttcatagaagctggatgttcagtgaaggcttttaaattctttcagaaagatcgcaaaatggcgctcattcaattgggatctgtggaagaagcaattcaggccctcattgagcttcataaccatgaccttggagaaaatcaccacctcagagtttccttctcaaaatctacaatctgacttttctgtgaatttttctcctaaaactggaccataatttcagtaaaaccttcagacatagactgaagcagctcaagaccaattttgcctctttcacaaaaataactctgagtttgatattcaagtatattttaaaaatcaagggattttttttttttgtattccccctgcccccgccagtcaaaggtttcttttccctttttaccatggtttctacaaaaataaccttcaggaaaaagaaaatcaggaaaaaaattttttttcaataatcttattccctatattaaattagatttgaagaggattaacgttgttttagtttgggtccagatcagccttatacaacatttctaaactcatttgtacttttaaaaaatttaaacacagacttctaaaattacttgatgtaagtaatttaaatcacttatgaccaagttattaaccttatgaatcagaagtctgacccttgtaggaaattatattcacatataaagtacatcagatctttgccatatattgatggttattatgcataaacacattgagttgtgttggaagcagatttataaacctgcatgttttctttgaatgatttctttttttcactgtaagacactcctttaaataatgcctatctttaactttttaagactatttggaaaaatgcagtgtctcagctgtccccagggaaattaagtggaattcaactaagatctgttaataagatgtcagaataactaataattttattaggaaaaaatcatgttttaaatttcaaaatgacacttatttgtcaagtaatatgatcttggaaaattttaaagaaaaataatcctacttataaactacttttttataattgttttcagaaaaaaagtttacagtcttaaggaaaatattcaggtctatcatatggtttgacagattttttaaaagttatttttggtaaggtcttcttttagaaaaaaattaatctcaagggttttttgtaccactataatctctaatacttactcagaattactgtgtatttacttaatttcttattatgtgccttattatgtgcttaagatacaataggttagagtttaatctaaatatcttgaaagctatattgtgggcttggtaagcattttgttttttctttctctgttttggtaaggatttaaaatttttttcattgcaattttaagtggttttcaataagtaatagtttttatcaaatttttggtgcttggtgcagagacggtgtggggaagggtgaatggttttgggaataattcagtgcacacctgtaggcctctttacattgtgactgataggggttattgcatatcaatttggggctgtagagtgcaatctcagtttcatctttttcacccatcagaatttgtctcaggattacttggtttttctcagtcctcaagcgagaacttgcttttctttgttaatgtgactttcattactgagtacccacgtatttggagtatgagaaggtgggttatttctcatactctgtccctctctttttcattgaatgtaagagtacattttaatgttgcttcagtgattgtataatgtaaaattgtttctttttaataagaaa

SEQ ID NO: 1707 - DNA, 7240 bp, Homo sapiens
gggggcgcggcggtggcgggagcgtgcccggtccccgcccctgttcccactctccttccacctcggaccggccggggctccgcagagccaaagctcgcttgtccccggaaccgccctgctgccgccgcctgcttcctctgctcgcggttagcccgtcagtccctgctctgtgcgcgcctccatctgggccatggatggcggggatctgatgagcttctttcttctggcatcattaacggaccttttaccatgaatagttctactccttctacaggtgtgtatgctaatgggaatgacagcaagaaatttaaacgagatagacctccctgttcgccttcccgtgttctccatcttcgaaaaattccatgtgatgtcaccgaagcagagatcatatcattaggtctaccatttggcaaagtaactaatcttttgatgttgaaaggaaaaagccaggctttcttagaaatggcttctgaggaagctgccgttactatggtgaattattacactcctattactcctcaccttcgaagccagcctgtttatattcagtattccaatcacagagaacttaagactgacaatctacctaatcaagctcgagcccaagctgcactgcaggctgtcagtgccgtccaatcaggaagcctggccctttctggaggtccttccaatgaaggcacagtcctacctgggcagagccctgtgcttcgaataattattgaaaacctcttttaccctgttaccctggaagttcttcatcagatattttctaaatttggcacagtcttgaagattatcacctttacaaagaataatcagtttcaagccttgcttcagtatgctgacccagtaaatgcacattatgccaaaatggctctggatggccagaatatctataatgcatgctgcactctgcgcattgacttctccaagctcaccagccttaatgtgaaatataataatgacaaaagcagagacttcactcgcttagaccttcctactggtgatggccagccatcccttgaaccccctatggctgctgcttttggtgcaccgggtataatttcttcaccatatgcaggggctgctggatttgccccagccattggatttcctcaagctacaggtctatcagttccagctgttcctggagctcttggtcctctcacaatcacctcttctgctgtcactggaaggatggccattcctggggctagtggtataccaggaaattctgttctactcgtcacaaatctcaatcctgatcttatcacaccacatgggctttttatcctatttggagtctatggtgatgtacatcgagtgaagattatgtttaataagaaagaaaatgccttggttcagatggcggatgcaaatcaagctcagctagcaatgaaccatctaagtggtcagagactttatgggaaagtgcttcgtgctacactgtccaaacatcaagcagtacagcttcctcgagagggacaagaagaccaaggtctgactaaggatttcagcaatagtcctttgcatcgctttaaaaagccgggctctaaaaacttccagaatatctttccaccatcagccactctgcatctttccaacattcccccttctgttacagtggatgatctgaagaaccttttcatagaagctggatgttcagtgaaggcttttaaattctttcagaaagatcgcaaaatggcgctcattcaattgggatctgtggaagaagcaattcaggccctcattgagcttcataaccatgaccttggagaaaatcaccacctcagagtttccttctcaaaatctacaatctgacttttctgtgaatttttctcctaaaactggaccataatttcagtaaaaccttcagacatagactgaagcagctcaagaccaattttgcctctttcacaaaaataactctgagtttgatattcaagtatattttaaaaatcaagggattttttttttttgtattccccctgcccccgccagtcaaaggtttcttttccctttttaccatggtttctacaaaaataaccttcaggaaaaagaaaatcaggaaaaaaattttttttcaataatcttattccctatattaaattagatttgaagaggattaacgttgttttagtttgggtccagatcagccttatacaacatttctaaactcatttgtacttttaaaaaatttaaacacagacttctaaaattacttgatgtaagtaatttaaatcacttatgaccaagttattaaccttatgaatcagaagtctgacccttgtaggaaattatattcacatataaagtacatcagatctttgccatatattgatggttattatgcataaacacattgagttgtgttggaagcagatttataaacctgcatgttttctttgaatgatttctttttttcactgtaagacactcctttaaataatgcctatctttaactttttaagactatttggaaaaatgcagtgtctcagctgtccccagggaaattaagtggaattcaactaagatctgttaataagatgtcagaataactaataattttattaggaaaaaatcatgttttaaatttcaaaatgacacttatttgtcaagtaatatgatcttggaaaattttaaagaaaaataatcctacttataaactacttttttataattgttttcagaaaaaaagtttacagtcttaaggaaaatattcaggtctatcatatggtttgacagattttttaaaagttatttttggtaaggtcttcttttagaaaaaaattaatctcaagggttttttgtaccactataatctctaatacttactcagaattactgtgtatttacttaatttcttattatgtgccttattatgtgcttaagatacaataggttagagtttaatctaaatatcttgaaagctatattgtgggcttggtaagcattttgttttttctttctctgttttggtaaggatttaaaatttttttcattgcaattttaagtggttttcaataagtaatagtttttatcaaatttttggtgcttggtgcagagacggtgtggggaagggtgaatggttttgggaataattcagtgcacacctgtaggcctctttacattgtgactgataggggttattgcatatcaatttggggctgtagagtgcaatctcagtttcatctttttcacccatcagaatttgtctcaggattacttggtttttctcagtcctcaagcgagaacttgcttttctttgttaatgtgactttcattactgagtacccacgtatttggagtatgagaaggtgggttatttctcatactctgtccctctctttttcattgaatgtaagagtacattttaatgttgcttcagtgattgtataatgtaaaattgtttctttttaataagaaactttgctattatttcttcaattgttgatcagaattttttaaagcagaatttgtcaaaagggtcatttttttgtctaccccttttacacttttcagattctcaaagtgtctcatctcaacttttaaaagaataaagaatatcttgctgggcatggtggtgtgcgcctgtgcgcctgtagtcccagctacaggctgagcctgtaggcaggaggctacaggcaggaggatcacttgagcccaggagttcaaggctgcagtgcgctatgatcacatttgtgaatagccacttcactccagccctggaacatagtgtgaccccttctcttaaaagtaaaaattaagaaaatctcaatctctttgctgtattccagtgattaatttgaacatagggaggtttttacagaagaaattttaccaaaaaatagagactgcaagagatgatacagattgtttaaaaagcagaattcactcaccactgagcaacacttagttggtagaatagaaaggagggatactaagttaagacttttcaaatggatcagtttggctgaatagatagatatactcatgtatgtagttgtgggagtttttagttttttgtttttttacttatgaaataagttttgacctagacacaaggggtatatgaaggaggaaaaaaatttctttgcaaaatctcccaaaacttgcttttttttcccttccacacaggcactattataattttcagtgccatgttaaattggattatttcatttactttaagttaggaattactgtgtaatttattaattcatgattctcataacattcagcataagtgtagcaaagttgctaataacggaaggggatcatagtggtgttgaatgtaactttgaagtagggaatggccttttaagtctgagagagaacatttgaatccttttcagggatttgtgtaggggtgtgtttgtgtgtgtgtgtgaatgtgtgtgtgtgtagataagtgtatatacataaatacactcttctaaagttgtatatacatatgcacattacatacattttaatttattgacaaaattaaccaaattaagatttggagatgtgggatgttcttgttttaaaatagcatgtttgaaaccatcagtttgtgtctaaaattagctgtagcacatggatgttgtccatattaagctatttgctgtttgaattatagaggtctacagtatttgtgttggcatagtttttgtaaaaaaaagattaaaaaatatcaggatggtggaaaaactagatctgtgtatctctgttttggcatgcatttattcagtatcttctagcaatggtttttctctgttgatctaccgtagtatcctatttttaagtttattttatttttaaggagtattgtcatcacttttcaaggtgtcttgacttctacacaaagtatatatattcaggactttaaaaaatagcagtacacatttaacagtagcgaattacaccaaaatgatttactttgagatttgaataatttgcatagcagtaaaatgtgttttgtgtaacatacaaatagaaaaatgacccagtatcttaattgatacttactggagagtatcagaattacccagcagctcttacagaatgccataaattctttaagactaaatattgaaatcaattatttgaagtaatgtttctgatttactgttaaaagttgctgagctcagtttttggagatatcatttatgcctgcctgttcccttatgacagtgaggccttctttggctccacctagtatgataatcatgggttctgttttagttgatgagaagtggctcctatgaatgcctctgctcaatttctttttattttactttattttatttttaggggtctcgccaactcctgggctcaagtgattctcctgcttccacctccccacagtgctgggattacaggcatgagccaccacgcctggctctctgttcttttcagtgtctccgtgccatcagtcagcagtgcttacatgtttagcatattgtcatgcagtttctcttctgttcccacgagatatttttggacaaaaaattgacaaaagtacatgtgtttttccccacctatcccttagaaaacctaatgtgtactgctatttttaaaaccaaaaagagacagcgtgacgatgcgtaaagcatttttcttagcctttcctttgtcttgatctgttaatgagaacaaaactgccagactcaaaatactctactattgtgctgaaagaaatacaatttagattgcacaaaatttgaaaatataactcagctgtcttttaaaagagttgtgttgttatctacaagactattagcagtcttttttcagagcaaattttaacagctagttgtgagtggtttaaaatatagaaaattattaaaatcttagtttgaggggttttatagtgggagaaaaaacaggaccaaagtttatgtgccttcttcagtagtcttaattgaccttttcttcctatttgagactaaagtagtatcagtattctggttttcaggaaatatgtactatatagttttaaaagaatgttgtcccaccaactattcatccaagcaaagaattgtaactataaataaagtctcagttacacttttgcctttatcacataatattcattgtagagcattgtgcaggtccaagaatagagctgctcaaaatctttgtggtagtttccttagtttttgtaacctgaggcatatgttccagagaacagggatatttgtctggtccagtgaccttggtgatcatagtcataattgaaagatgcctatggcatgcttaaatcagcattgtcaactgatttgttgttgtattattttcacttcttggatctatgtagtagttgtaataacaaatatttaaatagctatttttttgatgccattaaaaaaatcatactctggccttttttcccccttactgttgtttcccagatcttttaaaaattcatcccatatccagaaagtaccagttataaagattgctgaccaagcaaagttttgcatcaaagtgtcacctcattgctctgaccaaagactgactgttgtggttttaactcctctctgtaaagcattttgcattttccccaagctcctttctgaaagaagaaccagtgcagagcggcctttactttcaatttctactgctgaatagactacttagagaaaatgtgagtttcagtgtgaacagaatggattaggatgacgagtttgatgggcattttcagtactgtatctaagaaaaaaaaaatagcacagctaggagcctctgacattgtctggtgttttacgtggtctgttcatcaaaattccccttttcagtttttaagaatgttcgtctaacagaagaaaatgctgtaaatatttgtaacaacattttttttaacaaggccaaaaaagaaaaaaaggtttttgggaacaaatgaacttataaagtggttttatataaaacatcaattgtcttgtatattttggataagcagcagtaccagctttcatttgtaacagtctgtggcattggaaaaaaaggagtctgtgattgttgaagtgaattatgttataaatgcaaagagaagataaaatattaaaaaacatattttctaaatgcgtagtgcatggttaattcaagcttctgtacactacagtatattccattttcgttcagtttgtatatttgctgactattacttgatatctctaatctcttttcctaacaaatatagcattgtagcatgccttttaataaatgtcatgacatctgtactctcttaaaa

SEQ ID NO: 1708 - DNA, 368 bp, Homo sapiens
ccttccacctcggaccggccggggctccgcagagccaaagctcgcttgtccccggaaccgccctgctgccgccgcctgcttcctctgctcgcggttagcccgtcagtccctgctctgtgcgcgcctccatctgggccatggatggtgttgttacagatcttataacagtcggtttaaagcggggatctgatgagcttctttcttctggcatcattaacggaccttttaccatgaatagttctactccttctacaggtgtgtatgctaatgggaatgacagcaagaaatttaaacgagatagacctccctgttcgccttcccgtgttctccatcttcgaaaaattccatgtgatgtcaccgaagcagag

SEQ ID NO: 1709 - DNA, 7093 bp, Homo sapiens
atggacgcttccccctcacctttctctctccccaagaaacttaatgaattatctgcccgtcggggatctgatgagcttctttcttctggcatcattaacggaccttttaccatgaatagttctactccttctacagctaatgggaatgacagcaagaaatttaaacgagatagacctccctgttcgccttcccgtgttctccatcttcgaaaaattccatgtgatgtcaccgaagcagagatcatatcattaggtctaccatttggcaaagtaactaatcttttgatgttgaaaggaaaaagccaggctttcttagaaatggcttctgaggaagctgccgttactatggtgaattattacactcctattactcctcaccttcgaagccagcctgtttatattcagtattccaatcacagagaacttaagactgacaatctacctaatcaagctcgagcccaagctgcactgcaggctgtcagtgccgtccaatcaggaagcctggccctttctggaggtccttccaatgaaggcacagtcctacctgggcagagccctgtgcttcgaataattattgaaaacctcttttaccctgttaccctggaagttcttcatcagatattttctaaatttggcacagtcttgaagattatcacctttacaaagaataatcagtttcaagccttgcttcagtatgctgacccagtaaatgcacattatgccaaaatggctctggatggccagaatatctataatgcatgctgcactctgcgcattgacttctccaagctcaccagccttaatgtgaaatataataatgacaaaagcagagacttcactcgcttagaccttcctactggtgatggccagccatcccttgaaccccctatggctgctgcttttggtgcaccgggtataatttcttcaccatatgcaggggctgctggatttgccccagccattggatttcctcaagctacaggtctatcagttccagctgttcctggagctcttggtcctctcacaatcacctcttctgctgtcactggaaggatggccattcctggggctagtggtataccaggaaattctgttctactcgtcacaaatctcaatcctgatcttatcacaccacatgggctttttatcctatttggagtctatggtgatgtacatcgagtgaagattatgtttaataagaaagaaaatgccttggttcagatggcggatgcaaatcaagctcagctagcaatgaaccatctaagtggtcagagactttatgggaaagtgcttcgtgctacactgtccaaacatcaagcagtacagcttcctcgagagggacaagaagaccaaggtctgactaaggatttcagcaatagtcctttgcatcgctttaaaaagccgggctctaaaaacttccagaatatctttccaccatcagccactctgcatctttccaacattcccccttctgttacagtggatgatctgaagaaccttttcatagaagctggatgttcagtgaaggcttttaaattctttcagaaagatcgcaaaatggcgctcattcaattgggatctgtggaagaagcaattcaggccctcattgagcttcataaccatgaccttggagaaaatcaccacctcagagtttccttctcaaaatctacaatctgacttttctgtgaatttttctcctaaaactggaccataatttcagtaaaaccttcagacatagactgaagcagctcaagaccaattttgcctctttcacaaaaataactctgagtttgatattcaagtatattttaaaaatcaagggattttttttttttgtattccccctgcccccgccagtcaaaggtttcttttccctttttaccatggtttctacaaaaataaccttcaggaaaaagaaaatcaggaaaaaaattttttttcaataatcttattccctatattaaattagatttgaagaggattaacgttgttttagtttgggtccagatcagccttatacaacatttctaaactcatttgtacttttaaaaaatttaaacacagacttctaaaattacttgatgtaagtaatttaaatcacttatgaccaagttattaaccttatgaatcagaagtctgacccttgtaggaaattatattcacatataaagtacatcagatctttgccatatattgatggttattatgcataaacacattgagttgtgttggaagcagatttataaacctgcatgttttctttgaatgatttctttttttcactgtaagacactcctttaaataatgcctatctttaactttttaagactatttggaaaaatgcagtgtctcagctgtccccagggaaattaagtggaattcaactaagatctgttaataagatgtcagaataactaataattttattaggaaaaaatcatgttttaaatttcaaaatgacacttatttgtcaagtaatatgatcttggaaaattttaaagaaaaataatcctacttataaactacttttttataattgttttcagaaaaaaagtttacagtcttaaggaaaatattcaggtctatcatatggtttgacagattttttaaaagttatttttggtaaggtcttcttttagaaaaaaattaatctcaagggttttttgtaccactataatctctaatacttactcagaattactgtgtatttacttaatttcttattatgtgccttattatgtgcttaagatacaataggttagagtttaatctaaatatcttgaaagctatattgtgggcttggtaagcattttgttttttctttctctgttttggtaaggatttaaaatttttttcattgcaattttaagtggttttcaataagtaatagtttttatcaaatttttggtgcttggtgcagagacggtgtggggaagggtgaatggttttgggaataattcagtgcacacctgtaggcctctttacattgtgactgataggggttattgcatatcaatttggggctgtagagtgcaatctcagtttcatctttttcacccatcagaatttgtctcaggattacttggtttttctcagtcctcaagcgagaacttgcttttctttgttaatgtgactttcattactgagtacccacgtatttggagtatgagaaggtgggttatttctcatactctgtccctctctttttcattgaatgtaagagtacattttaatgttgcttcagtgattgtataatgtaaaattgtttctttttaataagaaactttgctattatttcttcaattgttgatcagaattttttaaagcagaatttgtcaaaagggtcatttttttgtctaccccttttacacttttcagattctcaaagtgtctcatctcaacttttaaaagaataaagaatatcttgctgggcatggtggtgtgcgcctgtgcgcctgtagtcccagctacaggctgagcctgtaggcaggaggctacaggcaggaggatcacttgagcccaggagttcaaggctgcagtgcgctatgatcacatttgtgaatagccacttcactccagccctggaacatagtgtgaccccttctcttaaaagtaaaaattaagaaaatctcaatctctttgctgtattccagtgattaatttgaacatagggaggtttttacagaagaaattttaccaaaaaatagagactgcaagagatgatacagattgtttaaaaagcagaattcactcaccactgagcaacacttagttggtagaatagaaaggagggatactaagttaagacttttcaaatggatcagtttggctgaatagatagatatactcatgtatgtagttgtgggagtttttagttttttgtttttttacttatgaaataagttttgacctagacacaaggggtatatgaaggaggaaaaaaatttctttgcaaaatctcccaaaacttgcttttttttcccttccacacaggcactattataattttcagtgccatgttaaattggattatttcatttactttaagttaggaattactgtgtaatttattaattcatgattctcataacattcagcataagtgtagcaaagttgctaataacggaaggggatcatagtggtgttgaatgtaactttgaagtagggaatggccttttaagtctgagagagaacatttgaatccttttcagggatttgtgtaggggtgtgtttgtgtgtgtgtgtgaatgtgtgtgtgtgtagataagtgtatatacataaatacactcttctaaagttgtatatacatatgcacattacatacattttaatttattgacaaaattaaccaaattaagatttggagatgtgggatgttcttgttttaaaatagcatgtttgaaaccatcagtttgtgtctaaaattagctgtagcacatggatgttgtccatattaagctatttgctgtttgaattatagaggtctacagtatttgtgttggcatagtttttgtaaaaaaaagattaaaaaatatcaggatggtggaaaaactagatctgtgtatctctgttttggcatgcatttattcagtatcttctagcaatggtttttctctgttgatctaccgtagtatcctatttttaagtttattttatttttaaggagtattgtcatcacttttcaaggtgtcttgacttctacacaaagtatatatattcaggactttaaaaaatagcagtacacatttaacagtagcgaattacaccaaaatgatttactttgagatttgaataatttgcatagcagtaaaatgtgttttgtgtaacatacaaatagaaaaatgacccagtatcttaattgatacttactggagagtatcagaattacccagcagctcttacagaatgccataaattctttaagactaaatattgaaatcaattatttgaagtaatgtttctgatttactgttaaaagttgctgagctcagtttttggagatatcatttatgcctgcctgttcccttatgacagtgaggccttctttggctccacctagtatgataatcatgggttctgttttagttgatgagaagtggctcctatgaatgcctctgctcaatttctttttattttactttattttatttttaggggtctcgccaactcctgggctcaagtgattctcctgcttccacctccccacagtgctgggattacaggcatgagccaccacgcctggctctctgttcttttcagtgtctccgtgccatcagtcagcagtgcttacatgtttagcatattgtcatgcagtttctcttctgttcccacgagatatttttggacaaaaaattgacaaaagtacatgtgtttttccccacctatcccttagaaaacctaatgtgtactgctatttttaaaaccaaaaagagacagcgtgacgatgcgtaaagcatttttcttagcctttcctttgtcttgatctgttaatgagaacaaaactgccagactcaaaatactctactattgtgctgaaagaaatacaatttagattgcacaaaatttgaaaatataactcagctgtcttttaaaagagttgtgttgttatctacaagactattagcagtcttttttcagagcaaattttaacagctagttgtgagtggtttaaaatatagaaaattattaaaatcttagtttgaggggttttatagtgggagaaaaaacaggaccaaagtttatgtgccttcttcagtagtcttaattgaccttttcttcctatttgagactaaagtagtatcagtattctggttttcaggaaatatgtactatatagttttaaaagaatgttgtcccaccaactattcatccaagcaaagaattgtaactataaataaagtctcagttacacttttgcctttatcacataatattcattgtagagcattgtgcaggtccaagaatagagctgctcaaaatctttgtggtagtttccttagtttttgtaacctgaggcatatgttccagagaacagggatatttgtctggtccagtgaccttggtgatcatagtcataattgaaagatgcctatggcatgcttaaatcagcattgtcaactgatttgttgttgtattattttcacttcttggatctatgtagtagttgtaataacaaatatttaaatagctatttttttgatgccattaaaaaaatcatactctggccttttttcccccttactgttgtttcccagatcttttaaaaattcatcccatatccagaaagtaccagttataaagattgctgaccaagcaaagttttgcatcaaagtgtcacctcattgctctgaccaaagactgactgttgtggttttaactcctctctgtaaagcattttgcattttccccaagctcctttctgaaagaagaaccagtgcagagcggcctttactttcaatttctactgctgaatagactacttagagaaaatgtgagtttcagtgtgaacagaatggattaggatgacgagtttgatgggcattttcagtactgtatctaagaaaaaaaaaatagcacagctaggagcctctgacattgtctggtgttttacgtggtctgttcatcaaaattccccttttcagtttttaagaatgttcgtctaacagaagaaaatgctgtaaatatttgtaacaacattttttttaacaaggccaaaaaagaaaaaaaggtttttgggaacaaatgaacttataaagtggttttatataaaacatcaattgtcttgtatattttggataagcagcagtaccagctttcatttgtaacagtctgtggcattggaaaaaaaggagtctgtgattgttgaagtgaattatgttataaatgcaaagagaagataaaatattaaaaaacatattttctaaatgcgtagtgcatggttaattcaagcttctgtacactacagtatattccattttcgttcagtttgtatatttgctgactattacttgatatctctaatctcttttcctaacaaatatagcattgtagcatgccttttaataaatgtcatgacatctgtactctcttaaaa

SEQ ID NO: 1710 - DNA, 1804 bp, Homo sapiens
gcgcggcgtgtggcccttgcgggcgagcctggcggggttgcgttcctgtccgctagcaggtcaatggccagcaaggaggggggtccgagccggcggcggcggcggcagtggtggcagcgggagacaaatggaaacctccacagggcacagactccatcaagatggagaacgggcagagcacagccgccaagctggggctgcctcccctgacgcccgagcagcaggaggcccttcagaaggccaagaagtacgccatggagcagagcatcaagagtgtgctggtgaagcagaccatcgcgcaccagcagcagcagctcaccaacctgcagatggcggctcagcggcagcgggcgctggccatcatgtgccgcgtctacgtgggctctatctactatgagctgggggaggacaccatccgccaggcctttgccccctttggccccatcaagagcatcgacatgtcctgggactccgtcaccatgaagcacaagggctttgccttcgtggagtatgaggtccccgaagctgcacagctggccttggagcagatgaactcggtgatgctggggggcaggaacatcaaggtgggcagacccagcaacatagggcaggcccagcccatcatagaccagttggctgaggaggcacgggccttcaaccgcatctacgtggcctctgtgcaccaggacctctcagacgatgacatcaagagcgtgtttgaggcctttggcaagatcaagtcctgcacactggcccgggaccccacaactggcaagcacaagggctacggcttcattgagtacgagaaggcccagtcgtcccaagatgctgtgtcttccatgaacctctttgacctgggtggccagtacttgcgggtgggcaaggctgtcacaccgcccatgcccctactcacaccagccacgcctggaggcctcccacctgccgctgctgtggcagctgctgcagccactgccaagatcacagctcaggaagcagtggccggagcagcggtgctgggtaccctgggcacacctggactggtgtccccagcactgaccctggcccagcccctgggcactttgccccaggctgtcatggctgcccaggcacctggagtcatcacaggtgtgaccccagcccgtcctcctatcccggtcaccatcccctcggtgggagtggtgaaccccatcctggccagccctccaacgctgggtctcctggagcccaagaaggagaaggaagaagaggagctgtttcccgagtcagagcggccagagatgctgagcgagcaggagcacatgagcatctcgggcagtagcgcccgacacatggtgatgcagaagctgctccgcaagcaggagtctacagtgatggttctgcgcaacatggtggaccccaaggacatcgatgatgacctggaaggggaggtgacagaggagtgtggcaagttcggggccgtgaaccgcgtcatcatctaccaagagaaacaaggcgaggaggaggatgcagaaatcattgtcaagatctttgtggagttttccatagcctctgagactcataaggccatccaggccctcaatggccgctggtttgctggccgcaaggtggtggctgaagtgtacgaccaggagcgttttgataacagtgacctctctgcgtgacagtggtccctctccccggacttgcacttgttccttgtttcctctgggttttatagtgatacagtggtgtccccggggccaggcgcgctctgcccagcccagcctacagtgcggataaaggtgcggatgctgctggccctgaa

SEQ ID NO: 1711 - DNA, 1821 bp, Homo sapiens
ggaaggagcaagagtgggaggcgcgcgcggaggccgcgacggacgcaagatggcgacggcgaccatagctctccaggtcaatggccagcaaggaggggggtccgagccggcggcggcggcggcagtggtggcagcgggagacaaatggaaacctccacagggcacagactccatcaagatggagaacgggcagagcacagccgccaagctggggctgcctcccctgacgcccgagcagcaggaggcccttcagaaggccaagaagtacgccatggagcagagcatcaagagtgtgctggtgaagcagaccatcgcgcaccagcagcagcagctcaccaacctgcagatggcggctcagcggcagcgggcgctggccatcatgtgccgcgtctacgtgggctctatctactatgagctgggggaggacaccatccgccaggcctttgccccctttggccccatcaagagcatcgacatgtcctgggactccgtcaccatgaagcacaagggctttgccttcgtggagtatgaggtccccgaagctgcacagctggccttggagcagatgaactcggtgatgctggggggcaggaacatcaaggtgggcagacccagcaacatagggcaggcccagcccatcatagaccagttggctgaggaggcacgggccttcaaccgcatctacgtggcctctgtgcaccaggacctctcagacgatgacatcaagagcgtgtttgaggcctttggcaagatcaagtcctgcacactggcccgggaccccacaactggcaagcacaagggctacggcttcattgagtacgagaaggcccagtcgtcccaagatgctgtgtcttccatgaacctctttgacctgggtggccagtacttgcgggtgggcaaggctgtcacaccgcccatgcccctactcacaccagccacgcctggaggcctcccacctgccgctgctgtggcagctgctgcagccactgccaagatcacagctcaggaagcagtggccggagcagcggtgctgggtaccctgggcacacctggactggtgtccccagcactgaccctggcccagcccctgggcactttgccccaggctgtcatggctgcccaggcacctggagtcatcacaggtgtgaccccagcccgtcctcctatcccggtcaccatcccctcggtgggagtggtgaaccccatcctggccagccctccaacgctgggtctcctggagcccaagaaggagaaggaagaagaggagctgtttcccgagtcagagcggccagagatgctgagcgagcaggagcacatgagcatctcgggcagtagcgcccgacacatggtgatgcagaagctgctccgcaagcaggagtctacagtgatggttctgcgcaacatggtggaccccaaggacatcgatgatgacctggaaggggaggtgacagaggagtgtggcaagttcggggccgtgaaccgcgtcatcatctaccaagagaaacaaggcgaggaggaggatgcagaaatcattgtcaagatctttgtggagttttccatagcctctgagactcataaggccatccaggccctcaatggccgctggtttgctggccgcaaggtggtggctgaagtgtacgaccaggagcgttttgataacagtgacctctctgcgtgacagtggtccctctccccggacttgcacttgttccttgtttcctctgggttttatagtgatacagtggtgtccccggggccaggcgcgctctgcccagcccagcctacagtgcggataaaggtgcggatgctgctggccctgaa

SEQ ID NO: 1712 - DNA, 1842 bp, Homo sapiens
cccttgcgggcgagcctggcggggttgcgttcctgtccgctagcaggtcaatggccagcaaggaggggggtccgagccggcggcggcggcggcagtggtggcagcgggagacaaatggaaacctccacagggcacagactccatcaagatggagaacgggcagagcacagccgccaagctggggctgcctcccctgacgcccgagcagcaggaggcccttcagaaggccaagaagtacgccatggagcagagcatcaagagtgtgctggtgaagcagaccatcgcgcaccagcagcagcagctcaccaacctgcagatggcagcagtgacaatgggctttggagatcctctctcacctttgcaatcgatggcggctcagcggcagcgggcgctggccatcatgtgccgcgtctacgtgggctctatctactatgagctgggggaggacaccatccgccaggcctttgccccctttggccccatcaagagcatcgacatgtcctgggactccgtcaccatgaagcacaagggctttgccttcgtggagtatgaggtccccgaagctgcacagctggccttggagcagatgaactcggtgatgctggggggcaggaacatcaaggtgggcagacccagcaacatagggcaggcccagcccatcatagaccagttggctgaggaggcacgggccttcaaccgcatctacgtggcctctgtgcaccaggacctctcagacgatgacatcaagagcgtgtttgaggcctttggcaagatcaagtcctgcacactggcccgggaccccacaactggcaagcacaagggctacggcttcattgagtacgagaaggcccagtcgtcccaagatgctgtgtcttccatgaacctctttgacctgggtggccagtacttgcgggtgggcaaggctgtcacaccgcccatgcccctactcacaccagccacgcctggaggcctcccacctgccgctgctgtggcagctgctgcagccactgccaagatcacagctcaggaagcagtggccggagcagcggtgctgggtaccctgggcacacctggactggtgtccccagcactgaccctggcccagcccctgggcactttgccccaggctgtcatggctgcccaggcacctggagtcatcacaggtgtgaccccagcccgtcctcctatcccggtcaccatcccctcggtgggagtggtgaaccccatcctggccagccctccaacgctgggtctcctggagcccaagaaggagaaggaagaagaggagctgtttcccgagtcagagcggccagagatgctgagcgagcaggagcacatgagcatctcgggcagtagcgcccgacacatggtgatgcagaagctgctccgcaagcaggagtctacagtgatggttctgcgcaacatggtggaccccaaggacatcgatgatgacctggaaggggaggtgacagaggagtgtggcaagttcggggccgtgaaccgcgtcatcatctaccaagagaaacaaggcgaggaggaggatgcagaaatcattgtcaagatctttgtggagttttccatagcctctgagactcataaggccatccaggccctcaatggccgctggtttgctggccgcaaggtggtggctgaagtgtacgaccaggagcgttttgataacagtgacctctctgcgtgacagtggtccctctccccggacttgcacttgttccttgtttcctctgggttttatagtgatacagtggtgtccccggggccaggcgcgctctgcccagcccagcctacagtgcggataaaggtgcggatgctgctggccctgaa

SEQ ID NO: 1713 - DNA, 2412 bp, Homo sapiens
gggtcatcggttccctggaaggagaaaaagctgccaattgaacggggcctcccggtcccagggatgtcgcgacgcggggacgacgcatctcacgacgtcagcctgaaacacgcgggcctttcatcacccgagactcctccagcccaggagggccccgctctttcgcctgcctcctgggggagagcctctggacgacgcacgcgacagcgttttctccaaaaaaggcagagaagagaagcgtagcagtggccgcaagggcgacgggcggcgaagggtactacgcacgcccgcgtcggccacgcggagagatacgcccgactcgagtcccgcggcgcacgcccctagacgcccgaggtgcgcgggccacgcccctcgcccggccaagagcacgccccttccgtcgcccctcccgggggcgtttaccgttcctccccgccccggaagcgcgttcttacctccttcctcgcgagagttccgtgcaccggcacccagatcgcgcgagacagcggaaggagcaagagtgggaggcgcgcgcggaggccgcgacggacgcaagatggcgacggcgaccatagctctccaggtcaatggccagcaaggaggggggtccgagccggcggcggcggcggcagtggtggcagcgggagacaaatggaaacctccacagggcacagactccatcaagatggagaacgggcagagcacagccgccaagctggggctgcctcccctgacgcccgagcagcaggaggcccttcagaaggccaagaagtacgccatggagcagagcatcaagagtgtgctggtgaagcagaccatcgcgcaccagcagcagcagctcaccaacctgcagatggcagcagtgacaatgggctttggagatcctctctcacctttgcaatcgatggcggctcagcggcagcgggcgctggccatcatgtgccgcgtctacgtgggctctatctactatgagctgggggaggacaccatccgccaggcctttgccccctttggccccatcaagagcatcgacatgtcctgggactccgtcaccatgaagcacaagggctttgccttcgtggagtatgaggtccccgaagctgcacagctggccttggagcagatgaactcggtgatgctggggggcaggaacatcaaggtgggcagacccagcaacatagggcaggcccagcccatcatagaccagttggctgaggaggcacgggccttcaaccgcatctacgtggcctctgtgcaccaggacctctcagacgatgacatcaagagcgtgtttgaggcctttggcaagatcaagtcctgcacactggcccgggaccccacaactggcaagcacaagggctacggcttcattgagtacgagaaggcccagtcgtcccaagatgctgtgtcttccatgaacctctttgacctgggtggccagtacttgcgggtgggcaaggctgtcacaccgcccatgcccctactcacaccagccacgcctggaggcctcccacctgccgctgctgtggcagctgctgcagccactgccaagatcacagctcaggaagcagtggccggagcagcggtgctgggtaccctgggcacacctggactggtgtccccagcactgaccctggcccagcccctgggcactttgccccaggctgtcatggctgcccaggcacctggagtcatcacaggtgtgaccccagcccgtcctcctatcccggtcaccatcccctcggtgggagtggtgaaccccatcctggccagccctccaacgctgggtctcctggagcccaagaaggagaaggaagaagaggagctgtttcccgagtcagagcggccagagatgctgagcgagcaggagcacatgagcatctcgggcagtagcgcccgacacatggtgatgcagaagctgctccgcaagcaggagtctacagtgatggttctgcgcaacatggtggaccccaaggacatcgatgatgacctggaaggggaggtgacagaggagtgtggcaagttcggggccgtgaaccgcgtcatcatctaccaagagaaacaaggcgaggaggaggatgcagaaatcattgtcaagatctttgtggagttttccatagcctctgagactcataaggccatccaggccctcaatggccgctggtttgctggccgcaaggtggtggctgaagtgtacgaccaggagcgttttgataacagtgacctctctgcgtgacagtggtccctctccccggacttgcacttgttccttgtttcctctgggttttatagtgatacagtggtgtccccggggccaggcgcgctctgcccagcccagcctacagtgcggataaaggtgcggatgctgctggccctgaacgtccgtgtgtctgccgtcggtcctgtcaccga

SEQ ID NO: 1714 - DNA, 13937 bp, Homo sapiens
atggcggacggaggagcagcgagtcaagatgagagttcagccgcggcggcagcagcagcagactggaaaagtaagaagagctttcctgcctttttaattaccaaactactctcagttttcaatgaatcagttcaaagaaagaatgcagtctttctatacctgactcaagaatgaacaatccgtcagaaaccagtaaaccatctatggagagtggagatggcaacacaggcacacaaaccaatggtctggactttcagaagcagcctgtgcctgtaggaggagcaatctcaacagcccaggcgcaggctttccttggacatctccatcaggtccaactcgctggaacaagtttacaggctgctgctcagtctttaaatgtacagtctaaatctaatgaagaatcgggggattcgcagcagccaagccagccttcccagcagccttcagtgcaggcagccattccccagacccagcttatgctagctggaggacagataactgggcttactttgacgcctgcccagcaacagttactactccagcaggcacaggcacaggcacagctgctggctgctgcagtgcagcagcactccgccagccagcagcacagtgctgctggagccaccatctccgcctctgctgccacgcccatgacgcagatccccctgtctcagcccatacagatcgcacaggatcttcaacaactgcaacagcttcaacagcagaatctcaacctgcaacagtttgtgttggtgcatccaaccaccaatttgcagccagcgcagtttatcatctcacagacgccccagggccagcagggtctcctgcaagcgcaaaatcttctaacgcaactacctcagcaaagccaagccaacctcctacagtcgcagccaagcatcaccctcacctcccagccagcaaccccaacacgcacaatagcagcaaccccaattcagacacttccacagagccagtcaacaccaaagcgaattgatactcccagcttggaggagcccagtgaccttgaggagcttgagcagtttgccaagaccttcaaacaaagacgaatcaaacttggattcactcagggtgatgttgggctcgctatggggaaactatatggaaatgacttcagccaaactaccatctctcgatttgaagccttgaacctcagctttaagaacatgtgcaagttgaagccacttttagagaagtggctaaatgatgcagagaacctctcatctgattcgtccctctccagcccaagtgccctgaattctccaggaattgagggcttgagccgtaggaggaagaaacgcaccagcatagagaccaacatccgtgtggccttagagaagagtttcttggagaatcaaaagcctacctcggaagagatcactatgattgctgatcagctcaatatggaaaaagaggtgattcgtgtttggttctgtaaccgccgccagaaagaaaaaagaatcaacccaccaagcagtggtgggaccagcagctcacctattaaagcaattttccccagcccaacttcactggtggcgaccacaccaagccttgtgactagcagtgcagcaactaccctcacagtcagccctgtcctccctctgaccagtgctgctgtgacgaatctttcagttacaggcacttcagacaccacctccaacaacacagcaaccgtgatttccacagcgcctccagcttcctcagcagtcacgtccccctctctgagtccctccccttctgcctcagcctccacctccgaggcatccagtgccagtgagaccagcacaacacagaccacctccactcctttgtcctcccctcttgggaccagccaggtgatggtgacagcatcaggtttgcaaacagcagcagctgctgcccttcaaggagctgcacagttgccagcaaatgccagtcttgctgccatggcagctgctgcaggactaaacccaagcctgatggcaccctcacagtttgcggctggaggtgccttactcagtctgaatccagggaccctgagcggtgctctcagcccagctctaatgagcaacagtacactggcaactattcaagctcttgcttctggtggctctcttccaataacatcacttgatgcaactgggaacctggtatttgccaatgcgggaggagcccccaacatcgtgactgcccctctgttcctgaaccctcagaacctctctctgctcaccagcaaccctgttagcttggtctctgccgccgcagcatctgcagggaactctgcacctgtagccagccttcacgccacctccacctctgctgagtccatccagaactctctcttcacagtggcctctgccagcggggctgcgtccaccaccaccaccgcctccaaggcacagtgagctgggcagagctgggctgccagaagcctttttcactctgcagtgtgattggactgccagccaggttaataaactgaaaaatgtgattggcttcctctcgccgtgttgtgagggcaaaggagagaagggagaaaaaaaaaaaaaaaccacacacacccatacacacataccagaaaaagaaagaaaggatggagacggaacatttgcctaattttgtaataaaacactgtcttttcaggattgcttcatggattggagaactttctaaccaaaaattaaaaaaaaaaaaaaaaaaagaaacaaaaaaatcaaaaacaaacaaaaataagtgaaaggactacttatcatttccagcagtcatgatgacaagttaaggtgggttaccaattccaatataggaaggggatttcttgtttgtctaaatttctttttttcttaaaaaaaaaaaatcatttttatgggtctgttgtacaggccattaagtcataacaaggtgtttataatcgtatcaattgtgttgggggttcctttcttaactggtacaatttaggcaggcctgtattactgtattattattgttgttgttgttattgttttatatatatagtttggacatgtttattatctcttgctcctggatcctatttcagtgagctcccacactgtggggagggagggttttggggtaaggggagacttctgttcttaactgtggggaatgttcttgctggtttccttatccttgatgactcttacagaggtgctagaaaattattttcttttgccacttatgcaagaggcttggtgcagaagctgaaggcagtgtgtgcaaacactcccattccacacacgccccttcccctccccacatcaggtggtgcctttggagcacttttgtgtaggaaggaattcctgctgaactgtagctctcactcacccccaaatcattgaatgaccctgaggcccagttcctgtggtgcaacagtgctgctttctgctactttcaatgggaacagctgtacatgttgcagggcaggatttggttcccaagagcaaagactactgcagacacctgacttggtggttctcctgatttcttatctcctgaaaaatgctcctgctgttggtgtgtttgtttgtttgttccattttgtggaagtttttcatccaaactttaactaacttggcaaagaaaaaaaactgacttactgaaattgggaaacttttcccttcttttattttctaaaggaattctactagactattttccattgataatatatacaaaagaggtgtgatgagaagggtataaggttaccaccttttcctctagagagccacagacttcctttccactggatggtttataaattcctctaaccctgagattcttcttggttctctgactaaaggaggcacttattagccgggctgggatctgtagaacctttgaagaaggactttgagcaggaactttgcacacaccttaagtgtctccttggtttgttcatgatgctcctgctaggtaggtctaaatggcaatacacatctctttattcaatgtagaaagtaattagctctgtaattattttcagggtgtttgtagactatataaatgagcccattgaaaaggaagagtttgtgaaagtggatgaagaggaataagggtaacttggagattaaattcctttttttgtcagtgtactgttgttatgccatctgtaccaaaaaattttccaaaagactggatcactgcagtgcagctcatctaagttccccttcttattggagttaaaggttcccatttggtggctgtgggtgcttgcttaaatctctggtggtcccaagactgcactttttctccctttcgagctggggatgtagagagaacttacaggtgatttttattctgattgcttttgtttgtgtccacaagggagcttggattctgtgtacttgtctctttcccattgtccagtaaggcagtaaatacagacacaatgtgtacttttgtgtgtgattcaagtgggagacagtctgttaaaaggtcagaaacattttagtcccctttaaaatatttcttttagtttatttctatcgtgttttatttcacagatatttaattaccacccctaaatttcctcctcttacccttcaccttccctaaaatccttccaaaatcagtgaactgcaagcagggaaactaacaaatgtccattcaccctttttgtgtggtgtgtttttttatgttttgttttgttttttaactaagcttgaaccaaagtcaatttttagcaagctgctgtactaatggactagttgataacgtgcagttcagacacatcgaggagatagatgctactgacaatttctttttcatttgtctttattaattttatatgaaagttgctgcttgtttttaatcttttatgttggtaaattgtgatatcctctgggcagacattaacttgatgtttaactagtttattaggttggtgtgtaaatagaatgacaatgtcaattactaatttctctcctctccattcactttttctctgttgtagttaaatttaatcttctatcctgacttgacatctctacctttagtctgtggaaatgattttagggctatcagtaatgctgtagctgcccataataatgagtccctcccttgggagtggtgaaacttagaaggaaggattcagggagggaaatgctggtacccagtatactggattagaagttatagcattaatttctcaaaattgctaccaaaggaagtgtggagtcccaagggactcaagctcagtgaggtaagacaaagggcaaggaaaggctgtttgggtggtttttttttccccacatatggtttagaaaatgatccctttcccaaacaaaactcaccaacagactttaatattagaaaagatactaagctttaaatgtcaatacagtggtcttttattccctgccctgtctatattttctactcaatttgggataaggggattttatgtgaagcacttgatgagggtagaccagcataaaaaatctgtttaaaagaagaaataatctttaggaaaagataaatctttagataaaaataaatttttttctctttttttacttatttaaaaataagttgtgaaatgaaaggtacatttacacatgtacacacgaaacactaatatagctttttggtggttgtttagtttaaaatcaactccctatccatcatccctagatattctacttatcgtattgcttcatgaacaccttagtcattttttactttacgtatatatttttttatcatctcaagaaatgcattttgaattgaatgaactatcttctaagctaagatactcaaatttaacttttagccaccttatatgggagagcctggaaactaaaggggaccagggaccatttgaccaaaagaggtgtttggtggagtttctgcatttcaaagaagaaaggccagataggtcatcacaattcattgtattattctttttttttccccttaatgtttatgcaaattttattttatatttctgaatttggttagcacatactaagccaaagactattctaaatgcatttatagtgaatactatgtatgcccatggtaatgggtcctccctaaggagtggtgaatgtaattgtgtgaatcctgcttatcacaagtggtgcaatttggtcataaactttatttataccctgtatacatctgaataacagagcagaaagacctaaaaaagggcttctcacaggaacaatattactatgttgttctaagaaaaaataagttgagtgctgtattagtttaagtgtttctaaagttctataggcagcattttagaattaagaattgtgtatatccattaactgatataattcacatgtccttttatttgttatcagaaagatcaatactatcccaatttattcaacttgttacccaagaaatggaaccaaaggaatccaactttcattttgtgtagaatcatacctacttatacttaatgctagcactgtaagaaataagtcttttttgtttaaaaaagggaagataagattaaagattcttagtgagatcatcttgccaatttgttgtacatctctcattcattgttgggggaaaaaaaagcacaactatacctctttaatgttattttcttccattatccctcatttatttggaaagataagggaaaccttgtctgtattatccagaagcacagatatttgcttgacacaatatttaaattcagcccaatctttaacattaaaaaattttctttttaacttgctggaaaagttggatacattggcaaatatagggaattcatgtcttttttttttttttttttctggtcttgctctgttgcctaggctagagtgcaacggcatgatctcggctcactgcaacctctgcctcccgggttcaagcaattctcctgcttcagcctcccaagtagctgggattacaggcgcccaccaccgcacccggctaatttttgtatttttagtagggacgggatttctccgtgttggccaggctttttgaactcctgaccttaggtgatctgcctgccttggcctcccaaagtgctgggattacaggtatgagccactgtgcccatcctcatgtcaatttttaaagtgataaatcctgatattatacattgcaattagtgtagaataaacgcttggcttatagaactctctgttcttagtctaaagctgttcccaaaccaggtcatcctcacgaaacattcttgaccaagaaaaaagataaggtcattgagataggaagacagaggaaaagcctcttgctgttgtttcttcccaagaaaggagaagccctgccagggagaagtcagtagtattgctgactcactgtatcactgagtgtagggtgtggtagcaaggaggaggcaggggattcacgctgacaggtggctctggcctggctcttggggggccttctgaagaccagtctgcagtttgaggaagggccccaacaattcatttggagagcttggccaaatactttctcattaaatcagcacctaaacttgatgaacttaaagtttgtttattagagttgaaaacattaaaagatgactgatactaatgggagaaaaatactaaagacccaaaatttaaaattttccaaaatggacaagaattgatgggttaatttgctcataactgatatgagtttgcttttatgtgtgtgtggaaagcatttaatgtgtgatgctgttcatagtcctggctatttgatgtcattttcagttttacaacattttgaggatgacactttataaaatggtaaatctttctcagcgtttacaaacttggcttttgagaagggaaaaatcctctttgctatttctgtaagaagaataactgagatcagctattatataggtttgcatggatggtgtccacaatacaaatgtaaacttggacaggaataggataaataaattgctttcatcataaaggccaatcatccatttcttagtccaaggagattaaatataaataggacacccctgagatttccagtaaggtatttgaaaggattccactgggagggcagggaatatattttttctcagagcatccagtttgtacccagttttctatatggtttgtgaactgtagcttttaaaaaaaaattttgtagttttcttctaaccttattcattaagtagttccttgttttggcccttctactcttggccttagctaaaagcagtaaatgtgagtgaattttatgttgattatgtcacctggatctcctttccttcccttctttttctcattgaatggtggtaccttaatttgggtaacagctagcttctggcaccttcataaaatacctcagaatagcttagcattgttgcaaaactggttttaaactaaaaaccaaataaataagtgaaaaaattttataaatagtggaaataattctagctgtagcatttagttgaactaatgtttattatgatcgataaacaagattgatgctgtatgtatttgggatcctgtttataggttacaatttatagggttagggagggttgggtgggggaagaggagatgttgattatgttagaaggaaaacattgctcgtgtgtgtgtttgttttttcttatatctgtcttgccaaaggaaacttgattttccctgtgattggctttggcctctgtggtctggtctgcagcagtgtgtggtggcatgcaggtaacatatggggtgtccagtaggttcagggaccctgagggtgcatttacatcccttcctatggttgcccatgccccccagaccctgccaacctctcctaatgattcattacctctgtacatagcaaaagcataggcaaaggatgaatgcgtgaatgcctggatgtgcagttgagaaacagaggcagacatagacatgcaccaattaatttggagccaagaggtgagtgattgatgtatcttaaatctaggaaagttaaagtgaaacaggttctttgtgttgccctctgtcaagttactgaatgttgtgctaataacacaacactttaaaaccttacttacttttctcataccaaggctagttctttctagaccaaaaacacaaacaggataaaaagcaaaccaagaagttgaaagctaacctgcccacctcacccctgtgatacaaagtgtgaaccttaaggattagttggtgggattgaggagagaattattcttggtgggaacatgaatgagaaatgatgctggcttaggaaaaatcacaagccctttctgcccatactctgggacaaactttcttggctccctgagttcggatatagactgtatctctagaaaggctatttttttaaataaatgatcccacagaacttaagtgggatttggtttagataccaaagacactgctaatgtcattgcttatccttaagttttcaaaacaggcagagggaataggagcaaaaagccaaaatttggaaaagctttactttatctctttccttcccttttccccttttcccagtcccctgctttttgaaggaagtcttcttggttatcctggctttggaaaagagatttattttgttttgctctgctggctctttaaagatggatagttgctcaatctagcagtgatgttcttggaattgctgagaaatttggggagggcaaaagataggggtagaattttttcattatttccctttatctaatacttttaaatagaaccaacacagcctatatgagttcagacaatatttagatgtggtatctccatctgtctcctgtaaaagataagaattttcaagaacaggattacgtggaaaaccaaaagatcttcccttactctcctataaatgttttgttccaaatgtttttatatatgggctctagggagtcaggtagttcattgtttcggtgtactattgataggacacagaaagggagagagggtaaagaaatgtatcactctctgaatattgcatcaaaaatgattaggttgcagaacttcatgaaagctttactaataatcttattgttctgacattatgtaaaggtggtattaatattgtatgacttgtcaaagtgctagataggtttataagtaggtaatagggatgttgaagattagagcacttgaaacagaagttctgggaaaacaaggtgtgtgtaatggaacaccactttgagcacagaaacaaaggtcccttggacctggtagggaagatgtgatttatgattgtttctgtgtccctgtatctgcccaccctgcacagggctccaccacccagggccaccttctggtttaaacccaggacactgtcaaaaagttaagaccccaaaactaatttactgtaaaaaacattgaggactgctgcaaagttttcccttgttttctttgtgtacttgttcatcattgtataagttagccacagcttcacaagagcagcttaaggcttctttcataaattggcagtggcattgagttctcaaacattatatcccaaagtctgcaggcagacagctggatacagcgctgtgtataaatgagacgtccaaacacttgagtttcttaagattgggatctctttcaaatgaaaaaggacagagccaagtagagaaaagactttgtgctcccacccagccttaatgagtctcatggtctaaaagtataggaagaaatgaaatgcactttcagaagctaaaatgacagtgtctgctacaaaaggctgtagttgtaggcagtcggggatgccatgtccttggttccattcctgcgtgagtctgcagaaggcacacactttgtaagagtagagtggactagtgccagcctgaataggtttaaaactgcaaacagttggagaacatggaacaggttggtgcaggaagcctaagattttgcaatcatattataacattggcttttgacaacataaatgttgtatcttccctaaggtcaggtcggggaaagaaagacttccagcttcttacctctgcgtgcatgggcacgtgtgcattgctcagtccgcaggaggtctcactccgcaggaaacgctctcctcccgcataagtctgtacttccatcccctcatctgtggtagtagtgaaggctaggtgagtaagcgtgggctgttctacccaccagaagtccaggagctgttgtatacctcatttctaactcgtgaccgagtgacttgctttaactttctcgaaatcctacagagttgccaagtctgccctccctcctcagtcatgttaaactctggcctatagcatcatgggacctgtagcctagggtgggaccccctaaagcctctgaatgtcgctgcttaaaagctactgcaaactgagggcaaattgcaatcttctattcctttttgttgcaaggggtcttcacaggtctcttaacatctgctttccctgccaccctgcctttaggggctggccagctatccacacccctaacccaccctgtgtttctgacagctggccacacgtcaacttctgtacttgccttttccttggtggggtagaggccaaccccttctcctctgaggcctcagggttctgtttcttttcaggactttgggtagaagggaagacaccaaaggctcctttaagctgactgctgcatacacatttcactttttttcctttgacatgaccaaaaatatccaaatatttaagtttattattattattattattatttgacaatcttatatccaatgggctctctagaagctgcatccccagccctttcaccttttctttgaatgtagttcccaaccttcaattcccacccctaatgctgacaaaaagcttagccaggtcatgatactgctgctataagccaggggagggtggtttctttgttttgttttgttttgttttgtttttcaaatttccagccaaaaccaaagatttcttaatgattgtataaactcaaaacaaacaaaagaaccaaagaaaagggaagtcttcagcatcagtccagtctgtggtgtcctggcacttagaagagtgaggccagggaaggtggggcggggggaccctctgactggatcagaaagggcaggcaagctgcttaccaccttccagggtccagcacaggtgcatgcccctagctttggccctcacaaacttgtgagcatgccctgaaacaaattggcatttcagattttccaaaacaaaagtcaaaaaaccccatcaccaccatcatccaccctacaccaaccagggtcactatggggacttagcacagggcctagggagggtgggagctgctgctggactggcccgaggactccacagagtgggggacgttgaagacactggcgcacgattggctgctctgctgggtgctttaacctctggggctgggcgaatgcacgccacggtgcccttctgagcctttttttcttttcctgtactggaactgcttggaagtggctgtcctgtttgtgagaaaacatgcagaaagattatcaagcttttcatttctctttattgtagttttctttcctttttgcagcaccactgtgcaactatgcattgtacttcacaaccttttgtgctaggtagatgcctgtgactttttaacttggggggtggggggattgcaaatgaaggaactttttacatggatctttttaatctcagttggttgggggaggggggtacttggttcttgggtcacacaagctctatcccaaagcaaaatccaaatgttaataatattagcctgatgcagataccaaagataatttctttcctgcagaaccttagactcgtgtattaagtacgattacccagcacttgcattagtctaacctcagtaattccaaagcttagatgtatattttggtatatttctgggatattaaaaaaaaaatgtcgtttaacttcttgtttgtttcagtgtaatgctcttaaagtcatagcatgaaaataattgaactgtcctattcttagtagtttgaaataatagtatttttgtatgttttgggtgtgtctatgtatgtattaacataacagttttcactgcctaggtgttcataataaaaaagaaaatgaaaaaagttctgagtgtacataatattcaataataatctcccaccaggtgtcaatttagattgcatattcctcattactgttcccaactgggattttgttttcttttaaagagacagtgatcgtgtttttctaaagatgttttctttctctctttcaatatcttaactcactttttttttcttccttttttgtcttaattattaattcaggggtgtttgtccactgttgtcaaaggaggggcacaaggggaattggcccccggcctcctagaactttttgttttatgtactttaaaatgtgagtttgagttcttctttgtggaaacttaagatgtggtgtaaatgattctttccaaaattgtccagcagcttgaatgaggcagtgacaattctgaggtggtttattgggagtccttctacatttctcttagataactctgcactctgggtggctattgtgtagccttactgccccagagtgcctgttagccaaatatttcccctctgataggaatattttctaagaatcagctgataacttgcgtgctggaccttgttatctgtgcccctgggagacacacgttttcttggttttgaaaacctgaaacacaggcaactttacattttggggaattagctgatgcctcctgaagcctgaggaggtggcggggaatatgagcggtgctgtctctctcaaaagtgccctttagatgattccccctcctagggctgcctgcaggggctgtaggcttgggaaagattgtgtaggtgacagtgaatcagaatgaagtggtagattttgtgtagatgcatttgtctgctgtaattttttatatatatattaaacttactgtaactgtacagttcatttctgttgtaaaacatcattaaaccatcttccaagtgttttcacattg

SEQ ID NO: 1715 - DNA, 14038 bp, Homo sapiens
aaactcctctgagcaactgaagtttccttattcagttgaagattgctatggtgtaacagaagttgtattttgcttttccccttaatccactttccaccctacgcaacccccctcttttcgcttaagaacatactgtagatttgttagaaatagtagtaccttctttccccaccccaaactgctacctgtttcttccttgtttggactctctgctcctctagaagatttcacagcaatgctggactgcagtgactatgttctagactcaagaatgaacaatccgtcagaaaccagtaaaccatctatggagagtggagatggcaacacaggcacacaaaccaatggtctggactttcagaagcagcctgtgcctgtaggaggagcaatctcaacagcccaggcgcaggctttccttggacatctccatcaggtccaactcgctggaacaagtttacaggctgctgctcagtctttaaatgtacagtctaaatctaatgaagaatcgggggattcgcagcagccaagccagccttcccagcagccttcagtgcaggcagccattccccagacccagcttatgctagctggaggacagataactgggcttactttgacgcctgcccagcaacagttactactccagcaggcacaggcacaggcacagctgctggctgctgcagtgcagcagcactccgccagccagcagcacagtgctgctggagccaccatctccgcctctgctgccacgcccatgacgcagatccccctgtctcagcccatacagatcgcacaggatcttcaacaactgcaacagcttcaacagcagaatctcaacctgcaacagtttgtgttggtgcatccaaccaccaatttgcagccagcgcagtttatcatctcacagacgccccagggccagcagggtctcctgcaagcgcaaaatcttctaacgcaactacctcagcaaagccaagccaacctcctacagtcgcagccaagcatcaccctcacctcccagccagcaaccccaacacgcacaatagcagcaaccccaattcagacacttccacagagccagtcaacaccaaagcgaattgatactcccagcttggaggagcccagtgaccttgaggagcttgagcagtttgccaagaccttcaaacaaagacgaatcaaacttggattcactcagggtgatgttgggctcgctatggggaaactatatggaaatgacttcagccaaactaccatctctcgatttgaagccttgaacctcagctttaagaacatgtgcaagttgaagccacttttagagaagtggctaaatgatgcagagaacctctcatctgattcgtccctctccagcccaagtgccctgaattctccaggaattgagggcttgagccgtaggaggaagaaacgcaccagcatagagaccaacatccgtgtggccttagagaagagtttcttggagaatcaaaagcctacctcggaagagatcactatgattgctgatcagctcaatatggaaaaagaggtgattcgtgtttggttctgtaaccgccgccagaaagaaaaaagaatcaacccaccaagcagtggtgggaccagcagctcacctattaaagcaattttccccagcccaacttcactggtggcgaccacaccaagccttgtgactagcagtgcagcaactaccctcacagtcagccctgtcctccctctgaccagtgctgctgtgacgaatctttcagttacaggcacttcagacaccacctccaacaacacagcaaccgtgatttccacagcgcctccagcttcctcagcagtcacgtccccctctctgagtccctccccttctgcctcagcctccacctccgaggcatccagtgccagtgagaccagcacaacacagaccacctccactcctttgtcctcccctcttgggaccagccaggtgatggtgacagcatcaggtttgcaaacagcagcagctgctgcccttcaaggagctgcacagttgccagcaaatgccagtcttgctgccatggcagctgctgcaggactaaacccaagcctgatggcaccctcacagtttgcggctggaggtgccttactcagtctgaatccagggaccctgagcggtgctctcagcccagctctaatgagcaacagtacactggcaactattcaagctcttgcttctggtggctctcttccaataacatcacttgatgcaactgggaacctggtatttgccaatgcgggaggagcccccaacatcgtgactgcccctctgttcctgaaccctcagaacctctctctgctcaccagcaaccctgttagcttggtctctgccgccgcagcatctgcagggaactctgcacctgtagccagccttcacgccacctccacctctgctgagtccatccagaactctctcttcacagtggcctctgccagcggggctgcgtccaccaccaccaccgcctccaaggcacagtgagctgggcagagctgggctgccagaagcctttttcactctgcagtgtgattggactgccagccaggttaataaactgaaaaatgtgattggcttcctctcgccgtgttgtgagggcaaaggagagaagggagaaaaaaaaaaaaaaaccacacacacccatacacacataccagaaaaagaaagaaaggatggagacggaacatttgcctaattttgtaataaaacactgtcttttcaggattgcttcatggattggagaactttctaaccaaaaattaaaaaaaaaaaaaaaaaaagaaacaaaaaaatcaaaaacaaacaaaaataagtgaaaggactacttatcatttccagcagtcatgatgacaagttaaggtgggttaccaattccaatataggaaggggatttcttgtttgtctaaatttctttttttcttaaaaaaaaaaaatcatttttatgggtctgttgtacaggccattaagtcataacaaggtgtttataatcgtatcaattgtgttgggggttcctttcttaactggtacaatttaggcaggcctgtattactgtattattattgttgttgttgttattgttttatatatatagtttggacatgtttattatctcttgctcctggatcctatttcagtgagctcccacactgtggggagggagggttttggggtaaggggagacttctgttcttaactgtggggaatgttcttgctggtttccttatccttgatgactcttacagaggtgctagaaaattattttcttttgccacttatgcaagaggcttggtgcagaagctgaaggcagtgtgtgcaaacactcccattccacacacgccccttcccctccccacatcaggtggtgcctttggagcacttttgtgtaggaaggaattcctgctgaactgtagctctcactcacccccaaatcattgaatgaccctgaggcccagttcctgtggtgcaacagtgctgctttctgctactttcaatgggaacagctgtacatgttgcagggcaggatttggttcccaagagcaaagactactgcagacacctgacttggtggttctcctgatttcttatctcctgaaaaatgctcctgctgttggtgtgtttgtttgtttgttccattttgtggaagtttttcatccaaactttaactaacttggcaaagaaaaaaaactgacttactgaaattgggaaacttttcccttcttttattttctaaaggaattctactagactattttccattgataatatatacaaaagaggtgtgatgagaagggtataaggttaccaccttttcctctagagagccacagacttcctttccactggatggtttataaattcctctaaccctgagattcttcttggttctctgactaaaggaggcacttattagccgggctgggatctgtagaacctttgaagaaggactttgagcaggaactttgcacacaccttaagtgtctccttggtttgttcatgatgctcctgctaggtaggtctaaatggcaatacacatctctttattcaatgtagaaagtaattagctctgtaattattttcagggtgtttgtagactatataaatgagcccattgaaaaggaagagtttgtgaaagtggatgaagaggaataagggtaacttggagattaaattcctttttttgtcagtgtactgttgttatgccatctgtaccaaaaaattttccaaaagactggatcactgcagtgcagctcatctaagttccccttcttattggagttaaaggttcccatttggtggctgtgggtgcttgcttaaatctctggtggtcccaagactgcactttttctccctttcgagctggggatgtagagagaacttacaggtgatttttattctgattgcttttgtttgtgtccacaagggagcttggattctgtgtacttgtctctttcccattgtccagtaaggcagtaaatacagacacaatgtgtacttttgtgtgtgattcaagtgggagacagtctgttaaaaggtcagaaacattttagtcccctttaaaatatttcttttagtttatttctatcgtgttttatttcacagatatttaattaccacccctaaatttcctcctcttacccttcaccttccctaaaatccttccaaaatcagtgaactgcaagcagggaaactaacaaatgtccattcaccctttttgtgtggtgtgtttttttatgttttgttttgttttttaactaagcttgaaccaaagtcaatttttagcaagctgctgtactaatggactagttgataacgtgcagttcagacacatcgaggagatagatgctactgacaatttctttttcatttgtctttattaattttatatgaaagttgctgcttgtttttaatcttttatgttggtaaattgtgatatcctctgggcagacattaacttgatgtttaactagtttattaggttggtgtgtaaatagaatgacaatgtcaattactaatttctctcctctccattcactttttctctgttgtagttaaatttaatcttctatcctgacttgacatctctacctttagtctgtggaaatgattttagggctatcagtaatgctgtagctgcccataataatgagtccctcccttgggagtggtgaaacttagaaggaaggattcagggagggaaatgctggtacccagtatactggattagaagttatagcattaatttctcaaaattgctaccaaaggaagtgtggagtcccaagggactcaagctcagtgaggtaagacaaagggcaaggaaaggctgtttgggtggtttttttttccccacatatggtttagaaaatgatccctttcccaaacaaaactcaccaacagactttaatattagaaaagatactaagctttaaatgtcaatacagtggtcttttattccctgccctgtctatattttctactcaatttgggataaggggattttatgtgaagcacttgatgagggtagaccagcataaaaaatctgtttaaaagaagaaataatctttaggaaaagataaatctttagataaaaataaatttttttctctttttttacttatttaaaaataagttgtgaaatgaaaggtacatttacacatgtacacacgaaacactaatatagctttttggtggttgtttagtttaaaatcaactccctatccatcatccctagatattctacttatcgtattgcttcatgaacaccttagtcattttttactttacgtatatatttttttatcatctcaagaaatgcattttgaattgaatgaactatcttctaagctaagatactcaaatttaacttttagccaccttatatgggagagcctggaaactaaaggggaccagggaccatttgaccaaaagaggtgtttggtggagtttctgcatttcaaagaagaaaggccagataggtcatcacaattcattgtattattctttttttttccccttaatgtttatgcaaattttattttatatttctgaatttggttagcacatactaagccaaagactattctaaatgcatttatagtgaatactatgtatgcccatggtaatgggtcctccctaaggagtggtgaatgtaattgtgtgaatcctgcttatcacaagtggtgcaatttggtcataaactttatttataccctgtatacatctgaataacagagcagaaagacctaaaaaagggcttctcacaggaacaatattactatgttgttctaagaaaaaataagttgagtgctgtattagtttaagtgtttctaaagttctataggcagcattttagaattaagaattgtgtatatccattaactgatataattcacatgtccttttatttgttatcagaaagatcaatactatcccaatttattcaacttgttacccaagaaatggaaccaaaggaatccaactttcattttgtgtagaatcatacctacttatacttaatgctagcactgtaagaaataagtcttttttgtttaaaaaagggaagataagattaaagattcttagtgagatcatcttgccaatttgttgtacatctctcattcattgttgggggaaaaaaaagcacaactatacctctttaatgttattttcttccattatccctcatttatttggaaagataagggaaaccttgtctgtattatccagaagcacagatatttgcttgacacaatatttaaattcagcccaatctttaacattaaaaaattttctttttaacttgctggaaaagttggatacattggcaaatatagggaattcatgtcttttttttttttttttttctggtcttgctctgttgcctaggctagagtgcaacggcatgatctcggctcactgcaacctctgcctcccgggttcaagcaattctcctgcttcagcctcccaagtagctgggattacaggcgcccaccaccgcacccggctaatttttgtatttttagtagggacgggatttctccgtgttggccaggctttttgaactcctgaccttaggtgatctgcctgccttggcctcccaaagtgctgggattacaggtatgagccactgtgcccatcctcatgtcaatttttaaagtgataaatcctgatattatacattgcaattagtgtagaataaacgcttggcttatagaactctctgttcttagtctaaagctgttcccaaaccaggtcatcctcacgaaacattcttgaccaagaaaaaagataaggtcattgagataggaagacagaggaaaagcctcttgctgttgtttcttcccaagaaaggagaagccctgccagggagaagtcagtagtattgctgactcactgtatcactgagtgtagggtgtggtagcaaggaggaggcaggggattcacgctgacaggtggctctggcctggctcttggggggccttctgaagaccagtctgcagtttgaggaagggccccaacaattcatttggagagcttggccaaatactttctcattaaatcagcacctaaacttgatgaacttaaagtttgtttattagagttgaaaacattaaaagatgactgatactaatgggagaaaaatactaaagacccaaaatttaaaattttccaaaatggacaagaattgatgggttaatttgctcataactgatatgagtttgcttttatgtgtgtgtggaaagcatttaatgtgtgatgctgttcatagtcctggctatttgatgtcattttcagttttacaacattttgaggatgacactttataaaatggtaaatctttctcagcgtttacaaacttggcttttgagaagggaaaaatcctctttgctatttctgtaagaagaataactgagatcagctattatataggtttgcatggatggtgtccacaatacaaatgtaaacttggacaggaataggataaataaattgctttcatcataaaggccaatcatccatttcttagtccaaggagattaaatataaataggacacccctgagatttccagtaaggtatttgaaaggattccactgggagggcagggaatatattttttctcagagcatccagtttgtacccagttttctatatggtttgtgaactgtagcttttaaaaaaaaattttgtagttttcttctaaccttattcattaagtagttccttgttttggcccttctactcttggccttagctaaaagcagtaaatgtgagtgaattttatgttgattatgtcacctggatctcctttccttcccttctttttctcattgaatggtggtaccttaatttgggtaacagctagcttctggcaccttcataaaatacctcagaatagcttagcattgttgcaaaactggttttaaactaaaaaccaaataaataagtgaaaaaattttataaatagtggaaataattctagctgtagcatttagttgaactaatgtttattatgatcgataaacaagattgatgctgtatgtatttgggatcctgtttataggttacaatttatagggttagggagggttgggtgggggaagaggagatgttgattatgttagaaggaaaacattgctcgtgtgtgtgtttgttttttcttatatctgtcttgccaaaggaaacttgattttccctgtgattggctttggcctctgtggtctggtctgcagcagtgtgtggtggcatgcaggtaacatatggggtgtccagtaggttcagggaccctgagggtgcatttacatcccttcctatggttgcccatgccccccagaccctgccaacctctcctaatgattcattacctctgtacatagcaaaagcataggcaaaggatgaatgcgtgaatgcctggatgtgcagttgagaaacagaggcagacatagacatgcaccaattaatttggagccaagaggtgagtgattgatgtatcttaaatctaggaaagttaaagtgaaacaggttctttgtgttgccctctgtcaagttactgaatgttgtgctaataacacaacactttaaaaccttacttacttttctcataccaaggctagttctttctagaccaaaaacacaaacaggataaaaagcaaaccaagaagttgaaagctaacctgcccacctcacccctgtgatacaaagtgtgaaccttaaggattagttggtgggattgaggagagaattattcttggtgggaacatgaatgagaaatgatgctggcttaggaaaaatcacaagccctttctgcccatactctgggacaaactttcttggctccctgagttcggatatagactgtatctctagaaaggctatttttttaaataaatgatcccacagaacttaagtgggatttggtttagataccaaagacactgctaatgtcattgcttatccttaagttttcaaaacaggcagagggaataggagcaaaaagccaaaatttggaaaagctttactttatctctttccttcccttttccccttttcccagtcccctgctttttgaaggaagtcttcttggttatcctggctttggaaaagagatttattttgttttgctctgctggctctttaaagatggatagttgctcaatctagcagtgatgttcttggaattgctgagaaatttggggagggcaaaagataggggtagaattttttcattatttccctttatctaatacttttaaatagaaccaacacagcctatatgagttcagacaatatttagatgtggtatctccatctgtctcctgtaaaagataagaattttcaagaacaggattacgtggaaaaccaaaagatcttcccttactctcctataaatgttttgttccaaatgtttttatatatgggctctagggagtcaggtagttcattgtttcggtgtactattgataggacacagaaagggagagagggtaaagaaatgtatcactctctgaatattgcatcaaaaatgattaggttgcagaacttcatgaaagctttactaataatcttattgttctgacattatgtaaaggtggtattaatattgtatgacttgtcaaagtgctagataggtttataagtaggtaatagggatgttgaagattagagcacttgaaacagaagttctgggaaaacaaggtgtgtgtaatggaacaccactttgagcacagaaacaaaggtcccttggacctggtagggaagatgtgatttatgattgtttctgtgtccctgtatctgcccaccctgcacagggctccaccacccagggccaccttctggtttaaacccaggacactgtcaaaaagttaagaccccaaaactaatttactgtaaaaaacattgaggactgctgcaaagttttcccttgttttctttgtgtacttgttcatcattgtataagttagccacagcttcacaagagcagcttaaggcttctttcataaattggcagtggcattgagttctcaaacattatatcccaaagtctgcaggcagacagctggatacagcgctgtgtataaatgagacgtccaaacacttgagtttcttaagattgggatctctttcaaatgaaaaaggacagagccaagtagagaaaagactttgtgctcccacccagccttaatgagtctcatggtctaaaagtataggaagaaatgaaatgcactttcagaagctaaaatgacagtgtctgctacaaaaggctgtagttgtaggcagtcggggatgccatgtccttggttccattcctgcgtgagtctgcagaaggcacacactttgtaagagtagagtggactagtgccagcctgaataggtttaaaactgcaaacagttggagaacatggaacaggttggtgcaggaagcctaagattttgcaatcatattataacattggcttttgacaacataaatgttgtatcttccctaaggtcaggtcggggaaagaaagacttccagcttcttacctctgcgtgcatgggcacgtgtgcattgctcagtccgcaggaggtctcactccgcaggaaacgctctcctcccgcataagtctgtacttccatcccctcatctgtggtagtagtgaaggctaggtgagtaagcgtgggctgttctacccaccagaagtccaggagctgttgtatacctcatttctaactcgtgaccgagtgacttgctttaactttctcgaaatcctacagagttgccaagtctgccctccctcctcagtcatgttaaactctggcctatagcatcatgggacctgtagcctagggtgggaccccctaaagcctctgaatgtcgctgcttaaaagctactgcaaactgagggcaaattgcaatcttctattcctttttgttgcaaggggtcttcacaggtctcttaacatctgctttccctgccaccctgcctttaggggctggccagctatccacacccctaacccaccctgtgtttctgacagctggccacacgtcaacttctgtacttgccttttccttggtggggtagaggccaaccccttctcctctgaggcctcagggttctgtttcttttcaggactttgggtagaagggaagacaccaaaggctcctttaagctgactgctgcatacacatttcactttttttcctttgacatgaccaaaaatatccaaatatttaagtttattattattattattattatttgacaatcttatatccaatgggctctctagaagctgcatccccagccctttcaccttttctttgaatgtagttcccaaccttcaattcccacccctaatgctgacaaaaagcttagccaggtcatgatactgctgctataagccaggggagggtggtttctttgttttgttttgttttgttttgtttttcaaatttccagccaaaaccaaagatttcttaatgattgtataaactcaaaacaaacaaaagaaccaaagaaaagggaagtcttcagcatcagtccagtctgtggtgtcctggcacttagaagagtgaggccagggaaggtggggcggggggaccctctgactggatcagaaagggcaggcaagctgcttaccaccttccagggtccagcacaggtgcatgcccctagctttggccctcacaaacttgtgagcatgccctgaaacaaattggcatttcagattttccaaaacaaaagtcaaaaaaccccatcaccaccatcatccaccctacaccaaccagggtcactatggggacttagcacagggcctagggagggtgggagctgctgctggactggcccgaggactccacagagtgggggacgttgaagacactggcgcacgattggctgctctgctgggtgctttaacctctggggctgggcgaatgcacgccacggtgcccttctgagcctttttttcttttcctgtactggaactgcttggaagtggctgtcctgtttgtgagaaaacatgcagaaagattatcaagcttttcatttctctttattgtagttttctttcctttttgcagcaccactgtgcaactatgcattgtacttcacaaccttttgtgctaggtagatgcctgtgactttttaacttggggggtggggggattgcaaatgaaggaactttttacatggatctttttaatctcagttggttgggggaggggggtacttggttcttgggtcacacaagctctatcccaaagcaaaatccaaatgttaataatattagcctgatgcagataccaaagataatttctttcctgcagaaccttagactcgtgtattaagtacgattacccagcacttgcattagtctaacctcagtaattccaaagcttagatgtatattttggtatatttctgggatattaaaaaaaaaatgtcgtttaacttcttgtttgtttcagtgtaatgctcttaaagtcatagcatgaaaataattgaactgtcctattcttagtagtttgaaataatagtatttttgtatgttttgggtgtgtctatgtatgtattaacataacagttttcactgcctaggtgttcataataaaaaagaaaatgaaaaaagttctgagtgtacataatattcaataataatctcccaccaggtgtcaatttagattgcatattcctcattactgttcccaactgggattttgttttcttttaaagagacagtgatcgtgtttttctaaagatgttttctttctctctttcaatatcttaactcactttttttttcttccttttttgtcttaattattaattcaggggtgtttgtccactgttgtcaaaggaggggcacaaggggaattggcccccggcctcctagaactttttgttttatgtactttaaaatgtgagtttgagttcttctttgtggaaacttaagatgtggtgtaaatgattctttccaaaattgtccagcagcttgaatgaggcagtgacaattctgaggtggtttattgggagtccttctacatttctcttagataactctgcactctgggtggctattgtgtagccttactgccccagagtgcctgttagccaaatatttcccctctgataggaatattttctaagaatcagctgataacttgcgtgctggaccttgttatctgtgcccctgggagacacacgttttcttggttttgaaaacctgaaacacaggcaactttacattttggggaattagctgatgcctcctgaagcctgaggaggtggcggggaatatgagcggtgctgtctctctcaaaagtgccctttagatgattccccctcctagggctgcctgcaggggctgtaggcttgggaaagattgtgtaggtgacagtgaatcagaatgaagtggtagattttgtgtagatgcatttgtctgctgtaattttttatatatatattaaacttactgtaactgtacagttcatttctgttgtaaaacatcattaaaccatcttccaagtgttttcacattg

SEQ ID NO: 1716 - DNA, 14332 bp, Homo sapiens
aaaatggcggacggaggagcagcgagtcaagatgagagttcagccgcggcggcagcagcagcagctactactgggctgtaaacagtgatgccagcaaaatgttacttcagctgatgaagtgatgctgtttcgagaatttgaaagcaatttttcagtggataaagaagttgacagcacgatttgttggatgtgatgaaggattaatgagcatacaccttcacttgtattagcttaagatggaatggttctgggcaatataaaataacagactcaagaatgaacaatccgtcagaaaccagtaaaccatctatggagagtggagatggcaacacagcatggacccttttatgatatgggcactgaaactaaagcacatggtggaagaaggattggtagcatatagaaacatttttagacaaatgaaaaagcaaaaaagtcagaaattacagtgtatttccataaagttacaccaagtgtgcctgcctctcctgcctccccttccagctttttgtcttctgccatttctgagtcagcaagacccctcctgttcctccttctcagcctactcagcatgaagacaaggatgaagatctttgtgatgatccacttccacttaatgaatagcacacaaaccaatggtctggactttcagaagcagcctgtgcctgtaggaggagcaatctcaacagcccaggcgcaggctttccttggacatctccatcaggtccaactcgctggaacaagtttacaggctgctgctcagtctttaaatgtacagtctaaatctaatgaagaatcgggggattcgcagcagccaagccagccttcccagcagccttcagtgcaggcagccattccccagacccagcttatgctagctggaggacagataactgggcttactttgacgcctgcccagcaacagttactactccagcaggcacaggcacaggcacagctgctggctgctgcagtgcagcagcactccgccagccagcagcacagtgctgctggagccaccatctccgcctctgctgccacgcccatgacgcagatccccctgtctcagcccatacagatcgcacaggatcttcaacaactgcaacagcttcaacagcagaatctcaacctgcaacagtttgtgttggtgcatccaaccaccaatttgcagccagcgcagtttatcatctcacagacgccccagggccagcagggtctcctgcaagcgcaaaatcttctaacgcaactacctcagcaaagccaagccaacctcctacagtcgcagccaagcatcaccctcacctcccagccagcaaccccaacacgcacaatagcagcaaccccaattcagacacttccacagagccagtcaacaccaaagcgaattgatactcccagcttggaggagcccagtgaccttgaggagcttgagcagtttgccaagaccttcaaacaaagacgaatcaaacttggattcactcagggtgatgttgggctcgctatggggaaactatatggaaatgacttcagccaaactaccatctctcgatttgaagccttgaacctcagctttaagaacatgtgcaagttgaagccacttttagagaagtggctaaatgatgcagagaacctctcatctgattcgtccctctccagcccaagtgccctgaattctccaggaattgagggcttgagccgtaggaggaagaaacgcaccagcatagagaccaacatccgtgtggccttagagaagagtttcttggagaatcaaaagcctacctcggaagagatcactatgattgctgatcagctcaatatggaaaaagaggtgattcgtgtttggttctgtaaccgccgccagaaagaaaaaagaatcaacccaccaagcagtggtgggaccagcagctcacctattaaagcaattttccccagcccaacttcactggtggcgaccacaccaagccttgtgactagcagtgcagcaactaccctcacagtcagccctgtcctccctctgaccagtgctgctgtgacgaatctttcagttacaggcacttcagacaccacctccaacaacacagcaaccgtgatttccacagcgcctccagcttcctcagcagtcacgtccccctctctgagtccctccccttctgcctcagcctccacctccgaggcatccagtgccagtgagaccagcacaacacagaccacctccactcctttgtcctcccctcttgggaccagccaggtgatggtgacagcatcaggtttgcaaacagcagcagctgctgcccttcaaggagctgcacagttgccagcaaatgccagtcttgctgccatggcagctgctgcaggactaaacccaagcctgatggcaccctcacagtttgcggctggaggtgccttactcagtctgaatccagggaccctgagcggtgctctcagcccagctctaatgagcaacagtacactggcaactattcaagctcttgcttctggtggctctcttccaataacatcacttgatgcaactgggaacctggtatttgccaatgcgggaggagcccccaacatcgtgactgcccctctgttcctgaaccctcagaacctctctctgctcaccagcaaccctgttagcttggtctctgccgccgcagcatctgcagggaactctgcacctgtagccagccttcacgccacctccacctctgctgagtccatccagaactctctcttcacagtggcctctgccagcggggctgcgtccaccaccaccaccgcctccaaggcacagtgagctgggcagagctgggctgccagaagcctttttcactctgcagtgtgattggactgccagccaggttaataaactgaaaaatgtgattggcttcctctcgccgtgttgtgagggcaaaggagagaagggagaaaaaaaaaaaaaaaccacacacacccatacacacataccagaaaaagaaagaaaggatggagacggaacatttgcctaattttgtaataaaacactgtcttttcaggattgcttcatggattggagaactttctaaccaaaaattaaaaaaaaaaaaaaaaaaagaaacaaaaaaatcaaaaacaaacaaaaataagtgaaaggactacttatcatttccagcagtcatgatgacaagttaaggtgggttaccaattccaatataggaaggggatttcttgtttgtctaaatttctttttttcttaaaaaaaaaaaatcatttttatgggtctgttgtacaggccattaagtcataacaaggtgtttataatcgtatcaattgtgttgggggttcctttcttaactggtacaatttaggcaggcctgtattactgtattattattgttgttgttgttattgttttatatatatagtttggacatgtttattatctcttgctcctggatcctatttcagtgagctcccacactgtggggagggagggttttggggtaaggggagacttctgttcttaactgtggggaatgttcttgctggtttccttatccttgatgactcttacagaggtgctagaaaattattttcttttgccacttatgcaagaggcttggtgcagaagctgaaggcagtgtgtgcaaacactcccattccacacacgccccttcccctccccacatcaggtggtgcctttggagcacttttgtgtaggaaggaattcctgctgaactgtagctctcactcacccccaaatcattgaatgaccctgaggcccagttcctgtggtgcaacagtgctgctttctgctactttcaatgggaacagctgtacatgttgcagggcaggatttggttcccaagagcaaagactactgcagacacctgacttggtggttctcctgatttcttatctcctgaaaaatgctcctgctgttggtgtgtttgtttgtttgttccattttgtggaagtttttcatccaaactttaactaacttggcaaagaaaaaaaactgacttactgaaattgggaaacttttcccttcttttattttctaaaggaattctactagactattttccattgataatatatacaaaagaggtgtgatgagaagggtataaggttaccaccttttcctctagagagccacagacttcctttccactggatggtttataaattcctctaaccctgagattcttcttggttctctgactaaaggaggcacttattagccgggctgggatctgtagaacctttgaagaaggactttgagcaggaactttgcacacaccttaagtgtctccttggtttgttcatgatgctcctgctaggtaggtctaaatggcaatacacatctctttattcaatgtagaaagtaattagctctgtaattattttcagggtgtttgtagactatataaatgagcccattgaaaaggaagagtttgtgaaagtggatgaagaggaataagggtaacttggagattaaattcctttttttgtcagtgtactgttgttatgccatctgtaccaaaaaattttccaaaagactggatcactgcagtgcagctcatctaagttccccttcttattggagttaaaggttcccatttggtggctgtgggtgcttgcttaaatctctggtggtcccaagactgcactttttctccctttcgagctggggatgtagagagaacttacaggtgatttttattctgattgcttttgtttgtgtccacaagggagcttggattctgtgtacttgtctctttcccattgtccagtaaggcagtaaatacagacacaatgtgtacttttgtgtgtgattcaagtgggagacagtctgttaaaaggtcagaaacattttagtcccctttaaaatatttcttttagtttatttctatcgtgttttatttcacagatatttaattaccacccctaaatttcctcctcttacccttcaccttccctaaaatccttccaaaatcagtgaactgcaagcagggaaactaacaaatgtccattcaccctttttgtgtggtgtgtttttttatgttttgttttgttttttaactaagcttgaaccaaagtcaatttttagcaagctgctgtactaatggactagttgataacgtgcagttcagacacatcgaggagatagatgctactgacaatttctttttcatttgtctttattaattttatatgaaagttgctgcttgtttttaatcttttatgttggtaaattgtgatatcctctgggcagacattaacttgatgtttaactagtttattaggttggtgtgtaaatagaatgacaatgtcaattactaatttctctcctctccattcactttttctctgttgtagttaaatttaatcttctatcctgacttgacatctctacctttagtctgtggaaatgattttagggctatcagtaatgctgtagctgcccataataatgagtccctcccttgggagtggtgaaacttagaaggaaggattcagggagggaaatgctggtacccagtatactggattagaagttatagcattaatttctcaaaattgctaccaaaggaagtgtggagtcccaagggactcaagctcagtgaggtaagacaaagggcaaggaaaggctgtttgggtggtttttttttccccacatatggtttagaaaatgatccctttcccaaacaaaactcaccaacagactttaatattagaaaagatactaagctttaaatgtcaatacagtggtcttttattccctgccctgtctatattttctactcaatttgggataaggggattttatgtgaagcacttgatgagggtagaccagcataaaaaatctgtttaaaagaagaaataatctttaggaaaagataaatctttagataaaaataaatttttttctctttttttacttatttaaaaataagttgtgaaatgaaaggtacatttacacatgtacacacgaaacactaatatagctttttggtggttgtttagtttaaaatcaactccctatccatcatccctagatattctacttatcgtattgcttcatgaacaccttagtcattttttactttacgtatatatttttttatcatctcaagaaatgcattttgaattgaatgaactatcttctaagctaagatactcaaatttaacttttagccaccttatatgggagagcctggaaactaaaggggaccagggaccatttgaccaaaagaggtgtttggtggagtttctgcatttcaaagaagaaaggccagataggtcatcacaattcattgtattattctttttttttccccttaatgtttatgcaaattttattttatatttctgaatttggttagcacatactaagccaaagactattctaaatgcatttatagtgaatactatgtatgcccatggtaatgggtcctccctaaggagtggtgaatgtaattgtgtgaatcctgcttatcacaagtggtgcaatttggtcataaactttatttataccctgtatacatctgaataacagagcagaaagacctaaaaaagggcttctcacaggaacaatattactatgttgttctaagaaaaaataagttgagtgctgtattagtttaagtgtttctaaagttctataggcagcattttagaattaagaattgtgtatatccattaactgatataattcacatgtccttttatttgttatcagaaagatcaatactatcccaatttattcaacttgttacccaagaaatggaaccaaaggaatccaactttcattttgtgtagaatcatacctacttatacttaatgctagcactgtaagaaataagtcttttttgtttaaaaaagggaagataagattaaagattcttagtgagatcatcttgccaatttgttgtacatctctcattcattgttgggggaaaaaaaagcacaactatacctctttaatgttattttcttccattatccctcatttatttggaaagataagggaaaccttgtctgtattatccagaagcacagatatttgcttgacacaatatttaaattcagcccaatctttaacattaaaaaattttctttttaacttgctggaaaagttggatacattggcaaatatagggaattcatgtcttttttttttttttttttctggtcttgctctgttgcctaggctagagtgcaacggcatgatctcggctcactgcaacctctgcctcccgggttcaagcaattctcctgcttcagcctcccaagtagctgggattacaggcgcccaccaccgcacccggctaatttttgtatttttagtagggacgggatttctccgtgttggccaggctttttgaactcctgaccttaggtgatctgcctgccttggcctcccaaagtgctgggattacaggtatgagccactgtgcccatcctcatgtcaatttttaaagtgataaatcctgatattatacattgcaattagtgtagaataaacgcttggcttatagaactctctgttcttagtctaaagctgttcccaaaccaggtcatcctcacgaaacattcttgaccaagaaaaaagataaggtcattgagataggaagacagaggaaaagcctcttgctgttgtttcttcccaagaaaggagaagccctgccagggagaagtcagtagtattgctgactcactgtatcactgagtgtagggtgtggtagcaaggaggaggcaggggattcacgctgacaggtggctctggcctggctcttggggggccttctgaagaccagtctgcagtttgaggaagggccccaacaattcatttggagagcttggccaaatactttctcattaaatcagcacctaaacttgatgaacttaaagtttgtttattagagttgaaaacattaaaagatgactgatactaatgggagaaaaatactaaagacccaaaatttaaaattttccaaaatggacaagaattgatgggttaatttgctcataactgatatgagtttgcttttatgtgtgtgtggaaagcatttaatgtgtgatgctgttcatagtcctggctatttgatgtcattttcagttttacaacattttgaggatgacactttataaaatggtaaatctttctcagcgtttacaaacttggcttttgagaagggaaaaatcctctttgctatttctgtaagaagaataactgagatcagctattatataggtttgcatggatggtgtccacaatacaaatgtaaacttggacaggaataggataaataaattgctttcatcataaaggccaatcatccatttcttagtccaaggagattaaatataaataggacacccctgagatttccagtaaggtatttgaaaggattccactgggagggcagggaatatattttttctcagagcatccagtttgtacccagttttctatatggtttgtgaactgtagcttttaaaaaaaaattttgtagttttcttctaaccttattcattaagtagttccttgttttggcccttctactcttggccttagctaaaagcagtaaatgtgagtgaattttatgttgattatgtcacctggatctcctttccttcccttctttttctcattgaatggtggtaccttaatttgggtaacagctagcttctggcaccttcataaaatacctcagaatagcttagcattgttgcaaaactggttttaaactaaaaaccaaataaataagtgaaaaaattttataaatagtggaaataattctagctgtagcatttagttgaactaatgtttattatgatcgataaacaagattgatgctgtatgtatttgggatcctgtttataggttacaatttatagggttagggagggttgggtgggggaagaggagatgttgattatgttagaaggaaaacattgctcgtgtgtgtgtttgttttttcttatatctgtcttgccaaaggaaacttgattttccctgtgattggctttggcctctgtggtctggtctgcagcagtgtgtggtggcatgcaggtaacatatggggtgtccagtaggttcagggaccctgagggtgcatttacatcccttcctatggttgcccatgccccccagaccctgccaacctctcctaatgattcattacctctgtacatagcaaaagcataggcaaaggatgaatgcgtgaatgcctggatgtgcagttgagaaacagaggcagacatagacatgcaccaattaatttggagccaagaggtgagtgattgatgtatcttaaatctaggaaagttaaagtgaaacaggttctttgtgttgccctctgtcaagttactgaatgttgtgctaataacacaacactttaaaaccttacttacttttctcataccaaggctagttctttctagaccaaaaacacaaacaggataaaaagcaaaccaagaagttgaaagctaacctgcccacctcacccctgtgatacaaagtgtgaaccttaaggattagttggtgggattgaggagagaattattcttggtgggaacatgaatgagaaatgatgctggcttaggaaaaatcacaagccctttctgcccatactctgggacaaactttcttggctccctgagttcggatatagactgtatctctagaaaggctatttttttaaataaatgatcccacagaacttaagtgggatttggtttagataccaaagacactgctaatgtcattgcttatccttaagttttcaaaacaggcagagggaataggagcaaaaagccaaaatttggaaaagctttactttatctctttccttcccttttccccttttcccagtcccctgctttttgaaggaagtcttcttggttatcctggctttggaaaagagatttattttgttttgctctgctggctctttaaagatggatagttgctcaatctagcagtgatgttcttggaattgctgagaaatttggggagggcaaaagataggggtagaattttttcattatttccctttatctaatacttttaaatagaaccaacacagcctatatgagttcagacaatatttagatgtggtatctccatctgtctcctgtaaaagataagaattttcaagaacaggattacgtggaaaaccaaaagatcttcccttactctcctataaatgttttgttccaaatgtttttatatatgggctctagggagtcaggtagttcattgtttcggtgtactattgataggacacagaaagggagagagggtaaagaaatgtatcactctctgaatattgcatcaaaaatgattaggttgcagaacttcatgaaagctttactaataatcttattgttctgacattatgtaaaggtggtattaatattgtatgacttgtcaaagtgctagataggtttataagtaggtaatagggatgttgaagattagagcacttgaaacagaagttctgggaaaacaaggtgtgtgtaatggaacaccactttgagcacagaaacaaaggtcccttggacctggtagggaagatgtgatttatgattgtttctgtgtccctgtatctgcccaccctgcacagggctccaccacccagggccaccttctggtttaaacccaggacactgtcaaaaagttaagaccccaaaactaatttactgtaaaaaacattgaggactgctgcaaagttttcccttgttttctttgtgtacttgttcatcattgtataagttagccacagcttcacaagagcagcttaaggcttctttcataaattggcagtggcattgagttctcaaacattatatcccaaagtctgcaggcagacagctggatacagcgctgtgtataaatgagacgtccaaacacttgagtttcttaagattgggatctctttcaaatgaaaaaggacagagccaagtagagaaaagactttgtgctcccacccagccttaatgagtctcatggtctaaaagtataggaagaaatgaaatgcactttcagaagctaaaatgacagtgtctgctacaaaaggctgtagttgtaggcagtcggggatgccatgtccttggttccattcctgcgtgagtctgcagaaggcacacactttgtaagagtagagtggactagtgccagcctgaataggtttaaaactgcaaacagttggagaacatggaacaggttggtgcaggaagcctaagattttgcaatcatattataacattggcttttgacaacataaatgttgtatcttccctaaggtcaggtcggggaaagaaagacttccagcttcttacctctgcgtgcatgggcacgtgtgcattgctcagtccgcaggaggtctcactccgcaggaaacgctctcctcccgcataagtctgtacttccatcccctcatctgtggtagtagtgaaggctaggtgagtaagcgtgggctgttctacccaccagaagtccaggagctgttgtatacctcatttctaactcgtgaccgagtgacttgctttaactttctcgaaatcctacagagttgccaagtctgccctccctcctcagtcatgttaaactctggcctatagcatcatgggacctgtagcctagggtgggaccccctaaagcctctgaatgtcgctgcttaaaagctactgcaaactgagggcaaattgcaatcttctattcctttttgttgcaaggggtcttcacaggtctcttaacatctgctttccctgccaccctgcctttaggggctggccagctatccacacccctaacccaccctgtgtttctgacagctggccacacgtcaacttctgtacttgccttttccttggtggggtagaggccaaccccttctcctctgaggcctcagggttctgtttcttttcaggactttgggtagaagggaagacaccaaaggctcctttaagctgactgctgcatacacatttcactttttttcctttgacatgaccaaaaatatccaaatatttaagtttattattattattattattatttgacaatcttatatccaatgggctctctagaagctgcatccccagccctttcaccttttctttgaatgtagttcccaaccttcaattcccacccctaatgctgacaaaaagcttagccaggtcatgatactgctgctataagccaggggagggtggtttctttgttttgttttgttttgttttgtttttcaaatttccagccaaaaccaaagatttcttaatgattgtataaactcaaaacaaacaaaagaaccaaagaaaagggaagtcttcagcatcagtccagtctgtggtgtcctggcacttagaagagtgaggccagggaaggtggggcggggggaccctctgactggatcagaaagggcaggcaagctgcttaccaccttccagggtccagcacaggtgcatgcccctagctttggccctcacaaacttgtgagcatgccctgaaacaaattggcatttcagattttccaaaacaaaagtcaaaaaaccccatcaccaccatcatccaccctacaccaaccagggtcactatggggacttagcacagggcctagggagggtgggagctgctgctggactggcccgaggactccacagagtgggggacgttgaagacactggcgcacgattggctgctctgctgggtgctttaacctctggggctgggcgaatgcacgccacggtgcccttctgagcctttttttcttttcctgtactggaactgcttggaagtggctgtcctgtttgtgagaaaacatgcagaaagattatcaagcttttcatttctctttattgtagttttctttcctttttgcagcaccactgtgcaactatgcattgtacttcacaaccttttgtgctaggtagatgcctgtgactttttaacttggggggtggggggattgcaaatgaaggaactttttacatggatctttttaatctcagttggttgggggaggggggtacttggttcttgggtcacacaagctctatcccaaagcaaaatccaaatgttaataatattagcctgatgcagataccaaagataatttctttcctgcagaaccttagactcgtgtattaagtacgattacccagcacttgcattagtctaacctcagtaattccaaagcttagatgtatattttggtatatttctgggatattaaaaaaaaaatgtcgtttaacttcttgtttgtttcagtgtaatgctcttaaagtcatagcatgaaaataattgaactgtcctattcttagtagtttgaaataatagtatttttgtatgttttgggtgtgtctatgtatgtattaacataacagttttcactgcctaggtgttcataataaaaaagaaaatgaaaaaagttctgagtgtacataatattcaataataatctcccaccaggtgtcaatttagattgcatattcctcattactgttcccaactgggattttgttttcttttaaagagacagtgatcgtgtttttctaaagatgttttctttctctctttcaatatcttaactcactttttttttcttccttttttgtcttaattattaattcaggggtgtttgtccactgttgtcaaaggaggggcacaaggggaattggcccccggcctcctagaactttttgttttatgtactttaaaatgtgagtttgagttcttctttgtggaaacttaagatgtggtgtaaatgattctttccaaaattgtccagcagcttgaatgaggcagtgacaattctgaggtggtttattgggagtccttctacatttctcttagataactctgcactctgggtggctattgtgtagccttactgccccagagtgcctgttagccaaatatttcccctctgataggaatattttctaagaatcagctgataacttgcgtgctggaccttgttatctgtgcccctgggagacacacgttttcttggttttgaaaacctgaaacacaggcaactttacattttggggaattagctgatgcctcctgaagcctgaggaggtggcggggaatatgagcggtgctgtctctctcaaaagtgccctttagatgattccccctcctagggctgcctgcaggggctgtaggcttgggaaagattgtgtaggtgacagtgaatcagaatgaagtggtagattttgtgtagatgcatttgtctgctgtaattttttatatatatattaaacttactgtaactgtacagttcatttctgttgtaaaacatcattaaaccatcttccaagtgttttcacattg

SEQ ID NO: 1717 - DNA, 13905 bp, Homo sapiens
gggaggggggaggggagccagagcgagggagggtttatcgaccgggcgattttggttaaaatattcaaaatggcggacggaggagcagcgagtcaagatgagagttcagccgcggcggcagcagcagcagactcaagaatgaacaatccgtcagaaaccagtaaaccatctatggagagtggagatggcaacacaggcacacaaaccaatggtctggactttcagaagcagcctgtgcctgtaggaggagcaatctcaacagcccaggcgcaggctttccttggacatctccatcaggtccaactcgctggaacaagtttacaggctgctgctcagtctttaaatgtacagtctaaatctaatgaagaatcgggggattcgcagcagccaagccagccttcccagcagccttcagtgcaggcagccattccccagacccagcttatgctagctggaggacagataactgggcttactttgacgcctgcccagcaacagttactactccagcaggcacaggcacaggcacagctgctggctgctgcagtgcagcagcactccgccagccagcagcacagtgctgctggagccaccatctccgcctctgctgccacgcccatgacgcagatccccctgtctcagcccatacagatcgcacaggatcttcaacaactgcaacagcttcaacagcagaatctcaacctgcaacagtttgtgttggtgcatccaaccaccaatttgcagccagcgcagtttatcatctcacagacgccccagggccagcagggtctcctgcaagcgcaaaatcttctaacgcaactacctcagcaaagccaagccaacctcctacagtcgcagccaagcatcaccctcacctcccagccagcaaccccaacacgcacaatagcagcaaccccaattcagacacttccacagagccagtcaacaccaaagcgaattgatactcccagcttggaggagcccagtgaccttgaggagcttgagcagtttgccaagaccttcaaacaaagacgaatcaaacttggattcactcagggtgatgttgggctcgctatggggaaactatatggaaatgacttcagccaaactaccatctctcgatttgaagccttgaacctcagctttaagaacatgtgcaagttgaagccacttttagagaagtggctaaatgatgcagagaacctctcatctgattcgtccctctccagcccaagtgccctgaattctccaggaattgagggcttgagccgtaggaggaagaaacgcaccagcatagagaccaacatccgtgtggccttagagaagagtttcttggagaatcaaaagcctacctcggaagagatcactatgattgctgatcagctcaatatggaaaaagaggtgattcgtgtttggttctgtaaccgccgccagaaagaaaaaagaatcaacccaccaagcagtggtgggaccagcagctcacctattaaagcaattttccccagcccaacttcactggtggcgaccacaccaagccttgtgactagcagtgcagcaactaccctcacagtcagccctgtcctccctctgaccagtgctgctgtgacgaatctttcagttacaggcacttcagacaccacctccaacaacacagcaaccgtgatttccacagcgcctccagcttcctcagcagtcacgtccccctctctgagtccctccccttctgcctcagcctccacctccgaggcatccagtgccagtgagaccagcacaacacagaccacctccactcctttgtcctcccctcttgggaccagccaggtgatggtgacagcatcaggtttgcaaacagcagcagctgctgcccttcaaggagctgcacagttgccagcaaatgccagtcttgctgccatggcagctgctgcaggactaaacccaagcctgatggcaccctcacagtttgcggctggaggtgccttactcagtctgaatccagggaccctgagcggtgctctcagcccagctctaatgagcaacagtacactggcaactattcaagctcttgcttctggtggctctcttccaataacatcacttgatgcaactgggaacctggtatttgccaatgcgggaggagcccccaacatcgtgactgcccctctgttcctgaaccctcagaacctctctctgctcaccagcaaccctgttagcttggtctctgccgccgcagcatctgcagggaactctgcacctgtagccagccttcacgccacctccacctctgctgagtccatccagaactctctcttcacagtggcctctgccagcggggctgcgtccaccaccaccaccgcctccaaggcacagtgagctgggcagagctgggctgccagaagcctttttcactctgcagtgtgattggactgccagccaggttaataaactgaaaaatgtgattggcttcctctcgccgtgttgtgagggcaaaggagagaagggagaaaaaaaaaaaaaaaccacacacacccatacacacataccagaaaaagaaagaaaggatggagacggaacatttgcctaattttgtaataaaacactgtcttttcaggattgcttcatggattggagaactttctaaccaaaaattaaaaaaaaaaaaaaaaaaagaaacaaaaaaatcaaaaacaaacaaaaataagtgaaaggactacttatcatttccagcagtcatgatgacaagttaaggtgggttaccaattccaatataggaaggggatttcttgtttgtctaaatttctttttttcttaaaaaaaaaaaatcatttttatgggtctgttgtacaggccattaagtcataacaaggtgtttataatcgtatcaattgtgttgggggttcctttcttaactggtacaatttaggcaggcctgtattactgtattattattgttgttgttgttattgttttatatatatagtttggacatgtttattatctcttgctcctggatcctatttcagtgagctcccacactgtggggagggagggttttggggtaaggggagacttctgttcttaactgtggggaatgttcttgctggtttccttatccttgatgactcttacagaggtgctagaaaattattttcttttgccacttatgcaagaggcttggtgcagaagctgaaggcagtgtgtgcaaacactcccattccacacacgccccttcccctccccacatcaggtggtgcctttggagcacttttgtgtaggaaggaattcctgctgaactgtagctctcactcacccccaaatcattgaatgaccctgaggcccagttcctgtggtgcaacagtgctgctttctgctactttcaatgggaacagctgtacatgttgcagggcaggatttggttcccaagagcaaagactactgcagacacctgacttggtggttctcctgatttcttatctcctgaaaaatgctcctgctgttggtgtgtttgtttgtttgttccattttgtggaagtttttcatccaaactttaactaacttggcaaagaaaaaaaactgacttactgaaattgggaaacttttcccttcttttattttctaaaggaattctactagactattttccattgataatatatacaaaagaggtgtgatgagaagggtataaggttaccaccttttcctctagagagccacagacttcctttccactggatggtttataaattcctctaaccctgagattcttcttggttctctgactaaaggaggcacttattagccgggctgggatctgtagaacctttgaagaaggactttgagcaggaactttgcacacaccttaagtgtctccttggtttgttcatgatgctcctgctaggtaggtctaaatggcaatacacatctctttattcaatgtagaaagtaattagctctgtaattattttcagggtgtttgtagactatataaatgagcccattgaaaaggaagagtttgtgaaagtggatgaagaggaataagggtaacttggagattaaattcctttttttgtcagtgtactgttgttatgccatctgtaccaaaaaattttccaaaagactggatcactgcagtgcagctcatctaagttccccttcttattggagttaaaggttcccatttggtggctgtgggtgcttgcttaaatctctggtggtcccaagactgcactttttctccctttcgagctggggatgtagagagaacttacaggtgatttttattctgattgcttttgtttgtgtccacaagggagcttggattctgtgtacttgtctctttcccattgtccagtaaggcagtaaatacagacacaatgtgtacttttgtgtgtgattcaagtgggagacagtctgttaaaaggtcagaaacattttagtcccctttaaaatatttcttttagtttatttctatcgtgttttatttcacagatatttaattaccacccctaaatttcctcctcttacccttcaccttccctaaaatccttccaaaatcagtgaactgcaagcagggaaactaacaaatgtccattcaccctttttgtgtggtgtgtttttttatgttttgttttgttttttaactaagcttgaaccaaagtcaatttttagcaagctgctgtactaatggactagttgataacgtgcagttcagacacatcgaggagatagatgctactgacaatttctttttcatttgtctttattaattttatatgaaagttgctgcttgtttttaatcttttatgttggtaaattgtgatatcctctgggcagacattaacttgatgtttaactagtttattaggttggtgtgtaaatagaatgacaatgtcaattactaatttctctcctctccattcactttttctctgttgtagttaaatttaatcttctatcctgacttgacatctctacctttagtctgtggaaatgattttagggctatcagtaatgctgtagctgcccataataatgagtccctcccttgggagtggtgaaacttagaaggaaggattcagggagggaaatgctggtacccagtatactggattagaagttatagcattaatttctcaaaattgctaccaaaggaagtgtggagtcccaagggactcaagctcagtgaggtaagacaaagggcaaggaaaggctgtttgggtggtttttttttccccacatatggtttagaaaatgatccctttcccaaacaaaactcaccaacagactttaatattagaaaagatactaagctttaaatgtcaatacagtggtcttttattccctgccctgtctatattttctactcaatttgggataaggggattttatgtgaagcacttgatgagggtagaccagcataaaaaatctgtttaaaagaagaaataatctttaggaaaagataaatctttagataaaaataaatttttttctctttttttacttatttaaaaataagttgtgaaatgaaaggtacatttacacatgtacacacgaaacactaatatagctttttggtggttgtttagtttaaaatcaactccctatccatcatccctagatattctacttatcgtattgcttcatgaacaccttagtcattttttactttacgtatatatttttttatcatctcaagaaatgcattttgaattgaatgaactatcttctaagctaagatactcaaatttaacttttagccaccttatatgggagagcctggaaactaaaggggaccagggaccatttgaccaaaagaggtgtttggtggagtttctgcatttcaaagaagaaaggccagataggtcatcacaattcattgtattattctttttttttccccttaatgtttatgcaaattttattttatatttctgaatttggttagcacatactaagccaaagactattctaaatgcatttatagtgaatactatgtatgcccatggtaatgggtcctccctaaggagtggtgaatgtaattgtgtgaatcctgcttatcacaagtggtgcaatttggtcataaactttatttataccctgtatacatctgaataacagagcagaaagacctaaaaaagggcttctcacaggaacaatattactatgttgttctaagaaaaaataagttgagtgctgtattagtttaagtgtttctaaagttctataggcagcattttagaattaagaattgtgtatatccattaactgatataattcacatgtccttttatttgttatcagaaagatcaatactatcccaatttattcaacttgttacccaagaaatggaaccaaaggaatccaactttcattttgtgtagaatcatacctacttatacttaatgctagcactgtaagaaataagtcttttttgtttaaaaaagggaagataagattaaagattcttagtgagatcatcttgccaatttgttgtacatctctcattcattgttgggggaaaaaaaagcacaactatacctctttaatgttattttcttccattatccctcatttatttggaaagataagggaaaccttgtctgtattatccagaagcacagatatttgcttgacacaatatttaaattcagcccaatctttaacattaaaaaattttctttttaacttgctggaaaagttggatacattggcaaatatagggaattcatgtcttttttttttttttttttctggtcttgctctgttgcctaggctagagtgcaacggcatgatctcggctcactgcaacctctgcctcccgggttcaagcaattctcctgcttcagcctcccaagtagctgggattacaggcgcccaccaccgcacccggctaatttttgtatttttagtagggacgggatttctccgtgttggccaggctttttgaactcctgaccttaggtgatctgcctgccttggcctcccaaagtgctgggattacaggtatgagccactgtgcccatcctcatgtcaatttttaaagtgataaatcctgatattatacattgcaattagtgtagaataaacgcttggcttatagaactctctgttcttagtctaaagctgttcccaaaccaggtcatcctcacgaaacattcttgaccaagaaaaaagataaggtcattgagataggaagacagaggaaaagcctcttgctgttgtttcttcccaagaaaggagaagccctgccagggagaagtcagtagtattgctgactcactgtatcactgagtgtagggtgtggtagcaaggaggaggcaggggattcacgctgacaggtggctctggcctggctcttggggggccttctgaagaccagtctgcagtttgaggaagggccccaacaattcatttggagagcttggccaaatactttctcattaaatcagcacctaaacttgatgaacttaaagtttgtttattagagttgaaaacattaaaagatgactgatactaatgggagaaaaatactaaagacccaaaatttaaaattttccaaaatggacaagaattgatgggttaatttgctcataactgatatgagtttgcttttatgtgtgtgtggaaagcatttaatgtgtgatgctgttcatagtcctggctatttgatgtcattttcagttttacaacattttgaggatgacactttataaaatggtaaatctttctcagcgtttacaaacttggcttttgagaagggaaaaatcctctttgctatttctgtaagaagaataactgagatcagctattatataggtttgcatggatggtgtccacaatacaaatgtaaacttggacaggaataggataaataaattgctttcatcataaaggccaatcatccatttcttagtccaaggagattaaatataaataggacacccctgagatttccagtaaggtatttgaaaggattccactgggagggcagggaatatattttttctcagagcatccagtttgtacccagttttctatatggtttgtgaactgtagcttttaaaaaaaaattttgtagttttcttctaaccttattcattaagtagttccttgttttggcccttctactcttggccttagctaaaagcagtaaatgtgagtgaattttatgttgattatgtcacctggatctcctttccttcccttctttttctcattgaatggtggtaccttaatttgggtaacagctagcttctggcaccttcataaaatacctcagaatagcttagcattgttgcaaaactggttttaaactaaaaaccaaataaataagtgaaaaaattttataaatagtggaaataattctagctgtagcatttagttgaactaatgtttattatgatcgataaacaagattgatgctgtatgtatttgggatcctgtttataggttacaatttatagggttagggagggttgggtgggggaagaggagatgttgattatgttagaaggaaaacattgctcgtgtgtgtgtttgttttttcttatatctgtcttgccaaaggaaacttgattttccctgtgattggctttggcctctgtggtctggtctgcagcagtgtgtggtggcatgcaggtaacatatggggtgtccagtaggttcagggaccctgagggtgcatttacatcccttcctatggttgcccatgccccccagaccctgccaacctctcctaatgattcattacctctgtacatagcaaaagcataggcaaaggatgaatgcgtgaatgcctggatgtgcagttgagaaacagaggcagacatagacatgcaccaattaatttggagccaagaggtgagtgattgatgtatcttaaatctaggaaagttaaagtgaaacaggttctttgtgttgccctctgtcaagttactgaatgttgtgctaataacacaacactttaaaaccttacttacttttctcataccaaggctagttctttctagaccaaaaacacaaacaggataaaaagcaaaccaagaagttgaaagctaacctgcccacctcacccctgtgatacaaagtgtgaaccttaaggattagttggtgggattgaggagagaattattcttggtgggaacatgaatgagaaatgatgctggcttaggaaaaatcacaagccctttctgcccatactctgggacaaactttcttggctccctgagttcggatatagactgtatctctagaaaggctatttttttaaataaatgatcccacagaacttaagtgggatttggtttagataccaaagacactgctaatgtcattgcttatccttaagttttcaaaacaggcagagggaataggagcaaaaagccaaaatttggaaaagctttactttatctctttccttcccttttccccttttcccagtcccctgctttttgaaggaagtcttcttggttatcctggctttggaaaagagatttattttgttttgctctgctggctctttaaagatggatagttgctcaatctagcagtgatgttcttggaattgctgagaaatttggggagggcaaaagataggggtagaattttttcattatttccctttatctaatacttttaaatagaaccaacacagcctatatgagttcagacaatatttagatgtggtatctccatctgtctcctgtaaaagataagaattttcaagaacaggattacgtggaaaaccaaaagatcttcccttactctcctataaatgttttgttccaaatgtttttatatatgggctctagggagtcaggtagttcattgtttcggtgtactattgataggacacagaaagggagagagggtaaagaaatgtatcactctctgaatattgcatcaaaaatgattaggttgcagaacttcatgaaagctttactaataatcttattgttctgacattatgtaaaggtggtattaatattgtatgacttgtcaaagtgctagataggtttataagtaggtaatagggatgttgaagattagagcacttgaaacagaagttctgggaaaacaaggtgtgtgtaatggaacaccactttgagcacagaaacaaaggtcccttggacctggtagggaagatgtgatttatgattgtttctgtgtccctgtatctgcccaccctgcacagggctccaccacccagggccaccttctggtttaaacccaggacactgtcaaaaagttaagaccccaaaactaatttactgtaaaaaacattgaggactgctgcaaagttttcccttgttttctttgtgtacttgttcatcattgtataagttagccacagcttcacaagagcagcttaaggcttctttcataaattggcagtggcattgagttctcaaacattatatcccaaagtctgcaggcagacagctggatacagcgctgtgtataaatgagacgtccaaacacttgagtttcttaagattgggatctctttcaaatgaaaaaggacagagccaagtagagaaaagactttgtgctcccacccagccttaatgagtctcatggtctaaaagtataggaagaaatgaaatgcactttcagaagctaaaatgacagtgtctgctacaaaaggctgtagttgtaggcagtcggggatgccatgtccttggttccattcctgcgtgagtctgcagaaggcacacactttgtaagagtagagtggactagtgccagcctgaataggtttaaaactgcaaacagttggagaacatggaacaggttggtgcaggaagcctaagattttgcaatcatattataacattggcttttgacaacataaatgttgtatcttccctaaggtcaggtcggggaaagaaagacttccagcttcttacctctgcgtgcatgggcacgtgtgcattgctcagtccgcaggaggtctcactccgcaggaaacgctctcctcccgcataagtctgtacttccatcccctcatctgtggtagtagtgaaggctaggtgagtaagcgtgggctgttctacccaccagaagtccaggagctgttgtatacctcatttctaactcgtgaccgagtgacttgctttaactttctcgaaatcctacagagttgccaagtctgccctccctcctcagtcatgttaaactctggcctatagcatcatgggacctgtagcctagggtgggaccccctaaagcctctgaatgtcgctgcttaaaagctactgcaaactgagggcaaattgcaatcttctattcctttttgttgcaaggggtcttcacaggtctcttaacatctgctttccctgccaccctgcctttaggggctggccagctatccacacccctaacccaccctgtgtttctgacagctggccacacgtcaacttctgtacttgccttttccttggtggggtagaggccaaccccttctcctctgaggcctcagggttctgtttcttttcaggactttgggtagaagggaagacaccaaaggctcctttaagctgactgctgcatacacatttcactttttttcctttgacatgaccaaaaatatccaaatatttaagtttattattattattattattatttgacaatcttatatccaatgggctctctagaagctgcatccccagccctttcaccttttctttgaatgtagttcccaaccttcaattcccacccctaatgctgacaaaaagcttagccaggtcatgatactgctgctataagccaggggagggtggtttctttgttttgttttgttttgttttgtttttcaaatttccagccaaaaccaaagatttcttaatgattgtataaactcaaaacaaacaaaagaaccaaagaaaagggaagtcttcagcatcagtccagtctgtggtgtcctggcacttagaagagtgaggccagggaaggtggggcggggggaccctctgactggatcagaaagggcaggcaagctgcttaccaccttccagggtccagcacaggtgcatgcccctagctttggccctcacaaacttgtgagcatgccctgaaacaaattggcatttcagattttccaaaacaaaagtcaaaaaaccccatcaccaccatcatccaccctacaccaaccagggtcactatggggacttagcacagggcctagggagggtgggagctgctgctggactggcccgaggactccacagagtgggggacgttgaagacactggcgcacgattggctgctctgctgggtgctttaacctctggggctgggcgaatgcacgccacggtgcccttctgagcctttttttcttttcctgtactggaactgcttggaagtggctgtcctgtttgtgagaaaacatgcagaaagattatcaagcttttcatttctctttattgtagttttctttcctttttgcagcaccactgtgcaactatgcattgtacttcacaaccttttgtgctaggtagatgcctgtgactttttaacttggggggtggggggattgcaaatgaaggaactttttacatggatctttttaatctcagttggttgggggaggggggtacttggttcttgggtcacacaagctctatcccaaagcaaaatccaaatgttaataatattagcctgatgcagataccaaagataatttctttcctgcagaaccttagactcgtgtattaagtacgattacccagcacttgcattagtctaacctcagtaattccaaagcttagatgtatattttggtatatttctgggatattaaaaaaaaaatgtcgtttaacttcttgtttgtttcagtgtaatgctcttaaagtcatagcatgaaaataattgaactgtcctattcttagtagtttgaaataatagtatttttgtatgttttgggtgtgtctatgtatgtattaacataacagttttcactgcctaggtgttcataataaaaaagaaaatgaaaaaagttctgagtgtacataatattcaataataatctcccaccaggtgtcaatttagattgcatattcctcattactgttcccaactgggattttgttttcttttaaagagacagtgatcgtgtttttctaaagatgttttctttctctctttcaatatcttaactcactttttttttcttccttttttgtcttaattattaattcaggggtgtttgtccactgttgtcaaaggaggggcacaaggggaattggcccccggcctcctagaactttttgttttatgtactttaaaatgtgagtttgagttcttctttgtggaaacttaagatgtggtgtaaatgattctttccaaaattgtccagcagcttgaatgaggcagtgacaattctgaggtggtttattgggagtccttctacatttctcttagataactctgcactctgggtggctattgtgtagccttactgccccagagtgcctgttagccaaatatttcccctctgataggaatattttctaagaatcagctgataacttgcgtgctggaccttgttatctgtgcccctgggagacacacgttttcttggttttgaaaacctgaaacacaggcaactttacattttggggaattagctgatgcctcctgaagcctgaggaggtggcggggaatatgagcggtgctgtctctctcaaaagtgccctttagatgattccccctcctagggctgcctgcaggggctgtaggcttgggaaagattgtgtaggtgacagtgaatcagaatgaagtggtagattttgtgtagatgcatttgtctgctgtaattttttatatatatattaaacttactgtaactgtacagttcatttctgttgtaaaacatcattaaaccatcttccaagtgttttcacattg

SEQ ID NO: 1718 - DNA, 2124 bp, Homo sapiens
cggaggagcagcgagtcaagatgagagttcagccgcggcggcagcagcagcagactggaaaagtaagaagagctttcctgcctttttaattaccaaactactctcagttttcaatgaatcagttcaaagaaagaatgcagtctttctatacctgactcaagaatgaacaatccgtcagaaaccagtaaaccatctatggagagtggagatggcaacacaggcacacaaaccaatggtctggactttcagaagcagcctgtgcctgtaggaggagcaatctcaacagcccaggcgcaggctttccttggacatctccatcaggtccaactcgctggaacaagtttacaggctgctgctcagtctttaaatgtacagtctaaatctaatgaagaatcgggggattcgcagcagccaagccagccttcccagcagccttcagtgcaggcagccattccccagacccagcttatgctagctggaggacagataactgggcttactttgacgcctgcccagcaacagttactactccagcaggcacaggcacaggcacagctgctggctgctgcagtgcagcagcactccgccagccagcagcacagtgctgctggagccaccatctccgcctctgctgccacgcccatgacgcagatccccctgtctcagcccatacagatcgcacaggatcttcaacaactgcaacagcttcaacagcagaatctcaacctgcaacagtttgtgttggtgcatccaaccaccaatttgcagccagcgcagtttatcatctcacagacgccccagggccagcagggtctcctgcaagcgcaaaatcttctaacgcaactacctcagcaaagccaagccaacctcctacagtcgcagccaagcatcaccctcacctcccagccagcaaccccaacacgcacaatagcagcaaccccaattcagacacttccacagagccagtcaacaccaaagcgaattgatactcccagcttggaggagcccagtgaccttgaggagcttgagcagtttgccaagaccttcaaacaaagacgaatcaaacttggattcactcagggtgatgttgggctcgctatggggaaactatatggaaatgacttcagccaaactaccatctctcgatttgaagccttgaacctcagctttaagaacatgtgcaagttgaagccacttttagagaagtggctaaatgatgcagagaacctctcatctgattcgtccctctccagcccaagtgccctgaattctccaggaattgagggcttgagccgtaggaggaagaaacgcaccagcatagagaccaacatccgtgtggccttagagaagagtttcttggagaatcaaaagcctacctcggaagagatcactatgattgctgatcagctcaatatggaaaaagaggtgattcgtgtttggttctgtaaccgccgccagaaagaaaaaagaatcaacccaccaagcagtggtgggaccagcagctcacctattaaagcaattttccccagcccaacttcactggtggcgaccacaccaagccttgtgactagcagtgcagcaactaccctcacagtcagccctgtcctccctctgaccagtgctgctgtgacgaatctttcagttacaggcacttcagacaccacctccaacaacacagcaaccgtgatttccacagcgcctccagcttcctcagcagtcacgtccccctctctgagtccctccccttctgcctcagcctccacctccgaggcatccagtgccagtgagaccagcacaacacagaccacctccactcctttgtcctcccctcttgggaccagccaggtgatggtgacagcatcaggtttgcaaacagcagcagctgctgcccttcaaggagctgcacagttgccagcaaatgccagtcttgctgccatggcagctgctgcaggactaaacccaagcctgatggcaccctcacagtttgcggctggaggtgccttactcagtctgaatccagggaccctgagcggtgctctcagcccagctctaatgagcaacagtacactggcaactattcaaggattgcttcatggattggagaactttctaaccaaaaattaa

SEQ ID NO: 1719 - DNA, 2248 bp, Homo sapiens
attcaaaatggcggacggaggagcagcgagtcaagatgagagttcagccgcggcggcagcagcagcagactcaagaatgaacaatccgtcagaaaccagtaaaccatctatggagagtggagatggcaacacaggcacacaaaccaatggtctggactttcagaagcagcctgtgcctgtaggaggagcaatctcaacagcccaggcgcaggctttccttggacatctccatcaggtccaactcgctggaacaagtttacaggctgctgctcagtctttaaatgtacagtctaaatctaatgaagaatcgggggattcgcagcagccaagccagccttcccagcagccttcagtgcaggcagccattccccagacccagcttatgctagctggaggacagataactggggatcttcaacaactgcaacagcttcaacagcagaatctcaacctgcaacagtttgtgttggtgcatccaaccaccaatttgcagccagcgcagtttatcatctcacagacgccccagggccagcagggtctcctgcaagcgcaaaatcttctaacgcaactacctcagcaaagccaagccaacctcctacagtcgcagccaagcatcaccctcacctcccagccagcaaccccaacacgcacaatagcagcaaccccaattcagacacttccacagagccagtcaacaccaaagcgaattgatactcccagcttggaggagcccagtgaccttgaggagcttgagcagtttgccaagaccttcaaacaaagacgaatcaaacttggattcactcagggtgatgttgggctcgctatggggaaactatatggaaatgacttcagccaaactaccatctctcgatttgaagccttgaacctcagctttaagaacatgtgcaagttgaagccacttttagagaagtggctaaatgatgcagagaacctctcatctgattcgtccctctccagcccaagtgccctgaattctccaggaattgagggcttgagccgtaggaggaagaaacgcaccagcatagagaccaacatccgtgtggccttagagaagagtttcttggagaatcaaaagcctacctcggaagagatcactatgattgctgatcagctcaatatggaaaaagaggtgattcgtgtttggttctgtaaccgccgccagaaagaaaaaagaatcaacccaccaagcagtggtgggaccagcagctcacctattaaagcaattttccccagcccaacttcactggtggcgaccacaccaagccttgtgactagcagtgcagcaactaccctcacagtcagccctgtcctccctctgaccagtgctgctgtgacgaatctttcagttacaggcacttcagacaccacctccaacaacacagcaaccgtgatttccacagcgcctccagcttcctcagcagtcacgtccccctctctgagtccctccccttctgcctcagcctccacctccgaggcatccagtgccagtgagaccagcacaacacagaccacctccactcctttgtcctcccctcttgggaccagccaggtgatggtgacagcatcaggtttgcaaacagcagcagctgctgcccttcaaggagctgcacagttgccagcaaatgccagtcttgctgccatggcagctgctgcaggactaaacccaagcctgatggcaccctcacagtttgcggctggaggtgccttactcagtctgaatccagggaccctgagcggtgctctcagcccagctctaatgagcaacagtacactggcaactattcaagctcttgcttctggtggctctcttccaataacatcacttgatgcaactgggaacctggtatttgccaatgcgggaggagcccccaacatcgtgactgcccctctgttcctgaaccctcagaacctctctctgctcaccagcaaccctgttagcttggtctctgccgccgcagcatctgcagggaactctgcacctgtagccagccttcacgccacctccacctctgctgagtccatccagaactctctcttcacagtggcctctgccagcggggctgcgtccaccaccaccaccgcctccaaggcacagtgagctgggcagagctgggctgccagaagcctttttcactctgcagtgtgattggactgccagccaggttaataaactgaaaaatgtgattggcttcctctcgccgtgttgtgagggcaaaggagagaaggg

SEQ ID NO: 1720 - DNA, 496 bp, Homo sapiens
attcaaaatggcggacggaggagcagcgagtcaagatgagagttcagccgcggcggcagcagcagcagactggaaaagtaagaagagctttcctgcctttttaattaccaaactactctcagttttcaatgaatcagttcaaagaaagaatgcagtctttctatacctggttttcttccatcatctgtgacagcttcttgatctgtccccagactcaagaatgaacaatccgtcagaaaccagtaaaccatctatggagagtggagatggcaacacaggcacacaaaccaatggtctggactttcagaagcagcctgtgcctgtaggaggagcaatctcaacagcccaggcgcaggctttccttggacatctccatcaggtccaactcgctggaacaagtttacaggctgctgctcagtctttaaatgtacagtctaaatctaatgaagaatcgggggattcgcagcagccaagccagccttcccagcagccttca

SEQ ID NO: 1721 - DNA, 1195 bp, Homo sapiens
attcaaaatggcggacggaggagcagcgagtcaagatgagagttcagccgcggcggcagcagcagcagactggaaaagtaagaagagctttcctgcctttttaattaccaaactactctcagttttcaatgaatcagttcaaagaaagaatgcagtctttctatacctgactcaagaatgaacaatccgtcagaaaccagtaaaccatctatggagagtggagatggcaacacaggcacacaaaccaatggtctggactttcagaagcagcctgtgcctgtaggaggagcaatctcaacagcccaggcgcaggctttccttggacatctccatcaggtccaactcgctggaacaagtttacaggctgctgctcagtctttaaatgtacagtctaaatctaatgaagaatcgggggattcgcagcagccaagccagccttcccagcagccttcagtgcaggcagccattccccagacccagcttatgctagctggaggacagataactgggcttactttgacgcctgcccagcaacagttactactccagcaggcacaggcacaggcacagctgctggctgctgcagtgcagcagcactccgccagccagcagcacagtgctgctggagccaccatctccgcctctgctgccacgcccatgacgcagatccccctgtctcagcccatacagatcgcacaggatcttcaacaactgcaacagcttcaacagcagaatctcaacctgcaacagtttgtgttggtgcatccaaccaccaatttgcagccagcgcagtttatcatctcacagacgccccagggccagcagggtctcctgcaagcgcaaaatcttctaacgcaactacctcagcaaagccaagccaacctcctacagtcgcagccaagcatcaccctcacctcccagatctggcccagtccagcctgaggtttctggagctggggtaacttatctgtaaccaccccatctaaagccagcaaccccaacacgcacaatagcagcaaccccaattcagacacttccacagagccagtcaacaccaaagcgaattgatactcccagcttggaggagcccagtgaccttgaggagcttgagcagtttgccaagaccttcaaacaaagacgaatcaaacttggattcactcagggtgatgttgggctcgctatggggaaactatat

SEQ ID NO: 1722 - DNA, 615 bp, Homo sapiens
aaaatggcggacggaggagcagcgagtcaagatgagagttcagccgcggcggcagcagcagcagctactactgggctgtaaacagtgatgccagcaaaatgttacttcagctgatgaagtgatgctgtttcgagaatttgaaagcaatttttcagtggataaagaagttgacagcacgatttgttggatgtgatgaaggattaatgagcatacaccttcacttgtattagcttaagatggaatggttctgggcaatataaaataacagactcaagaatgaacaatccgtcagaaaccagtaaaccatctatggagagtggagatggcaacacaggcacaggcacagctgctggctgctgcagtgcagcagcactccgccagccagcagcacagtgctgctggagccaccatctccgcctctgctgccacgcccatgacgcagatccccctgtctcagcccatacagatcgcacaggatcttcaacaactgcaacagcttcaacagcagaatctcaacctgcaacagtttgtgttggtgcatccaaccaccaatttgcagccagcgcagtttatcatctcacagacgccccagggccagcagggtctcctgcaagc

SEQ ID NO: 1723 - DNA, 2398 bp, Homo sapiens
gtgctggtttatagttgagactcaagaatgaacaatccgtcagaaaccagtaaaccatctatggagagtggagatggcaacacaggcacacaaaccaatggtctggactttcagaagcagcctgtgcctgtaggaggagcaatctcaacagcccaggcgcaggctttccttggacatctccatcaggtccaactcgctggaacaagtttacaggctgctgctcagtctttaaatgtacagtctaaatctaatgaagaatcgggggattcgcagcagccaagccagccttcccagcagccttcagtgcaggcagccattccccagacccagcttatgctagctggaggacagataactgggcttactttgacgcctgcccagcaacagttactactccagcaggcacaggcacaggcacagctgctggctgctgcagtgcagcagcactccgccagccagcagcacagtgctgctggagccaccatctccgcctctgctgccacgcccatgacgcagatccccctgtctcagcccatacagatcgcacaggatcttcaacaactgcaacagcttcaacagcagaatctcaacctgcaacagtttgtgttggtgcatccaaccaccaatttgcagccagcgcagtttatcatctcacagacgccccagggccagcagggtctcctgcaagcgcaaaatcttctaacgcaactacctcagcaaagccaagccaacctcctacagtcgcagccaagcatcaccctcacctcccagccagcaaccccaacacgcacaatagcagcaaccccaattcagacacttccacagagccagtcaacaccaaagcgaattgatactcccagcttggaggagcccagtgaccttgaggagcttgagcagtttgccaagaccttcaaacaaagacgaatcaaacttggattcactcagggtgatgttgggctcgctatggggaaactatatggaaatgacttcagccaaactaccatctctcgatttgaagccttgaacctcagctttaagaacatgtgcaagttgaagccacttttagagaagtggctaaatgatgcagagaacctctcatctgattcgtccctctccagcccaagtgccctgaattctccaggaattgagggcttgagccgtaggaggaagaaacgcaccagcatagagaccaacatccgtgtggccttagagaagagtttcttggagaatcaaaagcctacctcggaagagatcactatgattgctgatcagctcaatatggaaaaagaggtgattcgtgtttggttctgtaaccgccgccagaaagaaaaaagaatcaacccaccaagcagtggtgggaccagcagctcacctattaaagcaattttccccagcccaacttcactggtggcgaccacaccaagccttgtgactagcagtgcagcaactaccctcacagtcagccctgtcctccctctgaccagtgctgctgtgacgaatctttcagttacaggcacttcagacaccacctccaacaacacagcaaccgtgatttccacagcgcctccagcttcctcagcagtcacgtccccctctctgagtccctccccttctgcctcagcctccacctccgaggcatccagtgccagtgagaccagcacaacacagaccacctccactcctttgtcctcccctcttgggaccagccaggtgatggtgacagcatcaggtttgcaaacagcagcagctgctgcccttcaaggagctgcacagttgccagcaaatgccagtcttgctgccatggcagctgctgcaggactaaacccaagcctgatggcaccctcacagtttgcggctggaggtgccttactcagtctgaatccagggaccctgagcggtgctctcagcccagctctaatgagcaacagtacactggcaactattcaagctcttgcttctggtggctctcttccaataacatcacttgatgcaactgggaacctggtatttgccaatgcgggaggagcccccaacatcgtgactgcccctctgttcctgaaccctcagaacctctctctgctcaccagcaaccctgttagcttggtctctgccgccgcagcatctgcagggaactctgcacctgtagccagccttcacgccacctccacctctgctgagtccatccagaactctctcttcacagtggcctctgccagcggggctgcgtccaccaccaccaccgcctccaaggcacagtgagctgggcagagctgggctgccagaagcctttttcactctgcagtgtgattggactgccagccaggttaataaactgaaaaatgtgattggcttcctctcgccgtgttgtgagggcaaaggagagaagggagaaaaaaaa

SEQ ID NO: 1724 - DNA, 588 bp, Homo sapiens
aaaatattcaaaatggcggacggaggagcagcgagtcaagatgagagttcagccgcggcggcagcagcagcaggctggagtgcagtggtgtaattatggctcagttcaccctcaacctcctgaggtcaagtgattcttcctcctcagcctcctgagtagctgggactacagactcaagaatgaacaatccgtcagaaaccagtaaaccatctatggagagtggagatggcaacacaggcacacaaaccaatggtctggactttcagaagcagcctgtgcctgtaggaggagcaatctcaacagcccaggcgcaggctttccttggacatctccatcaggtccaactcgctggaacaagtttacaggctgctgctcagtctttaaatgtacagtctaaatctaatgaagaatcgggggattcgcagcagccaagccagccttcccagcagccttcagtgcaggcagccattccccagacccagcttatgctagctggaggacagataactgggcttactttgacgcctgcccagcaacagttactactccagcaggcacaggcacaggcacagctgctggctgctgcag

SEQ ID NO: 1725 - DNA, 2435 bp, Homo sapiens
aaaatattcaaaatggcggacggaggagcagcgagtcaagatgagagttcagccgcggcggcagcagcagcagactcaagaatgaacaatccgtcagaaaccagtaaaccatctatggagagtggagatggcaacacaggcacacaaaccaatggtctggactttcagaagcagcctgtgcctgtaggaggagcaatctcaacagcccaggcgcaggctttccttggacatctccatcaggtccaactcgctggaacaagtttacaggctgctgctcagtctttaaatgtacagtctaaatctaatgaagaatcgggggattcgcagcagccaagccagccttcccagcagccttcagtgcaggcagccattccccagacccagcttatgctagctggaggacagataactgggcttactttgacgcctgcccagcaacagttactactccagcaggcacaggcacaggcacagctgctggctgctgcagtgcagcagcactccgccagccagcagcacagtgctgctggagccaccatctccgcctctgctgccacgcccatgacgcagatccccctgtctcagcccatacagatcgcacaggatcttcaacaactgcaacagcttcaacagcagaatctcaacctgcaacagtttgtgttggtgcatccaaccaccaatttgcagccagcgcagtttatcatctcacagacgccccagggccagcagggtctcctgcaagcgcaaaatcttctaacgcaactacctcagcaaagccaagccaacctcctacagtcgcagccaagcatcaccctcacctcccagccagcaaccccaacacgcacaatagcagcaaccccaattcagacacttccacagagccagtcaacaccaaagcgaattgatactcccagcttggaggagcccagtgaccttgaggagcttgagcagtttgccaagaccttcaaacaaagacgaatcaaacttggattcactcagggtgatgttgggctcgctatggggaaactatatggaaatgacttcagccaaactaccatctctcgatttgaagccttgaacctcagctttaagaacatgtgcaagttgaagccacttttagagaagtggctaaatgatgcagagaacctctcatctgattcgtccctctccagcccaagtgccctgaattctccaggaattgagggcttgagccgtaggaggaagaaacgcaccagcatagagaccaacatccgtgtggccttagagaagagtttcttggagaatcaaaagcctacctcggaagagatcactatgattgctgatcagctcaatatggaaaaagaggtgattcgtgtttggttctgtaaccgccgccagaaagaaaaaagaatcaacccaccaagcagtggtgggaccagcagctcacctattaaagcaattttccccagcccaacttcactggtggcgaccacaccaagccttgtgactagcagtgcagcaactaccctcacagtcagccctgtcctccctctgaccagtgctgctgtgacgaatctttcagcacttcagacaccacctccaacaacacagcaaccgtgatttccacagcgcctccagcttcctcagcagtcacgtccccctctctgagtccctccccttctgcctcagcctccacctccgaggcatccagtgccagtgagaccagcacaacacagaccacctccactcctttgtcctcccctcttgggaccagccaggtgatggtgacagcatcaggtttgcaaacagcagcagctgctgcccttcaaggagctgcacagttgccagcaaatgccagtcttgctgccatggcagctgctgcaggactaaacccaagcctgatggcaccctcacagtttgcggctggaggtgccttactcagtctgaatccagggaccctgagcggtgctctcagcccagctctaatgagcaacagtacactggcaactattcaagctcttgcttctggtggctctcttccaataacatcacttgatgcaactgggaacctggtatttgccaatgcgggaggagcccccaacatcgtgactgcccctctgttcctgaaccctcagaacctctctctgctcaccagcaaccctgttagcttggtctctgccgccgcagcatctgcagggaactctgcacctgtagccagccttcacgccacctccacctctgctgagtccatccagaactctctcttcacagtggcctctgccagcggggctgcgtccaccaccaccaccgcctccaaggcacagtgagctgggcagagctgggctgccagaagcctttttcactctgcagtgtgattggactgccagccaggttaataaactgaaaaatgtgattggcttcctctcgccgtgttgtgagggcaaaggagagaaggg

SEQ ID NO: 1726 - DNA, 557 bp, Homo sapiens
gattttggttaaaatattcaaaatggcggacggaggagcagcgagtcaagatgagagttcagccgcggcggcagcagcagcagctactactgggctgtaaacagtgatgccagcaaaatgttacttcagctgatgaagtgatgctgtttcgagaatttgaaagcaatttttcagtggataaagaagttgacagcacgatttgttggatgtgatgaaggattaatgagcatacaccttcacttgtattagcttaagatggaatggttctgggcaatataaaataacagactggaaaagtaagaagagctttcctgcctttttaattaccaaactactctcagttttcaatgaatcagttcaaagaaagaatgcagtctttctatacctgactcaagaatgaacaatccgtcagaaaccagtaaaccatctatggagagtggagatggcaacacaggcacacaaaccaatggtctggactttcagaagcagcctgtgcctgtaggaggagcaatctcaacagcccaggcgcaggctttccttggacatctccatcaggt

SEQ ID NO: 1727 - DNA, 2502 bp, Homo sapiens
cttattcagttgaagattgctatggtgtaacagaagttgtattttgcttttccccttaatccactttccaccctacgcaacccccctcttttcgcttaagaacatactgtagatttgttagaaatagtagtaccttctttccccaccccaaactgctacctgtttcttccttgtttggactctctgctcctctagaagatttcacagcaatgctggactgcagtgactatgttctagactcaagaatgaacaatccgtcagaaaccagtaaaccatctatggagagtggagatggcaacacaggcacacaaaccaatggtctggactttcagaagcagcctgtgcctgtaggaggagcaatctcaacagcccaggcgcaggctttccttggacatctccatcaggtccaactcgctggaacaagtttacaggctgctgctcagtctttaaatgtacagtctaaatctaatgaagaatcgggggattcgcagcagccaagccagccttcccagcagccttcagtgcaggcagccattccccagacccagcttatgctagctggaggacagataactgggcttactttgacgcctgcccagcaacagttactactccagcaggcacaggcacaggcacagctgctggctgctgcagtgcagcagcactccgccagccagcagcacagtgctgctggagccaccatctccgcctctgctgccacgcccatgacgcagatccccctgtctcagcccatacagatcgcacaggatcttcaacaactgcaacagcttcaacagcagaatctcaacctgcaacagtttgtgttggtgcatccaaccaccaatttgcagccagcgcagtttatcatctcacagacgccccagggccagcagggtctcctgcaagcgcaaaatcttctaacgcaactacctcagcaaagccaagccaacctcctacagtcgcagccaagcatcaccctcacctcccagccagcaaccccaacacgcacaatagcagcaaccccaattcagacacttccacagagccagtcaacaccaaagcgaattgatactcccagcttggaggagcccagtgaccttgaggagcttgagcagtttgccaagaccttcaaacaaagacgaatcaaacttggattcactcagggtgatgttgggctcgctatggggaaactatatggaaatgacttcagccaaactaccatctctcgatttgaagccttgaacctcagctttaagaacatgtgcaagttgaagccacttttagagaagtggctaaatgatgcagagaacctctcatctgattcgtccctctccagcccaagtgccctgaattctccaggaattgagggcttgagccgtaggaggaagaaacgcaccagcatagagaccaacatccgtgtggccttagagaagagtttcttggagaatcaaaagcctacctcggaagagatcactatgattgctgatcagctcaatatggaaaaagaggtgattcgtgtttggttctgtaaccgccgccagaaagaaaaaagaatcaacccaccaagcagtggtgggaccagcagctcacctattaaagcaattttccccagcccaacttcactggtggcgaccacaccaagccttgtgactagcagtgcagcaactaccctcacagtcagccctgtcctccctctgaccagtgctgctgtgacgaatctttcagttacaggcacttcagacaccacctccaacaacacagcaaccgtgatttccacagcgcctccagcttcctcagcagtcacgtccccctctctgagtccctccccttctgcctcagcctccacctccgaggcatccagtgccagtgagaccagcacaacacagaccacctccactcctttgtcctcccctcttgggaccagccaggtgatggtgacagcatcaggtttgcaaacagcagcagctgctgcccttcaaggagctgcacagttgccagcaaatgccagtcttgctgccatggcagctgctgcaggactaaacccaagcctgatggcaccctcacagtttgcggctggaggtgccttactcagtctgaatccagggaccctgagcggtgctctcagcccagctctaatgagcaacagtacactggcaactattcaagctcttgcttctggtggctctcttccaataacatcacttgatgcaactgggaacctggtatttgccaatgcgggaggagcccccaacatcgtgactgcccctctgttcctgaaccctcagaacctctctctgctcaccagcaaccctgttagcttggtctctgccgccgcagcatctgcagggaactctgcacctgtagccagccttcacgccacctccacctctgctgagtccatccagaactctctcttcacagtggcctctgccagcggggctgcgtccaccaccaccaccgcctccaaggcacagtgagctgggcagagctgggctgccagaa

SEQ ID NO: 1728 - DNA, 3144 bp, Homo sapiens
agtttcgggtgccgaggtctgcagctagcggcaagcggagtcaggcatccgttcagactgacagcagaggcggcgaaggagcgcgtagccgagatcaggcgtacagagtccggaggcggcggcgggtgagctcaacttcgcacagcccttcccagctccagccccggctggcccggcacttctcggagggtcccggcagccgggaccagtgagtgcctctacggaccagcgccccggcgggcgggaagatgatgatgatgtccctgaacagcaagcaggcgtttagcatgccgcacggcggcagcctgcacgtggagcccaagtactcggcactgcacagcacctcgccgggctcctcggctcccatcgcgccctcggccagctcccccagcagctcgagcaacgctggtggtggcggcggcggcggcggcggcggcggcggcggcggaggccgaagcagcagctccagcagcagtggcagcagcggcggcgggggctcggaggctatgcggagagcctgtcttccaaccccaccgagcaatatattcggcgggctggatgagagtctgctggcccgcgccgaggctctggcagccgtggacatcgtctcccagagcaagagccaccaccaccatccaccccaccacagccccttcaaaccggacgccacctaccacactatgaataccatcccgtgcacgtcggccgcctcttcttcatcggtgcccatctcgcacccttccgcgttggcgggcacgcaccaccaccaccaccatcaccaccaccaccaccaccaaccgcaccaggcgctggagggcgagctgctggagcacctgagtcccgggctggccctgggcgctatggcgggccccgacggcgctgtggtgtccacgccggctcacgcgccgcacatggccaccatgaaccccatgcaccaagcagcgctcagcatggcccacgcgcacgggctgccgtcgcacatgggctgcatgagcgacgtggacgccgacccgcgggacctggaggcattcgccgagcgcttcaagcagcgacgcatcaagctgggggtgacccaggcagatgtgggctccgcgctggccaacctcaagatccccggcgtgggctcgcttagccagagcaccatctgcaggttcgagtccctcacactgtcccacaataatatgatcgcgctcaaacccatcctgcaggcatggctcgaggaggccgagaagtcccaccgcgagaagctcaccaagcctgaactcttcaatggcgcggagaagaagcgcaagcgcacgtccatcgctgcgccagagaagcgctcgctcgaagcctactttgccattcagcctcggccctcctctgaaaagatcgccgccatcgcggagaagctggacctgaagaaaaacgtggtgcgcgtctggttctgcaaccagaggcagaaacagaaaagaatgaaatattccgccggcatttagaagactcttggcctctccagagacgcccctttcctcgtccgctcttttctctcctctcttctgcctcttttcacttttggcgactagaaacaattccagtaaatgtgaatctcgacaaatcgaggactgaagagggagcgaacgagcgaacaactgagcccaagccggtgagaatgtgaaacagtttctcaaaggaaagaataacaaaagatggtatttgtctgttgtagcaaagttgtccctttgaaccccacctcggcttcttcagaggaagtgtggagatggctgtttgcaggaaggcagacgagacagtgtttaaaaagtccacaagaatgatcaagtaagatttgtttttattcttacagacatcacccgtgttcaagtttaaaagtacactttgcaactatttttcagaaatagaaattgattcaggactaaaactttaaactagagttgatgcttaatgtgatagagacatctctaaagtattttgaattttaaaaaaagatggcagattttctgcatttacactgtatattatatatatatttttattgtggttcttacccccttttccttctctgaagtgttaatgcttaagaaaagagttgcgcctgctgtgttcactgatcttgaaagctattattagattattgcagaacaaccctctgtaaattattaatttatctctctagcaacttaattttgtgcacattctaattaattaaacttcttccgtctaaaaaaagtgggggaaatgtatagctagtaacgttcaaaaaattttgtttgatgagtttaccgaatttttacagctttcctcctatactgtgttccttttgacccatttgtatattctcacttgaatgaagattgtttttttctttgtttttactggtagtgttctgatttgtgagtcgacactcagtaatggatgtcttaatcgtgtagacctgattcactgtctgaagtattgtttacttcgttacatatttaatggggattcccacattgtccccatgacacatgagcgctctcacttacccttacacacacacacacacacacacacacctctaacagaagggaagaagcagttggaagcatgaccgatgcaccattttctagttttaggtgcatttgccacttggtgtttgcccttcagattttagatttcaccaaggtatttcagtcttccagttttcaattgctttgttggctacatgttaatatttataggaatacttcagtttttccttttggaggtttgtttgtagaaaaactaatttgaactataagaaagacagtgcactgcttgtaaattcacattgtttggaaaaattcttttggaacaaaaaattaggtacatgataactggtaccttatctactgtaaatatttcattaaaaatgatgcacacatagatatattcttacaaattttgctgtattgctgttctctttgaggctctccaaagtcttgagttctgtatatggcctggtttcttgtttttattaatagatggtttatttactatggtaatgtattaatttatttttggtgttgttcgattgtctttcattgaagagataattttaatgttttattggcaacgtatgctgctttttcattaaaatatgctattaaaattaaatggcttttaaaa

SEQ ID NO: 1729 - DNA, 2474 bp, Homo sapiens
aggatcaagggaatcgtggctgcctgccccactgagcccactgccccaaccccctctccttcttgtgccagatcccttgggattggagccgctgtgagcagtggctaggcatttgagcacctctgtctctgccttgctccatagcagctgctgtgctgaacaccgctcttccggcaccggtacaagctgccgcaccagtacaggcctcctcgacggcccaaccccggccaccagcccagccccagacgctgttccagacccagccgctgctgcagaccacacctgccatcctcccgcagcccactgctgccaccgctgctgcccctacccccaagccagtggacacccccccacagatcaccgtccagcctgcaggcttcgcatttagcccaggaatcatcagtgctgcttccctcgggggacagacccagatcctggggtccctcactacagctccagtcattaccagcgccattcccagcatgccagggatcagcagtcagatcctcaccaatgctcagggacaggttattggaacccttccatgggtagtgaactcagctagtgtggcggccccagcaccagcccaaagcctgcaggtccaggccgtgaccccccagctgttgttgaacgcccagggccaggtgattgcgaccctggctagcagccccctgcctccacctgtggctgtccggaagccaagcacacctgagtcccctgctaagagtgaggtgcagcccatccagcccacaccaaccgtgccccagcctgctgtggtcattgccagcccagctccagccgccaagccatctgcctctgctcctatcccaattacctgctcagagacccccaccgtcagccagttggtgtccaagccacatactccaagtctggatgaggatgggatcaacttagaagagatccgggagtttgccaagaactttaagatccggcggctctcgctgggccttacacagacccaggtgggtcaggctctgactgcaacggaaggtccagcctacagccagtcagccatctgccggttcgagaagctagacatcacacccaagagtgcccagaagctaaagccggtgctggaaaagtggctaaacgaagctgaactgcggaaccaggaaggccagcagaacctgatggagtttgtgggaggcgagccctccaagaaacgcaaacgccgcacctccttcaccccccaggccatagaggctctcaatgcctattttgagaagaacccactgcccacaggccaggagatcactgaaattgctaaggagctcaactacgaccgtgaggtagtgcgggtctggttctgcaatcggcgccagacgctcaagaacaccagcaagctgaacgtctttcagatcccttagggctcagcccctggccctgtgttctagcactttgtccatttcccgtggcatccggctgcagccactgccatgacagcacctgtcattttgccacgtgcagctgtgctcaccccaggtcatcagactccaccgtgtgcatgtgcatcaatgtccctcttttctcccacacatctcacatcatggggaggccagagggggccacacgagagctccaggctctgggctggtcactccgaagaagaggatttgtgacgtcacttagagaagcaccttgctagcatggtttctgaagggtgaattctggtggggaaccagaaactccctgtctttggggcagggctaaagcagctcctaaggaccactggccattagctcttgcttttgatggcattctctttccaccttgtcttctcctttgctcctctgtgttagtgtggcaggtatgacaactcatccagtggaaacacagcctcacactgcccttccgccccccacactttgcctgcaggtgcaccgaaaggacctgggagataaaattcaaaaaagtgtgatgtgctgctcagaaggtcagactccatgtctgccttgacctcaaggtcagaaggttcccaaacccctggggctggaacatgggatctcctcttccacctcttcctggttcctttgcggggaaaattgcactaaaacagaaccttttcttaatccatgttggaaggaagcaacagtgaactctacctgttctggagttctcctgggtctgcagaaggttgggaatttagaaaataaggctgttctttcatattttaatttaatctctgtcaatggccatccctcccacaaaaaaacgtgggttaagagaacttgcagactggatatgcaagcaaacgggcaactctggagaaaaataaggaaaggaatgctgactttctctttctttctcttgtccccacacccattcccaacccaatactggggccttctcaaaaggagcaaattaaacaataaaccagacagcaaggccctgggggaaaggacaacatcctgaaataaatgatggagcccaggaaggtctcttgtggaagttga

SEQ ID NO: 1730 - DNA, 5157 bp, Homo sapiens
aatcggtggccgccagacacccgcggcgaaggcggctcgggctcgggctccggatgtgctaggtgtgggccggcccccacccgaccctgacaagtgaccatggatcctggagccgggtcagagacatctctgactgtcaatgagcaggtcatcgtgatgtcaggtcatgagaccatccgagtgctggaagtcggagtggatgcccaactccctgctgaggaagagagcaaaggactggagggtgtggccgccgagggctcccagagcggagaccctgctgaagccagtcaagctgctggtgaagctgggccagacaacctgggctcctctgcagaggcaactgtgaagtcacccccggggatccctccgagccctgccactgccattgccaccttcagccaagccccaagccagcctcaggcatcgcagaccctgacgccactggctgtacaagctgccccccagtattgcaggtcaagtggctggtcagcaggggctggccgtgtggacaattcctacagcaactgtggctgccctcccaggactgaccgctgcttctcctacggggggagtgttcaagccacctttagccggtctccaagcagctgctgtgctgaacaccgctcttccggcaccggtacaagctgccgcaccagtacaggcctcctcgacggcccaaccccggccaccagcccagccccagacgctgttccagacccagccgctgctgcagaccacacctgccatcctcccgcagcccactgctgccaccgctgctgcccctacccccaagccagtggacacccccccacagatcaccgtccagcctgcaggcttcgcatttagcccaggaatcatcagtgctgcttccctcgggggacagacccagatcctggggtccctcactacagctccagtcattaccagcgccattcccagcatgccagggatcagcagtcagatcctcaccaatgctcagggacaggttattggaacccttccatgggtagtgaactcagctagtgtggcggccccagcaccagcccaaagcctgcaggtccaggccgtgaccccccagctgttgttgaacgcccagggccaggtgattgcgaccctggctagcagccccctgcctccacctgtggctgtccggaagccaagcacacctgagtcccctgctaagagtgaggtgcagcccatccagcccacaccaaccgtgccccagcctgctgtggtcattgccagcccagctccagccgccaagccatctgcctctgctcctatcccaattacctgctcagagacccccaccgtcagccagttggtgtccaagccacatactccaagtctggatgaggatgggatcaacttagaagagatccgggagtttgccaagaactttaagatccggcggctctcgctgggccttacacagacccaggtgggtcaggctctgactgcaacggaaggtccagcctacagccagtcagccatctgccggttcgagaagctagacatcacacccaagagtgcccagaagctaaagccggtgctggaaaagtggctaaacgaagctgaactgcggaaccaggaaggccagcagaacctgatggagtttgtgggaggcgagccctccaagaaacgcaaacgccgcacctccttcaccccccaggccatagaggctctcaatgcctattttgagaagaacccactgcccacaggccaggagatcactgaaattgctaaggagctcaactacgaccgtgaggtagtgcgggtctggttctgcaatcggcgccagacgctcaagaacaccagcaagctgaacgtctttcagatcccttagggctcagcccctggccctgtgttctagcactttgtccatttcccgtggcatccggctgcagccactgccatgacagcacctgtcattttgccacgtgcagctgtgctcaccccaggtcatcagactccaccgtgtgcatgtgcatcaatgtccctcttttctcccacacatctcacatcatggggaggccagagggggccacacgagagctccaggctctgggctggtcactccgaagaagaggatttgtgacgtcacttagagaagcaccttgctagcatggtttctgaagggtgaattctggtggggaaccagaaactccctgtctttggggcagggctaaagcagctcctaaggaccactggccattagctcttgcttttgatggcattctctttccaccttgtcttctcctttgctcctctgtgttagtgtggcaggtatgacaactcatccagtggaaacacagcctcacactgcccttccgccccccacactttgcctgcaggtgcaccgaaaggacctgggagataaaattcaaaaaagtgtgatgtgctgctcagaaggtcagactccatgtctgccttgacctcaaggtcagaaggttcccaaacccctggggctggaacatgggatctcctcttccacctcttcctggttcctttgcggggaaaattgcactaaaacagaaccttttcttaatccatgttggaaggaagcaacagtgaactctacctgttctggagttctcctgggtctgcagaaggttgggaatttagaaaataaggctgttctttcatattttaatttaatctctgtcaatggccatccctcccacaaaaaaacgtgggttaagagaacttgcagactggatatgcaagcaaacgggcaactctggagaaaaataaggaaaggaatgctgactttctctttctttctcttgtccccacacccattcccaacccaatactggggccttctcaaaaggagcaaattaaacaataaaccagacagcaaggccctgggggaaaggacaacatcctgaaataaatgatggagcccaggaaggtctcttgtggaagttgacttaactctaattttctttgtaactttaagccttggatacgggaggagaaatctcattttgtcgagtctcagaccatgtctgtgtgtaagcaatccccacagtgtcctctgagccaaggacacccccagatcagattgagttttgcttctagacggggtagctatggtaccttgggggttagctctcatccaagctgttaagtgagtttccagcctcactgtggctggaaagcccctaaaattcagtatgtaactccaggaagtcaggagagaactgagatttgcctagatgaccacaggcttgcggtgtagattatccctaaagggccccaagtcacgggggtcaaccacccctgtcttcagtactcttatccttacagaggctggtctctaacagctgcctccagtggacctcccatgatccaccctgagggaaggaccgtcagctggggacacatcaccacctctgtcagtcactggtgcagagccacctcctagcctagcttcctctggtgtcctgtttcctttcccacttactgttggtgcctcccaggccctgcagtgccagcgtggccaccctcttggtagcctggccagtaagaggaggacagttgtgtgctgaattagcacacgcacgtgcagcgcgcacagacgcgcgcacacacacacacatacacgctctgctgcatttggacaaaccatgcctgccagagtgtagcagaggtgaggaagcaggtgggcagcttgcctgacccagcttttcaggagagcgtgtctccaacagagagtctccacactctagttcagggttatcgacctgcctcaatgagatgacagactcatttgggaggggtgttgcaaacaagttttcagtgagaatagttaagttccagagcttgtaaaggattcagtgactgacacttcagtaaattaggccaggcacattggcttatgcctgtaattccaacactttggaaggccgaggtgggcggatcatttgaggtctggagttcgagaccagcctgaccaacatggtgaaaccccgtctctactaaaaatacaaaaattagccaggtgtggtagtgcacatctgtaatcccagctacttgggaggtggaggcaggagaattgcttgaaccctggaggttgcaatgagctgagatcacactacttcactccagcctgggtgacagagcaagactcggtctcaaacaaacaaaaacttatggcgatgcaggttttcatgctcagacgcttgcattcaggtatgctttcttttttgagagagacaaatgggtcacagctggcaccctgggaatagcacataatccagggtgtgtctgtggtggtggacgtgcaggggaacaccatctgtcctgtgtcatgatgggaaaacaatcatgaaccactggtctaaattaggcctggccatgctttctcagcccctccctcatttaaatttgtcttcccaaagctgagctaaaactaaaccatttctcctctgctggaatgatggattggtcattcagaggaacaataccaggggtgggaggtttgcaggctgagttccccaggcatgggggtgcagggtgtccctgaggtttacccaaagcacagctcgctggcctgtgacctctgcccttcctcccacagtgtaagaccccccaggaagcagctggggcctgaacctctcacctaggaggtaggtttattttattttttgttagcatcaggctctgaaggagttggtatacattttgttttgaaaacatcttctggacttacaccagagcttagtgtcgtctttactatggaaagagaggagaatggacagaaatggtttaactgtgtggagttttgtttgttttgttttaaatggaagaaagaccaaaactttcctggtggatcagctagggcctttgaccctgcattaccacggcattttatccaggtgaagtccagggaaagaactcagccaaatggactaaggaacacacgagtttggaatgcgagactctgacatttttgtgttcttggaaatccaattaccttcccatgcccagatttccttcctgcctcttggaccaggctctggcactgaggttctcactgttcccaacacagacaaagcttcctgagggctggaggggcagcaaggggagaggagaatggggaagaagcgcttgatgtagttgtgtggaataaacagtattttttcttttgta

SEQ ID NO: 1731 - DNA, 207 bp, Homo sapiens
atttagcccaggaatcgctcttcctccacccacagatcagtgctgcttccctcgggggacagacccagatcctggggtccctcactacagctccagtcattaccagcgccattcccagcatgccagggatcagcagtcagatcctcaccaatgctcagggacaggttattggaacccttccatgggtagtgaactcagctagtgtgg

SEQ ID NO: 1732 - DNA, 2183 bp, Homo sapiens
gaagcccacattcacatctacccaccccaatgccctctgtcctcttccctctgcccggggttcttctcaccccttggcttctgagcaaggctcttcctccacccacagatcagtgctgcttccctcgggggacagacccagatcctggggtccctcactacagctccagtcattaccagcgccattcccagcatgccagggatcagcagtcagatcctcaccaatgctcagggacaggttattggaacccttccatgggtagtgaactcagctagtgtggcggccccagcaccagcccaaagcctgcaggtccaggccgtgaccccccagctgttgttgaacgcccagggccaggtgattgcgaccctggctagcagccccctgcctccacctgtggctgtccggaagccaagcacacctgagtcccctgctaagagtgaggtgcagcccatccagcccacaccaaccgtgccccagcctgctgtggtcattgccagcccagctccagccgccaagccatctgcctctgctcctatcccaattacctgctcagagacccccaccgtcagccagttggtgtccaagccacatactccaagtctggatgaggatgggatcaacttagaagagatccgggagtttgccaagaactttaagatccggcggctctcgctgggccttacacagacccaggtgggtcaggctctgactgcaacggaaggtccagcctacagccagtcagccatctgccggttcgagaagctagacatcacacccaagagtgcccagaagctaaagccggtgctggaaaagtggctaaacgaagctgaactgcggaaccaggaaggccagcagaacctgatggagtttgtgggaggcgagccctccaagaaacgcaaacgccgcacctccttcaccccccaggccatagaggctctcaatgcctattttgagaagaacccactgcccacaggccaggagatcactgaaattgctaaggagctcaactacgaccgtgaggtagtgcgggtctggttctgcaatcggcgccagacgctcaagaacaccagcaagctgaacgtctttcagatcccttagggctcagcccctggccctgtgttctagcactttgtccatttcccgtggcatccggctgcagccactgccatgacagcacctgtcattttgccacgtgcagctgtgctcaccccaggtcatcagactccaccgtgtgcatgtgcatcaatgtccctcttttctcccacacatctcacatcatggggaggccagagggggccacacgagagctccaggctctgggctggtcactccgaagaagaggatttgtgacgtcacttagagaagcaccttgctagcatggtttctgaagggtgaattctggtggggaaccagaaactccctgtctttggggcagggctaaagcagctcctaaggaccactggccattagctcttgcttttgatggcattctctttccaccttgtcttctcctttgctcctctgtgttagtgtggcaggtatgacaactcatccagtggaaacacagcctcacactgcccttccgccccccacactttgcctgcaggtgcaccgaaaggacctgggagataaaattcaaaaaagtgtgatgtgctgctcagaaggtcagactccatgtctgccttgacctcaaggtcagaaggttcccaaacccctggggctggaacatgggatctcctcttccacctcttcctggttcctttgcggggaaaattgcactaaaacagaaccttttcttaatccatgttggaaggaagcaacagtgaactctacctgttctggagttctcctgggtctgcagaaggttgggaatttagaaaataaggctgttctttcatattttaatttaatctctgtcaatggccatccctcccacaaaaaaacgtgggttaagagaacttgcagactggatatgcaagcaaacgggcaactctggagaaaaataaggaaaggaatgctgactttctctttctttctcttgtccccacacccattcccaacccaatactggggccttctcaaaaggagcaaattaaacaataaaccagacagcaaggccctgggggaaaggacaacatcctgaaataaatgatggagcccaggaaggtctcttgtggaagttg

SEQ ID NO: 1733 - DNA, 2516 bp, Homo sapiens
agtctgatccgggctgggggcgtgtacactcggcgcacctgcgagactacagagcctcgggccggcacgtgtggggagtgtggacacgtctgctgcgccccgcttctcgctgctgaggggaagggagggggcgggcaggtgcagcggccgggctagtgggagggggcggcggccatggagcgggtgaacgacgcttcgtgcggcccgtctggctgctacacataccaggtgagcagacacagcacggagatgctgcacaacctgaaccagcagcgcaaaaacggcgggcgcttctgcgacgtgctcttgcgggtaggcgacgagagcttcccagcgcaccgcgccgtgctggccgcctgcagcgagtactttgagtcggtgttcagcgcccagttgggcgacggcggagctgcggacgggggtccggctgatgtagggggcgcgacggcagcaccaggcggcggggccgggggcagccgggagctggagatgcacactatcagctccaaggtatttggggacattctggacttcgcctacacttcccgcatcgtggtgcgcttggagagctttcccgaactcatgacggccgccaagttcctgctgatgaggtcggttatcgagatctgccaggaagtcatcaaacagtccaacgtacagatcctggtaccccctgcccgcgccgatataatgctctttcgcccccctgggacctcggacttgggcttccctttggacatgaccaacggggcagccttggcagccaacagcaatggcatcgccggcagcatgcagccagaggaggaggcagctcgggcggctggtgcagccattgcaggccaagcctctttgcctgtgttacctggggtggaccgcttgcccatggtggctggacccctatccccccaactgctgacttccccattccccagtgtggcatccagtgcccctcccctgactggcaagcgaggccggggccgcccaaggaaggccaacctgctggactcaatgtttgggtccccagggggcctgagggaggcaggcatccttccatgcggtctatgtggtaaggtgttcactgatgccaaccggctccggcagcacgaggcccagcacggtgtcaccagcctccagctgggctacatcgaccttcctcctccgaggctgggtgagaatgggctacccatctctgaagaccccgacggcccccgaaagaggagccggaccaggaagcaggtggcttgtgagatctgcggcaagatcttccgtgatgtgtatcatcttaaccggcacaagctgtcccactctggggagaagccctactcctgccctgtgtgtgggttgcggttcaagagaaaagaccgcatgtcctaccatgtgcggtcccatgatgggtccgtgggcaagccttacatctgccagagctgtgggaaaggcttctccaggcctgatcacttgaacggacatatcaagcaggtgcacacttctgagcggcctcacaagtgtcaggtgtgggttgggagcagcagcggcctgccgcccctggaacctcttcctagcgacctgccatcatgggactttgcccagcctgctttgtggaggtcgtcccattcggttcctgacaccgccttttccctttctctaaaaaaatcattcccagcccttgaaaacctgggcccagcacactccagcaacactctcttctgcccagccccgccgggatatctgaggcagggctggaccaccccagagggcagcagggcctttacccagtggcctgttggctagcctgggcctccctggagagggttgacagtggaagggaacaggaggggcatttggcctgagacccctgcttttgggagaggctagcagggtggttcctgcccagcatgcccagctcctccctgggtgactcggagtctttcccatgtcagagcccccaaatgggggtagcaaggagcacctttctggaaccccctatagcatccaagtttctttctgggctctcttgccttttcccccctttcacagatggcacccctgggcatctgtccttgcctaggtgattttggaggttggtgccttcctgggaactagccaccagcttatctgcttcccttcccctggcatcacttcccataggcctggggtttctagactggggcctggccacccctttccccactccacgagtgagtcggcctccagagaagactggcacaattccaactagagtcaacccatgctgccctctgcccttcccactcagatctagatcctgctttcatttctggctagtgaagtagacttttgtgtttttgaggtttattagcaggtctgctcaggaaccaaactaatgagtagctttatattgggccaccccaatatatggctttgggggctgaaaaagcagatgtagaccccctccctcggatccttattggtgtgccctttagcactccgcagactctgcggggtgaacaggagtgatgataaaatttttcattctaaca

SEQ ID NO: 1734 - DNA, 3781 bp, Homo sapiens
gctccagccgccgccgccgccgccaccgccctccaggctccgggacccggcccgcgccaccgcccccgtgcgcgccccgccgccgccgccttcgccttcgccttttgtttcctccgctccggcgcccccgccccggctcgcgctttgcaggggacgcagcgcgcgcccccagcgggcccgggaaaagccgcggcgcgcgcgcgcgcctgcgcggcggacccctccttctcctccccgcgtgcgcgtgcccttcttggctgcgcgccggcgccgcctggcgggcgggaggggaggtggcaggcgcgtttgcaggaggggcgcacctcttcgctcgcgcacccccccggaaggtagaccgggaaggggaggcgggcgggcggagaggagagagtggcgcgcagtccagcgagggcgggggttggctatgtggggggtggtgcaccccgcagtctagacagtctgatccgggctgggggcgtgtacactcggcgcacctgcgagactacagagcctcgggccggcacgtgtggggagtgtggacacgtctgctgcgccccgcttctcgctgctgaggggaagggagggggcgggcaggtgcagcggccgggctagtgggagggggcggcggccatggagcgggtgaacgacgcttcgtgcggcccgtctggctgctacacataccaggtgagcagacacagcacggagatgctgcacaacctgaaccagcagcgcaaaaacggcgggcgcttctgcgacgtgctcttgcgggtaggcgacgagagcttcccagcgcaccgcgccgtgctggccgcctgcagcgagtactttgagtcggtgttcagcgcccagttgggcgacggcggagctgcggacgggggtccggctgatgtagggggcgcgacggcagcaccaggcggcggggccgggggcagccgggagctggagatgcacactatcagctccaaggtatttggggacattctggacttcgcctacacttcccgcatcgtggtgcgcttggagagctttcccgaactcatgacggccgccaagttcctgctgatgaggtcggttatcgagatctgccaggaagtcatcaaacagtccaacgtacagatcctggtaccccctgcccgcgccgatataatgctctttcgcccccctgggacctcggacttgggcttccctttggacatgaccaacggggcagccttggcagccaacagcaatggcatcgccggcagcatgcagccagaggaggaggcagctcgggcggctggtgcagccattgcaggccaagcctctttgcctgtgttacctggggtggaccgcttgcccatggtggctggacccctatccccccaactgctgacttccccattccccagtgtggcatccagtgcccctcccctgactggcaagcgaggccggggccgcccaaggaaggccaacctgctggactcaatgtttgggtccccagggggcctgagggaggcaggcatccttccatgcggtctatgtggtaaggtgttcactgatgccaaccggctccggcagcacgaggcccagcacggtgtcaccagcctccagctgggctacatcgaccttcctcctccgaggctgggtgagaatgggctacccatctctgaagaccccgacggcccccgaaagaggagccggaccaggaagcaggtggcttgtgagatctgcggcaagatcttccgtgatgtgtatcatcttaaccggcacaagctgtcccactctggggagaagccctactcctgccctgtgtgtgggttgcggttcaagagaaaagaccgcatgtcctaccatgtgcggtcccatgatgggtccgtgggcaagccttacatctgccagagctgtgggaaaggcttctccaggcctgatcacttgaacggacatatcaagcaggtgcacacttctgagcggcctcacaagtgtcagacctgcaatgcttcttttgccacccgagaccgtctgcgctcccacctggcctgtcatgaagacaaggtgccctgccaggtgtgtgggaagtacttgcgggcagcatacatggcagaccacctgaagaagcacagcgaggggcccagcaacttctgcagtatctgtaaccgaggtttctcctctgcctcctacttaaaggtccatgttaaaacccaccacggtgttccccttccccaggtctccaggcaccaggagcccatcctgaatgggggagcagcgttccactgcgccaggacctatggcaacaaagaaggccagaaatgctcacatcaggatccgattgagagctctgactcctatggtgacctctcagatgccagcgacctgaagacgccagagaagcagagtgccaatggctctttctcctgcgacatggcagtccccaaaaacaaaatggagtctgatggggagaagaagtacccatgccctgaatgtgggagcttcttccgctctaagtcctacttgaacaaacacatccagaaggtgcatgtccgggctctcgggggccccctgggggacctgggccctgcccttggctcacctttctctcctcagcagaacatgtctctcctcgagtcctttgggtttcagattgttcagtcggcatttgcgtcatctttagtagatcctgaggttgaccagcagcccatggggcctgaagggaaatgaggcagctgctgtgtccccacggaaacaaccatctggggactgctgggaaatgctgtgaatgcggagggaagtgatgtttgggttctgtagctgagagatttttattcatttttaactgccccccaaccccactccaactccttctccaccacccattctcccaatggtctttagaaatagattttcatctgatattctgcagaaatatcaatgagacttggtatgggacaggggcagaaaacactacataggcctccaaggcaaaaccagtcccagtttctttaatgggaagaagctggaattcctggtgctcaattcttagtgaccccaatcctatacccaaatctatgatattctgggacctcagtgattttggtcccctcccacttctctagttcgtcatcctcccttcccatatccttcaaaagaaccacactagggtctccacctacttatacaatgcggatgcccaactgtttttaaggaagccagaagcatcccatggaccatggggtgagtgtcctccaagagccccctgagctcagccctctgcctggagggctccagacctttctgagccctgcttggaggcgagcattttcactgctaggacaagctcagctgttgaggacacccccaccccaaatttcagttcttacgtgattttaaccattcaacatgctgttgggttttaattctctaattattattattattgttattattttttaggaccagttgtagtgaattgctactgaaagctatcccaggtgatacagagctctttgtaaaccgcagtcacacattagggttagtattaaactttgtttagatgtaccataattaacttggctagttgattgtttgaagtctatggaagaaatagttttatgcaaaattttaaaaaatgccagtctggtcagggaagtagggggtttcaatgctgttgggaaccaggaaggtgggacagccggcaggtagggacattgtgtacctcagttgtgtcacatgtgagcaagcccaggttgaccttgtgatgtgaattgatctgatcagactgtattaaaaatgttagtacattactcta

SEQ ID NO: 1735 - DNA, 3638 bp, Homo sapiens
gctccagccgccgccgccgccgccaccgccctccaggctccgggacccggcccgcgccaccgcccccgtgcgcgccccgccgccgccgccttcgccttcgccttttgtttcctccgctccggcgcccccgccccggctcgcgctttgcaggggacgcagcgcgcgcccccagcgggcccgggaaaagccgcggcgcgcgcgcgcgcctgcgcggcggacccctccttctcctccccgcgtgcgcgtgcccttcttggctgcgcgccggcgccgcctggcgggcgggaggggaggtggcaggcgcgtttgcaggaggggcgcacctcttcgctcgcgcacccccccggaaggtagaccgggaaggggaggcgggcgggcggagaggagagagtggcgcgcagtccagcgagggcgggggttggctatgtggggggtggtgcaccccgcagtctagacagtctgatccgggctgggggcgtgtacactcggcgcacctgcgagactacagagcctcgggccggcacgtgtggggagtgtggacacgtctgctgcgccccgcttctcgctgctgaggggaagggagggggcgggcaggtgcagcggccgggctagtgggagggggcggcggccatggagcgggtgaacgacgcttcgtgcggcccgtctggctgctacacataccaggtgagcagacacagcacggagatgctgcacaacctgaaccagcagcgcaaaaacggcgggcgcttctgcgacgtgctcttgcgggtaggcgacgagagcttcccagcgcaccgcgccgtgctggccgcctgcagcgagtactttgagtcggtgttcagcgcccagttgggcgacggcggagctgcggacgggggtccggctgatgtagggggcgcgacggcagcaccaggcggcggggccgggggcagccgggagctggagatgcacactatcagctccaaggtatttggggacattctggacttcgcctacacttcccgcatcgtggtgcgcttggagagctttcccgaactcatgacggccgccaagttcctgctgatgaggtcggttatcgagatctgccaggaagtcatcaaacagtccaacgtacagatcctggtaccccctgcccgcgccgatataatgctctttcgcccccctgggacctcggacttgggcttccctttggacatgaccaacggggcagccttggcagccaacagcaatggcatcgccggcagcatgcagccagaggaggaggcagctcgggcggctggtgcagccattgcaggccaagcctctttgcctgtgttacctggggtggaccgcttgcccatggtggctggacccctatccccccaactgctgacttccccattccccagtgtggcatccagtgcccctcccctgactggcaagcgaggccggggccgcccaaggaaggccaacctgctggactcaatgtttgggtccccagggggcctgagggaggcaggcatccttccatgcggtctatgtggtaaggtgttcactgatgccaaccggctccggcagcacgaggcccagcacggtgtcaccagcctccagctgggctacatcgaccttcctcctccgaggctgggtgagaatgggctacccatctctgaagaccccgacggcccccgaaagaggagccggaccaggaagcaggtggcttgtgagatctgcggcaagatcttccgtgatgtgtatcatcttaaccggcacaagctgtcccactctggggagaagccctactcctgccctgtgtgtgggttgcggttcaagagaaaagaccgcatgtcctaccatgtgcggtcccatgatgggtccgtgggcaagccttacatctgccagagctgtgggaaaggcttctccaggcctgatcacttgaacggacatatcaagcaggtgcacacttctgagcggcctcacaagtgtcagacctgcaatgcttcttttgccacccgagaccgtctgcgctcccacctggcctgtcatgaagacaaggtgccctgccaggtgtgtgggaagtacttgcgggcagcatacatggcagaccacctgaagaagcacagcgaggggcccagcaacttctgcagtatctgtaaccgagaaggccagaaatgctcacatcaggatccgattgagagctctgactcctatggtgacctctcagatgccagcgacctgaagacgccagagaagcagagtgccaatggctctttctcctgcgacatggcagtccccaaaaacaaaatggagtctgatggggagaagaagtacccatgccctgaatgtgggagcttcttccgctctaagtcctacttgaacaaacacatccagaaggtgcatgtccgggctctcgggggccccctgggggacctgggccctgcccttggctcacctttctctcctcagcagaacatgtctctcctcgagtcctttgggtttcagattgttcagtcggcatttgcgtcatctttagtagatcctgaggttgaccagcagcccatggggcctgaagggaaatgaggcagctgctgtgtccccacggaaacaaccatctggggactgctgggaaatgctgtgaatgcggagggaagtgatgtttgggttctgtagctgagagatttttattcatttttaactgccccccaaccccactccaactccttctccaccacccattctcccaatggtctttagaaatagattttcatctgatattctgcagaaatatcaatgagacttggtatgggacaggggcagaaaacactacataggcctccaaggcaaaaccagtcccagtttctttaatgggaagaagctggaattcctggtgctcaattcttagtgaccccaatcctatacccaaatctatgatattctgggacctcagtgattttggtcccctcccacttctctagttcgtcatcctcccttcccatatccttcaaaagaaccacactagggtctccacctacttatacaatgcggatgcccaactgtttttaaggaagccagaagcatcccatggaccatggggtgagtgtcctccaagagccccctgagctcagccctctgcctggagggctccagacctttctgagccctgcttggaggcgagcattttcactgctaggacaagctcagctgttgaggacacccccaccccaaatttcagttcttacgtgattttaaccattcaacatgctgttgggttttaattctctaattattattattattgttattattttttaggaccagttgtagtgaattgctactgaaagctatcccaggtgatacagagctctttgtaaaccgcagtcacacattagggttagtattaaactttgtttagatgtaccataattaacttggctagttgattgtttgaagtctatggaagaaatagttttatgcaaaattttaaaaaatgccagtctggtcagggaagtagggggtttcaatgctgttgggaaccaggaaggtgggacagccggcaggtagggacattgtgtacctcagttgtgtcacatgtgagcaagcccaggttgaccttgtgatgtgaattgatctgatcagactgtattaaaaatgttagtacatta

SEQ ID NO: 1736 - DNA, 3711 bp, Homo sapiens
gctccagccgccgccgccgccgccaccgccctccaggctccgggacccggcccgcgccaccgcccccgtgcgcgccccgccgccgccgccttcgccttcgccttttgtttcctccgctccggcgcccccgccccggctcgcgctttgcaggggacgcagcgcgcgcccccagcgggcccgggaaaagccgcggcgcgcgcgcgcgcctgcgcggcggacccctccttctcctccccgcgtgcgcgtgcccttcttggctgcgcgccggcgccgcctggcgggcgggaggggaggtggcaggcgcgtttgcaggaggggcgcacctcttcgctcgcgcacccccccggaaggtagaccgggaaggggaggcgggcgggcggagaggagagagtggcgcgcagtccagcgagggcgggggttggctatgtggggggtggtgcaccccgcagtctagacagtctgatccgggctgggggcgtgtacactcggcgcacctgcgagactacagagcctcgggccggcacgtgtggggagtgtggacacgtctgctgcgccccgcttctcgctgctgaggggaagggagggggcgggcaggtgcagcggccgggctagtgggagggggcggcggccatggagcgggtgaacgacgcttcgtgcggcccgtctggctgctacacataccaggtgagcagacacagcacggagatgctgcacaacctgaaccagcagcgcaaaaacggcgggcgcttctgcgacgtgctcttgcgggtaggcgacgagagcttcccagcgcaccgcgccgtgctggccgcctgcagcgagtactttgagtcggtgttcagcgcccagttgggcgacggcggagctgcggacgggggtccggctgatgtagggggcgcgacggcagcaccaggcggcggggccgggggcagccgggagctggagatgcacactatcagctccaaggtatttggggacattctggacttcgcctacacttcccgcatcgtggtgcgcttggagagctttcccgaactcatgacggccgccaagttcctgctgatgaggtcggttatcgagatctgccaggaagtcatcaaacagtccaacgtacagatcctggtaccccctgcccgcgccgatataatgctctttcgcccccctgggacctcggacttgggcttccctttggacatgaccaacggggcagccttggcagccaacagcaatggcatcgccggcagcatgcagccagaggaggaggcagctcgggcggctggtgcagccattgcaggccaagcctctttgcctgtgttacctggggtggaccgcttgcccatggtggctggacccctatccccccaactgctgacttccccattccccagtgtggcatccagtgcccctcccctgactggcaagcgaggccggggccgcccaaggaaggccaacctgctggactcaatgtttgggtccccagggggcctgagggaggcaggcatccttccatgcggtctatgtggtaaggtgttcactgatgccaaccggctccggcagcacgaggcccagcacggtgtcaccagcctccagctgggctacatcgaccttcctcctccgaggctgggtgagaatgggctacccatctctgaagaccccgacggcccccgaaagaggagccggaccaggaagcaggtggcttgtgagatctgcggcaagatcttccgtgatgtgtatcatcttaaccggcacaagctgtcccactctggggagaagccctactcctgccctgtgtgtgggttgcggttcaagagaaaagaccgcatgtcctaccatgtgcggtcccatgatgggtccgtgggcaagccttacatctgccagagctgtgggaaaggcttctccaggcctgatcacttgaacggacatatcaagcaggtgcacacttctgagcggcctcacaagtgtcagacctgcaatgcttcttttgccacccgagaccgtctgcgctcccacctggcctgtcatgaagacaaggtgccctgccaggtgtgtgggaagtacttgcgggcagcatacatggcagaccacctgaagaagcacagcgaggggcccagcaacttctgcagtatctgtaaccgaggtctccaggcaccaggagcccatcctgaatgggggagcagcgttccactgcgccaggacctatggcaacaaagaaggccagaaatgctcacatcaggatccgattgagagctctgactcctatggtgacctctcagatgccagcgacctgaagacgccagagaagcagagtgccaatggctctttctcctgcgacatggcagtccccaaaaacaaaatggagtctgatggggagaagaagtacccatgccctgaatgtgggagcttcttccgctctaagtcctacttgaacaaacacatccagaaggtgcatgtccgggctctcgggggccccctgggggacctgggccctgcccttggctcacctttctctcctcagcagaacatgtctctcctcgagtcctttgggtttcagattgttcagtcggcatttgcgtcatctttagtagatcctgaggttgaccagcagcccatggggcctgaagggaaatgaggcagctgctgtgtccccacggaaacaaccatctggggactgctgggaaatgctgtgaatgcggagggaagtgatgtttgggttctgtagctgagagatttttattcatttttaactgccccccaaccccactccaactccttctccaccacccattctcccaatggtctttagaaatagattttcatctgatattctgcagaaatatcaatgagacttggtatgggacaggggcagaaaacactacataggcctccaaggcaaaaccagtcccagtttctttaatgggaagaagctggaattcctggtgctcaattcttagtgaccccaatcctatacccaaatctatgatattctgggacctcagtgattttggtcccctcccacttctctagttcgtcatcctcccttcccatatccttcaaaagaaccacactagggtctccacctacttatacaatgcggatgcccaactgtttttaaggaagccagaagcatcccatggaccatggggtgagtgtcctccaagagccccctgagctcagccctctgcctggagggctccagacctttctgagccctgcttggaggcgagcattttcactgctaggacaagctcagctgttgaggacacccccaccccaaatttcagttcttacgtgattttaaccattcaacatgctgttgggttttaattctctaattattattattattgttattattttttaggaccagttgtagtgaattgctactgaaagctatcccaggtgatacagagctctttgtaaaccgcagtcacacattagggttagtattaaactttgtttagatgtaccataattaacttggctagttgattgtttgaagtctatggaagaaatagttttatgcaaaattttaaaaaatgccagtctggtcagggaagtagggggtttcaatgctgttgggaaccaggaaggtgggacagccggcaggtagggacattgtgtacctcagttgtgtcacatgtgagcaagcccaggttgaccttgtgatgtgaattgatctgatcagactgtattaaaaatgttagtacatta

SEQ ID NO: 1737 - DNA, 2476 bp, Homo sapiens
cccgcccacctcccccgtcggcccggccgtcccccggcgccggggagctccgggccgcccatgatgggctccgtgctcccggctgaggccctggtgctcaagaccgggctgaaggcgccgggactggcgctggccgaggttatcacctccgacatcctgcacagcttcctgtacggccgctggcgcaacgtgctcggggagcagctcttcgaggacaagagccaccacgccagccccaagacagccttcaccgccgaggtgctggcgcagtccttctccggcgaagtgcagaagctgtccagcctggtgctgcctgcggaggtgatcatcgctcagagctccatccctggcgagggcctcggcatcttctccaagacgtggatcaaggcgggaaccgagatgggccccttcaccggccgcgtgatcgccccggagcacgtggacatctgcaagaacaacaacctcatgtgggaggtgttcaatgaggatggcacggtgcgctacttcatcgatgccagccaggaggaccaccggagctggatgacctacatcaagtgtgcacgtaacgaacaggagcagaacctggaggtggtccagatcggcaccagcatcttctacaaggccattgagatgatcccacctgaccaggaactgctggtgtggtacggaaactcacacaacaccttcctggggatcccaggtgtgcccgggctagaggaggaccagaaaaagaacaagcatgaggacttccacccggcggactcggcggctggccccgcgggccgcatgcgatgcgtcatctgccaccgcggcttcaactcgcgcagcaacctgcgctcgcacatgcgcatccacacgctggacaagcccttcgtgtgccgcttctgcaaccgccgcttcagccagtcgtccacgctgcgcaaccacgtgcgcctgcacacgggcgagcgcccctacaagtgccaggtgtgccagagcgcctactcgcagctggccggcctgcgcgcccaccagaagagcgcgcggcaccggccgcccagcaccgcgctgcaggcacactcgcccgcgctgcccgccccgcacgcgcacgcgcccgcgctcgccgccgccgccgccgccgccgccgccgccgccgcgcaccacctgccggccatggtgctgtgagcgcgcccgcgcccccgccgggccccgcgcgctcctgggtccccggcaccccggccccgcagcgcgactcgccctccagccccaacccccggcccggcgccgccgcggagccccgcgcgctggggttgcgccccggaggcggatctcaggcacccccgccttggcccgtgtcgcagatgaggacactgagggcggcgtccctcacccaggccacgcagctggtgcggctgttcggccgcctcctctgggagggggtccccctgcctggcctcgcccccgagtctccctgctgctgtagagccgggcgcccaggccggcatccccctcgtgggtggcaggagagcggacttagagcccccgagggcccctcagcagaggaaggggagtcccctcctccgccaccgagagtcctgtgcttcggaatgaagggagggcgacctccttgtccgggtgtggtcgggcgcgggggttgtgggggcgccatctcctcttccggcccctgggactggtgtcctgaagtgtcgggagtccttacgcaaccttgacatgtgcgggctactggggtccatcggcagcgggaagagacccggagagatgcatcttctgggcccttctctcctttaggccagcttacccccaaacctggctcctggggacggatgaggaaggagctctttgcagtgcaccaggcacgttgagagtggaggcacaatggaaatcctctgtgggaccccgagcaagaccctgcacctctttgggcctcagtttccccatctgtaaaatgaaggagttggaccaatgccccctccccttcagctgtgacatcgtgcctgggaaggcgaaatatacccccagccccttccaacacacacactccagcgagaggagggcaagactggaaccgctgcccgagaggttaaggtggcttctgtggccacgaagcgcttccgagctgtgcccagtcccgggaattccgcccagtctgcccacacttccctcggtccctgcccgtttcctcaaattcgggccgtgcgcgccctctggtgtcgcctctcacactttgcagtcatttaccaggattcccgtagggcgttttgtaaaataaactataatattaatgaaaagtataaaatgtatagagttttcaagaaactgcgttctacttccagaagatggtcactttaaccttgtaaatatttatctaaaatgatatttacaaaactgtaatatattattatttgattgtatatgtacaactgtaaatacatttgtacctctcttgtattctaaaataaaaattacttggaacatt

SEQ ID NO: 1738 - DNA, 3234 bp, Homo sapiens
ccatgtgaccctctcgggtgggactctgcagctgcttcgcagcgcaactctctcaccaaactccgcgcccttgcgctagcggtgccaaaaggctcccgccccgattgaaaaggcgcagtgcatgcccgcccgcgtcactccgcgggcggaggacgcacgtcggggcgcggctctctggctagcgcgcagctccagctctgtcactcgcgcccttccaaggacctggagcacccgagcgcctgcctggtggcggcggcaacaatgcacggagccgccagagcgccagccaccagcgtgagtgccgactgctgcatcccggccggcttgcgcctcggaccggtgcctggtaccttcaagctgggcaagtacctgtcagaccgcagggagcccgggcctaagaaaaaggtattgaccattcagacctctgcccaccaggtgcgcatggtgagaggggagctggtggacgagtcggggggctcccctctggagtggatagggttaatccgggcagccagaaactcccaggaacagactctggaagctattgcagacttacccggaggacagatcttctaccgagcattgcgagacgtccagccaggggaggagctgacagtgtggtattctaactccttggctcagtggttcgacatccccaccacagcgactccgactcacgacgagaaaggggaggagcgctacatctgctggtactgctggaggacgtttagataccccaacagccttaaggcacacctgcgtttccactgcgtgttcagcggcggtggaggcggcgccttcctgcaccacgaacacgcggctcgccaaggcgccgtcccagcggctgatggcctcggtctctccccaaaacccccggcgcccgatttcgccgcgccttcccaggcaggaactttgcgaccccaccccctgggcccgccaccagttcaggcctgcggtgcgcgggagggcatcaagcgcgaggcctcttccgcgccctcggccacctcgccgaccccaggcaagtgggggcagcccaagaagggcaaggagcagctggaccgtgccctggacatgagcggagccgcccgaggacaagggcacttcctcggcatcgtgggcggctcctcggcgggggtcggcagcctggctttctaccccggcgtgcgctcagctttcaagcccgccggcctagcgagggcggcggcggccgctcacggcgacccctaccgggaggagagcagcagcaagcaaggagccggcctcgctttgggcaggctgctgggcgggggccgggcgtgcgggcgccccgggagcggggagaactcggcggcgggcggcgcgggtcaccaccatcaccaccacgcgcaccaccaccaccatcccaagtgcctgctcgctggggacccgccgccgccgccgccgcctggcctgccctgctctggggccctgcgcggcttccctctgctctccgtccccccggaagaggcgtccgccttcaagcacgtggagcgcgccccgcccgcagccgccgcgctgccaggagcgcgttatgcgcagctgccccctgcgccggggttgcccctcgagcgctgcgcgctgccgcccctcgacccgggcggtctcaaagcctatccgggtggtgagtgcagccacctgcccgccgtcatgccggcctttacagtctacaacggggagctgctctacggctcaccggccaccaccgcttattacccgctcaaattgcacttcggcgggctgctgaagtatccggagtccatctcctacttcagcgggcctgcagcggccgccctaagccccgccgagctggggtcgctggccagcatcgaccgagagatcgccatgcacaatcagcagctgtccgagatggctgccgggaagggtcgcggacgcctggactcggggacgttgccaccggccgtcgcggcggcgggaggcaccgggggcggcggcagcggaggcagcggcgcaggtaagcccaagaccggccacctgtgcctctactgtggcaagctgtactcgcgcaagtatgggctcaagatccacatgcggacgcacacgggctacaagccactcaagtgcaaagtctgtctgcggcccttcggcgaccccagcaatctcaacaagcacatccggctgcacgccgagggcaatacgccctaccgctgcgagttctgcggcaaggtacttgtgcgccgccgggacctggagcgacatgtcaagtcccgccaccctggccagagtctgctcgccaaagcgggcgacggcccgggtgccgagcccggctatcccccggagcctggggatcccaagagcgacgacagtgacgtggacgtctgcttcacagacgaccagagcgaccccgaggttgggggcggcggggagcgcgacttgtaacgagtcttcccgggaaggggcggggtgaggacagagaggagtcgagggtttattctcgcagtagaggaactcctggtggtgggaagagggacccaatggacaaaaccgtttttgtttttgagagggcgccagatttgaaacagtgagaggtcccacatctggtgctgaaactcagagcaacagttcagaggtggcgtaaatctggccacctggagagctcgagtgccaccagtacctccgcaccccgggcctctggacttcttggatgagctcaccctgaaccgcccaggcggtctgctcttggtgttcagaatcacatcaatgcgaacgtcacagcgccttcgagggcgcagattttaactgccacgtatttttaagttgtacttttctgtggaggaaattgtgccttttgaaacgacgttttgtgtgtgtatttcacgttagcatttcattgcataggcaaaacactagtcacaattgggtagatgtgacatccatatacttgtttacattttatctgttctcatgtcaaagactactccttgccccattgaatatatagtggtagcaggtgtacaaattggtcaagttgcaattatttatgagaaaataatgataaatgtaaaatatctaaagcatgaatctaagagcacgcaatatataattttaaagaaaatattctatttggtagaatacaaatgtggtgtgtgttgttttataatgactgctgtacagtgggtatagtattttggttttggttccagattgtgcaatctttaagaaaaataaagatacaaacgagagttttgttcacttagt

SEQ ID NO: 1739 - DNA, 2429 bp, Homo sapiens
gccattcagcggcctcgattatgcagggggctgagggaaccactccatgtgaccctctcgggtgggactctgcagctgcttcgcagcgcaactctctcaccaaactccgcgcccttgcgctagcggtgccaaaaggctcccgccccgattgaaaaggcgcagtgcatgcccgcccgcgtcactccgcgggcggaggacgcacgtcggggcgcggctctctggctagcgcgcagctccagctctgtcactcgcgcccttccaaggacctggagcacccgagcgcctgcctggtggcggcggcaacaatgcacggagccgccagagcgccagccaccagcgtgagtgccgactgctgcatcccggccggcttgcgcctcggaccggtgcctggtaccttcaagctgggcaagtacctgtcagaccgcagggagcccgggcctaagaaaaaggtgcgcatggtgagaggggagctggtggacgagtcggggggctcccctctggagtggatagggttaatccgggcagccagaaactcccaggaacagactctggaagctattgcagacttacccggaggacagatcttctaccgagcattgcgagacgtccagccaggggaggagctgacagtgtggtattctaactccttggctcagtggttcgacatccccaccacagcgactccgactcacgacgagaaaggggaggagcgctacatctgctggtactgctggaggacgtttagataccccaacagccttaaggcacacctgcgtttccactgcgtgttcagcggcggtggaggcggcgccttcctgcaccacgaacacgcggctcgccaaggcgccgtcccagcggctgatggcctcggtctctccccaaaacccccggcgcccgatttcgccgcgccttcccaggcaggaactttgcgaccccaccccctgggcccgccaccagttcaggcctgcggtgcgcgggagggcatcaagcgcgaggcctcttccgcgccctcggccacctcgccgaccccaggcaagtgggggcagcccaagaagggcaaggagcagctggaccgtgccctggacatgagcggagccgcccgaggacaagggcacttcctcggcatcgtgggcggctcctcggcgggggtcggcagcctggctttctaccccggcgtgcgctcagctttcaagcccgccggcctagcgagggcggcggcggccgctcacggcgacccctaccgggaggagagcagcagcaagcaaggagccggcctcgctttgggcaggctgctgggcgggggccgggcgtgcgggcgccccgggagcggggagaactcggcggcgggcggcgcgggtcaccaccatcaccaccacgcgcaccaccaccaccatcccaagtgcctgctcgctggggacccgccgccgccgccgccgcctggcctgccctgctctggggccctgcgcggcttccctctgctctccgtccccccggaagaggcgtccgccttcaagcacgtggagcgcgccccgcccgcagccgccgcgctgccaggagcgcgttatgcgcagctgccccctgcgccggggttgcccctcgagcgctgcgcgctgccgcccctcgacccgggcggtctcaaagcctatccgggtggtgagtgcagccacctgcccgccgtcatgccggcctttacagtctacaacggggagctgctctacggctcaccggccaccaccgcttattacccgctcaaattgcacttcggcgggctgctgaagtatccggagtccatctcctacttcagcgggcctgcagcggccgccctaagccccgccgagctggggtcgctggccagcatcgaccgagagatcgccatgcacaatcagcagctgtccgagatggctgccgggaagggtcgcggacgcctggactcggggacgttgccaccggccgtcgcggcggcgggaggcaccgggggcggcggcagcggaggcagcggcgcaggtaagcccaagaccggccacctgtgcctctactgtggcaagctgtactcgcgcaagtatgggctcaagatccacatgcggacgcacacgggctacaagccactcaagtgcaaagtctgtctgcggcccttcggcgaccccagcaatctcaacaagcacatccggctgcacgccgagggcaatacgccctaccgctgcgagttctgcggcaaggtacttgtgcgccgccgggacctggagcgacatgtcaagtcccgccaccctggccagagtctgctcgccaaagcgggcgacggcccgggtgccgagcccggctatcccccggagcctggggatcccaagagcgacgacagtgacgtggacgtctgcttcacagacgaccagagcgaccccgaggttgggggcggcggggagcgcgacttgtaa

SEQ ID NO: 1740 - DNA, 4710 bp, Homo sapiens
cgctgccccgtccacgccgcccgcgccccgcagtcccacccgcaggacccccggccgcgccagggtctcgcctgcgccccccgcgcccgcccgcggactacaagtcccgccatgccccgccgccgccccccggcttccggtgctgcgcagtttccggagcggatcgcaacccggagtccggatccgatcccgctctgcacattccaaaggcagccgcgcgccgccccggtccagccgccatgccgactgttctttgttacattcgccggctgcgggcaccgttggcgatcggagtcaaaacccggctggatttcccggagccgctccgggatcgccctgcgcgccgcccgcccgccggggtcttcgccgccccggcccgcggccccgcggcccccgccgccgggcggcgtcgtcgccgaggccccaggggatgtcgttatcccccgccctcgggtacagcccatgcgggtcgcacgggggggtccctggacccccaaccccgcgtttagagaagctgagtcctggtcccagattgggaaccagagggtcagtgagcagctcttggaaacatctctagggaatgaggtgtccgacactgagccactgagccctgcgagtgcaggcctgcgacgcaatcctgccctacctcctggaccctttgcacaaaacttttcctgggggaaccaggaaaatctgcccccagccctggggaagattgcgaacggaggaggaactggggcaggcaaggccgaatgcggctatgaaactgagtcacacttgctagagccgcacgagatacctttgaacgtgaatacacacaagttcagtgactgtgagtttccatatgagttttgcacggtctgcttttcacccttcaagctgctggggatgagcggggtggagggcgtgtggaatcagcattcaagaagtgccagcatgcacactttcctaaaccactcagcaacgggcatcagagaagcaggttgcaggaaggacatgccggtgtcagagatggctgaagatgggagcgaagagatcatgttcatctggtgtgaagactgcagccagtaccacgactccgaatgtcccgagctgggcccagtggtcatggtcaaagactcctttgtgttaagcagggcaaggtcttggcctgccagcggacacgtgcacacccaggcggggcaggggatgcggggttatgaggacagggacagggctgacccacagcagcttccagaagcagtccctgcaggcctggtgaggcggctcagtgggcagcagctgccctgccgttccaccctcacctgggggaggctgtgccacctggtggcccagggcaggtcatcccttcctcccaacttggagatcagacgactggaagatggagccgagggggtgttcgccatcactcagctcgtcaagcggacacagttcggtccctttgagtccaggagggtcgccaaatgggaaaaggagtctgcatttcccctgaaggtgttccagaaggacgggcaccccgtgtgcttcgacacctccaacgaggatgactgcaactggatgatgctggtgcggccagcggcggaggccgagcaccagaacctgacggcctaccagcacggcagcgacgtgtacttcaccacctccagagacatccccccgggtaccgagctgcgcgtgtggtatgcggccttctatgccaagaagatggacaagcccatgctgaagcaggccggctctggcgtccacgctgcaggcaccccagaaaacagcgcccccgtggagtcggagcccagccagtgggcgtgtaaagtgtgttctgccaccttcctggagctgcagctcctcaatgaacatctgttgggccacttagaacaagccaaaagccttcctccaggcagccaaagcgaggcagcagctcccgagaaggagcaggacacaccccggggggaaccccctgcagtgcccgagagcgagaatgttgccaccaaagaacagaagaaaaagcctcgaagggggagaaaacccaaagtgtccaaagctgagcagcctctagtcatcgtggaagacaaggaacccacagagcaagtggcagagatcattaccgaggtccctccggatgagcctgtgagtgcaacgccagatgagcggatcatggagctggttctggggaagctggccaccaccaccactgacaccagctcggttccaaagttcacccatcatcagaataacaccatcacgctcaagaggagcttaattctctcaagcagacacggcatccggcgcaagctcatcaaacagctcggggagcacaagcgggtttaccagtgcaatatctgcagcaagatcttccagaacagcagcaacctgagcaggcacgtgcgctcgcatggtgacaagctgtttaagtgcgaagagtgtgcaaaattgttcagccgcaaagagagcctaaagcagcacgtttcctacaagcacagcaggaacgaggtggacggcgagtacaggtaccgctgcggcacttgtgagaagaccttccgcatcgagagcgcgctggagttccacaactgcaggacagatgacaagacgttccaatgtgagatgtgtttcagattcttctccaccaacagcaacctctccaagcacaagaagaagcacggcgacaagaagtttgcctgtgaggtctgcagcaagatgttctaccgcaaggacgtcatgctggaccaccagcgccggcacctggaaggagtgcggcgagtgaagcgagaggacctggaggccggtggggagaacctggtccgttacaagaaggagccttccgggtgcccggtgtgtggcaaggtgttctcctgccggagcaatatgaacaagcacctgctcacccacggcgacaagaagtacacctgcgagatctgcgggcgcaagttcttccgcgtggatgtgctcagggaccacatccatgtccacttcaaggacatcgcgttgatggatgaccaccagagggaagagtttatcggcaagatcgggatctcctcggaagaaaacgatgacaattctgacgagagcgcagactcggagcctcacaagtacagctgcaagcggtgccagctcaccttcggccgggggaaggagtacctgaagcacatcatggaggtgcacaaggagaagggctatggctgcagcatctgcaaccggcgctttgcactgaaggccacctaccacgcccacatggtcatccaccgtgaaaacctgccggaccccaacgtgcagaagtacatccacccctgcgagatctgcgggcggatcttcaacagcatcgggaacctggagcgccacaagctcatccacacaggtgtgaagagccacgcctgcgagcagtgtgggaagtcctttgccaggaaggacatgctgaaggagcacatgcgtgtgcacgacaatgtccgcgagtacctgtgtgccgagtgtgggaaaggcatgaagaccaagcacgcgctgcgccaccacatgaagctgcacaagggcatcaaggagtacgagtgcaaggagtgccaccgcaggttcgcgcagaaggtcaacatgctcaagcactgcaagcggcacacggggattaaagatttcatgtgtgaattgtgtgggaagacattcagcgagaggaacaccatggagacccacaagctcatccacacagtgggcaagcagtggacgtgctccgtgtgcgacaagaagtacgtgaccgagtacatgctgcagaagcacgttcagctcacacacgacaaggtggaggcgcagagctgccagctgtgcgggaccaaggtgtccaccagggcctccatgagccgacacatgcggcgcaagcaccccgaggtgctcgcggtgaggatcgatgacctggaccacctcccggagaccaccaccatcgacgcctcctccattggcatcgtccagcctgagctgactctggagcaggaggatttggccgaagggaagcacgggaaagctgccaagcgaagtcacaagagaaagcagaagccagaagaggaggcgggtgctccggtgcccgaggacgccaccttcagcgaatactcagagaaagagacggagttcacaggcagtgtaggcgacgagaccaattccgcagtacagagcattcagcaggtagtggtgaccctgggtgacccaaatgtgaccacaccatcgagctcagtcggcttaaccaacatcaccgtgacccccatcaccactgcggccgcgactcagtttaccaatctccagccggtggccgtggggcaccttaccacccctgaacgccagttacagctggacaactcaatcctgaccgtgacctttgataccgtcagcggctctgccatgttgcacaaccgccaaaatgacgtccagatccacccccagccggaagcctcgaacccacagtctgtggcccatttcatcaacctgacgaccctggtcaactccatcacgcccctggggagccagcttagtgaccagcacccgctcacgtggcgggcagtgccccagactgacgtcttgccaccctcgcagccgcaggcacccccacagcaggcggcccagccccaggtgcaggcggagcagcagcagcagcagatgtacagctactgagctgcgttccgggagactcggggcaagaactgcagagggatgtttgggatttgtttagatgtgtttgctggatac

SEQ ID NO: 1741 - DNA, 2565 bp, Homo sapiens
cgctgccccgtccacgccgcccgcgccccgcagtcccacccgcaggacccccggccgcgccagggtctcgcctgcgccccccgcgcccgcccgcggactacaagtcccgccatgccccgccgccgccccccggcttccggtgctgcgcagtttccggagcggatcgcaacccggagtccggatccgatcccgctctgcacattccaaaggcagccgcgcgccgccccggtccagccgccatgccgactgttctttgttacattcgccggctgcgggcaccgttggcgatcggagtcaaaacccggctggatttcccggagccgctccgggatcgccctgcgcgccgcccgcccgccggggtcttcgccgccccggcccgcggccccgcggcccccgccgccgggcggcgtcgtcgccgaggccccaggggatgtcgttatcccccgccctcgggtacagcccatgcgggtcgcacgggggggtccctggacccccaaccccgcgtttagagaagctgagtcctggtcccagattgggaaccagagggtcagtgagcagctcttggaaacatctctagggaatgaggtgtccgacactgagccactgagccctgcgagtgcaggcctgcgacgcaatcctgccctacctcctggaccctttgcacaaaacttttcctgggggaaccaggaaaatctgcccccagccctggggaagattgcgaacggaggaggaactggggcaggcaaggccgaatgcggctatgaaactgagtcacacttgctagagccgcacgagatacctttgaacgtgaatacacacaagttcagtgactgtgagtttccatatgagttttgcacggtctgcttttcacccttcaagctgctggggatgagcggggtggagggcgtgtggaatcagcattcaagaagtgccagcatgcacactttcctaaaccactcagcaacgggcatcagagaagcaggttgcaggaaggacatgccggtgtcagagatggctgaagatgggagcgaagagatcatgttcatctggtgtgaagactgcagccagtaccacgactccgaatgtcccgagctgggcccagtggtcatggtcaaagactcctttgtgttaagcagggcaaggtcatcccttcctcccaacttggagatcagacgactggaagatggagccgagggggtgttcgccatcactcagctcgtcaagcggacacagttcggtccctttgagtccaggagggtcgccaaatgggaaaaggagtctgcatttcccctgaaggtgttccagaaggacgggcaccccgtgtgcttcgacacctccaacgaggatgactgcaactggatgatgctggtgcggccagcggcggaggccgagcaccagaacctgacggcctaccagcacggcagcgacgtgtacttcaccacctccagagacatccccccgggtaccgagctgcgcgtgtggtatgcggccttctatgccaagaagatggacaagcccatgctgaagcaggccggctctggcgtccacgctgcaggcaccccagaaaacagcgcccccgtggagtcggagcccagccagtgggcgtgtaaagtgtgttctgccaccttcctggagctgcagctcctcaatgaacatctgttgggccacttagaacaagccaaaagccttcctccaggcagccaaagcgaggcagcagctcccgagaaggagcaggacacaccccggggggaaccccctgcagtgcccgagagcgagaatgttgccaccaaagaacagaagaaaaagcctcgaagggggagaaaacccaaagtgtccaaagctgagcagcctctagtcatcgtggaagacaaggaacccacagagcaagtggcagagatcattaccgaggtccctccggatgagcctgtgagtgcaacgccagatgagcggatcatggagctggttctggggaagctggccaccaccaccactgacaccagctcggttccaaagttcacccatcatcagaataacaccatcacgctcaagaggagcttaattctctcaagcagacacggcatccggcgcaagctcatcaaacagctcggggagcacaagcgggtttaccagtgcaatatctgcagcaagatcttccagaacagcagcaacctgagcaggcacgtgcgctcgcatggtgacaagctgtttaagtgcgaagagtgtgcaaaattgttcagccgcaaagagagcctaaagcagcacgtttcctacaagcacagcaggaacgaggtggacggcgagtacaggtaccgctgcggcacttgtgagaagaccttccgcatcgagagcgcgctggagttccacaactgcaggacaggactcatagcacaccctggagagggggggcccggcggcagtcggcttagagacctaccagcaacctctccaagcacaagaagaagcacggcgacaagaagtttgcctgtgaggtctgcagcaagatgttctaccgcaaggacgtcatgctggaccaccagcgccggcacctggaagacatgtgctgct

SEQ ID NO: 1742 - DNA, 6654 bp, Homo sapiens
gtccacgccgcccgcgccccgcagtcccacccgcaggacccccggccgcgccagggtctcgcctgcgccccccgcgcccgcccgcggactacaagtcccgccatgccccgccgccgccccccggcttccggtgctgcgcagtttccggagcggatcgcaacccggagtccggatccgatcccgctctgcacattccaaaggcaggtgtcagagatggctgaagatgggagcgaagagatcatgttcatctggtgtgaagactgcagccagtaccacgactccgaatgtcccgagctgggcccagtggtcatggtcaaagactcctttgtgttaagcagggcaaggtcatcccttcctcccaacttggagatcagacgactggaagatggagccgagggggtgttcgccatcactcagctcgtcaagcggacacagttcggtccctttgagtccaggagggtcgccaaatgggaaaaggagtctgcatttcccctgaaggtgttccagaaggacgggcaccccgtgtgcttcgacacctccaacgaggatgactgcaactggatgatgctggtgcggccagcggcggaggccgagcaccagaacctgacggcctaccagcacggcagcgacgtgtacttcaccacctccagagacatccccccgggtaccgagctgcgcgtgtggtatgcggccttctatgccaagaagatggacaagcccatgctgaagcaggccggctctggcgtccacgctgcaggcaccccagaaaacagcgcccccgtggagtcggagcccagccagtgggcgtgtaaagtgtgttctgccaccttcctggagctgcagctcctcaatgaacatctgttgggccacttagaacaagccaaaagccttcctccaggcagccaaagcgaggcagcagctcccgagaaggagcaggacacaccccggggggaaccccctgcagtgcccgagagcgagaatgttgccaccaaagaacagaagaaaaagcctcgaagggggagaaaacccaaagtgtccaaagctgagcagcctctagtcatcgtggaagacaaggaacccacagagcaagtggcagagatcattaccgaggtccctccggatgagcctgtgagtgcaacgccagatgagcggatcatggagctggttctggggaagctggccaccaccaccactgacaccagctcggttccaaagttcacccatcatcagaataacaccatcacgctcaagaggagcttaattctctcaagcagacacggcatccggcgcaagctcatcaaacagctcggggagcacaagcgggtttaccagtgcaatatctgcagcaagatcttccagaacagcagcaacctgagcaggcacgtgcgctcgcatggtgacaagctgtttaagtgcgaagagtgtgcaaaattgttcagccgcaaagagagcctaaagcagcacgtttcctacaagcacagcaggaacgaggtggacggcgagtacaggtaccgctgcggcacttgtgagaagaccttccgcatcgagagcgcgctggagttccacaactgcaggacagatgacaagacgttccaatgtgagatgtgtttcagattcttctccaccaacagcaacctctccaagcacaagaagaagcacggcgacaagaagtttgcctgtgaggtctgcagcaagatgttctaccgcaaggacgtcatgctggaccaccagcgccggcacctggaaggagtgcggcgagtgaagcgagaggacctggaggccggtggggagaacctggtccgttacaagaaggagccttccgggtgcccggtgtgtggcaaggtgttctcctgccggagcaatatgaacaagcacctgctcacccacggcgacaagaagtacacctgcgagatctgcgggcgcaagttcttccgcgtggatgtgctcagggaccacatccatgtccacttcaaggacatcgcgttgatggatgaccaccagagggaagagtttatcggcaagatcgggatctcctcggaagaaaacgatgacaattctgacgagagcgcagactcggagcctcacaagtacagctgcaagcggtgccagctcaccttcggccgggggaaggagtacctgaagcacatcatggaggtgcacaaggagaagggctatggctgcagcatctgcaaccggcgctttgcactgaaggccacctaccacgcccacatggtcatccaccgtgaaaacctgccggaccccaacgtgcagaagtacatccacccctgcgagatctgcgggcggatcttcaacagcatcgggaacctggagcgccacaagctcatccacacaggtgtgaagagccacgcctgcgagcagtgtgggaagtcctttgccaggaaggacatgctgaaggagcacatgcgtgtgcacgacaatgtccgcgagtacctgtgtgccgagtgtgggaaaggcatgaagaccaagcacgcgctgcgccaccacatgaagctgcacaagggcatcaaggagtacgagtgcaaggagtgccaccgcaggttcgcgcagaaggtcaacatgctcaagcactgcaagcggcacacggggattaaagatttcatgtgtgaattgtgtgggaagacattcagcgagaggaacaccatggagacccacaagctcatccacacagtgggcaagcagtggacgtgctccgtgtgcgacaagaagtacgtgaccgagtacatgctgcagaagcacgttcagctcacacacgacaaggtggaggcgcagagctgccagctgtgcgggaccaaggtgtccaccagggcctccatgagccgacacatgcggcgcaagcaccccgaggtgctcgcggtgaggatcgatgacctggaccacctcccggagaccaccaccatcgacgcctcctccattggcatcgtccagcctgagctgactctggagcaggaggatttggccgaagggaagcacgggaaagctgccaagcgaagtcacaagagaaagcagaagccagaagaggaggcgggtgctccggtgcccgaggacgccaccttcagcgaatactcagagaaagagacggagttcacaggcagtgtaggcgacgagaccaattccgcagtacagagcattcagcaggtagtggtgaccctgggtgacccaaatgtgaccacaccatcgagctcagtcggcttaaccaacatcaccgtgacccccatcaccactgcggccgcgactcagtttaccaatctccagccggtggccgtggggcaccttaccacccctgaacgccagttacagctggacaactcaatcctgaccgtgacctttgataccgtcagcggctctgccatgttgcacaaccgccaaaatgacgtccagatccacccccagccggaagcctcgaacccacagtctgtggcccatttcatcaacctgacgaccctggtcaactccatcacgcccctggggagccagcttagtgaccagcacccgctcacgtggcgggcagtgccccagactgacgtcttgccaccctcgcagccgcaggcacccccacagcaggcggcccagccccaggtgcaggcggagcagcagcagcagcagatgtacagctactgagctgcgttccgggagactcggggcaagaactgcagagggatgtttgggatttgtttagatgtgtttgctggataccaaacaaacaaaaagtcatacattgcaatgtaaggttgacttagctttgcagagtatctccagatcccccgccagcaaccattacggtctgtcagcttaactctagaagggacctctggcaggccagagttttaaactggatggggctccacaccatgccttaccaaggcagtaagtcctgggccggggccgcatctgcctccccttacagaaccagtgttcgcccgacacagggttcgggaaagtgaagctgagagagaagcaggattttaagaggcaggagataagttattaggaacacaaatggttcattttcttttttcttttagagctcggttcctatgagaacacagacagtattcacaggtggcagcaggcagcagggaacattttctcctcacttctggatttttttgcaagcgagcacatagaagttaaagtaacgtgtattctctttgaactaggagtggagtcggttcttatacaactatgggctgaaaccatgaggcgtgctgagccgcacctgatcctgcaaccttcgaggtcatcacggtcatcatgtgcaaggggtcacgtgaggtcactgactccagctcaaaacgcatcttagtaatatccatgaatcgatttccaatagagtttttttccttttttttttttaactttatttcaaacatacattatgtgttcaagactgttatggccaatattgtgttttagttttatgttaacatgataaagtcatgtgcactgtaggaccatctgtccctgtccacccttcacagctgcccagatgcagagggtcgcgcggctgtgtgtgaggagtgagcctccctgctgcccccaggggctcctccgggttgtctcaggattctctgcaatccaaatgtatccattctggctgaagcccagccagaatcccgagtggaagaaacgggggaaaagtcatattttccttctgtttaaacttcaattccaaaggttggtgtatttcatgaccagttttctataaaaatattgaatgagtttggctctttacaatggaaaagtgtaggtatttctgaaacacagagaaaatgctatttcctgccaggtggtaatgaaagcagagaggttagttcactaatagaagcattaattgcccctaaaactgaatgtgcggtgaacagccaggtctgcgtgtgcggggacacgtgctgtcacgtctgtgtaccagtttcgggggcaggggccagggttgggggaggcacccagccctcctgctgcccacgacaagaaacactgagaggtgtggggagaagtttgctcttaactttcctggtactctgtttgtggccacagtgagaggacaaacctgccttaaggtgtcctgctttgccagttatcccagatcctgcactcactgggagtccatcttgaggaaacactggcatggctgagtaattgatcaggagcagtcctgatgttgccagcagaacaaaggatgattgtgtttttcaaaacgcaactttctcagcacttcactccaaacagcagacttttgaggacagggctggaatttgttttgtgcaatatatgccttcatgaactaaggaatgttcatccccaggcagcatgcaggagggtctgtggggctcacctcctcaccttacccaccatcactcgcgcctagctctcacctctcagttgaatgaatagtgggagatcatttgacttttaatttatgagaattattttatgttatttatgtatataattaactgttttatacatagtagtctcatcaaatgaattcgggcttggggtgatattgtctccattctccagatacaagtgctccaggcatccatggaatcagcaggagaccagggctcctaagatatatttttaaaaatcagtatcgatttctttttgcctttgcagaatctaaagggcaaatgacctcgcagagactcccaacgggctttgggctcatgacgaaacacccactagcattgatcttttattcctcttccctataaaataaaggccttggaaatcacaattttatttttttaaagaagttgttttagtgcctagagtaagaccgcatcaaatgttgttaaagaacctaatttagattgtgtggtatataccactgtttatctcaatacacagacacctcttacttcttgttataagtgagaactctaaagaaaaatcaaactcccaagttttctgtaaacatacgtggtcttaatagggtcactgtctgaggcaaaatgggttgtcttaaagcaattgctacaaatttgcatcaaagaaactagatagcaaaatacaacaaccatgtaccacccaggcagaagagtcctcacctatacgcagttctgcatattgatcatcatgacaggaagtatttcgttttttaactgatcccaggtgcacagatgtattcataaaggaagacattagatccagccattgtggccaccaggctctgtggacccatctcagtggagaattcgttttggacccgtggctccgtgcagctgtggactcgagtgccatccactggtgtgagtcttgcggggaggccacaggtacagctgctccccgtgaatcctggtctgtgggttgagaaggggctcgggcctctggaatgctctagcgtgtgacgtgttctcaggaaaacgttctgtgccaagtgccgcctcgctgtgtccggcatgggactgcgctggagggtccggcgtggaaggcagacctcctgtacctctatcgttcccatttgtggcatccaaaggcggaaggctcatggcttccccactagaggcggcgtcttgggctttcccattggattgtgaaaggcattaagactgtttggagatgttggctgtatttcctgtcacatcaggttgtatgatgacgaataaaaggtgctgtgacccgtgttttcaa

SEQ ID NO: 1743 - DNA, 6124 bp, Homo sapiens
cgctgccccgtccacgccgcccgcgccccgcagtcccacccgcaggacccccggccgcgccagggtctcgcctgcgccccccgcgcccgcccgcggactacaagtcccgccatgccccgccgccgccccccggcttccggtgctgcgcagtttccggagcggatcgcaacccggagtccggatccgatcccgctctgcacattccaaaggcagccgcgcgccgccccggtccagccgccatgccgactgttctttgttacattcgccggctgcgggcaccgttggcgatcggagtcaaaacccggctggatttcccggagccgctccgggatcgccctgcgcgccgcccgcccgccggggtcttcgccgccccggcccgcggccccgcggcccccgccgccgggcggcgtcgtcgccgaggccccaggggatgtcgttatcccccgccctcgggtacagcccatgcgggtcgcacgggggggtccctggacccccaaccccgcgtttagagaagctgagtcctggtcccagattgggaaccagagggtcagtgagcagctcttggaaacatctctagggaatgaggtgtccgacactgagccactgagccctgcgagtgcaggcctgcgacgcaatcctgccctacctcctggaccctttgcacaaaacttttcctgggggaaccaggaaaatctgcccccagccctggggaagattgcgaacggaggaggaactggggcaggcaaggccgaatgcggctatgaaactgagtcacacttgctagagccgcacgagatacctttgaacgtgaatacacacaagttcagtgactgtgagtttccatatgagttttgcacggtctgcttttcacccttcaagctgctggggatgagcggggtggagggcgtgtggaatcagcattcaagaagtgccagcatgcacactttcctaaaccactcagcaacgggcatcagagaagcaggttgcaggaaggacatgccggtgtcagagatggctgaagatgggagcgaagagatcatgttcatctggtgtgaagactgcagccagtaccacgactccgaatgtcccgagctgggcccagtggtcatggtcaaagactcctttgtgttaagcagggcaaggtcttggcctgccagcggacacgtgcacacccaggcggggcaggggatgcggggttatgaggacagggacagggctgacccacagcagcttccagaagcagtccctgcaggcctggtgaggcggctcagtgggcagcagctgccctgccgttccaccctcacctgggggaggctgtgccacctggtggcccagggcaggtcatcccttcctcccaacttggagatcagacgactggaagatggagccgagggggtgttcgccatcactcagctcgtcaagcggacacagttcggtccctttgagtccaggagggtcgccaaatgggaaaaggagtctgcatttcccctgaaggtgttccagaaggacgggcaccccgtgtgcttcgacacctccaacgaggatgactgcaactggatgatgctggtgcggccagcggcggaggccgagcaccagaacctgacggcctaccagcacggcagcgacgtgtacttcaccacctccagagacatccccccgggtaccgagctgcgcgtgtggtatgcggccttctatgccaagaagatggacaagcccatgctgaagcaggccggctctggcgtccacgctgcaggcaccccagaaaacagcgcccccgtggagtcggagcccagccagtgggcgtgtaaagtgtgttctgccaccttcctggagctgcagctcctcaatgaacatctgttgggccacttagaacaagccaaaagccttcctccaggcagccaaagcgaggcagcagctcccgagaaggagcaggacacaccccggggggaaccccctgcagtgcccgagagcgagaatgttgccaccaaagaacagaagaaaaagcctcgaagggggagaaaacccaaagtgtccaaagctgagcagcctctagtcatcgtggaagacaaggaacccacagagcaagtggcagagatcattaccgaggtccctccggatgagcctgtgagtgcaacgccagatgagcggatcatggagctggttctggggaagctggccaccaccaccactgacaccagctcggttccaaagttcacccatcatcagaataacaccatcacgctcaagaggagcttaattctctcaagcagacacggcatccggcgcaagctcatcaaacagctcggggagcacaagcgggtttaccagtgcaatatctgcagcaagatcttccagaacagcagcaacctgagcaggcacgtgcgctcgcatggtgacaagctgtttaagtgcgaagagtgtgcaaaattgttcagccgcaaagagagcctaaagcagcacgtttcctacaagcacagcaggaacgaggtggacggcgagtacaggtaccgctgcggcacttgtgagaagaccttccgcatcgagagcgcgctggagttccacaactgcaggacagatgacaagacgttccaatgtgagatgtgtttcagattcttctccaccaacagcaacctctccaagcacaagaagaagcacggcgacaagaagtttgcctgtgaggtctgcagcaagatgttctaccgcaaggacgtcatgctggaccaccagcgccggcacctggaaggagtgcggcgagtgaagcgagaggacctggaggccggtggggagaacctggtccgttacaagaaggagccttccgggtgcccggtgtgtggcaaggtgttctcctgccggagcaatatgaacaagcacctgctcacccacggcgacaagaagtacacctgcgagatctgcgggcgcaagttcttccgcgtggatgtgctcagggaccacatccatgtccacttcaaggacatcgcgttgatggatgaccaccagagggaagagtttatcggcaagatcgggatctcctcggaagaaaacgatgacaattctgacgagagcgcagactcggagcctcacaagtacagctgcaagcggtgccagctcaccttcggccgggggaaggagtacctgaagcacatcatggaggtgcacaaggagaagggctatggctgcagcatctgcaaccggcgctttgcactgaaggccacctaccacgcccacatggtcatccaccgtgaaaacctgccggaccccaacgtgcagaagtacatccacccctgcgagatctgcgggcggatcttcaacagcatcgggaacctggagcgccacaagctcatccacacaggtgtgaagagccacgcctgcgagcagtgtgggaagtcctttgccaggaaggacatgctgaaggagcacatgcgtgtgcacgacaatgtccgcgagtacctgtgtgccgagtgtgggaaaggcatgaagaccaagcacgcgctgcgccaccacatgaagctgcacaagggcatcaaggagtacgagtgcaaggagtgccaccgcaggttcgcgcagaaggtcaacatgctcaagcactgcaagcggcacacggggattaaagatttcatgtgtgaattgtgtgggaagacattcagcgagaggaacaccatggagacccacaagctcatccacacagtgggcaagcagtggacgtgctccgtgtgcgacaagaagtacgtgaccgagtacatgctgcagaagcacgttcagctcacacacgacaaggtggaggcgcagagctgccagctgtgcgggaccaaggtgtccaccagggcctccatgagccgacacatgcggcgcaagcaccccgaggtgctcgcggtgaggatcgatgacctggaccacctcccggagaccaccaccatcgacgcctcctccattggcatcgtccagcctgagctgactctggagcaggaggatttggccgaagggaagcacgggaaagctgccaagcgaagtcacaagagaaagcagaagccagaagaggaggcgggtgctccggtgcccgaggacgccaccttcagcgaatactcagagaaagagacggagttcacaggcagtgtaggcgacgagaccaattccgcagtacagagcattcagcaggtagtggtgaccctgggtgacccaaatgtgaccacaccatcgagctcagtcggcttaaccaacatcaccgtgacccccatcaccactgcggccgcgactcagtttaccaatctccagccggtggccgtggggcaccttaccacccctgaacgccagttacagctggacaactcaatcctgaccgtgacctttgataccgtcagcggctctgccatgttgcacaaccgccaaaatgacgtccagatccacccccagccggaagcctcgaacccacagtctgtggcccatttcatcaacctgacgaccctggtcaactccatcacgcccctggggagccagcttagtgaccagcacccgctcacgtggcgggcagtgccccagactgacgtcttgccaccctcgcagccgcaggcacccccacagcaggcggcccagccccaggtgcaggcggagcagcagcagcagcagatgtacagctactgagctgcgttccgggagactcggggcaagaactgcagagggatgtttgggatttgtttagatgtgtttgctggataccaaacaaacaaaaagtcatacattgcaatgtaaggttgacttagctttgcagagtatctccagatcccccgccagcaaccattacggtctgtcagcttaactctagaagggacctctggcaggccagagttttaaactggatggggctccacaccatgccttaccaaggcagtaagtcctgggccggggccgcatctgcctccccttacagaaccagtgttcgcccgacacagggttcgggaaagtgaagctgagagagaagcaggattttaagaggcaggagataagttattaggaacacaaatggttcattttcttttttcttttagagctcggttcctatgagaacacagacagtattcacaggtggcagcaggcagcagggaacattttctcctcacttctggatttttttgcaagcgagcacatagaagttaaagtaacgtgtattctctttgaactaggagtggagtcggttcttatacaactatgggctgaaaccatgaggcgtgctgagccgcacctgatcctgcaaccttcgaggtcatcacggtcatcatgtgcaaggggtcacgtgaggtcactgactccagctcaaaacgcatcttagtaatatccatgaatcgatttccaatagagtttttttccttttttttttttaactttatttcaaacatacattatgtgttcaagactgttatggccaatattgtgttttagttttatgttaacatgataaagtcatgtgcactgtaggaccatctgtccctgtccacccttcacagctgcccagatgcagagggtcgcgcggctgtgtgtgaggagtgagcctccctgctgcccccaggggctcctccgggttgtctcaggattctctgcaatccaaatgtatccattctggctgaagcccagccagaatcccgagtggaagaaacgggggaaaagtcatattttccttctgtttaaacttcaattccaaaggtgcacagatgtattcataaaggaagacattagatccagccattgtggccaccaggctctgtggacccatctcagtggagaattcgttttggacccgtggctccgtgcagctgtggactcgagtgccatccactggtgtgagtcttgcggggaggccacaggaaaacgttctgtgccaagtgccgcctcgctgtgtccggcatgggactgcgctggagggtccggcgtggaaggcagacctcctgtacctctatcgttcccatttgtggcatccaaaggcggaaggctcatggcttccccactagaggcggcgtcttgggctttcccattggattgtgaaaggcattaagactgtttggagatgttggctgtatttcctgtcacatcaggttgtatgatgacgaataaaaggtgctgtgacccgtgttttcaa

SEQ ID NO: 1744 - DNA, 6542 bp, Homo sapiens
gtccacgccgcccgcgccccgcagtcccacccgcaggacccccggccgcgccagggtctcgcctgcgccccccgcgcccgcccgcggactacaagtcccgccatgccccgccgccgccccccggcttccggtgctgcgcagtttccggagcggatcgcaacccggagtccggatccgatcccgctctgcacattccaaaggcaggtgtcagagatggctgaagatgggagcgaagagatcatgttcatctggtgtgaagactgcagccagtaccacgactccgaatgtcccgagctgggcccagtggtcatggtcaaagactcctttgtgttaagcagggcaaggtcatcccttcctcccaacttggagatcagacgactggaagatggagccgagggggtgttcgccatcactcagctcgtcaagcggacacagttcggtccctttgagtccaggagggtcgccaaatgggaaaaggagtctgcatttcccctgaaggtgttccagaaggacgggcaccccgtgtgcttcgacacctccaacgaggatgactgcaactggatgatgctggtgcggccagcggcggaggccgagcaccagaacctgacggcctaccagcacggcagcgacgtgtacttcaccacctccagagacatccccccgggtaccgagctgcgcgtgtggtatgcggccttctatgccaagaagatggacaagcccatgctgaagcaggccggctctggcgtccacgctgcaggcaccccagaaaacagcgcccccgtggagtcggagcccagccagtgggcgtgtaaagtgtgttctgccaccttcctggagctgcagctcctcaatgaacatctgttgggccacttagaacaagccaaaagccttcctccaggcagccaaagcgaggcagcagctcccgagaaggagcaggacacaccccggggggaaccccctgcagtgcccgagagcgagaatgttgccaccaaagaacagaagaaaaagcctcgaagggggagaaaacccaaagtgtccaaagctgagcagcctctagtcatcgtggaagacaaggaacccacagagcaagtggcagagatcattaccgaggtccctccggatgagcctgtgagtgcaacgccagatgagcggatcatggagctggttctggggaagctggccaccaccaccactgacaccagctcggttccaaaacacggcatccggcgcaagctcatcaaacagctcggggagcacaagcgggtttaccagtgcaatatctgcagcaagatcttccagaacagcagcaacctgagcaggcacgtgcgctcgcatggtgacaagctgtttaagtgcgaagagtgtgcaaaattgttcagccgcaaagagagcctaaagcagcacgtttcctacaagcacagcaggaacgaggtggacggcgagtacaggtaccgctgcggcacttgtgagaagaccttccgcatcgagagcgcgctggagttccacaactgcaggacagcaacctctccaagcacaagaagaagcacggcgacaagaagtttgcctgtgaggtctgcagcaagatgttctaccgcaaggacgtcatgctggaccaccagcgccggcacctggaaggagtgcggcgagtgaagcgagaggacctggaggccggtggggagaacctggtccgttacaagaaggagccttccgggtgcccggtgtgtggcaaggtgttctcctgccggagcaatatgaacaagcacctgctcacccacggcgacaagaagtacacctgcgagatctgcgggcgcaagttcttccgcgtggatgtgctcagggaccacatccatgtccacttcaaggacatcgcgttgatggatgaccaccagagggaagagtttatcggcaagatcgggatctcctcggaagaaaacgatgacaattctgacgagagcgcagactcggagcctcacaagtacagctgcaagcggtgccagctcaccttcggccgggggaaggagtacctgaagcacatcatggaggtgcacaaggagaagggctatggctgcagcatctgcaaccggcgctttgcactgaaggccacctaccacgcccacatggtcatccaccgtgaaaacctgccggaccccaacgtgcagaagtacatccacccctgcgagatctgcgggcggatcttcaacagcatcgggaacctggagcgccacaagctcatccacacaggtgtgaagagccacgcctgcgagcagtgtgggaagtcctttgccaggaaggacatgctgaaggagcacatgcgtgtgcacgacaatgtccgcgagtacctgtgtgccgagtgtgggaaaggcatgaagaccaagcacgcgctgcgccaccacatgaagctgcacaagggcatcaaggagtacgagtgcaaggagtgccaccgcaggttcgcgcagaaggtcaacatgctcaagcactgcaagcggcacacggggattaaagatttcatgtgtgaattgtgtgggaagacattcagcgagaggaacaccatggagacccacaagctcatccacacagtgggcaagcagtggacgtgctccgtgtgcgacaagaagtacgtgaccgagtacatgctgcagaagcacgttcagctcacacacgacaaggtggaggcgcagagctgccagctgtgcgggaccaaggtgtccaccagggcctccatgagccgacacatgcggcgcaagcaccccgaggtgctcgcggtgaggatcgatgacctggaccacctcccggagaccaccaccatcgacgcctcctccattggcatcgtccagcctgagctgactctggagcaggaggatttggccgaagggaagcacgggaaagctgccaagcgaagtcacaagagaaagcagaagccagaagaggaggcgggtgctccggtgcccgaggacgccaccttcagcgaatactcagagaaagagacggagttcacaggcagtgtaggcgacgagaccaattccgcagtacagagcattcagcaggtagtggtgaccctgggtgacccaaatgtgaccacaccatcgagctcagtcggcttaaccaacatcaccgtgacccccatcaccactgcggccgcgactcagtttaccaatctccagccggtggccgtggggcaccttaccacccctgaacgccagttacagctggacaactcaatcctgaccgtgacctttgataccgtcagcggctctgccatgttgcacaaccgccaaaatgacgtccagatccacccccagccggaagcctcgaacccacagtctgtggcccatttcatcaacctgacgaccctggtcaactccatcacgcccctggggagccagcttagtgaccagcacccgctcacgtggcgggcagtgccccagactgacgtcttgccaccctcgcagccgcaggcacccccacagcaggcggcccagccccaggtgcaggcggagcagcagcagcagcagatgtacagctactgagctgcgttccgggagactcggggcaagaactgcagagggatgtttgggatttgtttagatgtgtttgctggataccaaacaaacaaaaagtcatacattgcaatgtaaggttgacttagctttgcagagtatctccagatcccccgccagcaaccattacggtctgtcagcttaactctagaagggacctctggcaggccagagttttaaactggatggggctccacaccatgccttaccaaggcagtaagtcctgggccggggccgcatctgcctccccttacagaaccagtgttcgcccgacacagggttcgggaaagtgaagctgagagagaagcaggattttaagaggcaggagataagttattaggaacacaaatggttcattttcttttttcttttagagctcggttcctatgagaacacagacagtattcacaggtggcagcaggcagcagggaacattttctcctcacttctggatttttttgcaagcgagcacatagaagttaaagtaacgtgtattctctttgaactaggagtggagtcggttcttatacaactatgggctgaaaccatgaggcgtgctgagccgcacctgatcctgcaaccttcgaggtcatcacggtcatcatgtgcaaggggtcacgtgaggtcactgactccagctcaaaacgcatcttagtaatatccatgaatcgatttccaatagagtttttttccttttttttttttaactttatttcaaacatacattatgtgttcaagactgttatggccaatattgtgttttagttttatgttaacatgataaagtcatgtgcactgtaggaccatctgtccctgtccacccttcacagctgcccagatgcagagggtcgcgcggctgtgtgtgaggagtgagcctccctgctgcccccaggggctcctccgggttgtctcaggattctctgcaatccaaatgtatccattctggctgaagcccagccagaatcccgagtggaagaaacgggggaaaagtcatattttccttctgtttaaacttcaattccaaaggttggtgtatttcatgaccagttttctataaaaatattgaatgagtttggctctttacaatggaaaagtgtaggtatttctgaaacacagagaaaatgctatttcctgccaggtggtaatgaaagcagagaggttagttcactaatagaagcattaattgcccctaaaactgaatgtgcggtgaacagccaggtctgcgtgtgcggggacacgtgctgtcacgtctgtgtaccagtttcgggggcaggggccagggttgggggaggcacccagccctcctgctgcccacgacaagaaacactgagaggtgtggggagaagtttgctcttaactttcctggtactctgtttgtggccacagtgagaggacaaacctgccttaaggtgtcctgctttgccagttatcccagatcctgcactcactgggagtccatcttgaggaaacactggcatggctgagtaattgatcaggagcagtcctgatgttgccagcagaacaaaggatgattgtgtttttcaaaacgcaactttctcagcacttcactccaaacagcagacttttgaggacagggctggaatttgttttgtgcaatatatgccttcatgaactaaggaatgttcatccccaggcagcatgcaggagggtctgtggggctcacctcctcaccttacccaccatcactcgcgcctagctctcacctctcagttgaatgaatagtgggagatcatttgacttttaatttatgagaattattttatgttatttatgtatataattaactgttttatacatagtagtctcatcaaatgaattcgggcttggggtgatattgtctccattctccagatacaagtgctccaggcatccatggaatcagcaggagaccagggctcctaagatatatttttaaaaatcagtatcgatttctttttgcctttgcagaatctaaagggcaaatgacctcgcagagactcccaacgggctttgggctcatgacgaaacacccactagcattgatcttttattcctcttccctataaaataaaggccttggaaatcacaattttatttttttaaagaagttgttttagtgcctagagtaagaccgcatcaaatgttgttaaagaacctaatttagattgtgtggtatataccactgtttatctcaatacacagacacctcttacttcttgttataagtgagaactctaaagaaaaatcaaactcccaagttttctgtaaacatacgtggtcttaatagggtcactgtctgaggcaaaatgggttgtcttaaagcaattgctacaaatttgcatcaaagaaactagatagcaaaatacaacaaccatgtaccacccaggcagaagagtcctcacctatacgcagttctgcatattgatcatcatgacaggaagtatttcgttttttaactgatcccaggtgcacagatgtattcataaaggaagacattagatccagccattgtggccaccaggctctgtggacccatctcagtggagaattcgttttggacccgtggctccgtgcagctgtggactcgagtgccatccactggtgtgagtcttgcggggaggccacaggtacagctgctccccgtgaatcctggtctgtgggttgagaaggggctcgggcctctggaatgctctagcgtgtgacgtgttctcaggaaaacgttctgtgccaagtgccgcctcgctgtgtccggcatgggactgcgctggagggtccggcgtggaaggcagacctcctgtacctctatcgttcccatttgtggcatccaaaggcggaaggctcatggcttccccactagaggcggcgtcttgggctttcccattggattgtgaaaggcattaagactgtttggagatgttggctgtatttcctgtcacatcaggttgtatgatgacgaataaaaggtgctgtgacccgtgttttcaa

SEQ ID NO: 1745 - DNA, 4928 bp, Homo sapiens
tgacaggtgtcagagatggctgaagatgggagcgaagagatcatgttcatctggtgtgaagactgcagccagtaccacgactccgaatgtcccgagctgggcccagtggtcatggtcaaagactcctttgtgttaagcagggcaaggtcatcccttcctcccaacttggagatcagacgactggaagatggagccgagggggtgttcgccatcactcagctcgtcaagcggacacagttcggtccctttgagtccaggagggtcgccaaatgggaaaaggagtctgcatttcccctgaaggtgttccagaaggacgggcaccccgtgtgcttcgacacctccaacgaggatgactgcaactggatgatgctggtgcggccagcggcggaggccgagcaccagaacctgacggcctaccagcacggcagcgacgtgtacttcaccacctccagagacatccccccgggtaccgagctgcgcgtgtggtatgcggccttctatgccaagaagatggacaagcccatgctgaagcaggccggctctggcgtccacgctgcaggcaccccagaaaacagcgcccccgtggagtcggagcccagccagtgggcgtgtaaagtgtgttctgccaccttcctggagctgcagctcctcaatgaacatctgttgggccacttagaacaagccaaaagccttcctccaggcagccaaagcgaggcagcagctcccgagaaggagcaggacacaccccggggggaaccccctgcagtgcccgagagcgagaatgttgccaccaaagaacagaagaaaaagcctcgaagggggagaaaacccaaagtgtccaaagctgagcagcctctagtcatcgtggaagacaaggaacccacagagcaagtggcagagatcattaccgaggtccctccggatgagcctgtgagtgcaacgccagatgagcggatcatggagctggttctggggaagctggccaccaccaccactgacaccagctcggttccaaagttcacccatcatcagaataacaccatcacgctcaagaggagcttaattctctcaagcagacacggcatccggcgcaagctcatcaaacagctcggggagcacaagcgggtttaccagtgcaatatctgcagcaagatcttccagaacagcagcaacctgagcaggcacgtgcgctcgcatggtgacaagctgtttaagtgcgaagagtgtgcaaaattgttcagccgcaaagagagcctaaagcagcacgtttcctacaagcacagcaggaacgaggtggacggcgagtacaggtaccgctgcggcacttgtgagaagaccttccgcatcgagagcgcgctggagttccacaactgcaggacagatgacaagacgttccaatgtgagatgtgtttcagattcttctccaccaacagcaacctctccaagcacaagaagaagcacggcgacaagaagtttgcctgtgaggtctgcagcaagatgttctaccgcaaggacgtcatgctggaccaccagcgccggcacctggaaggagtgcggcgagtgaagcgagaggacctggaggccggtggggagaacctggtccgttacaagaaggagccttccgggtgcccggtgtgtggcaaggtgttctcctgccggagcaatatgaacaagcacctgctcacccacggcgacaagaagtacacctgcgagatctgcgggcgcaagttcttccgcgtggatgtgctcagggaccacatccatgtccacttcaaggacatcgcgttgatggatgaccaccagagggaagagtttatcggcaagatcgggatctcctcggaagaaaacgatgacaattctgacgagagcgcagactcggagcctcacaagtacagctgcaagcggtgccagctcaccttcggccgggggaaggagtacctgaagcacatcatggaggtgcacaaggagaagggctatggctgcagcatctgcaaccggcgctttgcactgaaggccacctaccacgcccacatggtcatccaccgtgaaaacctgccggaccccaacgtgcagaagtacatccacccctgcgagatctgcgggcggatcttcaacagcatcgggaacctggagcgccacaagctcatccacacaggtgtgaagagccacgcctgcgagcagtgtgggaagtcctttgccaggaaggacatgctgaaggagcacatgcgtgtgcacgacaatgtccgcgagtacctgtgtgccgagtgtgggaaaggcatgaagaccaagcacgcgctgcgccaccacatgaagctgcacaagggcatcaaggagtacgagtgcaaggagtgccaccgcaggttcgcgcagaaggtcaacatgctcaagcactgcaagcggcacacggggattaaagatttcatgtgtgaattgtgtgggaagacattcagcgagaggaacaccatggagacccacaagctcatccacacagtgggcaagcagtggacgtgctccgtgtgcgacaagaagtacgtgaccgagtacatgctgcagaagcacgttcagctcacacacgacaaggtggaggcgcagagctgccagctgtgcgggaccaaggtgtccaccagggcctccatgagccgacacatgcggcgcaagcaccccgaggtgctcgcggtgaggatcgatgacctggaccacctcccggagaccaccaccatcgacgcctcctccattggcatcgtccagcctgagctgactctggagcaggaggatttggccgaagggaagcacgggaaagctgccaagcgaagtcacaagagaaagcagaagccagaagaggaggcgggtgctccggtgcccgaggacgccaccttcagcgaatactcagagaaagagacggagttcacaggcagtgtaggcgacgagaccaattccgcagtacagagcattcagcaggtagtggtgaccctgggtgacccaaatgtgaccacaccatcgagctcagtcggcttaaccaacatcaccgtgacccccatcaccactgcggccgcgactcagtttaccaatctccagccggtggccgtggggcaccttaccacccctgaacgccagttacagctggacaactcaatcctgaccgtgacctttgataccgtcagcggctctgccatgttgcacaaccgccaaaatgacgtccagatccacccccagccggaagcctcgaacccacagtctgtggcccatttcatcaacctgacgaccctggtcaactccatcacgcccctggggagccagcttagtgaccagcacccgctcacgtggcgggcagtgccccagactgacgtcttgccaccctcgcagccgcaggcacccccacagcaggcggcccagccccaggtgcaggcggagcagcagcagcagcagatgtacagctactgagctgcgttccgggagactcggggcaagaactgcagagggatgtttgggatttgtttagatgtgtttgctggataccaaacaaacaaaaagtcatacattgcaatgtaaggttgacttagctttgcagagtatctccagatcccccgccagcaaccattacggtctgtcagcttaactctagaagggacctctggcaggccagagttttaaactggatggggctccacaccatgccttaccaaggcagtaagtcctgggccggggccgcatctgcctccccttacagaaccagtgttcgcccgacacagggttcgggaaagtgaagctgagagagaagcaggattttaagaggcaggagataagttattaggaacacaaatggttcattttcttttttcttttagagctcggttcctatgagaacacagacagtattcacaggtggcagcaggcagcagggaacattttctcctcacttctggatttttttgcaagcgagcacatagaagttaaagtaacgtgtattctctttgaactaggagtggagtcggttcttatacaactatgggctgaaaccatgaggcgtgctgagccgcacctgatcctgcaaccttcgaggtcatcacggtcatcatgtgcaaggggtcacgtgaggtcactgactccagctcaaaacgcatcttagtaatatccatgaatcgatttccaatagagtttttttccttttttttttttaactttatttcaaacatacattatgtgttcaagactgttatggccaatattgtgttttagttttatgttaacatgataaagtcatgtgcactgtaggaccatctgtccctgtccacccttcacagctgcccagatgcagagggtcgcgcggctgtgtgtgaggagtgagcctccctgctgcccccaggggctcctccgggttgtctcaggattctctgcaatccaaatgtatccattctggctgaagcccagccagaatcccgagtggaagaaacgggggaaaagtcatattttccttctgtttaaacttcaattccaaaggtgcacagatgtattcataaaggaagacattagatccagccattgtggccaccaggctctgtggacccatctcagtggagaattcgttttggacccgtggctccgtgcagctgtggactcgagtgccatccactggtgtgagtcttgcggggaggccacaggaaaacgttctgtgccaagtgccgcctcgctgtgtccggcatgggactgcgctggagggtccggcgtggaaggcagacctcctgtacctctatcgttcccatttgtggcatccaaaggcggaaggctcatggcttccccactagaggcggcgtcttgggctttcccattggattgtgaaaggcattaagactgtttggagatgttggctgtatttcctgtcacatcaggttgtatgatgacgaataaaaggtgctgtgacccgtgttttc

SEQ ID NO: 1746 - DNA, 6662 bp, Homo sapiens
gtccacgccgcccgcgccccgcagtcccacccgcaggacccccggccgcgccagggtctcgcctgcgccccccgcgcccgcccgcggactacaagtcccgccatgccccgccgccgccccccggcttccggtgctgcgcagtttccggagcggatcgcaacccggagtccggatccgatcccgctctgcacattccaaaggcaggtgtcagagatggctgaagatgggagcgaagagatcatgttcatctggtgtgaagactgcagccagtaccacgactccgaatgtcccgagctgggcccagtggtcatggtcaaagactcctttgtgttaagcagggcaaggtcatcccttcctcccaacttggagatcagacgactggaagatggagccgagggggtgttcgccatcactcagctcgtcaagcggacacagttcggtccctttgagtccaggagggtcgccaaatgggaaaaggagtctgcatttcccctgaaggtgttccagaaggacgggcaccccgtgtgcttcgacacctccaacgaggatgactgcaactggatgatgctggtgcggccagcggcggaggccgagcaccagaacctgacggcctaccagcacggcagcgacgtgtacttcaccacctccagagacatccccccgggtaccgagctgcgcgtgtggtatgcggccttctatgccaagaagatggacaagcccatgctgaagcaggccggctctggcgtccacgctgcaggcaccccagaaaacagcgcccccgtggagtcggagcccagccagtgggcgtgtaaagtgtgttctgccaccttcctggagctgcagctcctcaatgaacatctgttgggccacttagaacaagccaaaagccttcctccaggcagccaaagcgaggcagcagctcccgagaaggagcaggacacaccccggggggaaccccctgcagtgcccgagagcgagaatgttgccaccaaagaacagaagaaaaagcctcgaagggggagaaaacccaaagtgtccaaagctgagcagcctctagtcatcgtggaagacaaggaacccacagagcaagtggcagagatcattaccgaggtccctccggatgagcctgtgagtgcaacgccagatgagcggatcatggagctggttctggggaagctggccaccaccaccactgacaccagctcggttccaaagttcacccatcatcagaataacaccatcacgctcaagaggagcttaattctctcaagcagacacggcatccggcgcaagctcatcaaacagctcggggagcacaagcgggtttaccagtgcaatatctgcagcaagatcttccagaacagcagcaacctgagcaggcacgtgcgctcgcatggtgacaagctgtttaagtgcgaagagtgtgcaaaattgttcagccgcaaagagagcctaaagcagcacgtttcctacaagcacagcaggaacgaggtggacggcgagtacaggtaccgctgcggcacttgtgagaagaccttccgcatcgagagcgcgctggagttccacaactgcaggacaggactcatagcacaccctggagagggggggcccggcggcagtcggcttagagacctaccagcaacctctccaagcacaagaagaagcacggcgacaagaagtttgcctgtgaggtctgcagcaagatgttctaccgcaaggacgtcatgctggaccaccagcgccggcacctggaaggagtgcggcgagtgaagcgagaggacctggaggccggtggggagaacctggtccgttacaagaaggagccttccgggtgcccggtgtgtggcaaggtgttctcctgccggagcaatatgaacaagcacctgctcacccacggcgacaagaagtacacctgcgagatctgcgggcgcaagttcttccgcgtggatgtgctcagggaccacatccatgtccacttcaaggacatcgcgttgatggatgaccaccagagggaagagtttatcggcaagatcgggatctcctcggaagaaaacgatgacaattctgacgagagcgcagactcggagcctcacaagtacagctgcaagcggtgccagctcaccttcggccgggggaaggagtacctgaagcacatcatggaggtgcacaaggagaagggctatggctgcagcatctgcaaccggcgctttgcactgaaggccacctaccacgcccacatggtcatccaccgtgaaaacctgccggaccccaacgtgcagaagtacatccacccctgcgagatctgcgggcggatcttcaacagcatcgggaacctggagcgccacaagctcatccacacaggtgtgaagagccacgcctgcgagcagtgtgggaagtcctttgccaggaaggacatgctgaaggagcacatgcgtgtgcacgacaatgtccgcgagtacctgtgtgccgagtgtgggaaaggcatgaagaccaagcacgcgctgcgccaccacatgaagctgcacaagggcatcaaggagtacgagtgcaaggagtgccaccgcaggttcgcgcagaaggtcaacatgctcaagcactgcaagcggcacacggggattaaagatttcatgtgtgaattgtgtgggaagacattcagcgagaggaacaccatggagacccacaagctcatccacacagtgggcaagcagtggacgtgctccgtgtgcgacaagaagtacgtgaccgagtacatgctgcagaagcacgttcagctcacacacgacaaggtggaggcgcagagctgccagctgtgcgggaccaaggtgtccaccagggcctccatgagccgacacatgcggcgcaagcaccccgaggtgctcgcggtgaggatcgatgacctggaccacctcccggagaccaccaccatcgacgcctcctccattggcatcgtccagcctgagctgactctggagcaggaggatttggccgaagggaagcacgggaaagctgccaagcgaagtcacaagagaaagcagaagccagaagaggaggcgggtgctccggtgcccgaggacgccaccttcagcgaatactcagagaaagagacggagttcacaggcagtgtaggcgacgagaccaattccgcagtacagagcattcagcaggtagtggtgaccctgggtgacccaaatgtgaccacaccatcgagctcagtcggcttaaccaacatcaccgtgacccccatcaccactgcggccgcgactcagtttaccaatctccagccggtggccgtggggcaccttaccacccctgaacgccagttacagctggacaactcaatcctgaccgtgacctttgataccgtcagcggctctgccatgttgcacaaccgccaaaatgacgtccagatccacccccagccggaagcctcgaacccacagtctgtggcccatttcatcaacctgacgaccctggtcaactccatcacgcccctggggagccagcttagtgaccagcacccgctcacgtggcgggcagtgccccagactgacgtcttgccaccctcgcagccgcaggcacccccacagcaggcggcccagccccaggtgcaggcggagcagcagcagcagcagatgtacagctactgagctgcgttccgggagactcggggcaagaactgcagagggatgtttgggatttgtttagatgtgtttgctggataccaaacaaacaaaaagtcatacattgcaatgtaaggttgacttagctttgcagagtatctccagatcccccgccagcaaccattacggtctgtcagcttaactctagaagggacctctggcaggccagagttttaaactggatggggctccacaccatgccttaccaaggcagtaagtcctgggccggggccgcatctgcctccccttacagaaccagtgttcgcccgacacagggttcgggaaagtgaagctgagagagaagcaggattttaagaggcaggagataagttattaggaacacaaatggttcattttcttttttcttttagagctcggttcctatgagaacacagacagtattcacaggtggcagcaggcagcagggaacattttctcctcacttctggatttttttgcaagcgagcacatagaagttaaagtaacgtgtattctctttgaactaggagtggagtcggttcttatacaactatgggctgaaaccatgaggcgtgctgagccgcacctgatcctgcaaccttcgaggtcatcacggtcatcatgtgcaaggggtcacgtgaggtcactgactccagctcaaaacgcatcttagtaatatccatgaatcgatttccaatagagtttttttccttttttttttttaactttatttcaaacatacattatgtgttcaagactgttatggccaatattgtgttttagttttatgttaacatgataaagtcatgtgcactgtaggaccatctgtccctgtccacccttcacagctgcccagatgcagagggtcgcgcggctgtgtgtgaggagtgagcctccctgctgcccccaggggctcctccgggttgtctcaggattctctgcaatccaaatgtatccattctggctgaagcccagccagaatcccgagtggaagaaacgggggaaaagtcatattttccttctgtttaaacttcaattccaaaggttggtgtatttcatgaccagttttctataaaaatattgaatgagtttggctctttacaatggaaaagtgtaggtatttctgaaacacagagaaaatgctatttcctgccaggtggtaatgaaagcagagaggttagttcactaatagaagcattaattgcccctaaaactgaatgtgcggtgaacagccaggtctgcgtgtgcggggacacgtgctgtcacgtctgtgtaccagtttcgggggcaggggccagggttgggggaggcacccagccctcctgctgcccacgacaagaaacactgagaggtgtggggagaagtttgctcttaactttcctggtactctgtttgtggccacagtgagaggacaaacctgccttaaggtgtcctgctttgccagttatcccagatcctgcactcactgggagtccatcttgaggaaacactggcatggctgagtaattgatcaggagcagtcctgatgttgccagcagaacaaaggatgattgtgtttttcaaaacgcaactttctcagcacttcactccaaacagcagacttttgaggacagggctggaatttgttttgtgcaatatatgccttcatgaactaaggaatgttcatccccaggcagcatgcaggagggtctgtggggctcacctcctcaccttacccaccatcactcgcgcctagctctcacctctcagttgaatgaatagtgggagatcatttgacttttaatttatgagaattattttatgttatttatgtatataattaactgttttatacatagtagtctcatcaaatgaattcgggcttggggtgatattgtctccattctccagatacaagtgctccaggcatccatggaatcagcaggagaccagggctcctaagatatatttttaaaaatcagtatcgatttctttttgcctttgcagaatctaaagggcaaatgacctcgcagagactcccaacgggctttgggctcatgacgaaacacccactagcattgatcttttattcctcttccctataaaataaaggccttggaaatcacaattttatttttttaaagaagttgttttagtgcctagagtaagaccgcatcaaatgttgttaaagaacctaatttagattgtgtggtatataccactgtttatctcaatacacagacacctcttacttcttgttataagtgagaactctaaagaaaaatcaaactcccaagttttctgtaaacatacgtggtcttaatagggtcactgtctgaggcaaaatgggttgtcttaaagcaattgctacaaatttgcatcaaagaaactagatagcaaaatacaacaaccatgtaccacccaggcagaagagtcctcacctatacgcagttctgcatattgatcatcatgacaggaagtatttcgttttttaactgatcccaggtgcacagatgtattcataaaggaagacattagatccagccattgtggccaccaggctctgtggacccatctcagtggagaattcgttttggacccgtggctccgtgcagctgtggactcgagtgccatccactggtgtgagtcttgcggggaggccacaggtacagctgctccccgtgaatcctggtctgtgggttgagaaggggctcgggcctctggaatgctctagcgtgtgacgtgttctcaggaaaacgttctgtgccaagtgccgcctcgctgtgtccggcatgggactgcgctggagggtccggcgtggaaggcagacctcctgtacctctatcgttcccatttgtggcatccaaaggcggaaggctcatggcttccccactagaggcggcgtcttgggctttcccattggattgtgaaaggcattaagactgtttggagatgttggctgtatttcctgtcacatcaggttgtatgatgacgaataaaaggtgctgtgacccgtgttttcaa

SEQ ID NO: 1747 - DNA, 6712 bp, Homo sapiens
gtccacgccgcccgcgccccgcagtcccacccgcaggacccccggccgcgccagggtctcgcctgcgccccccgcgcccgcccgcggactacaagtcccgccatgccccgccgccgccccccggcttccggtgctgcgcagtttccggagcggatcgcaacccggagtccggatccgatcccgctctgcacattccaaaggcaggtgtcagagatggctgaagatgggagcgaagagatcatgttcatctggtgtgaagactgcagccagtaccacgactccgaatgtcccgagctgggcccagtggtcatggtcaaagactcctttgtgttaagcagggcaaggtcatcccttcctcccaacttggagatcagacgactggaagatggagccgagggggtgttcgccatcactcagctcgtcaagcggacacagttcggtccctttgagtccaggagggtcgccaaatgggaaaaggagtctgcatttcccctgaaggtgttccagaaggacgggcaccccgtgtgcttcgacacctccaacgaggatgactgcaactggatgatgctggtgcggccagcggcggaggccgagcaccagaacctgacggcctaccagcacggcagcgacgtgtacttcaccacctccagagacatccccccgggtaccgagctgcgcgtgtggtatgcggccttctatgccaagaagatggacaagcccatgctgaagcaggccggctctggcgtccacgctgcaggcaccccagaaaacagcgcccccgtggagtcggagcccagccagtgggcgtgtaaagtgtgttctgccaccttcctggagctgcagctcctcaatgaacatctgttgggccacttagaacaagccaaaagccttcctccaggcagccaaagcgaggcagcagctcccgagaaggagcaggacacaccccggggggaaccccctgcagtgcccgagagcgagaatgttgccaccaaagaacagaagaaaaagcctcgaagggggagaaaacccaaagtgtccaaagctgagcagcctctagtcatcgtggaagacaaggaacccacagagcaagtggcagagatcattaccgaggtccctccggatgagcctgtgagtgcaacgccagatgagcggatcatggagctggttctggggaagctggccaccaccaccactgacaccagctcggttccaaagttcacccatcatcagaataacaccatcacgctcaagaggagcttaattctctcaagcagacacggcatccggcgcaagctcatcaaacagctcggggagcacaagcgggtttaccagtgcaatatctgcagcaagatcttccagaacagcagcaacctgagcaggcacgtgcgctcgcatggtgacaagctgtttaagtgcgaagagtgtgcaaaattgttcagccgcaaagagagcctaaagcagcacgtttcctacaagcacagcaggaacgaggtggacggcgagtacaggtaccgctgcggcacttgtgagaagaccttccgcatcgagagcgcgctggagttccacaactgcaggacaggactcatagcacaccctggagagggggggcccggcggcagtcggcttagagacctaccagatgacaagacgttccaatgtgagatgtgtttcagattcttctccaccaacagcaacctctccaagcacaagaagaagcacggcgacaagaagtttgcctgtgaggtctgcagcaagatgttctaccgcaaggacgtcatgctggaccaccagcgccggcacctggaaggagtgcggcgagtgaagcgagaggacctggaggccggtggggagaacctggtccgttacaagaaggagccttccgggtgcccggtgtgtggcaaggtgttctcctgccggagcaatatgaacaagcacctgctcacccacggcgacaagaagtacacctgcgagatctgcgggcgcaagttcttccgcgtggatgtgctcagggaccacatccatgtccacttcaaggacatcgcgttgatggatgaccaccagagggaagagtttatcggcaagatcgggatctcctcggaagaaaacgatgacaattctgacgagagcgcagactcggagcctcacaagtacagctgcaagcggtgccagctcaccttcggccgggggaaggagtacctgaagcacatcatggaggtgcacaaggagaagggctatggctgcagcatctgcaaccggcgctttgcactgaaggccacctaccacgcccacatggtcatccaccgtgaaaacctgccggaccccaacgtgcagaagtacatccacccctgcgagatctgcgggcggatcttcaacagcatcgggaacctggagcgccacaagctcatccacacaggtgtgaagagccacgcctgcgagcagtgtgggaagtcctttgccaggaaggacatgctgaaggagcacatgcgtgtgcacgacaatgtccgcgagtacctgtgtgccgagtgtgggaaaggcatgaagaccaagcacgcgctgcgccaccacatgaagctgcacaagggcatcaaggagtacgagtgcaaggagtgccaccgcaggttcgcgcagaaggtcaacatgctcaagcactgcaagcggcacacggggattaaagatttcatgtgtgaattgtgtgggaagacattcagcgagaggaacaccatggagacccacaagctcatccacacagtgggcaagcagtggacgtgctccgtgtgcgacaagaagtacgtgaccgagtacatgctgcagaagcacgttcagctcacacacgacaaggtggaggcgcagagctgccagctgtgcgggaccaaggtgtccaccagggcctccatgagccgacacatgcggcgcaagcaccccgaggtgctcgcggtgaggatcgatgacctggaccacctcccggagaccaccaccatcgacgcctcctccattggcatcgtccagcctgagctgactctggagcaggaggatttggccgaagggaagcacgggaaagctgccaagcgaagtcacaagagaaagcagaagccagaagaggaggcgggtgctccggtgcccgaggacgccaccttcagcgaatactcagagaaagagacggagttcacaggcagtgtaggcgacgagaccaattccgcagtacagagcattcagcaggtagtggtgaccctgggtgacccaaatgtgaccacaccatcgagctcagtcggcttaaccaacatcaccgtgacccccatcaccactgcggccgcgactcagtttaccaatctccagccggtggccgtggggcaccttaccacccctgaacgccagttacagctggacaactcaatcctgaccgtgacctttgataccgtcagcggctctgccatgttgcacaaccgccaaaatgacgtccagatccacccccagccggaagcctcgaacccacagtctgtggcccatttcatcaacctgacgaccctggtcaactccatcacgcccctggggagccagcttagtgaccagcacccgctcacgtggcgggcagtgccccagactgacgtcttgccaccctcgcagccgcaggcacccccacagcaggcggcccagccccaggtgcaggcggagcagcagcagcagcagatgtacagctactgagctgcgttccgggagactcggggcaagaactgcagagggatgtttgggatttgtttagatgtgtttgctggataccaaacaaacaaaaagtcatacattgcaatgtaaggttgacttagctttgcagagtatctccagatcccccgccagcaaccattacggtctgtcagcttaactctagaagggacctctggcaggccagagttttaaactggatggggctccacaccatgccttaccaaggcagtaagtcctgggccggggccgcatctgcctccccttacagaaccagtgttcgcccgacacagggttcgggaaagtgaagctgagagagaagcaggattttaagaggcaggagataagttattaggaacacaaatggttcattttcttttttcttttagagctcggttcctatgagaacacagacagtattcacaggtggcagcaggcagcagggaacattttctcctcacttctggatttttttgcaagcgagcacatagaagttaaagtaacgtgtattctctttgaactaggagtggagtcggttcttatacaactatgggctgaaaccatgaggcgtgctgagccgcacctgatcctgcaaccttcgaggtcatcacggtcatcatgtgcaaggggtcacgtgaggtcactgactccagctcaaaacgcatcttagtaatatccatgaatcgatttccaatagagtttttttccttttttttttttaactttatttcaaacatacattatgtgttcaagactgttatggccaatattgtgttttagttttatgttaacatgataaagtcatgtgcactgtaggaccatctgtccctgtccacccttcacagctgcccagatgcagagggtcgcgcggctgtgtgtgaggagtgagcctccctgctgcccccaggggctcctccgggttgtctcaggattctctgcaatccaaatgtatccattctggctgaagcccagccagaatcccgagtggaagaaacgggggaaaagtcatattttccttctgtttaaacttcaattccaaaggttggtgtatttcatgaccagttttctataaaaatattgaatgagtttggctctttacaatggaaaagtgtaggtatttctgaaacacagagaaaatgctatttcctgccaggtggtaatgaaagcagagaggttagttcactaatagaagcattaattgcccctaaaactgaatgtgcggtgaacagccaggtctgcgtgtgcggggacacgtgctgtcacgtctgtgtaccagtttcgggggcaggggccagggttgggggaggcacccagccctcctgctgcccacgacaagaaacactgagaggtgtggggagaagtttgctcttaactttcctggtactctgtttgtggccacagtgagaggacaaacctgccttaaggtgtcctgctttgccagttatcccagatcctgcactcactgggagtccatcttgaggaaacactggcatggctgagtaattgatcaggagcagtcctgatgttgccagcagaacaaaggatgattgtgtttttcaaaacgcaactttctcagcacttcactccaaacagcagacttttgaggacagggctggaatttgttttgtgcaatatatgccttcatgaactaaggaatgttcatccccaggcagcatgcaggagggtctgtggggctcacctcctcaccttacccaccatcactcgcgcctagctctcacctctcagttgaatgaatagtgggagatcatttgacttttaatttatgagaattattttatgttatttatgtatataattaactgttttatacatagtagtctcatcaaatgaattcgggcttggggtgatattgtctccattctccagatacaagtgctccaggcatccatggaatcagcaggagaccagggctcctaagatatatttttaaaaatcagtatcgatttctttttgcctttgcagaatctaaagggcaaatgacctcgcagagactcccaacgggctttgggctcatgacgaaacacccactagcattgatcttttattcctcttccctataaaataaaggccttggaaatcacaattttatttttttaaagaagttgttttagtgcctagagtaagaccgcatcaaatgttgttaaagaacctaatttagattgtgtggtatataccactgtttatctcaatacacagacacctcttacttcttgttataagtgagaactctaaagaaaaatcaaactcccaagttttctgtaaacatacgtggtcttaatagggtcactgtctgaggcaaaatgggttgtcttaaagcaattgctacaaatttgcatcaaagaaactagatagcaaaatacaacaaccatgtaccacccaggcagaagagtcctcacctatacgcagttctgcatattgatcatcatgacaggaagtatttcgttttttaactgatcccaggtgcacagatgtattcataaaggaagacattagatccagccattgtggccaccaggctctgtggacccatctcagtggagaattcgttttggacccgtggctccgtgcagctgtggactcgagtgccatccactggtgtgagtcttgcggggaggccacaggtacagctgctccccgtgaatcctggtctgtgggttgagaaggggctcgggcctctggaatgctctagcgtgtgacgtgttctcaggaaaacgttctgtgccaagtgccgcctcgctgtgtccggcatgggactgcgctggagggtccggcgtggaaggcagacctcctgtacctctatcgttcccatttgtggcatccaaaggcggaaggctcatggcttccccactagaggcggcgtcttgggctttcccattggattgtgaaaggcattaagactgtttggagatgttggctgtatttcctgtcacatcaggttgtatgatgacgaataaaaggtgctgtgacccgtgttttc

SEQ ID NO: 1748 - DNA, 3052 bp, Homo sapiens
ctctctcacacacacacacacacacacacacacacacacacacacacacacacacacacacacacacacactcactctattttgtgctgtcgtaaaacccacgtgtccagccgggaagctgccagagcgtggaaccaaggagccaggacgcggcagcggccaagcgcagcagcccacggcggttgagtcgggcgcccaggtccgtccgcactctcgcgccctccgcgggcctcccaattttctcgcttgcaggtcgggaggtttccgggcggcacaatctctaggactctcctcccgcgctgctcaggggcatgtagcgcacgcagggcgcacactctcgcgcacccgcacgctcaccgagacacccgcacgcacccaccggcagcaccgagttttcagttcgaggcgccggacatgctgaagcccggagaccccggcggttcggccttcctcaaagtggacccagcctacctgcagcactggcagcaactcttccctcacggaggcgcaggcccgctcaagggcagcggcgccgcgggtctcctgagcgcgccgcagcctcttcagccgccgccgccgcccccgcccccggagcgcgctgagcctccgccggacagcctgcgcccgcggcccgcctctctctcctccgcctcgtccacgccggcttcctcttccacctccgcctcctccgcctcctcctgcgctgctgcggccgctgccgccgcgctggctggtctctcggccctgccggtgtcgcagctgccggtgttcgcgcctctagccgccgctgccgtcgccgccgagccgctgccccccaaggaactgtgcctcggcgccacctccggccccgggcccgtcaagtgcggtggtggtggcggcggcggcggggagggtcgcggcgccccgcgcttccgctgcagcgcagaggagctggactattacctgtatggccagcagcgcatggagatcatcccgctcaaccagcacaccagcgaccccaacaaccgttgcgacatgtgcgcggacaaccgcaacggcgagtgccctatgcatgggccactgcactcgctgcgccggcttgtgggcaccagcagcgctgcggccgccgcgcccccgccggagctgccggagtggctgcgggacctgcctcgcgaggtgtgcctctgcaccagtactgtgcccggcctggcctacggcatctgcgcggcgcagaggatccagcaaggcacctggattggacctttccaaggcgtgcttctgcccccagagaaggtgcaggcaggcgccgtgaggaacacgcagcatctctgggagatatatgaccaggatgggacactacagcactttattgatggtggggaacctagtaagtcgagctggatgaggtatatccgatgtgcaaggcactgcggagaacagaatctaacagtagttcagtacaggtcgaatatattctaccgagcctgtatagatatccctaggggcaccgagcttctggtgtggtacaatgacagctatacgtctttctttgggatccccttacaatgcattgcccaggatgaaaacttaaatgtcccttcaacggtaatggaagccatgtgcagacaagacgccctgcagcccttcaacaaaagcagcaaactcgcccctaccacccagcagcgctccgttgttttcccccagactccgtgcagcaggaacttctctcttctggataagtctgggcccattgaatcaggatttaatcaaatcaacgtgaaaaaccagcgagtcctggcaagcccaacttccacaagccagctccactcggagttcagtgactggcatctttggaaatgtgggcagtgctttaagactttcacccagcggatcctcttacagatgcacgtgtgcacgcagaaccccgacagaccctaccaatgcggccactgctcccagtccttttcccagccttcagaactgaggaaccacgtggtcactcactctagtgaccggcctttcaagtgcggctactgtggtcgtgcctttgccggggccaccaccctcaacaaccacatccgaacccacactggagaaaagcccttcaagtgcgagaggtgtgagaggagcttcacgcaggccacccagctgagccgacaccagcggatgcccaatgagtgcaagccaataactgagagcccagaatcaatcgaagtggattaacggattgactggttggaattaaactgcaaggaaagtcatgattaaatgtcacggacacttaagcaaaaccaaagatttcctctgagcaactttcaatcagtcccagaaaaccaaaagcagtaataaaataagtaagatgttaagagatattgatcctggcatggaagtcagaccaggaaagagattatttatttatgacttagggatgagacttatttcagtggacaactaacctgggatggttaacatttccagtcccaccatgtattttgctttgtttctaaaaagctttttaaaaactgttatttaataccaaagggaggaatcgtatgggttcttctgcccaccgttgtgactaagaatgcacagggacttggttctcgttgcacctttttttagtaacatgtttcatggggacccactgtacagcccttcattctgctgtgtcagtttggcctggcctgacactggctgccccagcggggaccacggaagcagagtgagagccttcgctgagtcaatgctaccttcagccccagacgcatcccatttccatgtcttccatgctcactgctcatgcactttttacacggtttcttccaaacagcccggtcttgatgcaggagagtctggaaaaggaagaaaatggtttcagtttcaaaattcaaaggaaaaagttgaggacttattttgtcctgtcaagattgcaagaacatgtaaaatgtacggagcttcataatacgttatattgttccgaagcagctcgttgagaaacatttgttttcaataacattttagcttaaaaaaaaaaaaagaaaatgaaaataaagttctttggtttaaggctgga

SEQ ID NO: 1749 - DNA, 2442 bp, Homo sapiens
atcattcccttactcgaatgaattaaagtacaggattggggctaaataatgtgagtgccacgctctttctgaagctcttatatcaaggaacatgcattacaactttcctaatccctgcttccctcacttccagattgtgagatgtgtcagaacttcttcattgacagctgtgctgctcatgggccccctacatttgtaaaggacagtgcagtggacaaggggcatcccaaccgttcagccctcagtctgcccccggggctgagaattgggccatcaggcatccctcaggctgggcttggagtatggaacgaggcatctgatctgccactgggtctgcactttggcccctatgagggccgaattacagaagacgaagaggcagccaacagtggatattcctggctaatcaccaaggggagaaactgctatgagtatgtggatggaaaagataaatcctcggccaactggatgagaaccaaagccagagatccatccatgtccctcatgctgtctggccttttcaagtcaaaaatttctcagtcaacatgtggaacgcaatcactcctctcagaacttcccaggaccatctgcaagaaaacttctccaaccagagaatccctgcccaggggatcagaatcaggagcggcaatattctgatccacgctgctgtaatgacaaaaccaaaggtcaagagatcaaagaaaggtccaaactcttgaataaaaggacatggcagagggagatttcaagggccttttctagcccacccaaaggacaaatggggagctctagagtgggagaaagaatgatggaagaagagtccagaacaggccagaaagtgaatccagggaacacaggcaaattatttgtgggggtaggaatctcaagaattgcgaaagtcaaatatggagagtgtgggcaaggtttcagtgataagtcagatgttattacacaccaaaggacacacacaggggggaagccctacgtctgcagagagtgtgggagggctttagccggaagtcagacctcctcagtcaccagaggacacacacaggggagaagccttatgtctgcagagagtgtgagcggggctttagccggaagtcagtcctcctcattcaccagaggacacacaggggagacgccccagtctgcaggaaggatgagtaagtcattagtaataaaaccttatctcaatagccacaagaagacaaacgtgatcaccacacacttgcacaccccagctctgaggtggcttcagcgaaagtctgctaaccccttacattccccgagagtgtaaagagatcggaaataactaattaaacaaatccgccactttcatgactagagttgaggaagaacaggggatagttctgtaagtgttcgggggacgtcaacatgtgtggttgtttcccgcactgatcccctccattttttgtgttttgcctcctgttctaattaattttgtctccatacatatctgaaccccaagtgtgtacctcattcttcccttatcactgaaggaaggaagagtccagaagggccacagagaactcaaacgttcagttcaagtctccacaggaattcaaccccagaaagacataaacttggagtccatctggtttaattattggagaatcgattcccaagtccaggaagagaaatgtagggttttacagagtcgcagcaggaaagagagctccctggtctcctgggaagtgtgacctcttctaatggacccctctcctctgctgccatactcccccttggctccccctgtctcctctcctgatttcctccaatctctgtagccccagaagtgaacgccagacaggaacacgcatgtgtgtatatatgtgttcacgtgtgctatgtgtgttaagcctgcatgcatgggtgtgggggtatgtgccctctgtgtacgtatctgtgtgagtgtgggggtttcaagggtgtattaggaataacgctcaaaatcctaaggaaattgaatactctgagagaagagagacagaccctctcatactgttttatattgttttatactcagaaaaggaaaaagaagcaaaactaaaggcaggtagcctggcgcctaggaaccagacctgaaaccaaggaaccagacccgaaaccaggcctgggccggcctgacctaagcctggtagttaaaattcgacccctgacctagcaactgatgttatctatagattatagaaagacattgtgaaacttcccggtctgttctgttccactctgaccatcggtgcatgcagcccctgtcacctaccccctgcttgctcaatcgatcacgaccctctcacgtggacccccttagagttgtgagcccttaaaagggacaggaattgctcactcggggagctcggctcttgagacagcagtcttgctgatgctcctggccgaataaaccgcttccttctttaa

SEQ ID NO: 1750 - DNA, 2937 bp, Homo sapiens
ttctagacagtcccagcaccatgagccctgaaaggtcccaagaggagagcccagaaggagacacagagagaacagagcggaagcccatggtcaaagatgccttcaaagacatttccatatacttcaccaaggaagaatgggcagaaatgggagactgggagaaaactcgctataggaatgtgaaaatgaactataatgcactgattactgtaggtctcagagccactcgaccagctttcatgtgtcaccgaaggcaggccatcaaactccaggtggatgacacagaagattccgatgaagaatggacacctaggcagcaagtcaaacctccttggatggccttcagaggagaacagagtaaacaccagaagggaatgcccaaggcgtcattcaataatgaatctagtttgagagaattgtcaggaacgccaaatttactgaatacaagtgactcagagcaggctcagaaaccagtgtcccctcctggagaagcaagtacctctggacagcactctagactaaaactggaactcaggaggaaggagactgaaggaaagatgtatagcctgcgagaaagaaagggtcatgcatacaaagagatcagcgagccacaggatgatgactacctctattgtgagatgtgtcagaacttcttcattgacagctgtgctgctcatgggccccctacatttgtaaaggacagtgcagtggacaaggggcatcccaaccgttcagccctcagtctgcccccggggctgagaattgggccatcaggcatccctcaggctgggcttggagtatggaacgaggcatctgatctgccactgggtctgcactttggcccctatgagggccgaattacagaagacgaagaggcagccaacagtggatattcctggctaatcaccaaggggagaaactgctatgagtatgtggatggaaaagataaatcctcggccaactggatgagaaccaaagccagagatccatccatgtccctcatgctgtctggccttttcaagtcaaaaatttctcagtcaacatgtggaacgcaatcactcctctcagaacttcccaggaccatctgcaagaaaacttctccaaccagagaatccctgcccaggggatcagaatcaggagcggcaatattctgatccacgctgctgtaatgacaaaaccaaaggtcaagagatcaaagaaaggtccaaactcttgaataaaaggacatggcagagggagatttcaagggccttttctagcccacccaaaggacaaatggggagctctagagtgggagaaagaatgatggaagaagagtccagaacaggccagaaagtgaatccagggaacacaggcaaattatttgtgggggtaggaatctcaagaattgcgaaagtcaaatatggagagtgtgggcaaggtttcagtgataagtcagatgttattacacaccaaaggacacacacaggggggaagccctacgtctgcagagagtgtgggagggctttagccggaagtcagacctcctcagtcaccagaggacacacacaggggagaagccttatgtctgcagagagtgtgagcggggctttagccggaagtcagtcctcctcattcaccagaggacacacaggggagacgccccagtctgcaggaaggatgagtaagtcattagtaataaaaccttatctcaatagccacaagaagacaaacgtgatcaccacacacttgcacaccccagctctgaggtggcttcagcgaaagtctgctaaccccttacattccccgagagtgtaaagagatcggaaataactaattaaacaaatccgccactttcatgactagagttgaggaagaacaggggatagttctgtaagtgttcgggggacgtcaacatgtgtggttgtttcccgcactgatcccctccattttttgtgttttgcctcctgttctaattaattttgtctccatacatatctgaaccccaagtgtgtacctcattcttcccttatcactgaaggaaggaagagtccagaagggccacagagaactcaaacgttcagttcaagtctccacaggaattcaaccccagaaagacataaacttggagtccatctggtttaattattggagaatcgattcccaagtccaggaagagaaatgtagggttttacagagtcgcagcaggaaagagagctccctggtctcctgggaagtgtgacctcttctaatggacccctctcctctgctgccatactcccccttggctccccctgtctcctctcctgatttcctccaatctctgtagccccagaagtgaacgccagacaggaacacgcatgtgtgtatatatgtgttcacgtgtgctatgtgtgttaagcctgcatgcatgggtgtgggggtatgtgccctctgtgtacgtatctgtgtgagtgtgggggtttcaagggtgtattaggaataacgctcaaaatcctaaggaaattgaatactctgagagaagagagacagaccctctcatactgttttatattgttttatactcagaaaaggaaaaagaagcaaaactaaaggcaggtagcctggcgcctaggaaccagacctgaaaccaaggaaccagacccgaaaccaggcctgggccggcctgacctaagcctggtagttaaaattcgacccctgacctagcaactgatgttatctatagattatagaaagacattgtgaaacttcccggtctgttctgttccactctgaccatcggtgcatgcagcccctgtcacctaccccctgcttgctcaatcgatcacgaccctctcacgtggacccccttagagttgtgagcccttaaaagggacaggaattgctcactcggggagctcggctcttgagacagcagtcttgctgatgctcctggccgaataaaccgcttccttcttt

SEQ ID NO: 1751 - DNA, 2961 bp, Homo sapiens
ttctagacagtcccagcaccatgagccctgaaaggtcccaagaggagagcccagaaggagacacagagagaacagagcggaagcccatggtcaaagatgccttcaaagacatttccatatacttcaccaaggaagaatgggcagaaatgggagactgggagaaaactcgctataggaatgtgaaaatgaactataatgcactgattactgtaggtctcagagccactcgaccagctttcatgtgtcaccgaaggcaggccatcaaactccaggtggatgacacagaagattccgatgaagaatggacacctaggcagcaagtcaaacctccttggatggccttcagaggagaacagagtaaacaccagaagattgtgagatgtgtcagaacttcttcattgacagctgtgctgctcatgggccccctacatttgtaaaggacagtgcagtggacaaggggcatcccaaccgttcagccctcagtctgcccccggggctgagaattgggccatcaggcatccctcaggctgggcttggagtatggaacgaggcatctgatctgccactgggtctgcactttggcccctatgagggccgaattacagaagacgaagaggcagccaacagtggatattcctggctaatcaccaaggggagaaactgctatgagtatgtggatggaaaagataaatcctcggccaactggatgaggtatgtgaactgtgcccgggatgatgaagagcagaacctggtggccttccagtaccacaggcagatcttctatagaacctgccgagtcattaggccaggctgtgaactgctggtctggtctggggatgagtatggccaggaactgggcatcagatcttctatagaacctgccgagtcattaggccaggctgtgaactgctggtctggtatggggatgagtatggccaggaactgggcatcaagtggggcagcaagtggaagaaagagctcatggcagggagagaaccaaagccagagatccatccatgtccctcatgctgtctggccttttcaagtcaaaaatttctcagtcaacatgtggaacgcaatcactcctctcagaacttcccaggaccatctgcaagaaaacttctccaaccagagaatccctgcccaggggatcagaatcaggagcggcaatattctgatccacgctgctgtaatgacaaaaccaaaggtcaagagatcaaagaaaggtccaaactcttgaataaaaggacatggcagagggagatttcaagggccttttctagcccacccaaaggacaaatggggagctctagagtgggagaaagaatgatggaagaagagtccagaacaggccagaaagtgaatccagggaacacaggcaaattatttgtgggggtaggaatctcaagaattgcgaaagtcaaatatggagagtgtgggcaaggtttcagtgataagtcagatgttattacacaccaaaggacacacacaggggggaagccctacgtctgcagagagtgtgggagggctttagccggaagtcagacctcctcagtcaccagaggacacacacaggggagaagccttatgtctgcagagagtgtgagcggggctttagccggaagtcagtcctcctcattcaccagaggacacacaggggagacgccccagtctgcaggaaggatgagtaagtcattagtaataaaaccttatctcaatagccacaagaagacaaacgtgatcaccacacacttgcacaccccagctctgaggtggcttcagcgaaagtctgctaaccccttacattccccgagagtgtaaagagatcggaaataactaattaaacaaatccgccactttcatgactagagttgaggaagaacaggggatagttctgtaagtgttcgggggacgtcaacatgtgtggttgtttcccgcactgatcccctccattttttgtgttttgcctcctgttctaattaattttgtctccatacatatctgaaccccaagtgtgtacctcattcttcccttatcactgaaggaaggaagagtccagaagggccacagagaactcaaacgttcagttcaagtctccacaggaattcaaccccagaaagacataaacttggagtccatctggtttaattattggagaatcgattcccaagtccaggaagagaaatgtagggttttacagagtcgcagcaggaaagagagctccctggtctcctgggaagtgtgacctcttctaatggacccctctcctctgctgccatactcccccttggctccccctgtctcctctcctgatttcctccaatctctgtagccccagaagtgaacgccagacaggaacacgcatgtgtgtatatatgtgttcacgtgtgctatgtgtgttaagcctgcatgcatgggtgtgggggtatgtgccctctgtgtacgtatctgtgtgagtgtgggggtttcaagggtgtattaggaataacgctcaaaatcctaaggaaattgaatactctgagagaagagagacagaccctctcatactgttttatattgttttatactcagaaaaggaaaaagaagcaaaactaaaggcaggtagcctggcgcctaggaaccagacctgaaaccaaggaaccagacccgaaaccaggcctgggccggcctgacctaagcctggtagttaaaattcgacccctgacctagcaactgatgttatctatagattatagaaagacattgtgaaacttcccggtctgttctgttccactctgaccatcggtgcatgcagcccctgtcacctaccccctgcttgctcaatcgatcacgaccctctcacgtggacccccttagagttgtgagcccttaaaagggacaggaattgctcactcggggagctcggctcttgagacagcagtcttgctgatgctcctggccgaataaaccgcttccttcttt

SEQ ID NO: 1752 - DNA, 3220 bp, Homo sapiens
ttctagacagtcccagcaccatgagccctgaaaggtcccaagaggagagcccagaaggagacacagagagaacagagcggaagcccatggtcaaagatgccttcaaagacatttccatatacttcaccaaggaagaatgggcagaaatgggagactgggagaaaactcgctataggaatgtgaaaatgaactataatgcactgattactgtaggtctcagagccactcgaccagctttcatgtgtcaccgaaggcaggccatcaaactccaggtggatgacacagaagattccgatgaagaatggacacctaggcagcaagtcaaacctccttggatggccttcagaggagaacagagtaaacaccagaagggaatgcccaaggcgtcattcaataatgaatctagtttgagagaattgtcaggaacgccaaatttactgaatacaagtgactcagagcaggctcagaaaccagtgtcccctcctggagaagcaagtacctctggacagcactctagactaaaactggaactcaggaggaaggagactgaaggaaagatgtatagcctgcgagaaagaaagggtcatgcatacaaagagatcagcgagccacaggatgatgactacctctattgtgagatgtgtcagaacttcttcattgacagctgtgctgctcatgggccccctacatttgtaaaggacagtgcagtggacaaggggcatcccaaccgttcagccctcagtctgcccccggggctgagaattgggccatcaggcatccctcaggctgggcttggagtatggaacgaggcatctgatctgccactgggtctgcactttggcccctatgagggccgaattacagaagacgaagaggcagccaacagtggatattcctggctaatcaccaaggggagaaactgctatgagtatgtggatggaaaagataaatcctcggccaactggatgaggtatgtgaactgtgcccgggatgatgaagagcagaacctggtggccttccagtaccacaggcagatcttctatagaacctgccgagtcattaggccaggctgtgaactgctggtctggtctggggatgagtatggccaggaactgggcatcagatcttctatagaacctgccgagtcattaggccaggctgtgaactgctggtctggtatggggatgagtatggccaggaactgggcatcaagtggggcagcaagtggaagaaagagctcatggcagggagagaaccaaagccagagatccatccatgtccctcatgctgtctggccttttcaagtcaaaaatttctcagtcaacatgtggaacgcaatcactcctctcagaacttcccaggaccatctgcaagaaaacttctccaaccagagaatccctgcccaggggatcagaatcaggagcggcaatattctgatccacgctgctgtaatgacaaaaccaaaggtcaagagatcaaagaaaggtccaaactcttgaataaaaggacatggcagagggagatttcaagggccttttctagcccacccaaaggacaaatggggagctctagagtgggagaaagaatgatggaagaagagtccagaacaggccagaaagtgaatccagggaacacaggcaaattatttgtgggggtaggaatctcaagaattgcgaaagtcaaatatggagagtgtgggcaaggtttcagtgataagtcagatgttattacacaccaaaggacacacacaggggggaagccctacgtctgcagagagtgtgggagggctttagccggaagtcagacctcctcagtcaccagaggacacacacaggggagaagccttatgtctgcagagagtgtgagcggggctttagccggaagtcagtcctcctcattcaccagaggacacacaggggagacgccccagtctgcaggaaggatgagtaagtcattagtaataaaaccttatctcaatagccacaagaagacaaacgtgatcaccacacacttgcacaccccagctctgaggtggcttcagcgaaagtctgctaaccccttacattccccgagagtgtaaagagatcggaaataactaattaaacaaatccgccactttcatgactagagttgaggaagaacaggggatagttctgtaagtgttcgggggacgtcaacatgtgtggttgtttcccgcactgatcccctccattttttgtgttttgcctcctgttctaattaattttgtctccatacatatctgaaccccaagtgtgtacctcattcttcccttatcactgaaggaaggaagagtccagaagggccacagagaactcaaacgttcagttcaagtctccacaggaattcaaccccagaaagacataaacttggagtccatctggtttaattattggagaatcgattcccaagtccaggaagagaaatgtagggttttacagagtcgcagcaggaaagagagctccctggtctcctgggaagtgtgacctcttctaatggacccctctcctctgctgccatactcccccttggctccccctgtctcctctcctgatttcctccaatctctgtagccccagaagtgaacgccagacaggaacacgcatgtgtgtatatatgtgttcacgtgtgctatgtgtgttaagcctgcatgcatgggtgtgggggtatgtgccctctgtgtacgtatctgtgtgagtgtgggggtttcaagggtgtattaggaataacgctcaaaatcctaaggaaattgaatactctgagagaagagagacagaccctctcatactgttttatattgttttatactcagaaaaggaaaaagaagcaaaactaaaggcaggtagcctggcgcctaggaaccagacctgaaaccaaggaaccagacccgaaaccaggcctgggccggcctgacctaagcctggtagttaaaattcgacccctgacctagcaactgatgttatctatagattatagaaagacattgtgaaacttcccggtctgttctgttccactctgaccatcggtgcatgcagcccctgtcacctaccccctgcttgctcaatcgatcacgaccctctcacgtggacccccttagagttgtgagcccttaaaagggacaggaattgctcactcggggagctcggctcttgagacagcagtcttgctgatgctcctggccgaataaaccgcttccttcttt

SEQ ID NO: 1753 - DNA, 4095 bp, Homo sapiens
aaaagcagcatcagacaagagctttattaatcccttacacgagcaaatgcgatctctgacctactagacttgttttcctacaatttcacaaaaagcctcgctagaggaatgtgcaaggacagaagggaaactgaggagacccgcaactcattagcgaaataatagggtgcacttcaataaaaatgcggtcctgaagtggagcagactcaccggcaaggagcccggaaaatcgtcaggggcggcggcaaaatactatcaaatcagcctgggaagcatcttttcgctcagcaagttcaagagaacaaatatgttacaatccttgcctattcttgcctccacttcataatgtcataaaagccacctggggtgtcatttatcaacctctctccagcccactcttccaaaataacactacagtttcctacatgtgtatttttgccaggactccaaagagccttgctaaagtggaacaagcaaaatcctcccctggcctcctgggactgcagtcaccaggctgtcaaagcctcaataccccactgagttccagagaagggtctcaaagctgggagaggatcaaactaacatggagtagagaattgaactgtgaaaaagaagcccgagattccccagcgacgtggtgttgcagccccgttgaaggagtcaacttgcaggctgttaaagacctcaagtcattagcatcagctgctgcactaaaggggcaagtcagcgcctctaagtggcttagcgcacaaacgaggctcccgagacggcctcggcaactccatcccctcctccaccacccgctggatgtgaaaagctttccggagcccatcttgggggaagcttggtagtgttggcgctcctgaagagagacgacgcccgtttatcacccccaggcaactagctgcgcaaatcagcggtggctccagggctagagaatccctggagctaaccgcacccctctccctttcacggaacgcggactccggggaaatacgcacggggtccgcacgcgctgggtgtccagctctctgtcacagcttctccaagtgcctagtgaaacggggaaaggccctctccaatcattttggaagagcctaaaaggcggcaacaccaacacctcttgacatggaaatacactgatacaataggcaaaaggaaacactcgattgcatcttcccggttccaggtggccttatttgggagattctatactgaccttattcctgtgatggaggatactggcatccagcgaggcatctgggatggagatgccaaggctgtccaacaatgtctgacagatatttttaccagcgtttacaccacctgcgacatccctgagaatgctatatttggtccctgtgtcctgagccatacttccctatatgacagcatagctttcatagctctcaagtctactgacaagagaacagtaccgtatatctttcgggtagacacctcagcagcaaatggttcctcagaaggtctcatgtggctgcggttggtccaatcggccagagataaggaagagcagaaccttgaagcctacataaaaaacggacagctgttctaccgctctctccgcaggattgccaaagacgaggagttactagtttggtacgggaaagaactgactgagttactcttgctctgcccctctagatcccacaacaaaatgaatgggtcgtccccttacacatgcctggaatgcagccaacgtttccagtttgagttcccctatgtggcgcatctgcgtttccgctgccccaagagacttcacagcgctgatataagtccccaagacgaacaaggcggcggcgtgggcaccaaggaccacgggggcggcggcggcggtggcaaagaccagcagcagcagcagcaggaggcacctttaggcccgggtcccaagttttgcaaagccggccccctccaccactacccatccccctccccggaaagcagcaacccatccgctgccgccggcggcagcagcgcgaagccatccacagacttccacaacctggccagggagctggaaaactcccggggaggcagcagctgctccccagcccagagcctcagcagcggtagcggcagcggcggcggcggcggccaccaggaggcggagctgagtcccgacggcatcgccacgggcggcggcaaaggaaagaggaaattcccggaggaggcggcggagggcggcggtggcgctggtctggtagggggccggggccgcttcgtagagcggcccctcccggcctccaaggaggatctggtgtgcacaccgcagcagtaccgagcctcgggcagctacttcggcctggaagagaacggccgcctcttcgcgccgccaagtcccgagacgggcgaggcgaagcgcagcgccttcgtggaggtgaagaaggctgcccgcgcggccagcctgcaggaggaggggacagccgacggcgcgggagtcgcctccgaggaccaggacgctggcggcggcggcggctcctccacgcccgcggccgcgtcaccggtgggcgccgagaagctgctggccccgcggcctgggggcccgctgcccagccggctcgagggcggcagtcctgcgaggggcagcgccttcacttcggtgccgcagctgggcagcgcgggcagcaccagcggtgggggcggaacgggcgccggggccgcaggcggcgcgggcgggggccagggcgccgcgtcggacgagcgcaaaagcgccttctcgcagccagcacgctctttctcgcagctgtccccgctggtgctgggccagaagctgggcgcgctcgagccatgccaccccgccgacggcgtgggccccaccagactctatcccgccgccgcggaccctctagcggtgaagctccagggggccgcggacctgaacggaggttgcgggtccctgccgagcggcggcggcggcctgcctaagcagagccccttcctgtacgccaccgccttctggcccaagagctccgctgccgctgcagccgcggctgcggcggcggccgcggggcccttgcagctgcagctgccctcggcgctcacgctgctgccgccctccttcacctcgctgtgtctgcccgcgcagaactggtgcgccaagtgcaatgcctccttccgcatgacctccgacctggtgtaccatatgaggtcgcaccacaaaaaggagtatgcgatggagcccttggtgaagcggcggcgagaggagaaactcaagtgccccatctgcaatgagtccttcagggagcgccaccacctctccaggcacatgacctcgcataattgactcggaaaggaccccagctttccacgcgcgcgcaagcacagttaagccacctgcaggaataaacacgcgagaacatccaccgcttccttgcaccccgaaaccctgcacaaagacacatacattcaccgcccccccgcccccccaacgcgcacacacacgtcctctcctcccaggaacctcattcaaatatttacccgggacacacacccccccccacacacacacacagacacactcacacacaagagccaggatggtggagttttgattgggtgggttgtttgagggggttttcttttgaatgcacgcattttcactttccccaaaacaaaggtacattttttaaaatgtcatatattgcaacatattgatgcatttgtcatacgtttctacttaaattattaagcacttacgatttagatgtaataattatatgtaagggcaaaatttattttagatataaagtaaaggaggagggtgagatgctttctgcatttcttgatgacagtttgtgttcctacaaaaataaacaaaatgaataaaaagggatcaccattcaatttgagtttccagggggaagtgcatgtataatgaaatgataatggacttcaatgaagaatgtcatcaattatgtacatatgtattttcttttaatacaaagtgtaattttgtgccagtgaaatggagtctgaatagttatgtgtttcttttatccctggaaatatttattaaactttatagtttatccgagtatgttggatgctttgacaataaatgactattttcttcaaagc

SEQ ID NO: 1754 - DNA, 3124 bp, Homo sapiens
gtcactgcatcgggtccatctgtacaactctctccgtttctccgtctctctccctccctccctccctccacccccccaatctttttctccccatctctccatctctctcttatctcttcaggaagagcctaaaaggcggcaacaccaacacctcttgacatggaaatacactgatacaataggcaaaaggaaacactcgattgcatcttcccggttccaggtggccttatttgggagattctatactgaccttattcctgtgatggaggatactggcatccagcgaggcatctgggatggagatgccaaggctgtccaacaatgtctgacagatatttttaccagcgtttacaccacctgcgacatccctgagaatgctatatttggtccctgtgtcctgagccatacttccctatatgacagcatagctttcatagctctcaagtctactgacaagagaacagtaccgtatatctttcgggtagacacctcagcagcaaatggttcctcagaaggtctcatgtggctgcggttggtccaatcggccagagataaggaagagcagaaccttgaagcctacataaaaaacggacagctgttctaccgctctctccgcaggattgccaaagacgaggagttactagtttggtacgggaaagaactgactgagttactcttgctctgcccctctagatcccacaacaaaatgaatgggtcgtccccttacacatgcctggaatgcagccaacgtttccagtttgagttcccctatgtggcgcatctgcgtttccgctgccccaagagacttcacagcgctgatataagtccccaagacgaacaaggcggcggcgtgggcaccaaggaccacgggggcggcggcggcggtggcaaagaccagcagcagcagcagcaggaggcacctttaggcccgggtcccaagttttgcaaagccggccccctccaccactacccatccccctccccggaaagcagcaacccatccgctgccgccggcggcagcagcgcgaagccatccacagacttccacaacctggccagggagctggaaaactcccggggaggcagcagctgctccccagcccagagcctcagcagcggtagcggcagcggcggcggcggcggccaccaggaggcggagctgagtcccgacggcatcgccacgggcggcggcaaaggaaagaggaaattcccggaggaggcggcggagggcggcggtggcgctggtctggtagggggccggggccgcttcgtagagcggcccctcccggcctccaaggaggatctggtgtgcacaccgcagcagtaccgagcctcgggcagctacttcggcctggaagagaacggccgcctcttcgcgccgccaagtcccgagacgggcgaggcgaagcgcagcgccttcgtggaggtgaagaaggctgcccgcgcggccagcctgcaggaggaggggacagccgacggcgcgggagtcgcctccgaggaccaggacgctggcggcggcggcggctcctccacgcccgcggccgcgtcaccggtgggcgccgagaagctgctggccccgcggcctgggggcccgctgcccagccggctcgagggcggcagtcctgcgaggggcagcgccttcacttcggtgccgcagctgggcagcgcgggcagcaccagcggtgggggcggaacgggcgccggggccgcaggcggcgcgggcgggggccagggcgccgcgtcggacgagcgcaaaagcgccttctcgcagccagcacgctctttctcgcagctgtccccgctggtgctgggccagaagctgggcgcgctcgagccatgccaccccgccgacggcgtgggccccaccagactctatcccgccgccgcggaccctctagcggtgaagctccagggggccgcggacctgaacggaggttgcgggtccctgccgagcggcggcggcggcctgcctaagcagagccccttcctgtacgccaccgccttctggcccaagagctccgctgccgctgcagccgcggctgcggcggcggccgcggggcccttgcagctgcagctgccctcggcgctcacgctgctgccgccctccttcacctcgctgtgtctgcccgcgcagaactggtgcgccaagtgcaatgcctccttccgcatgacctccgacctggtgtaccatatgaggtcgcaccacaaaaaggagtatgcgatggagcccttggtgaagcggcggcgagaggagaaactcaagtgccccatctgcaatgagtccttcagggagcgccaccacctctccaggcacatgacctcgcataattgactcggaaaggaccccagctttccacgcgcgcgcaagcacagttaagccacctgcaggaataaacacgcgagaacatccaccgcttccttgcaccccgaaaccctgcacaaagacacatacattcaccgcccccccgcccccccaacgcgcacacacacgtcctctcctcccaggaacctcattcaaatatttacccgggacacacacccccccccacacacacacacagacacactcacacacaagagccaggatggtggagttttgattgggtgggttgtttgagggggttttcttttgaatgcacgcattttcactttccccaaaacaaaggtacattttttaaaatgtcatatattgcaacatattgatgcatttgtcatacgtttctacttaaattattaagcacttacgatttagatgtaataattatatgtaagggcaaaatttattttagatataaagtaaaggaggagggtgagatgctttctgcatttcttgatgacagtttgtgttcctacaaaaataaacaaaatgaataaaaagggatcaccattcaatttgagtttccagggggaagtgcatgtataatgaaatgataatggacttcaatgaagaatgtcatcaattatgtacatatgtattttcttttaatacaaagtgtaattttgtgccagtgaaatggagtctgaatagttatgtgtttcttttatccctggaaatatttattaaactttatagtttatccgagtatgttggatgctttgacaataaatgactattttcttcaaa

SEQ ID NO: 1755 - DNA, 3706 bp, Homo sapiens
ggcgtcccgcccccgccccggggaacgctgcctctgccgcaaagatgcccccttccgctggaaagcggtcataaaagccacctggggtgtcatttatcaacctctctccagcccactcttccaaaataacactacagtttcctacatgtgtatttttgccaggactccaaagagccttgctaaagtggaacaaggagtagagaattgaactgtgaaaaagaagcccgagattccccagcgacgtggtgttgcagccccgttgaaggagtcaacttgcaggctgttaaagacctcaagtcattagcatcagctgctgcactaaaggggcaagtcagcgcctctaagtggcttagcgcacaaacgaggctcccgagacggcctcggcaactccatcccctcctccaccacccgctggatgtgaaaagctttccggagcccatcttgggggaagcttggtagtgttggcgctcctgaagagagacgacgcccgtttatcacccccaggcaactagctgcgcaaatcagcggtggctccagggctagagaatccctggagctaaccgcacccctctccctttcacggaacgcggactccggggaaatacgcacggggtccgcacgcgctgggtgtccagctctctgtcacagcttctccaagtgcctagtgaaacggggaaaggccctctccaatcattttggaagagcctaaaaggcggcaacaccaacacctcttgacatggaaatacactgatacaataggcaaaaggaaacactcgattgcatcttcccggttccaggtggccttatttgggagattctatactgaccttattcctgtgatggaggatactggcatccagcgaggcatctgggatggagatgccaaggctgtccaacaatgtctgacagatatttttaccagcgtttacaccacctgcgacatccctgagaatgctatatttggtccctgtgtcctgagccatacttccctatatgacagcatagctttcatagctctcaagtctactgacaagagaacagtaccgtatatctttcgggtagacacctcagcagcaaatggttcctcagaaggtctcatgtggctgcggttggtccaatcggccagagataaggaagagcagaaccttgaagcctacataaaaaacggacagctgttctaccgctctctccgcaggattgccaaagacgaggagttactagtttggtacgggaaagaactgactgagttactcttgctctgcccctctagatcccacaacaaaatgaatgggtcgtccccttacacatgcctggaatgcagccaacgtttccagtttgagttcccctatgtggcgcatctgcgtttccgctgccccaagagacttcacagcgctgatataagtccccaagacgaacaaggcggcggcgtgggcaccaaggaccacgggggcggcggcggcggtggcaaagaccagcagcagcagcagcaggaggcacctttaggcccgggtcccaagttttgcaaagccggccccctccaccactacccatccccctccccggaaagcagcaacccatccgctgccgccggcggcagcagcgcgaagccatccacagacttccacaacctggccagggagctggaaaactcccggggaggcagcagctgctccccagcccagagcctcagcagcggtagcggcagcggcggcggcggcggccaccaggaggcggagctgagtcccgacggcatcgccacgggcggcggcaaaggaaagaggaaattcccggaggaggcggcggagggcggcggtggcgctggtctggtagggggccggggccgcttcgtagagcggcccctcccggcctccaaggaggatctggtgtgcacaccgcagcagtaccgagcctcgggcagctacttcggcctggaagagaacggccgcctcttcgcgccgccaagtcccgagacgggcgaggcgaagcgcagcgccttcgtggaggtgaagaaggctgcccgcgcggccagcctgcaggaggaggggacagccgacggcgcgggagtcgcctccgaggaccaggacgctggcggcggcggcggctcctccacgcccgcggccgcgtcaccggtgggcgccgagaagctgctggccccgcggcctgggggcccgctgcccagccggctcgagggcggcagtcctgcgaggggcagcgccttcacttcggtgccgcagctgggcagcgcgggcagcaccagcggtgggggcggaacgggcgccggggccgcaggcggcgcgggcgggggccagggcgccgcgtcggacgagcgcaaaagcgccttctcgcagccagcacgctctttctcgcagctgtccccgctggtgctgggccagaagctgggcgcgctcgagccatgccaccccgccgacggcgtgggccccaccagactctatcccgccgccgcggaccctctagcggtgaagctccagggggccgcggacctgaacggaggttgcgggtccctgccgagcggcggcggcggcctgcctaagcagagccccttcctgtacgccaccgccttctggcccaagagctccgctgccgctgcagccgcggctgcggcggcggccgcggggcccttgcagctgcagctgccctcggcgctcacgctgctgccgccctccttcacctcgctgtgtctgcccgcgcagaactggtgcgccaagtgcaatgcctccttccgcatgacctccgacctggtgtaccatatgaggtcgcaccacaaaaaggagtatgcgatggagcccttggtgaagcggcggcgagaggagaaactcaagtgccccatctgcaatgagtccttcagggagcgccaccacctctccaggcacatgacctcgcataattgactcggaaaggaccccagctttccacgcgcgcgcaagcacagttaagccacctgcaggaataaacacgcgagaacatccaccgcttccttgcaccccgaaaccctgcacaaagacacatacattcaccgcccccccgcccccccaacgcgcacacacacgtcctctcctcccaggaacctcattcaaatatttacccgggacacacacccccccccacacacacacacagacacactcacacacaagagccaggatggtggagttttgattgggtgggttgtttgagggggttttcttttgaatgcacgcattttcactttccccaaaacaaaggtacattttttaaaatgtcatatattgcaacatattgatgcatttgtcatacgtttctacttaaattattaagcacttacgatttagatgtaataattatatgtaagggcaaaatttattttagatataaagtaaaggaggagggtgagatgctttctgcatttcttgatgacagtttgtgttcctacaaaaataaacaaaatgaataaaaagggatcaccattcaatttgagtttccagggggaagtgcatgtataatgaaatgataatggacttcaatgaagaatgtcatcaattatgtacatatgtattttcttttaatacaaagtgtaattttgtgccagtgaaatggagtctgaatagttatgtgtttcttttatccctggaaatatttattaaactttatagtttatccgagtatgttggatgctttgacaataaatgactattttcttcaaagcaaa

SEQ ID NO: 1756 - DNA, 2514 bp, Homo sapiens
aaaagcagcatcagacaagagctttattaatcccttacacgagcaaatgcgatctctgacctactagacttgttttcctacaatttcacaaaaagcctcgctagaggaatgtgcaaggacagaagggaaactgaggagacccgcaactcattagcgaaataatagggtgcacttcaataaaaatgcggtcctgaagtggagcagactcaccggcaaggagcccggaaaatcgtcaggggcggcggcaaaatactatcaaatcagcctgggaagcatcttttcgctcagcaagttcaagagaacaaatatgttacaatccttgcctattcttgcctccacttcataatgtcataaaagccacctggggtgtcatttatcaacctctctccagcccactcttccaaaataacactacagtttcctacatgtgtatttttgccaggactccaaagagccttgctaaagtggaacaagcaaaatcctcccctggcctcctgggactgcagtcaccaggctgtcaaagcctcaataccccactgagttccagagaagggtctcaaagctgggagaggatcaaactaacatggagtagagaattgaactgtgaaaaagaagcccgagattccccagcgacgtggtgttgcagccccgttgaaggagtcaacttgcaggctgttaaagacctcaagtcattagcatcagctgctgcactaaaggggcaagtcagcgcctctaagtggcttagcgcacaaacgaggctcccgagacggcctcggcaactccatcccctcctccaccacccgctggatgtgaaaagctttccggagcccatcttgggggaagcttggtagtgttggcgctcctgaagagagacgacgcccgtttatcacccccaggcaactagctgcgcaaatcagcggtggctccagggctagagaatccctggagctaaccgcacccctctccctttcacggaacgcggactccggggaaatacgcacggggtccgcacgcgctgggtgtccagctctctgtcacagcttctccaagtgcctagtgaaacggggaaaggccctctccaatcattttggaagagcctaaaaggcggcaacaccaacacctcttgacatggaaatacactgatacaataggcaaaaggaaacactcgattgcatcttcccggttccaggtggccttatttgggagattctatactgaccttattcctgtgatggaggatactggcatccagcgaggcatctgggatggagatgccaaggctgtccaacaatgtctgacagatatttttaccagcgtttacaccacctgcgacatccctgagaatgctatatttggtccctgtgtcctgagccatacttccctatatgacagcatagctttcatagctctcaagtctactgacaagagaacagtaccgtatatctttcgggtagacacctcagcagcaaatggttcctcagaaggtctcatgtggctgcggttggtccaatcggccagagataaggaagagcagaaccttgaagcctacataaaaaacggacagctgttctaccgctctctccgcaggattgccaaagacgaggagttactagtttggtacgggaaagaactgactgagttactcttgctctgcccctctagatcccacaacaaaatgaatgggtcgtccccttacacatgcctggaatgcagccaacgtttccagtttgagttcccctatgtggcgcatctgcgtttccgctgccccaagagacttcacagcgctgatataagtccccaagacgaacaaggcggcggcgtgggcaccaaggaccacgggggcggcggcggcggtggcaaagaccagcagcagcagcagcaggaggcacctttaggcccgggtcccaagttttgcaaagccggccccctccaccactacccatccccctccccggaaagcagcaacccatccgctgccgccggcggcagcagcgcgaagccatccacagacttccacaacctggccagggagctggaaaactcccggggaggcagcagctgctccccagcccagagcctcagcagcggtagcggcagcggcggcggcggcggccaccaggaggcggagctgagtcccgacggcatcgccacgggcggcggcaaaggaaagaggaaattcccggaggaggcggcggagggcggcggtggcgctggtctggtagggggccggggccgcttcgtagagcggcccctcccggcctccaaggaggatctggtgtgcacaccgcagcagtaccgagcctcgggcagctacttcggcctggaagagaacggccgcctcttcgcgccgccaagtcccgagacgggcgaggcgaagcgcagcgccttcgtggaggtgaagaaggctgcccgcgcggccagcctgcaggaggaggggacagccgacggcgcgggagtcgcctccgaggaccaggacgctggcggcggcggcggctcctccacgcccgcggccgc

SEQ ID NO: 1757 - DNA, 1414 bp, Homo sapiens
agaagtgccgttgcctcggcaaccccaaacccagtccaagcccggagagggggaagttcggggcgagtcccgggggcggtgcgtggcgccggttggctgacggagatgaaggggcgtgtctgtaggcggtgcaatacacgggttggctggcgatagcggcggtgggcgtggcttaggcgcgagcgagagcgggcgcggcgctcaggcagcggcggttggctgcggcgccagtggtagtgctccaggctcgacggcaccctcacagcgcccgcccggccctgccgctcatggccgccccgccgcgccccgcgccatcgccccccgccccgcggcgcctcgacacgagcgacgtcctgcagcagatcatggccatcaccgaccagagcctggacgaggcacaggccagaaagcatgctctgaattgccatcggatgaagcctgctctgttcagcgtgctctgtgagatcaaggaaaagacagtggtaagcatccgtggcattcaagacgaagatccccctgacgcccagctcctgaggctggataacatgctgctggctgagggcgtgtgcaggcccgagaagagaggaagaggaggagcggtggccagggccggcacagcaacaccaggtggctgtccaaatgacaatagcattgagcactctgactacagggccaagctgtcccagatccgacagatttaccactctgagctagagaaatatgaacaggcctgtcgtgagttcaccacgcacgtcaccaacctcctccaggagcagagcaggatgaggcctgtctcccctaaggagattgagcgcatggtcggcgccattcacggcaagttcagcgccatccagatgcagttgaagcagagcacctgtgaggcagtgatgaccctgcgttcgcggctgctcgatgccaggcgcaagcggcggaatttcagcaagcaggcgacggaagtgctgaatgagtatttttactcccatctgaacaacccttaccccagcgaagaagccaaagaagagctggccaggaagggcggcctcaccatctcccaggtctctaactggtttggcaacaaaagaatccggtataaaaagaacatggggaagtttcaagaagaggctaccatttacacgggtaaaacggctgtggataccacggaagttggggtcccagggaaccacgccagctgcctgtcaacacctagctccggctcctctggacccttcccgctgcccagcgctggggacgccttcctcaccctgcggactctggcctctctccagcctcctcctgggggaggctgcctgcagtcccaggcccagggtagctggcagggggccaccccccaacctgcaactgcctcacctgctggagaccctggcagcatcaactccagtacatctaattaagt

SEQ ID NO: 1758 - DNA, 770 bp, Homo sapiens
gagtctcgctcaggctcggttttaccccggagtctattcgaagggggctgctacgtcagcgcgtctcagcgtaagacggcgctattccgctgtaacagcttccggcgggtcctggatgttgatgtcctgcatctaacgcggtgtaacccccgaagccgagcgagctccggaggaatttcagtatctgctacggtaacttcatcagcccgccaagatggcgatgcaagcggccaagagggcgaacattcgacttccacctgaagtaaatcggatattgtatataagaaatttgccatacaaaatcacagctgaagaaatgtatgatatatttgggaaatatggacctattcgtcaaatcagagtggggaacacacctgaaactagaggaacagcttatgtggtctatgaggacatctttgatgccaagaatgcatgtgatcacctatcgggattcaatgtttgtaacagataccttgtggttttgtactataatgccaacagggcatttcagaagatggacacaaagaagaaggaggaacagttgaagcttctcaaggagaaatatggcatcaacacagatccaccaaaataaatgttttctacattttcatttggactaaatcccacgaatgacaactaccacctttttttcctttttaattaatactaaatattgtgatttcttatttgaggttcaaaatgacctgcttgaaactttgatacatattggaatacattatgttaataaacttgtagctttttgtgaaaca

SEQ ID NO: 1759 - DNA, 1648 bp, Homo sapiens
agaaaaactctggggatctatcgagagggcagttggcgggactgggcactccccttccttctccctcccactgtccccagaaatcttcccatccctccacctccccaagccctaagtcctctcgggctctgcccttcagggcagcgggtgttggggatgtccagctcctgagccctcttgcacggaggctctgcacggaggcaagacaaggggttcagctctgtcccttatctgaggtgggagggggaagggaattatggaaggaatccagctggcctgttagtaagggtgttccagtgctaggtggaggtggagtttggctgcctttggggagattggaagggtgaggaatagaggcctgatttctgagtgttgtttctgtgttggacaattctatgcaaactagagccaaaatggaagagggtgcaagtcccctcctggggccccagacgccccctcctttcttgctgcctggagcaggggcagtgctgttagtggctactcctggtgtgaacagcccatcctggccaccttccacaggaaacctgacctgaaggacagaagaggaaggaagcaggctttgccacaaatgtcagtgcagaactctggctggccccaccaagaagacagccccaagccccaggatccaggtccaccagccaactcagacagtgactcaggccacctgccgggggaggaccctgaggatacccatgctcagggtcctgcagttctgagcttgggttccctttgcctggacaccaaccaagcccccaactggactggacttcagaccctcctgcagcaactccctccgcaggacattgatgagcgctactgcctggcccttggggaggaggagcgggccgagctgcagctcttctgtgccaggcggaagcaggaagccctgggacagggggtagcccgcctggtacttcccaagcttgaaggacacacctgtgagaagtgtagggagctgctgaagccaggggagtacggagtgtttgcagcccgggcaggggaacagcgctgctggcaccagccttgctttgcctgccaggcctgtggccaggccctgataaacctcatctacttctaccatgatggacaactctactgcggccgtcatcatgcagagttgctgcgcccgcgctgcccggcttgtgaccagctgatcttctcctggcgctgcaccgaggcggagggacagcgctggcatgagaaccacttctgttgccaggactgcgccgggcctctgggcgggggacgttatgccctgcctgggggaagcccctgctgccccagctgcttcgagaaccgctactcggatgcaggctcgagctgggccggggcactggaagggcaggcattccttggagcgcccccaccgcaccccccagacccaagcctcggggcccgcagctctcaccgcgcatccctggccggagcgttccaagggccgcccgaacccaccccgcgccgcggtcggggttgcggcgccagactccctcccaggcgcgggaggcggacgccctctggtggaggcgggggaccctggcgaggactctcggcggcggcggcggcgcgcacggcccaggggctgggcggggcgggaggctgggcctcacccccactagctgcggtgtag

SEQ ID NO: 1760 - DNA, 939 bp, Homo sapiens
atgtctcctcagggtcctgcagttctgagcttgggttccctttgcctggacaccaaccaagcccccaactggactggacttcagaccctcctgcagcaactccctccgcaggacattgatgagcgctactgcctggcccttggggaggaggagcgggccgagctgcagctcttctgtgccaggcggaagcaggaagccctgggacagggggtagcccgcctggtacttcccaagcttgaaggacacacctgtgagaagtgtagggagctgctgaagccaggggagtacggagtgtttgcagcccgggcaggggaacagcgctgctggcaccagccttgctttgcctgccaggcctgtggccaggccctgataaacctcatctacttctaccatgatggacaactctactgcggccgtcatcatgcagagttgctgcgcccgcgctgcccggcttgtgaccagctgatcttctcctggcgctgcaccgaggcggagggacagcgctggcatgagaaccacttctgttgccaggactgcgccgggcctctgggcgggggacgttatgccctgcctgggggaagcccctgctgccccagctgcttcgagaaccgctactcggatgcaggctcgagctgggccggggcactggaagggcaggcattccttggagcgcccccaccgcaccccccagacccaagcctcggggcccgcagctctcaccgcgcatccctggccggagcgttccaagggccgcccgaacccaccccgcgccgcggtcggggttgcggcgccagactccctcccaggcgcgggaggcggacgccctctggtggaggcgggggaccctggcgaggactctcggcggcggcggcggcgcgcacggcccaggggctgggcggggcgggaggctgggcctcacccccactagctgcggtgtag

SEQ ID NO: 1761 - DNA, 1035 bp, Homo sapiens
atgtctcctcagggtcctgcagttctgagcttgggttccctttgcctggacaccaaccaagcccccaactggactggacttcagaccctcctgcagcaactccctccgcaggacattgatgagcgctactgcctggcccttggggaggaggagcgggccgagctgcagctcttctgtgccaggcggaagcaggaagccctgggacagggggtagcccgcctggtacttcccaagcttgaaggacacacctgtgagaagtgtagggagctgctgaagccaggggagtacggagtgtttgcagcccgggcaggggaacagcgctgctggcaccagccttgctttgcctgccaggcctgtggccaggccctgataaacctcatctacttctaccatgatggacaactctactgcggccgtcatcatgcagagttgctgcgcccgcgctgcccggcttgtgaccagctgatcttctcctggcgctgcaccgaggcggagggacagcgctggcatgagaaccacttctgttgccaggactgcgccgggcctctgggcgggggacgttatgccctgcctgggggaagcccctgctgccccagctgcttcgagaaccgctactcggatgcaggctcgagctgggccggggcactggaagggcaggcattccttggggagactggactcgaccgaactgaaggaagggaccaaacctcggtgaactctgcaaccctctcccgaacactcctcgctgctgccggcggttccagcctgcaaactcagagggggctgcctggatccagtccccagcaggagaaccgacctggggacaaagcggaggcacccaaagggcaggagcaatgccgcctggagactattcgtgatcccaaggacacccctttctccacctgctcctcctcctctgactcggaacctgaaggatttttcttaggcgagcgccttccccagtcctggaagacccccggaagcctccaagcagaggacagcaacgcctctaagacgcactgcaccatgtgctag

SEQ ID NO: 1762 - DNA, 1646 bp, Homo sapiens
gaccgggtgaggggcctgacggcagagtcggtccagaactgcccggacagcgacgcacagcgaggagccaaaatggaagagggtgcaagtcccctcctggggccccagacgccccctcctttcttgctgcctggagcaggggcagtgctgttagtggctactcctggtgtgaacagcccatcctggccaccttccacaggaaacctgacctgaaggacagaagaggaaggaagcaggctttgccacaaatgtcagtgcagaactctggctggccccaccaagaagacagccccaagccccaggatccaggtccaccagccaactcagacagtgactcaggccacctgccgggggaggaccctgaggatacccatgctcagggtcctgcagttctgagcttgggttccctttgcctggacaccaaccaagcccccaactggactggacttcagaccctcctgcagcaactccctccgcaggacattgatgagcgctactgcctggcccttggggaggaggagcgggccgagctgcagctcttctgtgccaggcggaagcaggaagccctgggacagggggtagcccgcctggtacttcccaagcttgaaggacacacctgtgagaagtgtagggagctgctgaagccaggggagtacggagtgtttgcagcccgggcaggggaacagcgctgctggcaccagccttgctttgcctgccaggcctgtggccaggccctgataaacctcatctacttctaccatgatggacaactctactgcggccgtcatcatgcagagttgctgcgcccgcgctgcccggcttgtgaccagctgatcttctcctggcgctgcaccgaggcggagggacagcgctggcatgagaaccacttctgttgccaggactgcgccgggcctctgggcgggggacgttatgccctgcctgggggaagcccctgctgccccagctgcttcgagaaccgctactcggatgcaggctcgagctgggccggggcactggaagggcaggcattccttggggagactggactcgaccgaactgaaggaagggaccaaacctcggtgaactctgcaaccctctcccgaacactcctcgctgctgccggcggttccagcctgcaaactcagagggggctgcctggatccagtccccagcaggagaaccgacctggggacaaagcggaggcacccaaagggcaggagcaatgccgcctggagactattcgtgatcccaaggacacccctttctccacctgctcctcctcctctgactcggaacctgaaggatttttcttaggcgagcgccttccccagtcctggaagacccccggaagcctccaagcagaggacagcaacgcctctaagacgcactgcaccatgtgctagtggcgcagctcagagaggggatgtgagtgggaggaaaggggtctgtaaagcgggagaacaaggctagcctccccctaacaatcctagactgagacgcagtcaggcgcacgcccgcaagaggcggcgaggtgacaagtttggagtgcgcccccttcagtactgcgcgttctaagacttttggcggagactttcttggcaaaacccattccccaaagctacgcttcccctgctgagatagcccct

SEQ ID NO: 1763 - DNA, 3947 bp, Homo sapiens
cggggctgggagaccacagggagagtttggggagacctgggaactgcggagagacagggctgcgggcccggcgaggcgtttccattcagcgaatggttgaaaacccagcgtaaacgcggctcccggcgtctgctggatgcctgccgggcgcagtccgagccagagagcccttgcacctgcatggcagaggccatggagcccgcacatttccaccctgagatcccataaatgtggttttgttttccttttttttttcctccccccaatctgcagctccaggcccctccctgagccgcccctctccaccagccggggaggggcgggcgggggccgctggggcgtgggagaggaagggccgcgctattagggcgggcgggggcggacgggggcgggcgctgaagccttggggtggggaccgggtgaggggcctgacggcagagtcggtccagaactgcccggacagcgacgcacagcgaggagccaaaatggaagagggtgcaagtcccctcctggggccccagacgccccctcctttcttgctgcctggagcaggggcagtgctgttagtggctactcctggtgtgaacagcccatcctggccaccttccacaggaaacctgacctgaaggacagaagaggaaggaagcaggctttgccacaaatgtcagtgcagaactctggctggccccaccaagaagacagccccaagccccaggatccaggtccaccagccaactcagacagtgactcaggccacctgccgggggaggaccctgaggatacccatgctcaggaattcctgtctctgcacctgcttagaacatggggttttgactttaaactcattcacatgagtattcattatctctcctagggggtctgtattgtcaaaccagactctaggggctttggccccaaggcgtgaagggggttaagaagggaaagcataagaagggaagctgttttggggtgtggggcctccccagcctccctcaaggaagaccacacatgcaggcatcagtcagctatccttgcactcagtgaggatctgcaaggaggaccctcccaaatggagggcatgcttagaagctgctctagattggagaagaggtggcaatgatgagggggaaagaaggagaaaggaaagaaaaacctagtttcactcctccccttcttccatgtctcctcagggtcctgcagttctgagcttgggttccctttgcctggacaccaaccaagcccccaactggactggacttcagaccctcctgcagcaactccctccgcaggacattgatgagcgctactgcctggcccttggggaggaggagcgggccgagctgcagctcttctgtgccaggcggaagcaggaagccctgggacagggggtagcccgcctggtacttcccaagcttgaaggacacacctgtgagaagtgtagggagctgctgaagccaggggagtacggagtgtttgcagcccgggcaggggaacagcgctgctggcaccagccttgctttgcctgccaggcctgtggccaggccctgataaacctcatctacttctaccatgatggacaactctactgcggccgtcatcatgcagagttgctgcgcccgcgctgcccggcttgtgaccagctgatcttctcctggcgctgcaccgaggcggagggacagcgctggcatgagaaccacttctgttgccaggactgcgccgggcctctgggcgggggacgttatgccctgcctgggggaagcccctgctgccccagctgcttcgagaaccgctactcggatgcaggctcgagctgggccggggcactggaagggcaggcattccttggagcgcccccaccgcaccccccagacccaagcctcggggcccgcagctctcaccgcgcatccctggccggagcgttccaagggccgcccgaacccaccccgcgccgcggtcggggttgcggcgccagactccctcccaggcgcgggaggcggacgccctctggtggaggcgggggaccctggcgaggactctcggcggcggcggcggcgcgcacggcccaggggctgggcggggcgggaggctgggcctcacccccactagctgcggtgtaggtccagctccgcggctctgagaccagcgtttccgacccggcccggaacaggggagactggactcgaccgaactgaaggaagggaccaaacctcggtgaactctgcaaccctctcccgaacactcctcgctgctgccggcggttccagcctgcaaactcagagggggctgcctggatccagtccccagcaggagaaccgacctggggacaaagcggaggcacccaaagggcaggagcaatgccgcctggagactattcgtgatcccaaggacacccctttctccacctgctcctcctcctctgactcggaacctgaaggatttttcttaggcgagcgccttccccagtcctggaagacccccggaagcctccaagcagaggacagcaacgcctctaagacgcactgcaccatgtgctagtggcgcagctcagagaggggatgtgagtgggaggaaaggggtctgtaaagcgggagaacaaggctagcctccccctaacaatcctagactgagacgcagtcaggcgcacgcccgcaagaggcggcgaggtgacaagtttggagtgcgcccccttcagtactgcgcgttctaagacttttggcggagactttcttggcaaaacccattccccaaagctacgcttcccctgctgagatagcccctacccccacctccacaggctgggacagccccgtccccaccatcctcctcccaagccaattaaatgatcacagcacgcgtgacagttaccggctggagagccggaggtgggaccgggagcaggggaccgtagaaccgggccgcgctcctcccctcctagagttcgtggaggcgcagcagagggccgtccctcttccggatgtcggactaagcgaacagcgcccccactgccggccggtagcagccggaagtgccagaccggaggtgcgtcattcaccggcgacgccgatacggttcctccaccgaggcccatgcgaagctttccactatggcttccagcactgtcccggtgagcgctgctggctcggctaatgaaactcccgaaataccggacaacgtgggagattggcttcggggcgtctaccgctttgccactgataggaatgacttccggaggaacttgatactaaatttgggactctttgctgcgggagtttggctggccaggaacttgagtgacattgacctcatggcacctcagccaggggtgtagccaagtagttctaatgccacctgtcgtcttatcatctgattgcagacaaatggaatcctgtgctgaacccgaatcttccaaaaaacagcctacaatctgtgaccaccacaagatgtgccctgatggcagctgaagtttgattcagatgggcacttttcttccccttccctgcctagtttccttttgttccttgagtccacgcagaattccattctctggtcagcagacaggcttaagctaaagtattgcctctattctgtaaagttctgtacatagttcccaagcttctgcagggggtgatttttgctcttgtcctgagaaataacagtgctgttttaaaaaacatttgaaataaataccgcacacaaaggcagtcattttattcttttaataagaaacttttgcttacaaaaacaaggtgtaaaaagatttacaaaaatcataaaaacatgatttatatttcacacttgagagacaaaaacaagccccaaaacatggattttaatggaggtggtttgcttcattttaaaagggaaaaaaaaaaaaggaagctgtaaccatacattgatgttaacctagcatgaagtttattcttgaagaatttacattgttgagcaat

SEQ ID NO: 1764 - DNA, 904 bp, Homo sapiens
ggtgcgaccaccgaggcccaagaaagagccgcagacgctcgtcatccccaagaatgcggcggaggagcagaagctcaagctggagcggctcatgaagaacccggacaaagcagttccaattccagagaaaatgagtgaatgggcacctcgacctcccccagaatttgtccgagatgtcatgggttcaagtgctggggccggcagtggagagttccacgtgtacagacatctgcgccggagagaatatcagcgacaggactacatggatgccatggctgagaagcaaaaattggatgcagagtttcagaaaagactggaaaagaataaaattgctgcagaggagcagaccgcaaagcgccggaagaagcggacccggtcagcccaaggagcaggggtccagcagctctgcggaggcatctggaacagaggaggaggaggaagtgcccagtttcaccatggggcgatgacaatgtttgccacagcctctgcctggaacctggctcgtgctgtgaccagaagggaaaggcggctgtttggctctttctcccccgcaaggacccgctgacccgctggatggagagcaaaggagacccctcccgagccgctcacagtcctgtatttggcaggtttgggagcctgaggggccatctccctgacactcagaggcactgccttgcagacaccatccgtgctcctggtaaagggggacagagagcctcaccttgccacatatttgaacagtgatgagtttggggctggtttctgggaagggaacgtttatttagtaaagagcagaacacccttgcgttttgttgggacatgtggaccgtgagtcgcaaacactctggagaaggctgagatgccaccattcccacggggactgaagacacattacgtggacctg

SEQ ID NO: 1765 - DNA, 2159 bp, Homo sapiens
atacttgcgcgccgacgccgccgctcgcttgtgaaactggaaggctgccatggctagcccagccgcctcctcggtgcgaccaccgaggcccaagaaagagccgcagacgctcgtcatccccaagaatgcggcggaggagcagaagctcaagctggagcggctcatgaagaacccggacaaagcagttccaattccagagaaaatgagtgaatgggcacctcgacctcccccagaatttgtccgagatgtcatgggttcaagtgctggggccggcagtggagagttccacgtgtacagacatctgcgccggagagaatatcagcgacaggactacatggatgccatggctgagaagcaaaaattggatgcagagtttcagaaaagactggaaaagaataaaattgctgcagaggagcagaccgcaaagcgccggaagaagcgccagaagttaaaagagaagaaattactggcaaagaagatgaaacttgaacagaagaaacaagaaggacccggtcagcccaaggagcaggggtccagcagctctgcggaggcatctggaacagaggaggaggaggaagtgcccagtttcaccatggggcgatgacaatgtttgccacagcctctgcctggaacctggctcgtgctgtgaccagaagggaaaggcggctgtttggctctttctcccccgcaaggacccgctgacccgctggatggagagcaaaggagacccctcccgagccgctcacagtcctgtatttggcaggtttgggagcctgaggggccatctccctgacactcagaggcactgccttgcagacaccatccgtgctcctggtaaagggggacagagagcctcaccttgccacatatttgaacagtgatgagtttggggctggtttctgggaagggaacgtttatttagtaaagagcagaacacccttgcgttttgttgggacatgtggaccgtgagtcgcaaacactctggagaaggctgagatgccaccattcccacggggactgaagacacattacgtggacctggtcccaggctcagtgaggagatggcctcagctgtggggctggtccatgttgcccactcactccagtgggaagtggggaccacgccatagagggtctgctcccactgcagctcccggtgctctcgtgttctgggaaggcctgggtgtgtgcacaaggaggcccgggccagggacttcaccaggggctgggtcacaagggcacagggtgtgtggaaagcgctgtgggggaagagccggtcaccggagagtgagcaggcggagactccaagctgggctgagccagagcagaaggcgagggattcccagccggacgggggttctctcaccaacagctgtgatttcatcccgaagtggaagggggtctaaacagaacaggctgagagaggcgggactgggtcaagtgggtggagctcctccttgcatgactgcaactgtcggggctttccgccggctcacagcagttggggccagcggggagaagagaggcggaactgctgtgtcctcatgtggcgcagcctcaaactggcatccaggcactgggcccatgcagagaaggcacctgcagagagcagggcagcccggcgcaggggcatgcgcctagaatcccagctactcggaaggccaaggcaggaggaccgcttgagtccagggattcaaggccaacctgggcaatagagcgagaccctgtctcttaaaaaacgatgatgatgaacacagaggacggggcactgtgctgggagccagggggcctgggaggagccgagaccagccttttacctcggggttttgaggccaacagggacgacagagacagtttctagttagagccttggctccatttttggatgatttagccccgagttcctgagtctattttatgccccttacgtactttgatagaactaaggaaatagtggttttgagtgaagggaaaggaaacccagaaacattttacgttgcttttacttctgtagtgtagattgccccggcccctctctgagccctgtagcatctgtgatagcttctgtcccttcatcggttcatgtcacagggattttctttcccaggaagcggacacggagagtcagccctaataaatgagcacatgccctggctgta

SEQ ID NO: 1766 - DNA, 3430 bp, Homo sapiens
ctgcgcctcttcaggtcatcgcttgctctcgttcccaggctttggcctctagtggacgagaatcaccgagtctgcggggctggacgctgactgcccgggccagcacctaggcgggcgggagctgtgcggcccagggttcacgcgggccgggtagaggctcgagccgggacccccgagcgtgaaccccggagccggcggcgctggggccagaggggccgggcgggaggtggtggcggaggcgaaggggcgacgggacctgggcctggcccgtgtgtgtcctcggcggcctggcgccggccgtcgctgtacggtgagccccagggaggcggatctgggccccgagaaggacccccgcctggatttgccccgtaggcccggcccgggcccctcgggagcagaacagctttggtgaggtggacaggaggtgacctcgcgagcagacgcgcgcgccagcgacagcagcccgccccggcctctcgggagccgtggggcagaggctgcggagccccaggagggtgatttctgcctttgcaggccggagccctcatgacttcagtgacctgcttctgcccctctaggtctatcagccacagtctctgcaagtttccaagagcagcagaaaatgaacacattgcaggggccagtgtcattcaaagatgtggctgtggatttcacccaggaggagtggcagcaactggaccctgatgagaagatagcatacggggatgtgatgttggagaactacagccatctagtttctgtggggtatgattatcaccaagccaaacatcatcatggagtggaggtgaaggaagtggagcagggagaggagccgtggataatggaaggtgaatttccatgtcaacatagtccaggagattgtcagaaatggaggagggggcaccagatccaaggaagtgcccggacaaagccgggaggcgaggagagccgacggggaggaggtgccgagagcatcagcggggctgctcggtggcacgaagacgcccgcggggactggagaggtcggctagggccaggctactcaggcacggagggccacctccccttcagggacgtgagcatctagctgcactgatttgttgttcaggaacaggaaatgaaaccccgcagctttgaacacaataacccacgccagcctcaggctcatgaatattcagcaggctgcttgcgccttgcaaccccgcctccgttcccctctgcggagactgcgtatgcgtcgccggcgcgcggctgtgtcgtcatacttgcgcgccgacgccgccgctcgcttgtgaaactggaaggctgccatggctagcccagccgcctcctcggtgcgaccaccgaggcccaagaaagagccgcagacgctcgtcatccccaagaatgcggcggaggagcagaagctcaagctggagcggctcatgaagaacccggacaaagcagttccaattccagagaaaatgagtgaatgggcacctcgacctcccccagaatttgtccgagatgtcatgggttcaagtgctggggccggcagtggagagttccacgtgtacagacatctgcgccggagagaatatcagcgacaggactacatggatgccatggctgagaagcaaaaattggatgcagagtttcagaaaagactggaaaagaataaaattgctgcagaggagcagaccgcaaagcgccggaagaagcgccagaagttaaaagagaagaaattactggcaaagaagatgaaacttgaacagaagaaacaagaaggacccggtcagcccaaggagcaggggtccagcagctctgcggaggcatctggaacagaggaggaggaggaagtgcccagtttcaccatggggcgatgacaatgtttgccacagcctctgcctggaacctggctcgtgctgtgaccagaagggaaaggcggctgtttggctctttctcccccgcaaggacccgctgacccgctggatggagagcaaaggagacccctcccgagccgctcacagtcctgtatttggcaggtttgggagcctgaggggccatctccctgacactcagaggcactgccttgcagacaccatccgtgctcctggtaaagggggacagagagcctcaccttgccacatatttgaacagtgatgagtttggggctggtttctgggaagggaacgtttatttagtaaagagcagaacacccttgcgttttgttgggacatgtggaccgtgagtcgcaaacactctggagaaggctgagatgccaccattcccacggggactgaagacacattacgtggacctggtcccaggctcagtgaggagatggcctcagctgtggggctggtccatgttgcccactcactccagtgggaagtggggaccacgccatagagggtctgctcccactgcagctcccggtgctctcgtgttctgggaaggcctgggtgtgtgcacaaggaggcccgggccagggacttcaccaggggctgggtcacaagggcacagggtgtgtggaaagcgctgtgggggaagagccggtcaccggagagtgagcaggcggagactccaagctgggctgagccagagcagaaggcgagggattcccagccggacgggggttctctcaccaacagctgtgatttcatcccgaagtggaagggggtctaaacagaacaggctgagagaggcgggactgggtcaagtgggtggagctcctccttgcatgactgcaactgtcggggctttccgccggctcacagcagttggggccagcggggagaagagaggcggaactgctgtgtcctcatgtggcgcagcctcaaactggcatccaggcactgggcccatgcagagaaggcacctgcagagagcagggcagcccggcgcaggggcatgcgcctagaatcccagctactcggaaggccaaggcaggaggaccgcttgagtccagggattcaaggccaacctgggcaatagagcgagaccctgtctcttaaaaaacgatgatgatgaacacagaggacggggcactgtgctgggagccagggggcctgggaggagccgagaccagccttttacctcggggttttgaggccaacagggacgacagagacagtttctagttagagccttggctccatttttggatgatttagccccgagttcctgagtctattttatgccccttacgtactttgatagaactaaggaaatagtggttttgagtgaagggaaaggaaacccagaaacattttacgttgcttttacttctgtagtgtagattgccccggcccctctctgagccctgtagcatctgtgatagcttctgtcccttcatcggttcatgtcacagggattttctttcccaggaagcggacacggagagtcagccctaataaatgagcacatgccctggctgtacattttgaaa

SEQ ID NO: 1767 - DNA, 3244 bp, Homo sapiens
gtgatctggaatggcccagatcccttaaatgtcaaatgcaaaagaaagaaaacacgccaagaaaatgagaaaccagcctaccaatgtgactctgtcctctggctttgtggctgacagaggtgtaaagcaccacagtggaggtgaaaaacctttccaagctcaaaaacaagagcctcatcctggaacttcacgacagcggcaaaccagagtcaacccccattctctgcctgaccctgaagtgaatgagcagtcttcctccaaagggatgtttagaaaaaagggaggatggaaagcaggtcccgagggcacgtctcaggagatccccaagtatataactgcttctacttttgctcaagcacgagctgctgaaatcagtgctatgttaaaagctgtgacccagaagtcttcgaattcactggtttttcagactctgccacggcacatgcgacgaagagccatgagccacaacgtcaaacgccttcccagacggttacaggagattgcccagaaagaggcggagaaagccgtacatcagaaaaaagaacattcaaaaaataaatgccataaagctcgaagatgtcacatgaaccggacgctagaatttaaccgtagacaaaagaagaacatttggttagaaactcacatctggcacgccaagcggtttcatatggtcaagaagtggggctactgccttggggagaggccaacagtcaagagccacagagcctgctatcgagccatgacgaaccggtgcctcctgcaggatttatcctattactgttgtttggagttgaaaggcaaagaggaagaaatactaaaggcgctttctggaatgtgtaacatagacacagggctgacgtttgcagcagttcactgcttgtctggaaagcgccaagggagccttgtgctttatcgggtgaataaatatcccagagaaatgcttgggcctgttacgtttatctggaagtcccagaggaccccgggtgacccttctgagagcaggcagctgtggatctggctgcatccaacccttaaacaggatatcttagaggaaataaaagcagcgtgccagtgtgtggaacccatcaaatcagctgtctgcatcgctgacccacttccaacaccatcccaagaaaaaagccaaactgaattgcctgacgagaaaattggcaagaaaagaaaaaggaaagatgatggagaaaatgctaaaccaattaaaaaaattatcggtgatggaactagagatccatgtctaccatactcttggatctctccaaccacaggcattataatcagcgatttgacgatggagatgaacagattccggctgattgggccactttcccactccatcctaactgaagcaataaaagctgcttctgtccacactgtgggagaggacacagaggagacacctcaccgctggtggatagaaacctgtaagaaacctgacagcgtttcccttcattgcagacaagaagccattttcgagttgttgggaggaataacatcaccagcagaaattccggcaggtactattctgggactgacagttggggatcctcgaataaatttgccccaaaagaagtccaaagctttgcccaatccagaaaaatgccaagataatgagaaagttagacagctgcttctggagggtgtgcctgtggaatgtacgcatagctttatctggaaccaagatatctgtaagagtgtcacagagaataaaatctcggatcaggatttaaaccggatgaggagtgaattgctggtgcctgggtcacagcttattttaggtccccatgaatccaagatacctatacttttgattcagcagccaggaaaagtgactggtgaagatcgactaggctggggaagtggctgggatgtcctactcccaaagggctggggcatggctttctggattccatttatttatcgaggtgtgagagtcggagggttgaaagagtctgcagtgcattctcagtataagaggtcgcctaatgtcccaggcgattttccagactgccctgccgggatgctgtttgcggaagagcaagctaagaatcttcttgaaaagtacaaaagacgccctcctgcaaaacggcccaactacgttaagcttggcactctggcacctttctgctgtccctgggagcagttaactcaagactgggagtcaagagtccaggcttacgaagaaccttctgtagcttcatctccaaatggtaaggagagtgacctaagaagatctgaggtgccttgtgctcccatgcctaaaaaaactcatcagccatctgatgaagtgggcacatccatagagcaccccagggaggcagaggaggtaatggatgcagggtgtcaagaatcggcagggcctgagaggatcacagaccaggaggccagtgaaaaccatgttgctgccacagggagtcacctctgcgttctcaggagtagaaaattactgaagcaactgtcagcctggtgtgggcccagttctgaggatagtcggggaggccggcgagctcccggcagaggccagcaaggattgaccagagaggcttgcctgtccatcttgggccacttccccagggccctggtttgggtcagcctgtccctgctcagcaagggcagccccgagcctcacaccatgatctgtgtcccagccaaggaggacttcctccagctccatgaggactggcattactgtgggccccaggaatccaaacacagtgacccattcaggagcaagatcctgaaacagaaagagaagaagaaaagggagaagaggcagaagccaggacgtgcctcttctgatggcccggcgggggaagagcccgtggctgggcaggaagctctgactctagggctgtggtcaggccctctgccgcgtgtgacgttgcactgctccagaactctcctaggctttgtgactcagggagatttttccatggctgttggctgtggagaagccctggggtttgttagcttgacaggcttgctggatatgctgtccagccagcctgcagcgcagaggggcttagtgctactgaggcctcccgcctctctgcagtatcgatttgcgaggattgctattgaggtgtgaatgcgtgcttgtatcccagcagggcatagataatacgttattattgtctgccaagttctacatgtggagaatctgcttctgctttaaaatatcatgtgaaactccctggaaacaagaataaaaaattatgtattatgcaga

SEQ ID NO: 1768 - DNA, 4719 bp, Homo sapiens
ctccaggagctttggctcggtgggtactgtcgcggaggcttgtcattctgacccggggattcctcacagcgtctggcagaaatgtcaaatgcaaaagaaagaaaacacgccaagaaaatgagaaaccagcctaccaatgtgactctgtcctctggctttgtggctgacagaggtgtaaagcaccacagtggaggtgaaaaacctttccaagctcaaaaacaagagcctcatcctggaacttcacgacagcggcaaaccagagtcaacccccattctctgcctgaccctgaagtgaatgagcagtcttcctccaaagggatgtttagaaaaaagggaggatggaaagcaggtcccgagggcacgtctcaggagatccccaagtatataactgcttctacttttgctcaagcacgagctgctgaaatcagtgctatgttaaaagctgtgacccagaagtcttcgaattcactggtttttcagactctgccacggcacatgcgacgaagagccatgagccacaacgtcaaacgccttcccagacggttacaggagattgcccagaaagaggcggagaaagccgtacatcagaaaaaagaacattcaaaaaataaatgccataaagctcgaagatgtcacatgaaccggacgctagaatttaaccgtagacaaaagaagaacatttggttagaaactcacatctggcacgccaagcggtttcatatggtcaagaagtggggctactgccttggggagaggccaacagtcaagagccacagagcctgctatcgagccatgacgaaccggtgcctcctgcaggatttatcctattactgttgtttggagttgaaaggcaaagaggaagaaatactaaaggcgctttctggaatgtgtaacatagacacagggctgacgtttgcagcagttcactgcttgtctggaaagcgccaagggagccttgtgctttatcgggtgaataaatatcccagagaaatgcttgggcctgttacgtttatctggaagtcccagaggaccccgggtgacccttctgagagcaggcagctgtggatctggctgcatccaacccttaaacaggatatcttagaggaaataaaagcagcgtgccagtgtgtggaacccatcaaatcagctgtctgcatcgctgacccacttccaacaccatcccaagaaaaaagccaaactgaattgcctgacgagaaaattggcaagaaaagaaaaaggaaagatgatggagaaaatgctaaaccaattaaaaaaattatcggtgatggaactagagatccatgtctaccatactcttggatctctccaaccacaggcattataatcagcgatttgacgatggagatgaacagattccggctgattgggccactttcccactccatcctaactgaagcaataaaagctgcttctgtccacactgtgggagaggacacagaggagacacctcaccgctggtggatagaaacctgtaagaaacctgacagcgtttcccttcattgcagacaagaagccattttcgagttgttgggaggaataacatcaccagcagaaattccggcaggtactattctgggactgacagttggggatcctcgaataaatttgccccaaaagaagtccaaagctttgcccaatccagaaaaatgccaagataatgagaaagttagacagctgcttctggagggtgtgcctgtggaatgtacgcatagctttatctggaaccaagatatctgtaagagtgtcacagagaataaaatctcggatcaggatttaaaccggatgaggagtgaattgctggtgcctgggtcacagcttattttaggtccccatgaatccaagatacctatacttttgattcagcagccaggaaaagtgactggtgaagatcgactaggctggggaagtggctgggatgtcctactcccaaagggctggggcatggctttctggattccatttatttatcgaggtgtgagagtcggagggttgaaagagtctgcagtgcattctcagtataagaggtcgcctaatgtcccaggcgattttccagactgccctgccgggatgctgtttgcggaagagcaagctaagaatcttcttgaaaagtacaaaagacgccctcctgcaaaacggcccaactacgttaagcttggcactctggcacctttctgctgtccctgggagcagttaactcaagactgggagtcaagagtccaggcttacgaagaaccttctgtagcttcatctccaaatggtaaggagagtgacctaagaagatctgaggtgccttgtgctcccatgcctaaaaaaactcatcagccatctgatgaagtgggcacatccatagagcaccccagggaggcagaggaggtaatggatgcagggtgtcaagaatcggcagggcctgagaggatcacagaccaggaggccagtgaaaaccatgttgctgccacagggagtcacctctgcgttctcaggagtagaaaattactgaagcaactgtcagcctggtgtgggcccagttctgaggatagtcggggaggccggcgagctcccggcagaggccagcaaggattgaccagagaggcttgcctgtccatcttgggccacttccccagggccctggtttgggtcagcctgtccctgctcagcaagggcagccccgagcctcacaccatgatctgtgtcccagccaaggaggacttcctccagctccatgaggactggcattactgtgggccccaggaatccaaacacagtgacccattcaggagcaagatcctgaaacagaaagagaagaagaaaagggagaagaggcagaagccaggacgtgcctcttctgatggcccggcgggggaagagcccgtggctgggcaggaagctctgactctagggctgtggtcaggccctctgccgcgtgtgacgttgcactgctccagaactctcctaggctttgtgactcagggagatttttccatggctgttggctgtggagaagccctggggtttgttagcttgacaggcttgctggatatgctgtccagccagcctgcagcgcagaggggcttagtgctactgaggcctcccgcctctctgcagtatcgatttgcgaggattgctattgaggtgtgaatgcgtgcttgtatcccagcagggcatagataatacgttattattgtctgccaagttctacatgtggagaatctgcttctgctttaaaatatcatgtgaaactccctggaaacaagaataaaaaattatgtattatgcagatgatgaaatgtttacatcattccagtaatgtcattgattttcatctttccctgtccttgctgtaatacttttaaattatttggccaaaagctttgtattatgatctcttggtctgtgtagttgtggctgaaaataatgagaagctctacgagttatcatcccctttttttgttagaaacaaagggcttgtcaggtctatttgaaaaacctcatagtcatgtgataagcaacaatagatgtttaatgatttcactgttatagcagaagacaagagaagacgcttggcctctgtacatgaaatatgggctcctgatggacctcattcaattctgtactgtgatttccatgccgaacaactcaagccttaaagagagaaatcatggacaactgatttctgcctgttttcaggcaggcacagtttatggcgtcagtgctaggctggaattagaaagtgggggtctatgacgtggacttcctgactctttgatctctttgttgttgaccaacacttgatcctactagttacttaatttttttaagtaaaaaattattattattttgtttctgcaaagattttctcaaagccatagaggagcatttctcagaatatgttctatgatatgtgtcacctaaaaaagtaagagattccaaggtcaggttgatatggaaactctaggttaaataaagttaagcatttctttatgaaagaacttctggaaacttccatgtgataatgtgcattgcggatctctaggaaggaaatgatagtgtatagtattttctaaatacttgtgattcctaaagttctcttacaaggagccctttgtaggaccagtgttcttagtagcgcgctttgggcagtgtggctgtgtagtgcatagctacctctgcaaggtgataactaagccggcaagctgcctttcaacactcatgcagtcacgttgtccacctgagattctcaacagggtataaaaggaaggtctcatcttgcctcacaggaagagtgggctcagtgtggcttttttccaactatggagaaactcagtgctcatctactttaagtttccacatatggcttgctcatagccttggtccttacctttcctgccataactttctagaagagcttaatgggattttttttctaaaaaatgtaaatatgcagttaggcattattttatgtaaatgcattgggtttttactgtagcatttggcactaaatggctttgggggtgatgaggtggggaaggatacagcaggtggtacagtagtcaggaagtacctgccaccaatgagatgtctgatgctttgcctcttaccatgcctctgaatgtctttggatccaacccagatgagactgaaaaaaaaaaaacagtgtaactaagtggcatctgtaaacagaataaatgaaaatgtcacctg

SEQ ID NO: 1769 - DNA, 585 bp, Homo sapiens
gctctccagcgcgctctccaggagctttggctcgaaatgtcaaatgcaaaagaaagaaaacacgccaagaaaatgagaaaccagcctaccaatgtgactctgtcctctggctttgtggctgacagaggtgtaaagcaccacagtggaggtgaaaaacctttccaagctcaaaaacaagagcctcatcctggaacttcacgacagcggcaaaccagagtcaacccccattctctgcctgaccctgaagtgaatgagcagtcttcctccaaagggatgtttagaaaaaagggaggatggaaagcaggtcccgagggcacgtctcaggagatccccaagtatataactgcttctacttttgctcaagcacgagctgctgaaatcagtgctatgttaaaagctgtgacccagaagtcttcgaattcactggtttttcagactctgccacggcacatgcgacgaagagccatgagccacaacgtcaaacgccttcccagacggttacaggagattgcccagaaagaggcggagaaagccgtacatcagaaaaaagaacattcaaaaaataaatgccataaagctcgaaga

SEQ ID NO: 1770 - DNA, 927 bp, Homo sapiens
gaacgcagcaagcccaggcggcggtggaaaggctggaggacacacctaaacatgtggaatcccaatgccggtgggccccctcatcctgtgccacagccagggtatccaggatgccaaccgttgggtccctaccctcctccatacccaccgcctgcccctggaatccctcctgtgaatcccttggctcctggcatggttggaccagcagtgatagtagacaagaagatgcagaagaaaatgaagaaagctcataaaaagatgcacaagcaccaaaagcaccacaagtaccacaagcatggcaagcattcctcctcttcctcctcctcttccagcagtgattctgactgaatacaggccctggacccttccctcaagtctcaccagttctgctctcccatcaagcttcagatgccatgttgtactgggggaatgtagcccttgtgctccccaccccctacctccacctgagcctcaccctgctgttgagccctgagtggctaggggaaatgggaagaggattgccatggcctggccatcttgttgctgcttggttagatcatatagctaatgaattaggcaggggagctattttttgaagatgatgaactaaatgttgaagacaagtttgagatctgtaaaatgtgattttttacttccacttataatacttgtgattggggaggtttgtggaaattcaattatgatgaaaaacctatcttttttgtaatgttggcatacttggggaatttagtggcaaatacattccccagcaggccttttgttggttgcactaactgcaaggttgctgggaagtagagtccatttggttgatgagctttgactgcggttttggaaccttacctctcctccttagcccaatatgctgtcttgggtcctattcaaataaagttatttctcctggtctca

SEQ ID NO: 1771 - DNA, 1229 bp, Homo sapiens
agagcaaccgtttcctcctcagtcggaccagagtgattgattagtttgttgtctaatcatcagtcgagcggccacataattaccaattaggcagtagcagaggcgggtgccgaagcacggggtctgggtgactaggaagagccgagactgcgaaggagaacgcagcaagcccaggcggcggtggaaaggctggaggacacacctaaacatgtggaatcccaatgccgggcagccagggccaaatccatatccccccaatattgggtgccctggaggttccaatcctgcccacccaccacctattaatccaccctttcccccaggcccctgtcctcctcccccaggagctccccatggcaatccagctttccccccaggtgggccccctcatcctgtgccacagccagggtatccaggatgccaaccgttgggtccctaccctcctccatacccaccgcctgcccctggaatccctcctgtgaatcccttggctcctggcatggttggaccagcagtgatagtagacaagaagatgcagaagaaaatgaagaaagctcataaaaagatgcacaagcaccaaaagcaccacaagtaccacaagcatggcaagcattcctcctcttcctcctcctcttccagcagtgattctgactgaatacaggccctggacccttccctcaagtctcaccagttctgctctcccatcaagcttcagatgccatgttgtactgggggaatgtagcccttgtgctccccaccccctacctccacctgagcctcaccctgctgttgagccctgagtggctaggggaaatgggaagaggattgccatggcctggccatcttgttgctgcttggttagatcatatagctaatgaattaggcaggggagctattttttgaagatgatgaactaaatgttgaagacaagtttgagatctgtaaaatgtgattttttacttccacttataatacttgtgattggggaggtttgtggaaattcaattatgatgaaaaacctatcttttttgtaatgttggcatacttggggaatttagtggcaaatacattccccagcaggccttttgttggttgcactaactgcaaggttgctgggaagtagagtccatttggttgatgagctttgactgcggttttggaaccttacctctcctccttagcccaatatgctgtcttgggtcctattcaaataaagttatttctcctgg

SEQ ID NO: 1772 - DNA, 688 bp, Homo sapiens
gaaggagaacgcagcaagcccaggcggcggtggaaaggtgatggggtatctggattccataggctggaggacacacctaaacatgtggaatcccaatgccgggcagccagggccaaatccatatccccccaatattgggtgccctggaggttccaatcctgcccacccaccacctattaatccaccctttcccccaggcccctgtcctcctcccccaggagctccccatggcaatccagctttccccccaggtgggccccctcatcctgtgccacagccagggtatccaggatgccaaccgttgggtccctaccctcctccatacccaccgcctgcccctggaatccctcctgtgaatcccttggctcctggcatggttggaccagcagtgatagtagacaagaagatgcagaagaaaatgaagaaagctcataaaaagatgcacaagcaccaaaagcaccacaagtaccacaagcatggcaagcattcctcctcttcctcctcctcttccagcagtgattctgactgaatacaggccctggacccttccctcaagtctcaccagttctgctctcccatcaagcttcagatgccatgttgtactgggggaatgtagcccttgtgctccccaccccctacctccacctgagcctcaccctgctgttgagccctgagtggctaggggaaa

SEQ ID NO: 1773 - DNA, 755 bp, Homo sapiens
tttcttatgtggaagttgtggtagttctccaggctggaggacacacctaaacatgtggaatcccaatgccgggcagccagggccaaatccatatccccccaatattgggtgccctggaggttccaatcctgcccacccaccacctattaatccaccctttcccccaggcccctgtcctcctcccccaggagctccccatggcaatccagctttccccccaggtgggccccctcatcctgtgccacagccagggtatccaggatgccaaccgttgggtccctaccctcctccatacccaccgcctgcccctggaatccctcctgtgaatcccttggctcctggcatggttggaccagcagtgatagtagacaagaagatgcagaagaaaatgaagaaagctcataaaaagatgcacaagcaccaaaagcaccacaagtaccacaagcatggcaagcattcctcctcttcctcctcctcttccagcagtgattctgactgaatacaggccctggacccttccctcaagtctcaccagttctgctctcccatcaagcttcagatgccatgttgtactgggggaatgtagcccttgtgctccccaccccctacctccacctgagcctcaccctgctgttgagccctgagtggctaggggaaatgggaagaggattgccatggcctggccatcttgttgctgcttggttagatcatatagctaatgaattaggcaggggagctattttttgaagatgatg

SEQ ID NO: 1774 - DNA, 625 bp, Homo sapiens
acataattaccaattaggcagtagcagaggcgggtgccgaagcacggggtctgggtgactaggaagagccgagactgcgaaggagaacgcagcaagcccaggcggcggtggaaaggtgatggggctggaggacacacctaaacatgtggaatcccaatgccgggcagccagggccaaatccatatccccccaatattgggtgccctggaggttccaatcctgcccacccaccacctattaatccaccctttcccccaggcccctgtcctcctcccccaggagctccccatggcaatccagctttccccccaggtgggccccctcatcctgtgccacagccagggtatccaggatgccaaccgttgggtccctaccctcctccatacccaccgcctgcccctggaatccctcctgtgaatcccttggctcctggcatggttggaccagcagtgatagtagacaagaagatgcagaagaaaatgaagaaagctcataaaaagatgcacaagcaccaaaagcaccacaagtaccacaagcatggcaagcattcctcctcttcctcctcctcttccagcagtgattctgactgaatacaggccctggacccttccctcaagtctcacca

SEQ ID NO: 1775 - DNA, 2763 bp, Homo sapiens
atggatccaaactccatcttgctttctcctcagccccagatctgctcccacctagcagaagcttgtacggaaggcgagagaagctcatcccctccagagctggatagagactccccgtttccctggagtcaggtccccagctccagccctacagaccccgaatggtttggtgatgagcacatccaggcaaagagggccagagtggagaccattgtccgaggcatgtgtctctccccgaatcctctggtgccaggcaatgcgcaagctggggtcagcccacgctgcccaaagaaggcccgagagaggaagaggaagcagaaccttcccacaccgcaaggcctcctgatgccagcccctgcctgggaccagggcaacaggaaggggggccctcgtgtgagagaacaacttcatctgctgaagcaacagctaagacatctgcaagagcacatcctacaggctgccaagcccagggacacagctcaggggccaggaggctgtggcacggggaaaggccctctgagtgcaaagcaggggaatggctgtgggcctcgcccctgggttgtggacggtgaccaccagcaaggtaccagcaaggacctctctggggcagaaaaacaccaagagtctgagaagcccagtttccttccttctggagcaccagcttcactagagattctgaggaaagagctgaccagggcagtgtcccaggctgtggactcggtattacaaaaggtactattggatccaccaggccacctgactcagctgggcagaagcttccaggggcaggtggcagagggtagaagcgagccctcacctcctgtgggaggggcctgtaaagatccacttgctttggctgccttgcccaggagggtccagctacaagctggggtcccagtaggaaatttatcactggccaagcgtctagattctcctaggtaccctatccctccaagaatgacccccaaaccctgtcaggatcccccagcaaactttcccttgactgcaccttcccacatccaggaaaatcagattcttagccagctactgggtcatagatacaacaatggccattggagtagcagtcctccccaggactcatcttcccagaggcacccctcctcagagcctgccctacgaccttggagaactactaagccgcaaccattggtcctgagccagcagcagtgtcccttgcctttcacctctgcccatctggaaagtctaccccttcttccctcggtgaagatggaacagagaggcctgcatgctgtcatggaggcactgcctttctctttggtccacatatccgagggtctaaaccctggtcacttgaagaaggccaaactaatgtttttcttcacacgatatcccagctccaacctcctgaaggtttattttcctgatgttcagttcaaccgctgcattacctcccagatgatcaagtggttcagcaactttcgtgagttttattacatccaaatggaaaaatctgcccggcaagcaatttcagatggtgtcacaaatcccaaaatgctggtggttctccgcaattcagaactttttcaagctctcaatatgcactacaacaagggaaatgactttgaggttccagattgcttcttggaaattgccagcttgacgttacaggagttcttcagggctgtctccgcagggagagactcagatccttcctggaagaaacccatttataaaattatttcgaaactggacagtgacatcccagagatattcaaatcttccagctatccccagtagctgtttcggggttaagatcccacaacgtgaggagtgactggctagggtttcctgggtttgtcttaaagggcaatttagctgtagtcatataaaaagggcacaaggaaatctcctctatcaaaacaggtactattaccattttgatcatttatttccctttccagaatcatcagaaatttaactataaaatgtactaactatattggtgtattggtagtatattgtaaaaggaacacaagtttccaatcagaagacttgaagctcaactccattgtttccaggtgttgtgaccctgggaacttcctggtatctctgtatctgtaaaatgaggttgttaaggattaaaggacagtatgtcctatgcaatgtcattcacacacaaatgtcagttttttgagcccctctttcagataaggttatcttatttggggtttttacaaattgctgtttttagtcacctaattataaagcgccatctatttgctagatactttcacatactttaagcttttcaccctgaaaagtagttattatcatcatttaaaagatgaccaaacagaagctttagaactgcaaggtaactcgccaaagcctatgaggctaggacatctgggttgatagggacagtcaggagcctggaggaaccaagactttctgatgcccaactgcatgctggacccatctcctgcagctaactcaggatctcaagcaggaccccacccctagtaagcatccagcgctgacagggcaccgtcacctgacaactcctgcccagcacttaggagcacttcaccgcccaagatttctgctgatcatttcagcaaactcaagacaaactttatgcaggacttgagtgttgctgtttattcacatttgtctgctggaagagtttatcagctggataatgcaaatagtctccagctgaccattgcaattggtgccccaacctcatatatgcagaagaagctgaacttcagactgtga

SEQ ID NO: 1776 - DNA, 1779 bp, Homo sapiens
atggatccaaactccatcttgctttctcctcagccccagatctgctcccacctagcagaagcttgtacggaaggcgagagaagctcatcccctccagagctggatagagactccccgtttccctggagtcaggtccccagctccagccctacagaccccgaatggtttggtgatgagcacatccaggcaaagagggccagagtggagaccattgtccgaggcatgtgtctctccccgaatcctctggtgccaggcaatgcgcaagctggggtcagcccacgctgcccaaagaaggcccgagagaggaagaggaagcagaaccttcccacaccgcaaggcctcctgatgccagcccctgcctgggaccagggcaacaggaaggggggccctcgtgtgagagaacaacttcatctgctgaagcaacagctaagacatctgcaagagcacatcctacaggctgccaagcccagggacacagctcaggggccaggaggctgtggcacggggaaaggccctctgagtgcaaagcaggggaatggctgtgggcctcgcccctgggttgtggacggtgaccaccagcaaggtaccagcaaggacctctctggggcagaaaaacaccaagagtctgagaagcccagtttccttccttctggagcaccagcttcactagagattctgaggaaagagctgaccagggcagtgtcccaggctgtggactcggtattacaaaaggtactattggatccaccaggccacctgactcagctgggcagaagcttccaggggcaggtggcagagggtagaagcgagccctcacctcctgtgggaggggcctgtaaagatccacttgctttggctgccttgcccaggagggtccagctacaagctggggtcccagtaggaaatttatcactggccaagcgtctagattctcctaggtaccctatccctccaagaatgacccccaaaccctgtcaggatcccccagcaaactttcccttgactgcaccttcccacatccaggaaaatcagattcttagccagctactgggtcatagatacaacaatggccattggagtagcagtcctccccaggactcatcttcccagaggcacccctcctcagagcctgccctacgaccttggagaactactaagccgcaaccattggtcctgagccagcagcagtgtcccttgcctttcacctctgcccatctggaaagtctaccccttcttccctcggtgaagatggaacagagaggcctgcatgctgtcatggaggcactgcctttctctttgttgcatatccaggagggtctaaaccctggtcacttgaagaaggccaaactaatgtttttcttcacacgatatcccagctccaacctcctgaaggtttattttcctgatgttcagttcaaccgctgcattacctcccagatgatcaagtggttcagcaactttcgtgagttttattacatccaaatggaaaaatctgcccggcaagcaatttcagatggtgtcacaaatcccaaaatgctggtggttctccgcaattcagaactttttcaagctctcaatatgcactacaacaagggaaatgactttgaggttccagattgcttcttggaaattgccagcttgacgttacaggagttcttcagggctgtctccgcagggagagactcagatccttcctggaagaaacccatttataaaattatttcgaaactggacagtgacatcccagagatattcaaatcttccagctatccccagtag

SEQ ID NO: 1777 - DNA, 2763 bp, Homo sapiens
atggatccaaactccatcttgctttctcctcagccccagatctgctcccacctagcagaagcttgtacggaaggcgagagaagctcatcccctccagagctggatagagactccccgtttccctggagtcaggtccccagctccagccctacagaccccgaatggtttggtgatgagcacatccaggcaaagagggccagagtggagaccattgtccgaggcatgtgtctctccccgaatcctctggtgccaggcaatgcgcaagctggggtcagcccacgctgcccaaagaaggcccgagagaggaagaggaagcagaaccttcccacaccgcaaggcctcctgatgccagcccctgcctgggaccagggcaacaggaaggggggccctcgtgtgagagaacaacttcatctgctgaagcaacagctaagacatctgcaagagcacatcctacaggctgccaagcccagggacacagctcaggggccaggaggctgtggcacggggaaaggccctctgagtgcaaagcaggggaatggctgtgggcctcgcccctgggttgtggacggtgaccaccagcaaggtaccagcaaggacctctctggggcagaaaaacaccaagagtctgagaagcccagtttccttccttctggagcaccagcttcactagagattctgaggaaagagctgaccagggcagtgtcccaggctgtggactcggtattacaaaaggtactattggatccaccaggccacctgactcagctgggcagaagcttccaggggcaggtggcagagggtagaagcgagccctcacctcctgtgggaggggcctgtaaagatccacttgctttggctgccttgcccaggagggtccagctacaagctggggtcccagtaggaaatttatcactggccaagcgtctagattctcctaggtaccctatccctccaagaatgacccccaaaccctgtcaggatcccccagcaaactttcccttgactgcaccttcccacatccaggaaaatcagattcttagccagctactgggtcatagatacaacaatggccattggagtagcagtcctccccaggactcatcttcccagaggcacccctcctcagagcctgccctacgaccttggagaactactaagccgcaaccattggtcctgagccagcagcagtgtcccttgcctttcacctctgcccatctggaaagtctaccccttcttccctcggtgaagatggaacagagaggcctgcatgctgtcatggaggcactgcctttctctttggtccacatccaggagggtctaaaccctggtcacttgaagaaggccaaactaatgtttttcttcacacgatatcccagctccaacctcctgaaggtttattttcctgatgttcagttcaaccgctgcattacctcccagatgatcaagtggttcagcaactttcgtgagttttattacatccaaatggaaaaatctgcccggcaagcaatttcagatggtgtcacaaatcccaaaatgctggtggttctccgcaattcagaactttttcaagctctcaatatgcactacaacaagggaaatgactttgaggttccagattgcttcttggaaattgccagcttgacgttacaggagttcttcagggctgtctccgcagggagagactcagatccttcctggaagaaacccatttataaaattatttcgaaactggacagtgacatcccagagatattcaaatcttccagctatccccagtagctgtttcggggttaagatcccacaacgtgaggagtgactggctagggtttcctgggtttgtcttaaagggcaatttagctgtagtcatataaaaagggcacaaggaaatctcctctatcaaaacaggtactattaccattttgatcatttatttccctttccagaatcatcagaaatttaactataaaatgtactaactatattggtgtattggtagtatattgtaaaaggaacacaagtttccaatcagaagacttgaagctcaactccattgtttccaggtgttgtgaccctgggaacttcctggtatctctgtatctgtaaaatgaggttgttaaggattaaaggacagtatgtcctatgcaatgtcattcacacacaaatgtcagttttttgagcccctctttcagataaggttatcttatttggggtttttacaaattgctgtttttagtcacctaattataaagcgccatctatttgctagatactttcacatactttaagcttttcaccctgaaaagtagttattatcatcatttaaaagatgaccaaacagaagctttagaactgcaaggtaactcgccaaagcctatgaggctaggacatctgggttgatagggacagtcaggagcctggaggaaccaagactttctgatgcccaactgcatgctggacccatctcctgcagctaactcaggatctcaagcaggaccccacccctagtaagcatccagcgctgacagggcaccgtcacctgacaactcctgcccagcacttaggagcacttcaccgcccaagatttctgctgatcatttcagcaaactcaagacaaactttatgcaggacttgagtgttgctgtttattcacatttgtctgctggaagagtttatcagctggataatgcaaatagtctccagctgaccattgcaattggtgccccaacctcatatatgcagaagaagctgaacttcagactgtga

SEQ ID NO: 1778 - DNA, 383 bp, Homo sapiens
ccgtccttcctctcctagcctaaggcgtgcaaacagagcgccactgggaggctgaaacctttaggccgatgcttgcttgcaaggtcaggcaagctggattctggtccccacctttgcagagagaacagcgatgttgtgcgcccatttctcagatcaaggaccggcccatcttactacctccaagagtgcttttctctctaataagaaaacatctactttgaaacatctactgggcgagaccaggagtgatggctcagcctgtaattctggaatttcgggaggccgaggcaggaagattccttgagcacaggagttccagaccagcctgggcaatgtagcaagacgctgtctctatttatacaataaaatttttttaaaaaagg

SEQ ID NO: 1779 - DNA, 6528 bp, Homo sapiens
ctctcctgagtcgctgtcgcggaggctggagcgctgccccggaagtcctcccccctgttccccgcccgcggcaaacatggcggtggactcggcgatggagctgttatttttagatacttttaaacacccgagcgctgagcaaagttctcatatagatgtggttcgttttccatgtgtggtttatatcaatgaagtccgagtcatacccccaggagtaagagcccatagcagtctgccagacaatagagcatatggagagacatctccccatacatttcaattagacttattcttcaacaatgtaagcaaaccaagtgcccctgttttcgataggttgggaagcctggaatatgatgagaatacttccatcatctttagacctaactcaaaggtgaatactgatggtctggtgctaagaggctggtataactgtctgacactggcaatatatggatcagtggatagagtgataagtcatgacagagactctccaccaccaccacctccaccgccaccacctccccagccacaaccaagtttgaaaaggaatccaaaacatgctgatggggagaaagaagatcagtttaatggaagccctccaagaccacagccaaggggaccaagaactcctccaggaccccctccacctgatgatgatgaagatgatcctgtgcctctgccagtgtctggtgacaaggaagaggatgctcctcatagagaagattactttgagcccatttctcctgatcggaattctgttccccaggaagggcaatattctgatgaaggagaagtagaagaggaacaacaagaagaaggagaagaagatgaagatgatgtggatgtagaggaagaagaggatgaggatgaggatgatcgacgaacagtagacagtattcctgaggaggaagaggaagatgaagaggaagaaggtgaagaggatgaagaaggtgaaggggatgatggttatgaacaaatttccagtgatgaagatggaattgctgacttggaacgtgaaacatttaagtatccaaactttgatgttgaatacactgctgaagacttagcttcagttcctcctatgacatatgatccatatgacagggagcttgtaccactcttatacttcagttgtccatacaagactacttttgaaattgaaatcagtagaatgaaggatcaaggtccagataaagaaaattcaggggcaatcgaagcctcagtgaagttaacagaactcttagatttgtatagagaagatagaggtgcaaaatgggtaacagctttagaagaaattccaagtttaataataaaagggttaagctatttgcaattgaaaaacacaaaacaagactcccttggccagttggtagactggaccatgcaagctttaaatttacaagtagcgcttcgccaacctatcgccttaaatgttcgacagctcaaagctgggaccaaattagtgtcctcactagcagaatgtggggctcaaggagttacaggactgctacaagcaggagtgatcagtggattatttgaacttctgtttgctgatcacgtatcatcttctcttaagttaaatgcttttaaagctttggacagtgtcattagtatgacagaaggaatggaagcttttttaagaggtaggcagaatgaaaaaagtggttatcaaaagcttctggaactcatacttttagatcagactgtgagggttgttactgctggttcagctattctccaaaaatgccatttctatgaagtcttgtcagagattaaaagacttggtgaccatttagcagagaagacttcatctcttcctaaccacagtgaacctgatcacgacacagatgctggacttgagagaacaaacccagaatatgaaaatgaggtggaagcttctatggatatggatcttttggaatcctcaaatataagtgaaggggaaatagaaaggcttattaacctcctagaagaagtttttcatttaatggaaactgcccctcatacaatgatccaacaacctgttaagtctttcccaacgatggcacgaattactggacctccagagagggatgatccataccctgttctctttagatatcttcacagtcatcacttcttggagttggttaccttgcttctgtcaattccagtaacaagtgctcaccctggtgtgctgcaagccacaaaagatgttttgaagtttcttgcacagtcacagaagggtcttcttttttttatgtcggaatatgaagcaacaaatttattgatccgagctctgtgtcacttttatgatcaagatgaggaggaaggtctccaatctgatggtgttattgatgatgcatttgccttgtggctacaggactcaacacagacattgcaatgtattacagaactgttcagccattttcagcgttgtacagccagtgaagaaacagaccattcagatctcttgggaaccctgcacaatctttatttgattacttttaatcctgtgggaagatcagctgttggccatgtttttagtctggagaaaaatctccaaagtcttattactctaatggagtactattccaaagaagccttgggtgattccaaatctaagaagtcagtagcttataattacgcatgcatacttattttggtggtggttcagtcttccagtgatgttcaaatgctagaacaacatgcagcatctctcttgaagctttgtaaagcagatgaaaataatgctaaattgcaagaacttggcaagtggcttgaacctctgaaaaaccttagatttgaaattaactgcatcccaaacttaattgagtatgttaagcagaatatcgataacttgatgaccccagaaggagttggccttaccactgccttacgtgttctctgtaatgttgcatgcccaccacctcctgttgaaggtcaacagaaagatctgaaatggaatcttgccgttattcagcttttttctgctgaaggaatggacacgtttattcgagttctgcaaaaattgaacagtattctgactcagccttggaggctccatgtcaacatggggactacccttcacagagttactactatttcaatggctcgctgcacactcactcttcttaaaactatgttaacggaactcctgagaggtggatcctttgagtttaaggacatgcgtgttccttcagcgcttgttactttacatatgctcctgtgctctatccccctctcaggtcgtttggatagtgatgaacagaaaattcagaatgatatcattgatattttactgacttttacacaaggagttaatgaaaaactcacaatctcagaagagactctggccaataatacttggtctttaatgttaaaagaagttctttcttcaatcttgaaggttcctgaaggatttttttctggactcatactcctttcagagctgctgcctcttccattgcccatgcaaacaactcaggttattgagccacatgatatatcagtggcactcaacacccgaaaattgtggagcatgcaccttcatgttcaagcaaagttgctccaagaaatagttcgctctttctctggcacaacctgccagcccattcaacatatgttacggcgtatttgtgttcaattgtgtgaccttgcctcaccaactgcacttctgattatgagaactgtgttggatttgattgtagaagacttgcaaagcacttcagaagataaagaaaaacagtatactagccaaaccaccaggttgcttgctcttcttgatgctctggcttcacacaaagcttgtaaattagctattttgcatctaattaatggaactattaaaggtgatgaaagatatgcagagatattccaggatcttttagctttggtgcggtctcctggagacagtgttattcgccaacagtgtgttgaatatgtcacatccattttgcagtctctctgtgatcaggacattgcacttatcttaccaagctcttctgaaggttctatttctgaactggagcagctctccaattctctaccaaataaagaattgatgacctcaatctgtgactgtctgttggctacgctagctaactctgagagcagttacaactgtttactgacatgtgtcagaacaatgatgtttcttgcagagcatgattatggattatttcatttaaaaagttctttaaggaaaaacagtagtgctctgcatagtttactgaaacgagtggtcagcacatttagtaaggacacaggagagcttgcatcttcatttttagaatttatgagacaaattcttaactctgacacaattggatgctgtggagatgataatggtctcatggaagtagagggagctcatacatcacggacgatgagtattaatgctgcagagttaaaacagcttctacaaagcaaagaagaaagtccagaaaatttgttccttgaactagagaagcttgttttggaacattcaaaagatgatgacaatctggattctttgttggacagtgtagttggacttaagcagatgctggagtcatcaggtgaccctttacctctcagtgaccaggatgtagaaccagtactttcagctccagaatctcttcagaatctgtttaacaataggactgcctatgtgcttgctgatgtcatggatgatcagttgaaatctatgtggttcactccatttcaggctgaagagatagatacagatctggatttggtaaaggttgacttaattgaactctctgaaaaatgctgtagtgactttgatttgcactcagaattagagcgctcatttttgtcagaaccatcatctccaggaagaaccaagactactaaaggattcaaacttgggaagcacaagcatgagacctttataacgtcaagtggaaaatctgaatacattgaacctgccaaaagagctcatgttgtgccaccaccaagaggaaggggcaggggaggatttggacagggtatacgacctcatgatatttttcgtcagagaaaacagaacacaagtagaccaccatctatgcatgtggatgactttgttgctgctgaaagtaaagaagtggttcctcaagatggaatacctccaccaaaacggccactcaaagtatcacagaagatttcttcccgtggtgggttttcaggcaatagaggaggacggggtgctttccacagtcagaataggtttttcacaccacctgcttcaaaaggaaactacagtcgtcgggaaggaacaagaggctccagttggagtgctcagaatactcctcgaggaaattacaatgaaagtcgtggaggccagagcaattttaacagaggccctcttccaccattacgaccccttagttctacaggttaccgcccaagtcctcgggaccgtgcttctagaggtcgtgggggacttggaccttcctgggctagtgcaaatagcggcagtggaggctcaagaggaaagtttgttagtggaggcagtggtagaggtcgtcatgtacgctcctttacacgataaaaatccttttgggaacatcttaactgtatatgaacatttcacgaggacaataaaaataagacattgaaggaccaatttagacttagcagttatctggagacatctgagagaatatttttatctgaagaaagcagaatttgtttgatacctaacaagatttcaataaaaatccaaactttgtatgtacgtttgtatatattttcccttttttgtatgactatttatttagaaaatttctaggtgaaaaactaaatgatgttttgtatttttcttgcctatagcacagatattctcaaactttctcagctcatgacactatttagtgcctcagtacttttttcacagcatacctggtccaaaagaaatatctaatacttgtgtttattaagcagttagatccaacagcttaataagaatgtacatcatcaccactagtaactgtggacactgcatgtctcaaaccttggaatcagtatcattttcttttcctctctgcttcttgcacagtactttttatcaaactgctgaaaacccagttttgtaaagatatgttgttatagaaaggaatataatgctatttaatgttgaaaatgtaaactacctcaaagtagtagtttatgtgatgtccaacaggtgttgctatgtttttctcaaaaattttaaaatattgtgtggcacccatgttaatttgctaaggtgccctgctacacagtttgggaaccatggctgtaccaaaagaaacaaaatactcctctcctttgtattagaaatctgaactttgcatttcagctttggacctactgacactattttattatacaaattatttaaagcctaaaataaggaatatcctaatactattattttgggaatcagaaacatctaataaagctggactttatacatagaaataaagcttacaactttgagaaagtagccatattttccccaagatacgtcttaacacactgagtctatataagtggcgtaaaatacagagttatcttaatcag

SEQ ID NO: 1780 - DNA, 4087 bp, Homo sapiens
ggcgaccgtggggaggtgccgccggggtcgcaggtgagcggttctatgctggaggaggcggccagggaagcggcggctccgtgaccagtgggtgccctcgcagtgggtagggtcccggaggggtcagcggcaattggcgcaacgcttgctgccgggtttggtccaagggctgcgacgtagcgggactgcacgctcgggagaagtgccacgcgcgtctgtcgcctgaccggggaggctggggagggcccaggccacggaaacaagactgcagaagtttctgggcactcagtcgggactctcatttaatacccagagagaggagatcttccaggttgccccgactcccaccgggactcctaccagcagcaacctcatcattgtggccgaggcaggtgcgcgcccctgctcccctgggtggccttccgggagcccagtctaactcgattcttcccaggggctctttttggacggtcccaaaggaggcagcgggagggaggtgaaagatactttgataaccgtcgacccataagtatacttgttatgcacctaccacgagttttagagaagaacatactttttggcagggaagtgaatcccctataagaatataggggaggggaaagccacactttaaagagaatttgggtagggtttgatattgtagatttgtgatgcttttcttcttgaactgcttaactaatttaccctcaaatttttttgatccggaacttgccgtctggtttttctcagacttcttaattctgacttatcatgaagtatctaggaacttcattctcaagttttagtgcttgtaaaaagttgcctggttatattatgccattggcagtacatcatcttcacaaggattacgtaagtgaactacatctcattcctgtttccaactagtgaagaacgattgtgaaatgggattttagaaaatggctgttctctgtgattgggcatagaaggtttgtaagttttagagactgcagctgttgaatcctttctgctaagagagcgatgacaggcaatagaaaagggatagtgtttgacatctaaaatgacatattttcacattttatgaggtgttatatccccagcaccaaaaatagtgcctttcacacagtaggagctcagtaagtattttttgaggaaattattggggaatgaatggatggtagaaaacccaagcttctgttacttggataccggcatataaaggagaggacaggaagacaaacatttctggaaatggcttttatccaggaattatccagactgccttgccactagatgaatggaagacaatgatttgaactaagggccagcaaagaattatccctggtttttgtgctttgcagcattcctcaaattgttttcacatctcttaccataaaaactgcattgaaattgaaaatgaagcagttgaaaagaaaaaggaaaagcaattttagtgttcaagaaactcagacccttttgaaagaaattacgaaaaggaaagaagtcattttttccaagcagctcaatacaacaattaatgtgatgaagcgaatggcttgggaagagattgcacagtgtgtgaatgctgtaggagaaggagaacagaggacagggacagaggtgaaaagaaggtaccttgactggcgagcacttatgaagagaaagaggatgaaggccaacattaagctggttggttcaggatttccccttccctcctctgatttggatgactctctcactgaagagatagatgaaaagattggattccgaaatgatgcaaattttgactggcaaaatgtggcagatttcagggatgcaggtggatccttaactgaggtcaaggtggaagaggaagaaagggatccgcagagtcctgaatttgaaattgaggaggaggaagaaatgttgtcatccgtcataccagattccaggagagaaaatgaacttcccgatttcccccacattgatgagttttttacccttaactcaacaccatctagatctgcatatgatgagcctcatttgctcgtaaatattgagaaacagaaactagagttggaaaaacgacgactggatatcgaggccgaaaggctgcaggtagaaaaggaacgcctacaaatcgagaaagagaggctgcggcatttagacatggaacatgagcggcttcagctagagaaggagcggctgcagattgaaagagaaaagttgaggttacagatagtcaattcagagaaaccgtccttggaaaatgaacttggtcaaggagaaaaatccatgcttcaaccacaggacatagaaacagagaagttaaaacttgagcgagaacgcttgcaactggaaaaggataggctgcagtttttgaagtttgaatctgagaagctgcagattgaaaaggaacgcttacaggtagagaaagacagacttcgaattcagaaagaaggacacttgcagtgatttttccaggcttccatttagcaaatgtttgaaaactctagatttttctcatatcaggtgatataatgatggttgctggattagctgtggtttcttgtctaatgtcagtgttcagtaggaaaaagttatatgtggataactgtatgcctaagtagtatataaaagctgtgccctagcgtaaacagtatagcagaaacttactgtgctggactctttaccttataatattacatagagtcttgtattgtctgtgtacccagagtttacaattatgtccatataaaattctagcccagaagttctcatctggggtagattttggccttcagaagaccaatttggtgatgtctggagacatgttgggttgtcaaaactggggtggggaaaaggttgctactgtgcaatgcatacctcctcaacacccccccacactcagtaaagaattttccaacccaaaatatcattagtcctgaggttgagaaaccctgtcctagcctaactgtgtacctctatagctatgttttatagttttagaatattaaaacctcagatatttatgtgggtaggtacttaaatggccaaaaactttaactatgaaatgttactgtgtagtatattgaatataggaagtgatgaagattataggtattttattcccatgtttccatctataaatagccttctcagattcagaaaacaatacagagaacatcagaaattttctaaaatgggtcactttgaaaagaattctttttctcactattaatgctttagaagcaagacgcaattttaaagctttagttccttttctttcagtcattgtcttagtttgggtacaaaaatgtcatttcagtaatgtactgaaatcttataagtgaatagttgaagctagtaaaaatgataccagtataaaaatggtacttgtagtccatgagcttgaacccaatgactgattgtttgacttttaaaataagtaatagcagccatttgggagtagggggtaggtggggaagatgtactccgtatcaaataataatgatgttgaaataatgatagtaggtatgtattatggattggagaagcacttattacactatctaacctaatatgtagaacaattcttgagagttgtatctgtcgttatttctgaatgtgaagctcagagaagtgacacagagtaaatggctgatcttctatattgtagtatattttgtccttccctcttccctgaggaacaaagcacgtatctttagtctctttgatatttattctgagaccaagggcttgcttgacctgatgattttccttcagctctctgaaggtgctttttccacaatccaagtgattctgatacacactaaagttgagaatcactgcactagatcactttgtgttttctgattttcaaggttgatacgtagctttaatacagctcttctgttgacagttattactttaattttgcatttgttccttgtaagaatggctggaaactgtgtgttgacatttgaggatgggtatgcaaggaaaaaatatacttctgtttacttactctgactttgaaatagtgttatttttctatatctgaaataaatgcttctaccatagaaataaatttgcctatactatctga

SEQ ID NO: 1781 - DNA, 13708 bp, Homo sapiens
ggctgggaaagttgaggccgcgctgccgccgggtctccggccttgagggctcgggctcgcagcggctgcggtggccgcaaaaagaggcggcgggggcggggggagaggagggcctgggcccgcgctcccccagccccggaggagcaggcggtggccgcggacggagagattcgcccagacggtcagacactcctgccttcccctcctgggatcatgacccaggcgggggtcgccgccgtcgccgccgccaccgcggccgagaccgcgcagccggcggtaagaagaaagcataacccatagaccatcttctggcagaagatgatacatttggatcagaaacgggaggcattggaagccaggaatcaaaagtgaagaaactctgcaagcccttaggttcctattactgtaaccatgccagaaatgacagagaatgagacgcctacaaaaaagcagcacagaaagaaaaaccgggagacacacaatgcagtggagaggcatagaaagaagaaaattaatgctgggataaacagaataggagagctgatcccatgttctcctgccctgaagcagagcaagaatatgatcctggaccaagcctttaaatatataacagaattgaaaaggcaaaatgatgaactcctgcttaatggaggaaacaatgaacaagctgaagaaataaaaaagctacggaaacaactggaagaaatccaaaaagaaaatggccgatatattgaattactgaaagctaatgacatatgcttatatgatgacccgacaattcactggaaaggaaatcttaaaaactcaaaggtctctgttgttattcctagtgaccaggttcaaaaaaaaattattgtttattccaacgggaatcagcctggtggaaacagccagggaacagctgttcaggggataacttttaatgttagtcataatttacaaaagcagaccgccaatgtggtgccagtacagaggacttgcaatcttgtgactcctgtatctatttctggagtttacccttctgaaaacaagccatggcatcagaccacagttcctgcattggctaccaaccagcctgttcctctttgtcttcctgctgccatttctgctcagagtattctcgagcttcccacctctgaaagcgaatcaaatgtgcttggtgccactagtggctcactgattgctgtttcaattgaatctgagcctcaccaacatcattctttgcacacatgcctaaatgatcaaaattcttctgaaaataagaatggacaagagaaccccaaagtattgaagaaaatgaccccttgtgttacaaacatcccccacagctcctcagcaactgccactaaagtgcaccatggaaacaagtcctgcctgagcatacaggacttcagaggtgattttcaaaacacttttgttgtttcagttaccaccacagtctgctcgcagcctcccagaactgcaggtgattcttctccaatgagcattagtaagagtgcagacttgacaagtacagctacagtggtggcatcatctgcccctggagtagggaaggccaccattcctataagcactctttcgggaaaccctttggacaatggttggactctttcttgttctttgccttcttcaagtgttagtacttcagatttgaaaaacattaatagccttacacgaatctcttcagctggaaacacacagacaacgtggactactttgcaactggcaggaaacactattcagcccttaagccagacaccatcttctgctgtgactccagtattaaatgagtctggtactagccccaccacaagcaaccacagtagatatgtggctacagacatcaacttgaataattcctttccagcagatgggcagccagttgagcaagtagttgtaacattgccttcttgtccatctttacctatgcagccactaattgcccagccacaagttaaatctcagcctcccaaaaatatccttccactgaattcagcaatgcaagtgattcagatggctcagccagttgggtcagctgttaattcagctccaactaatcaaaatgttataattcttcagccacctagcaccaccccatgcccaacagtgatgagggcagaagtttccaaccaaacagtaggtcaacagatagtaatcatacaggctgctaatcagaatcctttgccactcctccctgctccacctcctggttctgttcgactccccatcaatggagccaatactgtaatagggtctaataattcagtgcaaaatgttccaacaccacagacttttggaggaaagcatcttgtccacatattaccaagaccttcatctttatcagcgtctaactcaacacaaactttttctgttaccatgtcaaaccaacagcctcaaaccatttctttaaatggacagctctttgctttgcagcctgtgatgtcttcatcaggaactacaaatcaaacccctatgcaaattattcaacccaccaccagcgaagatccaaataccaatgttgccctgaatacatttggtgctttggccagcctcaatcaaagcatatcacagatggctgggcaaagctgtgtacaattgtctattagccagcctgccaattctcaaactgctgcaaatagtcaaaccactacagctaactgtgtttcattaacaacaactgcagcacctcctgtgacaacagatagttcagccacactagctagtacttataatctagtgagtacttcctcaatgaacactgttgcttgtttgcctaacatgaaatctaaaaggttgaataagaagccaggtggcaggaaacacttagcagcaaacaagtcagcgtgtcccctgaattcagtcagagatgtgagcaagttagactgccccaacactgaaggctcagcagagccaccctgtaatgatggactgctagaaagcttccctgctgtgttaccatctgtctctgtgtctcaggcaaatagtgtgagtgtttctgcttcacattctttgggtgttctaagctctgaatcattaatacctgagtctgtatcgaaatctaagtcagcagaaaagtccagcccaccctcccaagaatctgtaacaagtgaacattttgcaatggccgcagcaaaatccaaagattctacccctaatctacaacaagagacatctcaggataaaccaccaagtagtttagcattatcagatgctgccaaaccctgcgcttcagccaatgtattgattccatctccaagtgatcctcacattttggtttctcaggttcctggtttgtcatctacaacaagcactacaagtactgactgtgtttctgaggtagaaatcattgctgaaccttgcagagttgagcaagattcatcagatacaatgcaaaccacaggtctcttaaaggggcaaggtttaactacattgctatctgatcttgctaaaaaaaaaaaccctcagaaatcatctctttctgatcagatggatcatcctgacttttcttcagaaaatcctaaaatagttgattcaagtgtgaatttacatcccaaacaggaactattactgatgaacaatgatgatagagatcctccacagcatcattcctgcctccctgatcaagaggttattaatggttctttgatcaacggtagacaggccgactctcccatgtcaaccagctctggcagtagtcgtagtttctcagttgcatccatgcttcctgaaacaacaagagaagatgtgaccagcaatgcaacaactaatacatgtgacagctgtacctttgtagagcaaactgatatagtagctcttgcagcaagagctatttttgaccaggagaaccttgagaaggggagagttggcctccaggctgatataagggaagttgcttcaaagccttctgaagcatcattgttagagggagacccacccttcaaatcacagatacctaaagagagtggcacaggacaggcagaagcaacaccaaatgaatttaattctcagggttcaattgaagcaactatggagaggccccttgagaaaccaagttgttctctaggaattaaaacatcaaatgcatctttacaggattcaacttctcagccaccaagcatcaccagtttaagtgtgaataatcttatccatcagagcagcatcagccatcctctggccagctgtgcgggtttatccccaacttcagagcaaacaactgtgcctgcaacggttaatctgaccgtttcatctagctcctatggcagtcaacctcctggaccatctctgatgactgaatattcccaagaacagctaaatactatgactagtaccataccaaattcacagattcaagagccactcttaaagccaagccatgaaagccgtaaggattctgctaagcgtgctgtccaagatgaccttttactgtcttcagctaaacgtcaaaagcactgtcagccagcccccctcaggcttgaaagtatgtccctgatgagcagaactccagacaccatttctgaccaaactcaaatgatggtcagtcagatccctcctaattcttcaaactcagttgtgcctgttagcaacccagctcatggagatggccttacacgattatttccacctagtaacaactttgtgactcctgcattgaggcaaactgaagttcagtgtggttctcagccttcagttgctgaacagcagcaaacccaggcaagtcagcatctacaggccctgcagcagcatgttccagctcaaggtgtatctcaccttcatagtaaccatctctacataaagcagcagcagcagcagcagcagcagcagcagcagcaacagcaacaacaacaagcagggcagttaagagagaggcatcacttatatcaaatgcagcatcatgtacctcatgcagagagctctgtccactctcagccccataatgtccaccaacagaggactctgcaacaggaagttcagatgcagaaaaagaggaatcttgttcagggcacccagacctctcagctttccttacaaccaaagcaccatggaactgaccaatcccgatccaagactggccagccacatccccaccatcagcagatgcagcaacaaatgcagcaacactttggaagctcccagacagagaagagctgtgaaaacccttcaactagtcggaaccatcataaccatccccagaaccatctcaatcaagatattatgcaccaacagcaggatgttggaagcagacagcaaggttcaggggtttcatctgaacatgtatctggccataatccaatgcagaggcttttgacatcaagaggcttagagcagcaaatggtgtcccaaccaagtattgtgactagatcttcagacatgacctgtactccacacaggccagagagaaatagagtttcaagttattctgctgaggcactcattggaaagacatcttctaattcagagcagagaatggggatatcaattcagggttccagagtttcagatcagcttgaaatgagaagctatcttgatgttcccagaaataagagtttggctattcataatatgcagggtcgtgtggaccatactgtggcctcagatatccgcctttctgattgtcagacgtttaaaccaagtggagctagtcaacagccccagagtaattttgaagtacaatcttcaagaaacaatgaaataggtaaccctgtatcatcattgcggagtatgcagtcccaggcttttcgaattagtcaaaacactggccccccaccaattgaccgtcaaaagagattatcttacccaccagttcagagcatcccaacaggaaatggtattccatcaagggacagtgaaaatacttgtcaccaaagtttcatgcagagcttacttgcccctcacctcagtgatcaggtcattgggagccagaggtcactctcagaacatcagaggaatacacagtgtggtccatcctctgcaattgaatataattgtcccccaactcatgaaaatgtccatattagaagagagagtgagagtcagaatagggaaagttgtgacatgtcgttaggtgcaattaacaccaggaacagcaccttgaatattcctttttcaagttcctcttcctcaggagatattcaaggtcgaaacacaagccccaatgtttctgtacagaaatccaatcccatgaggattactgagagtcatgccaccaagggccacatgaaccctccagtcacaaccaacatgcatggggttgcaaggccagcgttgccacatccatctgtgtctcatggaaatggcgatcaaggccctgctgtacgtcaagctaattcttcagttccccagagatcaaggcatcccctgcaagacagcagtggttccaaaattcgtcagcctgaaaggaatcgttctggaaaccaaaggcaaagtactgtctttgatccaagtcttccccatcttcctctctctactggtggcagtatgattcttggacgtcaacaacctgccacagagaagagaggaagtattgttcgtttcatgcctgatagcccacaagtacctaatgataattcaggtcctgaccagcatacactatcacaaaattttggtttttcttttattcctgagggtggcatgaatccaccaataaatgctaatgcttctttcattccacaggttactcagcctagtgccactcgaactccagccctcatcccggtagatccgcaaaatactctgccctccttctatcctccatactctcctgctcatcctacactgtccaatgatatttcaatcccctattttcctaatcagatgttctcaaatcctagcacagagaaggtaaacagtggaagtttaaataaccgatttggatcaattttatctcctcccagacctgttgggtttgctcaaccaagttttcctcttctcccagatatgccaccaatgcacatgaccaactctcacttatccaattttaatatgacatctttgtttccagaaatagccacagtgcttcctgatggctcagcaatgtcacctttgcttacaatagcaaattcctctgcctctgactcttccaagcagtcctcaaacagacctgcccataacataagccatattctaggtcatgattgcagttcagctgtttaaatactgataaacaaaatgtaaaggtaatgagtgagattacaaatgtatttgtgcgtgcatgtgcacagacatgtacatgaagagaaggattgtgtgtgtgtgtctgtataatcagttttcagttatcttctgaatgtagggaagccatgtcagatgcagatactgggttgtcagaaaacaagttatctttcgttttcaactgcatggtgtacttttttattttccaagtagatttacatttccaagttgatatttcctaaatactaattagctggaaattgggggagatcatcttgtcatgtactgggtagtaggagggagcctagactttaaacttgattgttgataacttatggaatatgtaggtaagttgctactgaaaaatataggcagcttgataaaacacagtggctcataatcaagtgctggctaatgtcagcatctagaacagcttcttacctatgacagatgttgaactgatgttgagtttaatgtccgtagttaaagtcaagcagttagcaaataaataaaagcaatcagcctttattctcaaagtttggtttagatacaggcttctttctaaattataacaatgcataaattatctgaattttatgtcttgttcttcaaattagggagctgtgttaccctttaatgtgccaagattatttaaagcaaaggtcttccttagacaattatttagccgtaaatatagaaagctaaaaagttaagtacatacatattctccgttttgtgcttgcattttgcatcgggtcataagggtaaaagcagttagttgtattgtggagttttgcatgggtgcagttaacaatggatgtttcatcagctgagtttaatttagtattctctcttcattctatttatttggtcttgaaataaattcttttgcattcatttaaatattaggattgatcaggaaatagtgtttgtaatctacacgtttatttgagccttactttaaaaatatttctgaacagagatttaagctctgtcagtattttcatttactgatagcatttatattttaaatatggcattgtatatttcattattatccttcataacagaattataatgagaatatgaatttgttatttttcttgttggtagatgtgaaatggtgcttcaaaaaatatatagtctttctgtatgtctctgtgtgtgtaagtatgtgtgtgtgtgtgtacacatattttaaagtatgaattggtcctttaaaaacaggcctgccatctgaaaatgggaaattgagacctgagacctgctaaagcatagaagaacttgatataggtagggttttttttttttttttttttttaatagatggagtctggctctgttgcccaggctggagtgcagtggcgtgatctcagctcactgcaagctccacctcccgggttcaagtgattctcctgcctcagcctcctgtgtagctgggactacaggcacgtgccaccacacctggctaatttttggtacttttagtagagacggggtttcaccgtgttagccaggatggtcttgatctcctgacctcgtgatccacctgcctcggcctcccaaagtgccaggattacaggcatgagccaccgtgcttggcctaggtacaggtttttaaaagccccacagaagtttataatacgtttaaaaacccatattaaaatttgaaaacttaaaaaaaaaactaagaaaacaatggcatatattccttttcttaaacctgtgaagtccattactttttgttcttgttatattctgccaaaaatgggatggggtgggagagatgcatagaaattgttttatctgccttgttaacaaagtgaactcaaggaccagcttttcttttctttcttcttttcttttttttttgagactctgtcacccaggctggagtgtcgttaggtgcaactaacaccaggaacagcaccttgaatattcctttttcaagttcctcttcctcaggagatattcaaggtcactttgtcacccaggctggagtctacaatggcaggatcttggctcactgcagcctctgcctcctgggttcaagcaaattcttgagcctcagcctcccgagtagctgagattacaggtctgtgccactacacctggctaatttttatatttttagtagagacggggtttcaccatcttggccaggctggtcttgaactcctgatgtcaggtgatccacccacctcggcctcccaaagtactggaattacaggcatgagtcacccctcccaggcccccccctttttttttaatcctaaaaagcttcctaagggttggtcagagcagttaactccagtgaatacctcttctaaagactcagcaaaagggtcatttgtgcctctttaactgttcttaccaaactgtcctgtctcttttctgctgccaactaagcagcttcctagggacaaaaaaatatacaatatttttttttttcttgcttacaaagcaagaacaacctgtattttctttcttcaaaatggtcttggggaagaataggagagcttcatgaataagttactcaagacaacagataaacacagtagtcaaaactttttattgaggaaaaatgtggcatttatgacttgctttttaattctcttaactgaattttaagctgcaacgttcaaatttttctttgtacttgaaaggtccagtgtgccaatttcaagaaggacagttttccatgtgtttggctattcatttccctctctccctctctcatctgtctgtctctcactgcctctgtctctgtctctcatacacatatacacacacacacacacacacacacacacacactctctctctctctctctctctctccagtggctgttaagttctgaaggactggggactgctagacataattgaaagtaaggtaacaggctaaggagaagctcagtttgaacattgcaatgtaaagtcctcaaagcctgtgactttcaagtatttctgttgcattaattgtattttcctgcttagctgtgttcagacatagtatttgcatttcttggagctttcattccaacagtctaacattttgatcttgaaagagtctcaataagccttatttgaccatctgaggaaaaatgtgaccatctgtgaataattggctcctgcttacgtgtagctctcattactttacagatgtatgcatgtgtatgtaagacttcagttcatacatggcttaattctgaaagtgttcagaccatagtacccttatttgatttaaaagcatgaatatatgagatttactagcagtattaagtatttgatagagctacgtgatttttgggaagaaatttgttatatggtatgtagtgttaatttggatataatttttggtaaagggatggcagaaaacatagtcaattttggttataataaacgtaaccttattcttggcctgctccatgtgaaatagggctcagggaagctggtcttttccttagcgggatgattactcctttgccttgaaacatttattgggcccaccatgtatggatcagcatgtggtggtaagtcatactcccaaatcagtgattcccaagtcttggctttgggaaccagtatgcctcgtattctcttaaagagcaacaagaatttcttgaaacaaaattagttcagaattgatttaaattttttaacttctggaaatacacgaagttatgtctgagtcatgagtgacagtcattgattaaatcatttctctgtctcttttttagcattattgatcacagagtccgttataaaaagtggttgattcctttcaacatttaacaataacttctaatgaagggtaaaattccagattctcttcatgcgtaaacatttaatgtgtcaatcatagatgaaaggaatctagtttgatgttgtttctttctttcttttttttggaaaacacaagttgctctgggatggcttatatgttgttttataccggttcaggaaatttatttttgtttttattgtaagaccttttgcggtaccagagatggcaccttttttctaggtaaggtgtaggaattcctcaatggtcttgcttcgtaaaatttaacatatcagaactggggaaagagaaaggagggggttatttttttgcagcattttccagtcacatatcagggttatactgaactgcaacaaagatcaacttttaaaaattagccttcttaaaatacaaaatgatttaagtattttaaagataatttatttgccttgctcttgccttctaacattagccatttcatggagaggctaaaacttatactccaaaaaatgtggaagcacattttaatgggagtaaaattaaaaaattttgagaaagggtaaaatcttatgaatatgcatcttcttagctttatcttccctttgataggtaggcacttatgctcttccatctgctccatgtcaaatagggctcagggaagccagtcatttccttagcgagatgattactcctttgccttgaaacatttattgggcccaccatgtatggatcagtgtgtggtagtgagtcatactcccaaatcagtgattcccaagtcttggctttgggaaccagtatgccttgtattctcttaaaaagcaacaataatttcttgaaacaaaattagttcagaattgatttaaaatatttcagtgtgccatatagctctgtcccttggtttggttggccttgttttttcctgtgaagaatgaaagggcaaaggtgataccaaaatgaaacagctttggagtgatatctttaggagcctggaagccatttttgtaattttgttgtctatataaatgctacctttgcctggaggtagtgcgcctgtggctgtgtacatccagagggcaacagtaatagccaacaaccagacaaactagtgaagttaatctgtgagtgatgattttatgatacttatatgcaaattaaaggcagaagttagtttcttctcaagatgcctttttggctgaacattaccatttttctttccccagggtttgaaagaaaagggccttttttggatttaactatattctgtctgcattctattcttcatgcgtaggtttctactagaacctgtggaggggggacaccaaatttagattgagtcagtccatgctgataagaagcgtgaggaccttgttggacacagagcttctagatctttccacctgtagcctctaccctgttcctgcactttacctgaaactgtgcctctggtctttagaccagctgttggaacatatcactcacccactcctctgttatagcaaagggccagctgggatggtacacgctgtgtaatcagacaccttctcgacaagtacagctgatgtttctcactgttgccttaccattctctgagccatctttgatgttgatttgtaaaaaaaaacaaaaaacaaaaaaaaaacctagtagcaaaactcctgttaaactcagagcttgtatgtggtggtcattcaacatccttatttctagatttacacaaactgtaccaactgtaatctttttctggcacgcgtatgtggtcagatgcttcataaacgtgagccaacttgggttgtaaacattggacataatatacaaattggggaattttggatgactgcataatcctgtcattagagatttcataagacagaagataactgtttatttgtaatttaacacatttttagaaaagatgatctttaatttctttccctcagttgtgtatacagctatacaccatactaacaccgtactatgtcataggaacttaaagttagatgtatctaaatcccttcacttttctaagacttctctgtgctcccacccctgaagtcttcaaatcatttttcatctgtgaagtcactgaggtactgggcttgactatagtggtaacagttaaggggagttgaactattgatcttccaagaagaaagggaccagatagtgttaagatgctgcagttgtgttactgtgaagaaaagattcgcttccactttcagcaggctatataaatatatatacatatatatatatattttcactttggtaaaaaaaagttgaaaaatctgaggagaacataattaccttcacaaattatttatagatacactgggtgagaagcttactgtagggcagtcacccaaaaaaaactaattttagtgctttcaatagtgtaatatttgtatctattaccatggcagcagtgtctgctgcacactgtgtcctattactgtaaatctcctggtttataattcttatggaaactaatttgttttgtaatggaatccagagcagatatgtataatatgatcaggattgtcctacagttgtaaataagaataggtcctgtttattttgacatctttttacaaatgcattgtattagggtgtgaatattctgaaccatcctcttgtttaaagtttggaaatttttattgttaaatgtaacattttaatggttgtaataattatttgtatagatatgaatatagtattttatttaagaaaataaactttgcatttttgcattgtaaa

SEQ ID NO: 1782 - DNA, 3924 bp, Homo sapiens
ttctccctctcctgagtcgctgtcgcggaggctggagcgctgccccggaagtcctcccccctgttccccgcccgcggcaaacatggcggtggactcggcgatggagctgttatttttagatacttttaaacacccgagcgctgagcaaagttctcatatagatgtggttcgttttccatgtgtggtttatatcaatgaagtccgagtcatacccccaggagtaagagcccatagcagtctgccagacaatagagcatatggagagacatctccccatacatttcaattagacttattcttcaacaatgtaagcaaaccaagtgcccctgttttcgataggttgggaagcctggaatatgatgagaatacttccatcatctttagacctaactcaaaggtgaatactgatggtctggtgctaagaggctggtataactgtctgacactggcaatatatggatcagtggatagagtgataagtcatgacagagactctccaccaccaccacctccaccgccaccacctccccagccacaaccaagtttgaaaaggaatccaaaacatgctgatggggagaaagaagatcagtttaatggaagccctccaagaccacagccaaggggaccaagaactcctccaggaccccctccacctgatgatgatgaagatgatcctgtgcctctgccagtgtctggtgacaaggaagaggatgctcctcatagagaagattactttgagcccatttctcctgatcggaattctgttccccaggaagggcaatattctgatgaaggagaagtagaagaggaacaacaagaagaaggagaagaagatgaagatgatgtggatgtagaggaagaagaggatgaggatgaggatgatcgacgaacagtagacagtattcctgaggaggaagaggaagatgaagaggaagaaggtgaagaggatgaagaaggtgaaggggatgatggttatgaacaaatttccagtgatgaagatggaattgctgacttggaacgtgaaacatttaagtatccaaactttgatgttgaatacactgctgaagacttagcttcagttcctcctatgacatatgatccatatgacagggagcttgtaccactcttatacttcagttgtccatacaagactacttttgaaattgaaatcagtagaatgaaggatcaaggtccagataaagaaaattcaggggcaatcgaagcctcagtgaagttaacagaactcttagatttgtatagagaagatagaggtgcaaaatgggtaacagctttagaagaaattccaagtttaataataaaagggttaagctatttgcaattgaaaaacacaaaacaagactcccttggccagttggtagactggaccatgcaagctttaaatttacaagtagcgcttcgccaacctatcgccttaaatgttcgacagctcaaagctgggaccaaattagtgtcctcactagcagaatgtggggctcaaggagttacaggactgctacaagcaggagtgatcagtggattatttgaacttctgtttgctgatcacgtatcatcttctcttaagttaaatgcttttaaagctttggacagtgtcattagtatgacagaaggaatggaagcttttttaagaggtaggcagaatgaaaaaagtggttatcaaaagcttctggaactcatacttttagatcagactgtgagggttgttactgctggttcagctattctccaaaaatgccatttctatgaagtcttgtcagagattaaaagacttggtgaccatttagcagagaagacttcatctcttcctaaccacagtgaacctgatcacgacacagatgctggacttgagagaacaaacccagaatatgaaaatgaggtggaagcttctatggatatggatcttttggaatcctcaaatataagtgaaggggaaatagaaaggcttattaacctcctagaagaagtttttcatttaatggaaactgcccctcatacaatgatccaacaacctgttaagtctttcccaacgatggcacgaattactggacctccagagagggatgatccataccctgttctctttagatatcttcacagtcatcacttcttggagttggttaccttgcttctgtcaattccagtaacaagtgctcaccctggtgtgctgcaagccacaaaagatgttttgaagtttcttgcacagtcacagaagggtcttcttttttttatgtcggaatatgaagcaacaaatttattgatccgagctctgtgtcacttttatgatcaagatgaggaggaaggtctccaatctgatggtgttattgatgatgcatttgccttgtggctacaggactcaacacagacattgcaatgtattacagaactgttcagccattttcagcgttgtacagccagtgaagaaacagaccattcagatctcttgggaaccctgcacaatctttatttgattacttttaatcctgtgggaagatcagctgttggccatgtttttagtctggagaaaaatctccaaagtcttattactctaatggagtactattccaaagaagccttgggtgattccaaatctaagaagtcagtagcttataattacgcatgcatacttattttggtggtggttcagtcttccagtgatgttcaaatgctagaacaacatgcagcatctctcttgaagctttgtaaagcagatgaaaataatgctaaattgcaagaacttggcaagtggcttgaacctctgaaaaaccttagatttgaaattaactgcatcccaaacttaattgagtatgttaagcagaatatcgataacttgatgaccccagaaggagttggccttaccactgccttacgtgttctctgtaatgttgcatgcccaccacctcctgttgaaggtcaacagaaagatctgaaatggaatcttgccgttattcagcttttttctgctgaaggaatggacacgtttattcgagttctgcaaaaattgaacagtattctgactcagccttggaggctccatgtcaacatggggactacccttcacagagttactactatttcaatggctcgctgcacactcactcttcttaaaactatgttaacggaactcctgagaggtggatcctttgagtttaaggacatgcgtgttccttcagcgcttgttactttacatatgctcctgtgctctatccccctctcaggtcgtttggatagtgatgaacagaaaattcagaatgatatcattgatattttactgacttttacacaaggagttaatgaaaaactcacaatctcagaagagactctggccaataatacttggtctttaatgttaaaagaagttctttcttcaatcttgaaggttcctgaaggatttttttctggactcatactcctttcagagctgctgcctcttccattgcccatgcaaacaactcaggtatcacttccatataacatgcatcttataaatgactgcagtaacactttttaaaaagccagtgattttgttaaaaaacaaaaaccctcatctcccttcctcccaaaaagacataaaataaccggatgagggggagataaaactgaaacaagttggtcattgaggaaatatgggggtaacattttaaataaatttttgttaaagtgagttttattttgctgttatgtatgtttgtacttacatttttctgttattttaaatcctttcccccacaccttaccatgtgttagaatttgccaataactagattgcttcaccaatggactctgctcaactaactgctaacctgagaacaataagattttttagactcattgaattcaagcaaatgtttaactgtataatagaaaattaaatgttttaagcatgcagtaaaaatgttcttttcataa

SEQ ID NO: 1783 - DNA, 5653 bp, Homo sapiens
gcccgcggcaaacatggcggtggactcggcgatggagctgttatttttagatacttttaaacacccgagcgctgagcaaagttctcatatagatgtggttcgttttccatgtgtggtttatatcaatgaagtccgagtcatacccccaggagtaagagcccatagcagtctgccagacaatagagcatatggagagacatctccccatacatttcaattagacttattcttcaacaatgtaagcaaaccaagtgcccctgttttcgataggttgggaagcctggaatatgatgagaatacttccatcatctttagacctaactcaaaggtgaatactgatggtctggtgctaagaggctggtataactgtctgacactggcaatatatggatcagtggatagagtgataagtcatgacagagactctccaccaccaccacctccaccgccaccacctccccagccacaaccaagtttgaaaaggaatccaaaacatgctgatggggagaaagaagatcagtttaatggaagccctccaagaccacagccaaggggaccaagaactcctccaggaccccctccacctgatgatgatgaagatgatcctgtgcctctgccagtgtctggtgacaaggaagaggatgctcctcatagagaagattactttgagcccatttctcctgatcggaattctgttccccaggaagggcaatattctgatgaaggagaagtagaagaggaacaacaagaagaaggagaagaagatgaagatgatgtggatgtagaggaagaagaggatgaggatgaggatgatcgacgaacagtagacagtattcctgaggaggaagaggaagatgaagaggaagaaggtgaagaggatgaagaaggtgaaggggatgatggttatgaacaaatttccagtgatgaagatggaattgctgacttggaacgtgaaacatttaagtatccaaactttgatgttgaatacactgctgaagacttagcttcagttcctcctatgacatatgatccatatgacagggagcttgtaccactcttatacttcagttgtccatacaagactacttttgaaattgaaatcagtagaatgaaggatcaaggtccagataaagaaaattcaggggcaatcgaagcctcagtgaagttaacagaactcttagatttgtatagagaagatagaggtgcaaaatgggtaacagctttagaagaaattccaagtttaataataaaagggttaagctatttgcaattgaaaaacacaaaacaagactcccttggccagttggtagactggaccatgcaagctttaaatttacaagtagcgcttcgccaacctatcgccttaaatgttcgacagctcaaagctgggaccaaattagtgtcctcactagcagaatgtggggctcaaggagttacaggactgctacaagcaggagtgatcagtggattatttgaacttctgtttgctgatcacgtatcatcttctcttaagttaaatgcttttaaagctttggacagtgtcattagtatgacagaaggaatggaagcttttttaagaggtaggcagaatgaaaaaagtggttatcaaaagcttctggaactcatacttttagatcagactgtgagggttgttactgctggttcagctattctccaaaaatgccatttctatgaagtcttgtcagagattaaaagacttggtgaccatttagcagagaagacttcatctcttcctaaccacagtgaacctgatcacgacacagatgctggacttgagagaacaaacccagaatatgaaaatgaggtggaagcttctatggatatggatcttttggaatcctcaaatataagtgaaggggaaatagaaaggcttattaacctcctagaagaagtttttcatttaatggaaactgcccctcatacaatgatccaacaacctgttaagtctttcccaacgatggcacgaattactggacctccagagagggatgatccataccctgttctctttagatatcttcacagtcatcacttcttggagttggttaccttgcttctgtcaattccagtaacaagtgctcaccctggtgtgctgcaagccacaaaagatgttttgaagtttcttgcacagtcacagaagggtcttcttttttttatgtcggaatatgaagcaacaaatttattgatccgagctctgtgtcacttttatgatcaagatgaggaggaaggtctccaatctgatggtgttattgatgatgcatttgccttgtggctacaggactcaacacagacattgcaatgtattacagaactgttcagccattttcagcgttgtacagccagtgaagaaacagaccattcagatctcttgggaaccctgcacaatctttatttgattacttttaatcctgtgggaagatcagctgttggccatgtttttagtctggagaaaaatctccaaagtcttattactctaatggagtactattccaaagaagccttgggtgattccaaatctaagaagtcagtagcttataattacgcatgcatacttattttggtggtggttcagtcttccagtgatgttcaaatgctagaacaacatgcagcatctctcttgaagctttgtaaagcagatgaaaataatgctaaattgcaagaacttggcaagtggcttgaacctctgaaaaaccttagatttgaaattaactgcatcccaaacttaattgagtatgttaagcagaatatcgataacttgatgaccccagaaggagttggccttaccactgccttacgtgttctctgtaatgttgcatgcccaccacctcctgttgaaggtcaacagaaagatctgaaatggaatcttgccgttattcagcttttttctgctgaaggaatggacacgtttattcgagttctgcaaaaattgaacagtattctgactcagccttggaggctccatgtcaacatggggactacccttcacagagttactactatttcaatggctcgctgcacactcactcttcttaaaactatgttaacggaactcctgagaggtggatcctttgagtttaaggacatgcgtgttccttcagcgcttgttactttacatatgctcctgtgctctatccccctctcaggtcgtttggatagtgatgaacagaaaattcagaatgatatcattgatattttactgacttttacacaaggagttaatgaaaaactcacaatctcagaagagactctggccaataatacttggtctttaatgttaaaagaagttctttcttcaatcttgaaggttcctgaaggatttttttctggactcatactcctttcagagctgctgcctcttccattgcccatgcaaacaactcaggttattgagccacatgatatatcagtggcactcaacacccgaaaattgtggagcatgcaccttcatgttcaagcaaagttgctccaagaaatagttcgctctttctctggcacaacctgccagcccattcaacatatgttacggcgtatttgtgttcaattgtgtgaccttgcctcaccaactgcacttctgattatgagaactgtgttggatttgattgtagaagacttgcaaagcacttcagaagataaagaaaaacagtatactagccaaaccaccaggttgcttgctcttcttgatgctctggcttcacacaaagcttgtaaattagctattttgcatctaattaatggaactattaaaggtgatgaaagatatgcagagatattccaggatcttttagctttggtgcggtctcctggagacagtgttattcgccaacagtgtgttgaatatgtcacatccattttgcagtctctctgtgatcaggacattgcacttatcttaccaagctcttctgaaggttctatttctgaactggagcagctctccaattctctaccaaataaagaattgatgacctcaatctgtgactgtctgttggctacgctagctaactctgagagcagttacaactgtttactgacatgtgtcagaacaatgatgtttcttgcagagcatgattatggattatttcatttaaaaagggatgctgtggagatgataatggtctcatggaagtagagggagctcatacatcacggacgatgagtattaatgctgcagagttaaaacagcttctacaaagcaaagaagaaagtccagaaaatttgttccttgaactagagaagcttgttttggaacattcaaaagatgatgacaatctggattctttgttggacagtgtagttggacttaagcagatgctggagtcatcaggtgaccctttacctctcagtgaccaggatgtagaaccagtactttcagctccagaatctcttcagaatctgtttaacaataggactgcctatgtgcttgctgatgtcatggatgatcagttgaaatctatgtggttcactccatttcaggctgaagagatagatacagatctggatttggtaaaggttgacttaattgaactctctgaaaaatgctgtagtgactttgatttgcactcagaattagagcgctcatttttgtcagaaccatcatctccaggaagaaccaagactactaaaggattcaaacttgggaagcacaagcatgagacctttataacgtcaagtggaaaatctgaatacattgaacctgccaaaagagctcatgttgtgccaccaccaagaggaaggggcaggggaggatttggacagggtatacgacctcatgatatttttcgtcagagaaaacagaacacaagtagaccaccatctatgcatgtggatgactttgttgctgctgaaagtaaagaagtggttcctcaagatggaatacctccaccaaaacggccactcaaagtatcacagaagatttcttcccgtggtgggttttcaggcaatagaggaggacggggtgctttccacagtcagaataggtttttcacaccacctgcttcaaaaggaaactacagtcgtcgggaaggaacaagaggctccagttggagtgctcagaatactcctcgaggaaattacaatgaaagtcgtggaggccagagcaattttaacagaggccctcttccaccattacgaccccttagttctacaggttaccgcccaagtcctcgggaccgtgcttctagaggtcgtgggggacttggaccttcctgggctagtgcaaatagcggcagtggaggctcaagaggaaagtttgttagtggaggcagtggtagaggtcgtcatgtacgctcctttacacgataaaaatccttttgggaacatcttaactgtatatgaacatttcacgaggacaataaaaataagacattgaaggaccaatttagacttagcagttatctggagacatctgagagaatatttttatctgaagaaagcagaatttgtttgatacctaacaagatttcaataaaaatccaaactttgtatgtacgtttgtatatattttcccttttttgtatgactatttatttagaaaatttctaggtgaaaaactaaatgatgttttgtatttttcttgcctatagcacagatattctcaaactttctcagctcatgacactatttagtgcctcagtac

SEQ ID NO: 1784 - DNA, 1020 bp, Homo sapiens
ccctggtccatcgctgccgcctccttcttctgcagctcctggtgctgcttgtgtgctcgtttggtgcggacctggtacctcttttgtgaaacggcagctgaggagattccggcgcttgccatggccgacgaaaaacccaaggaaggagtcaagactgagaacaacgatcatattaatttgaaggtggcggggcaggatggttctgtggtgcagtttaagattaagaggcatacaccacttagtaaactaatgaaagcctattgtgaacgacagggattgtcagtgaggcagatcagattccgattcgacgggcaaccaatcaatgaaacagacacacctgcacagttggaaatggaggatgaagatacaattgatgtgttccaacagcagacgggaggtgtctactgaaaagggaacctgcttctttactccagaactctgttctttaaagaccaagattacattctcaattagaaaactgcaatttggttccaccacatcctgactactaccgtatagttttctctattctttcatttcccccttccctattcctttattgtacataaagtaactggtatatgtacacaagcatattgcattttttttaactaaacagccaatgatatgttttgattgacatcaagtggagatgggatggggaaaaatactgattctgtgaaaataccccctttctccattagtggcatgctcattcagctcttatctttatattccagtaagttattttgctctcactgttttaacaaaaacaacaacaacaacaacataaaaatccttgcatacctttttcaattggagaattttaatgattttcatttatcattgtaaaaccaaggacaattttataactttttcgtacatagctgctacatgtagggcaatctgtctttaagtagggataaattactctaaaacaaaaaagaatcctagatacttttcccttcaagtcaagcgtcttgtttaaataaactgcttgtttaaaatgaaaaaaaaaaa

SEQ ID NO: 1785 - DNA, 8461 bp, Homo sapiens
gttcctattactgtaaccatgccagaaatgacagagaatgagacgcctacaaaaaagcagcacagaaagaaaaaccgggagacacacaatgcagtggagaggcatagaaagaagaaaattaatgctgggataaacagaataggagagctgatcccatgttctcctgccctgaagcagagcaagaatatgatcctggaccaagcctttaaatatataacagaattgaaaaggcaaaatgatgaactcctgcttaatggaggaaacaatgaacaagctgaagaaataaaaaagctacggaaacaactggaagaaatccaaaaagaaaatggccgatatattgaattactgaaagctaatgacatatgcttatatgatgacccgacaattcactggaaaggaaatcttaaaaactcaaaggtctctgttgttattcctagtgaccaggttcaaaaaaaaattattgtttattccaacgggaatcagcctggtggaaacagccagggaacagctgttcaggggataacttttaatgttagtcataatttacaaaagcagaccgccaatgtggtgccagtacagaggacttgcaatcttgtgactcctgtatctatttctggagtttacccttctgaaaacaagccatggcatcagaccacagttcctgcattggctaccaaccagcctgttcctctttgtcttcctgctgccatttctgctcagagtattctcgagcttcccacctctgaaagcgaatcaaatgtgcttggtgccactagtggctcactgattgctgtttcaattgaatctgagcctcaccaacatcattctttgcacacatgcctaaatgatcaaaattcttctgaaaataagaatggacaagagaaccccaaagtattgaagaaaatgaccccttgtgttacaaacatcccccacagctcctcagcaactgccactaaagtgcaccatggaaacaagtcctgcctgagcatacaggacttcagaggtgattttcaaaacacttttgttgtttcagttaccaccacagtctgctcgcagcctcccagaactgcaggtgattcttctccaatgagcattagtaagagtgcagacttgacaagtacagctacagtggtggcatcatctgcccctggagtagggaaggccaccattcctataagcactctttcgggaaaccctttggacaatggttggactctttcttgttctttgccttcttcaagtgttagtacttcagatttgaaaaacattaatagccttacacgaatctcttcagctggaaacacacagacaacgtggactactttgcaactggcaggaaacactattcagcccttaagccagacaccatcttctgctgtgactccagtattaaatgagtctggtactagccccaccacaagcaaccacagtagatatgtggctacagacatcaacttgaataattcctttccagcagatgggcagccagttgagcaagtagttgtaacattgccttcttgtccatctttacctatgcagccactaattgcccagccacaagttaaatctcagcctcccaaaaatatccttccactgaattcagcaatgcaagtgattcagatggctcagccagttgggtcagctgttaattcagctccaactaatcaaaatgttataattcttcagccacctagcaccaccccatgcccaacagtgatgagggcagaagtttccaaccaaacagtaggtcaacagatagtaatcatacaggctgctaatcagaatcctttgccactcctccctgctccacctcctggttctgttcgactccccatcaatggagccaatactgtaatagggtctaataattcagtgcaaaatgttccaacaccacagacttttggaggaaagcatcttgtccacatattaccaagaccttcatctttatcagcgtctaactcaacacaaactttttctgttaccatgtcaaaccaacagcctcaaaccatttctttaaatggacagctctttgctttgcagcctgtgatgtcttcatcaggaactacaaatcaaacccctatgcaaattattcaacccaccaccagcgaagatccaaataccaatgttgccctgaatacatttggtgctttggccagcctcaatcaaagcatatcacagatggctgggcaaagctgtgtacaattgtctattagccagcctgccaattctcaaactgctgcaaatagtcaaaccactacagctaactgtgtttcattaacaacaactgcagcacctcctgtgacaacagatagttcagccacactagctagtacttataatctagtgagtacttcctcaatgaacactgttgcttgtttgcctaacatgaaatctaaaaggttgaataagaagccaggtggcaggaaacacttagcagcaaacaagtcagcgtgtcccctgaattcagtcagagatgtgagcaagttagactgccccaacactgaaggctcagcagagccaccctgtaatgatggactgctagaaagcttccctgctgtgttaccatctgtctctgtgtctcaggcaaatagtgtgagtgtttctgcttcacattctttgggtgttctaagctctgaatcattaatacctgagtctgtatcgaaatctaagtcagcagaaaagtccagcccaccctcccaagaatctgtaacaagtgaacattttgcaatggccgcagcaaaatccaaagattctacccctaatctacaacaagagacatctcaggataaaccaccaagtagtttagcattatcagatgctgccaaaccctgcgcttcagccaatgtattgattccatctccaagtgatcctcacattttggtttctcaggttcctggtttgtcatctacaacaagcactacaagtactgactgtgtttctgaggtagaaatcattgctgaaccttgcagagttgagcaagattcatcagatacaatgcaaaccacaggtctcttaaaggggcaaggtttaactacattgctatctgatcttgctaaaaaaaaaaaccctcagaaatcatctctttctgatcagatggatcatcctgacttttcttcagaaaatcctaaaatagttgattcaagtgtgaatttacatcccaaacaggaactattactgatgaacaatgatgatagagatcctccacagcatcattcctgcctccctgatcaagaggttattaatggttctttgatcaacggtagacaggccgactctcccatgtcaaccagctctggcagtagtcgtagtttctcagttgcatccatgcttcctgaaacaacaagagaagatgtgaccagcaatgcaacaactaatacatgtgacagctgtacctttgtagagcaaactgatatagtagctcttgcagcaagagctatttttgaccaggagaaccttgagaaggggagagttggcctccaggctgatataagggaagttgcttcaaagccttctgaagcatcattgttagagggagacccacccttcaaatcacagatacctaaagagagtggcacaggacaggcagaagcaacaccaaatgaatttaattctcagggttcaattgaagcaactatggagaggccccttgagaaaccaagttgttctctaggaattaaaacatcaaatgcatctttacaggattcaacttctcagccaccaagcatcaccagtttaagtgtgaataatcttatccatcagagcagcatcagccatcctctggccagctgtgcgggtttatccccaacttcagagcaaacaactgtgcctgcaacggttaatctgaccgtttcatctagctcctatggcagtcaacctcctggaccatctctgatgactgaatattcccaagaacagctaaatactatgactagtaccataccaaattcacagattcaagagccactcttaaagccaagccatgaaagccgtaaggattctgctaagcgtgctgtccaagatgaccttttactgtcttcagctaaacgtcaaaagcactgtcagccagcccccctcaggcttgaaagtatgtccctgatgagcagaactccagacaccatttctgaccaaactcaaatgatggtcagtcagatccctcctaattcttcaaactcagttgtgcctgttagcaacccagctcatggagatggccttacacgattatttccacctagtaacaactttgtgactcctgcattgaggcaaactgaagttcagtgtggttctcagccttcagttgctgaacagcagcaaacccaggcaagtcagcatctacaggccctgcagcagcatgttccagctcaaggtgtatctcaccttcatagtaaccatctctacataaagcagcagcagcagcagcagcagcagcagcagcagcaacagcaacaacaacaagcagggcagttaagagagaggcatcacttatatcaaatgcagcatcatgtacctcatgcagagagctctgtccactctcagccccataatgtccaccaacagaggactctgcaacaggaagttcagatgcagaaaaagaggaatcttgttcagggcacccagacctctcagctttccttacaaccaaagcaccatggaactgaccaatcccgatccaagactggccagccacatccccaccatcagcagatgcagcaacaaatgcagcaacactttggaagctcccagacagagaagagctgtgaaaacccttcaactagtcggaaccatcataaccatccccagaaccatctcaatcaagatattatgcaccaacagcaggatgttggaagcagacagcaaggttcaggggtttcatctgaacatgtatctggccataatccaatgcagaggcttttgacatcaagaggcttagagcagcaaatggtgtcccaaccaagtattgtgactagatcttcagacatgacctgtactccacacaggccagagagaaatagagtttcaagttattctgctgaggcactcattggaaagacatcttctaattcagagcagagaatggggatatcaattcagggttccagagtttcagatcagcttgaaatgagaagctatcttgatgttcccagaaataagagtttggctattcataatatgcagggtcgtgtggaccatactgtggcctcagatatccgcctttctgattgtcagacgtttaaaccaagtggagctagtcaacagccccagagtaattttgaagtacaatcttcaagaaacaatgaaataggtaaccctgtatcatcattgcggagtatgcagtcccaggcttttcgaattagtcaaaacactggccccccaccaattgaccgtcaaaagagattatcttacccaccagttcagagcatcccaacaggaaatggtattccatcaagggacagtgaaaatacttgtcaccaaagtttcatgcagagcttacttgcccctcacctcagtgatcaggtcattgggagccagaggtcactctcagaacatcagaggaatacacagtgtggtccatcctctgcaattgaatataattgtcccccaactcatgaaaatgtccatattagaagagagagtgagagtcagaatagggaaagttgtgacatgtcgttaggtgcaattaacaccaggaacagcaccttgaatattcctttttcaagttcctcttcctcaggagatattcaaggtcgaaacacaagccccaatgtttctgtacagaaatccaatcccatgaggattactgagagtcatgccaccaagggccacatgaaccctccagtcacaaccaacatgcatggggttgcaaggccagcgttgccacatccatctgtgtctcatggaaatggcgatcaaggccctgctgtacgtcaagctaattcttcagttccccagagatcaaggcatcccctgcaagacagcagtggttccaaaattcgtcagcctgaaaggaatcgttctggaaaccaaaggcaaagtactgtctttgatccaagtcttccccatcttcctctctctactggtggcagtatgattcttggacgtcaacaacctgccacagagaagagaggaagtattgttcgtttcatgcctgatagcccacaagtacctaatgataattcaggtcctgaccagcatacactatcacaaaattttggtttttcttttattcctgagggtggcatgaatccaccaataaatgctaatgcttctttcattccacaggttactcagcctagtgccactcgaactccagccctcatcccggtagatccgcaaaatactctgccctccttctatcctccatactctcctgctcatcctacactgtccaatgatatttcaatcccctattttcctaatcagatgttctcaaatcctagcacagagaaggtaaacagtggaagtttaaataaccgatttggatcaattttatctcctcccagacctgttgggtttgctcaaccaagttttcctcttctcccagatatgccaccaatgcacatgaccaactctcacttatccaattttaatatgacatctttgtttccagaaatagccacagtgcttcctgatggctcagcaatgtcacctttgcttacaatagcaaattcctctgcctctgactcttccaagcagtcctcaaacagacctgcccataacataagccatattctaggtcatgattgcagttcagctgtttaaatactgataaacaaaatgtaaaggtaatgagtgagattacaaatgtatttgtgcgtgcatgtgcacagacatgtacatgaagagaaggattgtgtgtgtgtgtctgtataatcagttttcagttatcttctgaatgtagggaagccatgtcagatgcagatactgggttgtcagaaaacaagttatctttcgttttcaactgcatggtgtacttttttattttccaagtagatttacatttccaagttgatatttcctaaatactaattagctggaaattgggggagatcatcttgtcatgtactgggtagtaggagggagcctagactttaaacttgattgttgataacttatggaatatgtaggtaagttgctactgaaaaatataggcagcttgataaaacacagtggctcataatcaagtgctggctaatgtcagcatctagaacagcttcttacctatgacagatgttgaactgatgttgagtttaatgtccgtagttaaagtcaagcagttagcaaataaataaaagcaatcagcctttattctcaaagtttggtttagatacaggcttctttctaaattataacaatgcataaattatctgaattttatgtcttgttcttcaaattagggagctgtgttaccctttaatgtgccaagattatttaaagcaaaggtcttccttagacaattatttagccgtaaatatagaaagctaaaaagttaagtacatacatattctccgttttgtgcttgcattttgcatcgggtcataagggtaaaagcagttagttgtattgtggagttttgcatgggtgcagttaacaatggatgtttcatcagctgagtttaatttagtattctctcttcattctatttatttggtcttgaaataaattcttttgcattcatttaaatattaggattgatcaggaaatagtgtttgtaatctacacgtttatttgagccttactttaaaaatatttctgaacagagatttaagctctgtcagtattttcatttactgatagcatttatattttaaatatggcattgtatatttcattattatccttcataacagaattataatgagaatatgaatttgttatttttcttgttggtagatgtgaaatggtgcttcaaaaaatatatagtctttctgtatgtctctgtgtgtgtaagtatgtgtgtgtgtgtgtacacatattttaaagtatgaattggtcctttaaaaacaggcctgccatctgaaaatgggaaattgagacctgagacctgctaaagcatagaagaacttgatataggtagggttttttttttttttttttttttaatagatggagtctggctctgttgcccaggctggagtgcagtggcgtgatctcagctcactgcaagctccacctcccgggttcaagtgattctcctgcctcagcctcctgtgtagctgggactacaggcacgtgccaccacacctggctaatttttggtacttttagtagagacggggtttcaccgtgttagccaggatggtcttgatctcctgacctcgtgatccacctgcctcggcctcccaaagtgccaggattacaggcatgagccaccgtgcttggcctaggtacaggtttttaaaagccccacagaagtttataatacgtttaaaaacccatattaaaatttgaaaacttaaaaaaaaaa

SEQ ID NO: 1786 - DNA, 780 bp, Homo sapiens
atcttttttcctaccccccttggggcgaccgtggggaggtgccgccggggtcgcaggtgagcggttctatgctggaggaggcggccagggaagcggcggctccgtgaccagtgggtgccctcgcagtgggtagggtcccggaggggtcagcggcaattggcgcaacgcttgctgccgggtttggtccaagggctgcgacgtagcgggactgcacgctcgggagaagtgccacgcgcgtctgtcgcctgaccggggaggctggggagggcccaggccacggaaacaagactgcagaagtttctgggcactcagtcgggactctcatttaatacccagagagaggagatcttccaggttgccccgactcccaccgggactcctaccagcagcaacctcatcattgtggccgaggcaggaattatccagactgccttgccactagatgaatggaagacaatgatttgaactaagggccagcaaagaattatccctggtttttgtgctttgcagcattcctcaaattgttttcacatctcttaccataaaaactgcattgaaattgaaaatgaagcagttgaaaagaaaaaggaaaagcaattttagtgttcaagaaactcagacccttttgaaagaaattacgaaaaggaaagaagtcattttttccaagcagctcaatacaacaattaatgtgatgaagcgaatggcttgggaagagattgcacagtgtgtgaatgctgtaggagaaggagaacagaggacagggacagaggtgaaaagaag

SEQ ID NO: 1787 - DNA, 948 bp, Homo sapiens
attgtgaggccaggcctagggcgggctctcagccagaatggctacaccattctaaccaatggatgagactcatcaaatgagcggcagccatatgagccattggggtggcgggagatgggcgggcccagttagtgggcgggggatcaatgaagcatcttttttcctaccccccttggggcgaccgtggggaggtgccgccggggtcgcaggaattatccagactgccttgccactagatgaatggaagacaatgatttgaactaagggccagcaaagaattatccctggtttttgtgctttgcagcattcctcaaattgttttcacatctcttaccataaaaactgcattgaaattgaaaatgaagcagttgaaaagaaaaaggaaaagcaattttagtgttcaagaaactcagacccttttgaaagaaattacgaaaaggaaagaagtcattttttccaagcagctcaatacaacaattaatgtgatgaagcgaatggcttgggaagagattgcacagtgtgtgaatgctgtaggagaaggagaacagaggacagggacagaggtgaaaagaaggtaccttgactggcgagcacttatgaagagaaagaggatgaaggccaacattaagctggttggttcaggatttccccttccctcctctgatttggatgactctctcactgaagagatagatgaaaagattggattccgaaatgatgcaaattttgactggcaaaatgtggcagatttcagggatgcaggtggatccttaactgaggtcaaggtggaagaggaagaaagggatccgcagagtcctgaatttgaaattgaggaggaggaagaaatgttgtcatccgtcataccagattccaggagagaaaatgaacttcccgatttcccccacattgatgagttttttacccttaactcaacaccatctagatctg

SEQ ID NO: 1788 - DNA, 612 bp, Homo sapiens
atcttttttcctaccccccttggggcgaccgtggggaggtgccgccggggtcgcaggtgagcggttctatgctggaggaggcggccagggaagcggcggctccgtgaccagtgggtgccctcgcagtgggaattatccagactgccttgccactagatgaatggaagacaatgatttgaactaagggccagcaaagaattatccctggtttttgtgctttgcagcattcctcaaattgttttcacatctcttaccataaaaactgcattgaaattgaaaatgaagcagttgaaaagaaaaaggaaaagcaattttagtgttcaagaaactcagacccttttgaaagaaattacgaaaaggaaagaagtcattttttccaagcagctcaatacaacaattaatgtgatgaagcgaatggcttgggaagagattgcacagtgtgtgaatgctgtaggagaaggagaacagaggacagggacagaggtgaaaagaaggtaccttgactggcgagcacttatgaagagaaagaggatgaaggccaacattaagctggttggttcaggatttccccttccctcctctgatttggatgactctctcactgaagagata

SEQ ID NO: 1789 - DNA, 1736 bp, Homo sapiens
cccgccatctctcagcacctcctcggcagcccctcggctccttctcggtcacgcgcctgccccaacctctggctggcttcggagcctgcaggcactgaagggagtgcagggtgtggatcgctgccccagcccgggccgccgcctccgagcagtcggcacccggaggcaggaggcacaatgcaggcgtgcgggggcggcgcggccggccgtcgggccttcgacagcatctgccccaacagaatgctggcactgccgggccgggcgctgctctgcaagccggggaagccggagaggaagttcgctcctccgcggaagttcttccccggatgcacaggcgggagcccggtgtcggtgtacgaggatcccccggacgccgagcccacagcgctgccagccctcaccaccatagacctgcaggacctcgctgactgctcttcgctactcgggtccgacgcgccgcctggtggtgacctggccgcctcgcagaaccattcccaccaaacggaagcagacttcaatctgcaagatttcagagacacggtggatgatctcatttcagactcatcctctatgatgtcgcctaccctggccagcggagacttccccttctctccttgcgacatatcaccattcgggccctgcctctccccgccactggacccacgggccctgcagtcaccaccgctgcgccctccagacgtgcccccgcctgagcaatactggaaggaggtggcggaccagaaccagagagcgttgggagacgcgcttgttgagaataatcaactgcacgtgacattgacccagaaacaggaggagatcgcctcgctcaaggagcggaacgtgcagctgaaggaactcgccagccgaacccggcacctggcctcggtgctggataagctgatgatcacacagtcccgggattgtggggcggcggccgagcccttcctgctcaaggcgaaggccaaaaggagcctggaggagttggtcagcgctgcggggcaggattgcgcggaagtggacgccatcctgagggagatttccgagcgctgcgatgaagcccttcagagccgcgatcccaagcggccccgactgctgccagagcccgcgaatactgacaccaggcccgggaacctgcatggcgccttccgggggctgcgcacagactgcagccggagcgcgttgaacctgagccacagtgagctggaggagggcggctccttcagcacccgcatccgcagccacagcaccatccgcaccctcgccttcccccagggcaatgccttcaccatcagaacagccaacgggggttacaagttccgctgggtccccagttgagctgtgatgtggtcccccaaaacactgccctgtgtttccactgaagtgcctgggggcttcccagaactttgccttcaggttgaatgccaccctgaaacactttttcaggaacaaaagcatcttgataccgatgcattgtaaatttctgctacaaaacattgtatagcccctccccttgtcacagtgaaactctgtttatatatgtatatgtcacatatgtcacagccaattttaaaagtatttatttttagcagctttgaattatgtatttttagagcagggaaggatttagaaaccatagttacttttataattatgtaatgctctaatattataagaaggaaaagaaggctctaagagattaagtaatttcctgcaatgggaaacactggaacctttca

SEQ ID NO: 1790 - DNA, 5909 bp, Homo sapiens
atggcggatttcgaagagttgaggaatatggtttctagttttagggtttctgaactacaagtattactaggctttgctggacggaataaaagtggacgcaagcatgacctcctgatgagggcgctgcatttattgaagagcggctgcagccctgcggttcagattaaaatccgagaattgtatagacgccgatatccacgaactcttgaaggactttctgatttatccacaatcaaatcatcggttttcagtttggatggtggctcatcacctgtagaacctgacttggccgtggctggaatccactcgttgccttccacttcagttacacctcactcaccatcctctcctgttggttctgtgctgcttcaagatactaagcccacatttgagatgcagcagccatctcccccaattcctcctgtccatcctgatgtgcagttaaaaaatctgcccttttatgatgtccttgatgttctcatcaagcccacgagtttagttcaaagcagtattcagcgatttcaagagaagttttttatttttgctttgacacctcaacaagttagagagatatgcatatccagggattttttgccaggtggtaggagagattatacagtccaagttcagttgagactttgcctggcagagacaagttgccctcaagaagataactatccaaatagtctatgtataaaagtaaatgggaagctatttcctttgcctggctatgcaccaccgcctaaaaatgggattgaacagaagcgccctggacgccccttgaatattacatctttagttaggttatcttcagctgtgccaaaccaaatttccatttcttgggcatcagaaattgggaagaattactctatgtctgtatatcttgtacggcagcttacatcagccatgttattacagagattaaaaatgaaaggtattagaaaccctgatcattccagagcactaattaaagaaaaacttactgcagatcctgatagtgaaattgctacaactagccttcgggtatccttgatgtgccctttaggaaaaatgaggctgacaatcccatgccgtgcagtgacttgtacacatctgcagtgttttgatgctgccctctatctacaaatgaatgagaaaaagcccacctggatttgtcctgtgtgtgacaaaaaagctgcctatgaaagtctaatattagatgggctttttatggaaattctcaatgactgttctgatgtagatgagatcaaattccaagaagatggttcttggtgtccaatgagaccgaagaaagaagctatgaaagtatccagccaaccgtgtacaaaaatagaaagttcaagcgtcctcagtaagccttgttcagtgactgtagccagtgaggcaagcaagaagaaagtagatgttattgatcttacaatagaaagctcttctgacgaagaggaagaccctcctgccaaaaggaaatgcatctttatgtcagaaacacaaagcagcccaaccaaaggggttctcatgtatcagccatcttctgtaagggtgcccagtgtgacttcggttgatcctgctgctattccgccttcattaacagactactcagtaccattccaccatacgccaatatcaagcatgtcatcagatttgccaggtttggattttctttcccttattccagttgatccccagtactgtcctcctatgtttttggatagtctcacctcacccttaacagcaagcagtacgtctgtcaccaccaccagctcccatgaaagcagtactcatgttagttcatccagcagcaggagtgagacaggggtcataaccagcagtggaagtaacattcctgacatcatctcattggactaaaggaggactcacttgattctgggaatcattcatcagaactgctttttcttggatctctagtctgtggaaacgttcttttttttttttttttaataatttggtatttattgaaagtcagatggattcttttgctttctgaggggtgaacacagaagactgcaacaagaaccaaatgacatgcaaggatttttcttaattatgctgtactctcagcatcagatacattcaaccataactgtatcttcctgagagatggatttcactttcatacgttaatggatggagtctacaaatcagtgaaaaaagtttttgttaaaataaagagcaataaaattatgtaaatattcaagtaaccttttttctaattaaaaaaaaaattgtaatcactgattctagaatgacagcaacttctgtttaaccttacgtgaaggaaaaaaaatatatggaaagaacttaatgtttgctgaatgagtcctttccatggagatttgctctgtttcattgaagtaatgaagtttcagtacgtggccaaagcttggattccacttttcgtcctgcatttccacttttcttcgtgattgcatcaaagaaaaatggcattcgtgttacttggtttttttcctgcttatcatttacactttgacgttgtttgctaatgagtgctgtgtgaagttctgggatttggctactcttcattggtgattatgtttaaaagcactatgcagattctgccctgacataaagtgtgttattatgtttttagtaattgtacatttttcattctagagttttctataaatttgaggcttgccttctcaaaaaagaaactatgcagccattgaatgaaatgtctttggggtacggtgtgactggaatgtttgttagaaatttgttcacactatcaaatattgatatcttggagccagcagaagagcagattttgggaggtggtaataacaaaatttaatttcttcccaacaacttaattttctcatttattttacagaatagtagtgaaatatttgatgaaactttgtattttggtagcactacatagaaaatgtgttttagatttatgatgatcatatttctcaccaatgtaatttcagtctcagcagtgattttcaaacttagggaaagggacagcattagattttttttttttttcatttttttaaaatgatatcttacctgaaactacaaacgacaaaagagaattagaaatgtttgaattaaagtgaagaagggttgggggagatgggcctgaacccacttcctgtctcaatccatgctaccccaaacactccagggaacctctgaggttttattgggtgcactttgaaaatttctcttctatagtgtgtttgtttgattttaaatcacagagaaaactgggttttactcttagagaaacattttcatccagttttttagtttgcttcatttgacttcctaaatcatttttgagttcacaaggatttggtacttttctgtttagctttctctctctaagctttatctaccttaaaaacaaagtcctttttttaatggccagtccaaccaattgatttctcaaactgaagtgcccaggtgtggactcatcaatttccgttagaatagggacatcctacttaagagttggtgcagctccaaggagctgacttgtccttgcttggggttttttttttttttctttcaccttctcaagtttccatggcctttgtgtgttctttttatgttgatttaaattcatatggttttccacaaatcccttctttggctacattgtctccttattcaatggattatccctttgtgggggctgcttattttaaagatgttgggggggaaacaaacccaaatctacgagcagtagttgcacatagttgccagttttaccttcttagtcattagatttccaaaccatgttgcagttttttggtccagatatagtatttctttctaataaagttttatgttgctgctctaaatacagatgcaatatttattgactctgtaatcagatagaaaaaacttaacttggtttgtgtggtatgacttataaagaaatgatgtatatttgttattttgttaccctttagattgtcagagactcccccaatttaatcaacaaagttttataaagtaaatgaaaatattaatagaaattagtttatttacttggttcttataactgatatctctgtgcttttataattgtgatttgtttttttgtttttttttctattttctgtgaacagttttaatgttcggttttggtgttttacactgaaattacatataaatttttaatttatttcatacaggcaacttgcattttaaaaaatacactttgaagtttatcatcttgaaattggggcttacgttgtttatctgtcttgagcattagtactttatgactttggccttatggcaacatcatgattattaatccgtcagcctttaatgtggtcactgtttcttatccagaccctgactttctagtagtttattttgctagcccagatttctgcttaaccaaatataagggagtttcagaggggtgatcttagctgtcacctagattctgtcagccaaccagtgattgtctggaatatcttaggaaatgaactgtaattgtcagcctcctaaaatcaatttttttttttttttttttgaggctgagtcttgctcttgttgcccgggatggagtgcaatggtgcgatcttggctcaccgcaacctccacctacagggttcaagcgattctcctgcctcagcctcccgagtagctgggattacaggcatgtatcaccacgcccagctaattttgtatttttagtagatacggggtttctccattttggtcaggctggtctcgaactcccgacctcaggtgatccgcctgccttggcctcccaaagtgctgggatttacaggcgtgagccaccgcgcctggccaaaataaaatgtttttatctttcttcacttagaactatgaaggccttttcttgttctggtaaccccccacagtgtaattggtgctgaaaatagtttcgtgcctgaggtctgttgtcactcactcactttctgacaattaggtgagccacttgaggattttctggcctgaagttataaaaacttggcatctgtcctaaggtaattgtaaaggcaaaatgaaagcattgaggtgaatttaggttatatggcatttatctggtaatgtgtttcagaaaagctagaatgaaaatgtgatgtaagggatagcaagtgtaggttgattcataattcttggtataaaaccaagttttccttagtcttgaggaatttgaagaaaggtaaaatgttggattttaagcaaagtaggattgaccagagactgttctgactttgacattcagacctttcagatgttcttccttcagaccagtccaagacactcagcatttccagccaagttgtcttttttttctgccaataaagtattcattagttgacgtttgtttgtattttaagtaaagtcaattttttttaaagcattaatttaattcacgggtatgcctttcatttctctggccttcagttggtttaaaaaaaaaaaaaaaaaaaaaagcacttagccggaccattctttctttagtaaacatttttattttcttaatttttcctgaaagattttcttcattttcatggaatgtcataatgacactaccattattttctagctctttgcataatagaaaaatgtagagcagtgcaccatttaaacacgtctgacattggatttagtggtcctaggttcatgtgatttgggagccttaagttgttatttagattgattcagcctgattcaccatcttttttactacagttctacatgaatgtggtgaaacaggtagaagaaaattaagcatttctctgcttttggagtctaatgttcctgcctagtgactggtttgtaacacccccctcacccctactttgttaggaacctgcaattcctaaaagaaataaataaagctgtacccaatgtccattctttaa

SEQ ID NO: 1791 - DNA, 2202 bp, Homo sapiens
atggctaattttgaagaaattataaatatggtttctagttttagggtttctgaactacaagtattactaggctttgctggacggaataaaagtggacgcaagcatgacctcctgatgagggcgctgcatttattgaagagcggctgcagccctgcggttcagattaaaatccgagaattgtatagacgccgatatccacgaactcttgaaggactttctgatttatccacaatcaaatcatcggttttcagtttggatggtggctcatcacctgtagaacctgacttggccgtggctggaatccactcgttgccttccacttcagttacacctcactcaccatcctctcctgttggttctgtgctgcttcaagatactaagcccacatttgagatgcagcagccatctcccccaattcctcctgtccatcctgatgtgcagttaaaaaatctgcccttttatgatgtccttgatgttctcatcaagcccacgagtttagttcaaagcagtattcagcgatttcaagagaagttttttatttttgctttgacacctcaacaagttagagagatatgcatatccagggattttttgccaggtggtaggagagattatacagtccaagttcagttgagactttgcctggcagagacaagttgccctcaagaagataactatccaaatagtctatgtataaaagtaaatgggaagctatttcctttgcctggctatgcaccaccgcctaaaaatgggattgaacagaagcgccctggacgccccttgaatattacatctttagttaggttatcttcagctgtgccaaaccaaatttccatttcttgggcatcagaaattgggaagaattactctatgtctgtatatcttgtacggcagcttacatcagccatgttattacagagattaaaaatgaaaggtattagaaaccctgatcattccagagcactaattaaagaaaaacttactgcagatcctgatagtgaaattgctacaactagccttcgggtatccttgatgtgccctttaggaaaaatgaggctgacaatcccatgccgtgcagtgacttgtacacatctgcagtgttttgatgctgccctctatctacaaatgaatgagaaaaagcccacctggatttgtcctgtgtgtgacaaaaaagctgcctatgaaagtctaatattagatgggctttttatggaaattctcaatgactgttctgatgtagatgagatcaaattccaagaagatggttcttggtgtccaatgagaccgaagaaagaagctatgaaagtatccagccaaccgtgtacaaaaatagaaagttcaagcgtcctcagtaagccttgttcagtgactgtagccagtgaggcaagcaagaagaaagtagatgttattgatcttacaatagaaagctcttctgacgaagaggaagaccctcctgccaaaaggaaatgcatctttatgtcagaaacacaaagcagcccaaccaaaggggttctcatgtatcagccatcttctgtaagggtgcccagtgtgacttcggttgatcctgctgctattccgccttcattaacagactactcagtaccattccaccatacgccaatatcaagcatgtcatcagatttgccaggtttggattttctttcccttattccagttgatccccagtactgtcctcctatgtttttggatagtctcacctcacccttaacagcaagcagtacgtctgtcaccaccaccagctcccatgaaagcagtactcatgttagttcatccagcagcaggagtgagacaggggtcataaccagcagtggaagtaacattcctgacatcatctcattggactaaaggaggactcacttgattctgggaatcattcatcagaactgctttttcttggatctctagtctgtggaaacgttcttttttttttttttttaataatttggtatttattgaaagtcagatggattcttttgctttctgaggggtgaacacagaagactgcaacaagaaccaaatgacatgcaaggatttttcttaattatgctgtactctcagcatcagatacattcaaccataactgtatcttcctgagagatggatttcactttcatacgttaatggatggagtctacaaatcagtgaaaaaagtttttgttaaaataaagagcaataaaatta

SEQ ID NO: 1792 - DNA, 1902 bp, Homo sapiens
gacgggcccggctgtagcggcggcggccgcggcgtcttaagcggcgcccagtgcaggatggtgctggaggcggcggcggccgtggtggcggcagcgtcgttggcggcagcgggagtgggtgcggcggcagcggcggcggcgcccgcgggtggtataaaatggcggatttcgaagagttgaggaatatggtttctagttttagggtttctgaactacaagtattactaggctttgctggacggaataaaagtggacgcaagcatgacctcctgatgagggcgctgcatttattgaagagcggctgcagccctgcggttcagattaaaatccgagaattgtatagacgccgatatccacgaactcttgaaggactttctgatttatccacaatcaaatcatcggttttcagtttggatggtggctcatcacctgtagaacctgacttggccgtggctggaatccactcgttgccttccacttcagttacacctcactcaccatcctctcctgttggttctgtgctgcttcaagatactaagcccacatttgagatgcagcagccatctcccccaattcctcctgtccatcctgatgtgcagttaaaaaatctgcccttttatgatgtccttgatgttctcatcaagcccacgagtttagttcaaagcagtattcagcgatttcaagagaagttttttatttttgctttgacacctcaacaagttagagagatatgcatatccagggattttttgccaggtggtaggagagattatacagtccaagttcagttgagactttgcctggcagagacaagttgccctcaagaagataactatccaaatagtctatgtataaaagtaaatgggaagctatttcctttgcctggctatgcaccaccgcctaaaaatgggattgaacagaagcgccctggacgccccttgaatattacatctttagttaggttatcttcagctgtgccaaaccaaatttccatttcttgggcatcagaaattgggaagaattactctatgtctgtatatcttgtacggcagcttacatcagccatgttattacagagattaaaaatgaaaggtattagaaaccctgatcattccagagcactaattaaagaaaaacttactgcagatcctgatagtgaaattgctacaactagccttcgggtatccttgatgtgccctttaggaaaaatgaggctgacaatcccatgccgtgcagtgacttgtacacatctgcagtgttttgatgctgccctctatctacaaatgaatgagaaaaagcccacctggatttgtcctgtgtgtgacaaaaaagctgcctatgaaagtctaatattagatgggctttttatggaaattctcaatgactgttctgatgtagatgagatcaaattccaagaagatggttcttggtgtccaatgagaccgaagaaagaagctatgaaagtatccagccaaccgtgtacaaaaatagaaagttcaagcgtcctcagtaagccttgttcagtgactgtagccagtgaggcaagcaagaagaaagtagatgttattgatcttacaatagaaagctcttctgacgaagaggaagaccctcctgccaaaaggaaatgcatctttatgtcagaaacacaaagcagcccaaccaaaggggttctcatgtatcagccatcttctgtaagggtgcccagtgtgacttcggttgatcctgctgctattccgccttcattaacagactactcagtaccattccaccatacgccaatatcaagcatgtcatcagatttgccaggagaacaaagaagaaatgatattaataatgaactgaagcttggaacatcttctgatactgtgcaacagtgaatacaaaataaaacaaataatttgt

SEQ ID NO: 1793 - DNA, 2190 bp, Homo sapiens
cgtaacttgaataatatggtttctagttttagggtttctgaactacaagtattactaggctttgctggacggaataaaagtggacgcaagcatgacctcctgatgagggcgctgcatttattgaagagcggctgcagccctgcggttcagattaaaatccgagaattgtatagacgccgatatccacgaactcttgaaggactttctgatttatccacaatcaaatcatcggttttcagtttggatggtggctcatcacctgtagaacctgacttggccgtggctggaatccactcgttgccttccacttcagttacacctcactcaccatcctctcctgttggttctgtgctgcttcaagatactaagcccacatttgagatgcagcagccatctcccccaattcctcctgtccatcctgatgtgcagttaaaaaatctgcccttttatgatgtccttgatgttctcatcaagcccacgagtttagttcaaagcagtattcagcgatttcaagagaagttttttatttttgctttgacacctcaacaagttagagagatatgcatatccagggattttttgccaggtggtaggagagattatacagtccaagttcagttgagactttgcctggcagagacaagttgccctcaagaagataactatccaaatagtctatgtataaaagtaaatgggaagctatttcctttgcctggctatgcaccaccgcctaaaaatgggattgaacagaagcgccctggacgccccttgaatattacatctttagttaggttatcttcagctgtgccaaaccaaatttccatttcttgggcatcagaaattgggaagaattactctatgtctgtatatcttgtacggcagcttacatcagccatgttattacagagattaaaaatgaaaggtattagaaaccctgatcattccagagcactaattaaagaaaaacttactgcagatcctgatagtgaaattgctacaactagccttcgggtatccttgatgtgccctttaggaaaaatgaggctgacaatcccatgccgtgcagtgacttgtacacatctgcagtgttttgatgctgccctctatctacaaatgaatgagaaaaagcccacctggatttgtcctgtgtgtgacaaaaaagctgcctatgaaagtctaatattagatgggctttttatggaaattctcaatgactgttctgatgtagatgagatcaaattccaagaagatggttcttggtgtccaatgagaccgaagaaagaagctatgaaagtatccagccaaccgtgtacaaaaatagaaagttcaagcgtcctcagtaagccttgttcagtgactgtagccagtgaggcaagcaagaagaaagtagatgttattgatcttacaatagaaagctcttctgacgaagaggaagaccctcctgccaaaaggaaatgcatctttatgtcagaaacacaaagcagcccaaccaaaggggttctcatgtatcagccatcttctgtaagggtgcccagtgtgacttcggttgatcctgctgctattccgccttcattaacagactactcagtaccattccaccatacgccaatatcaagcatgtcatcagatttgccaggtttggattttctttcccttattccagttgatccccagtactgtcctcctatgtttttggatagtctcacctcacccttaacagcaagcagtacgtctgtcaccaccaccagctcccatgaaagcagtactcatgttagttcatccagcagcaggagtgagacaggggtcataaccagcagtggaagtaacattcctgacatcatctcattggactaaaggaggactcacttgattctgggaatcattcatcagaactgctttttcttggatctctagtctgtggaaacgttcttttttttttttttttaataatttggtatttattgaaagtcagatggattcttttgctttctgaggggtgaacacagaagactgcaacaagaaccaaatgacatgcaaggatttttcttaattatgctgtactctcagcatcagatacattcaaccataactgtatcttcctgagagatggatttcactttcatacgttaatggatggagtctacaaatcagtgaaaaaagtttttgttaaaataaagagcaataaaatta

SEQ ID NO: 1794 - DNA, 2360 bp, Homo sapiens
gacgggcccggctgtagcggcggcggccgcggcgtcttaagcggcgcccagtgcaggatggtgctggaggcggcggcggccgtggtggcggcagcgtcgttggcggcagcgggagtgggtgcggcggcagcggcggcggcgcccgcgggtggtataaaatggcggatttcgaagagttgaggaatatggtttctagttttagggtttctgaactacaagtattactaggctttgctggacggaataaaagtggacgcaagcatgacctcctgatgagggcgctgcatttattgaagagcggctgcagccctgcggttcagattaaaatccgagaattgtatagacgccgatatccacgaactcttgaaggactttctgatttatccacaatcaaatcatcggttttcagtttggatggtggctcatcacctgtagaacctgacttggccgtggctggaatccactcgttgccttccacttcagttacacctcactcaccatcctctcctgttggttctgtgctgcttcaagatactaagcccacatttgagatgcagcagccatctcccccaattcctcctgtccatcctgatgtgcagttaaaaaatctgcccttttatgatgtccttgatgttctcatcaagcccacgagtttagttcaaagcagtattcagcgatttcaagagaagttttttatttttgctttgacacctcaacaagttagagagatatgcatatccagggattttttgccaggtggtaggagagattatacagtccaagttcagttgagactttgcctggcagagacaagttgccctcaagaagataactatccaaatagtctatgtataaaagtaaatgggaagctatttcctttgcctggctatgcaccaccgcctaaaaatgggattgaacagaagcgccctggacgccccttgaatattacatctttagttaggttatcttcagctgtgccaaaccaaatttccatttcttgggcatcagaaattgggaagaattactctatgtctgtatatcttgtacggcagcttacatcagccatgttattacagagattaaaaatgaaaggtattagaaaccctgatcattccagagcactaattaaagaaaaacttactgcagatcctgatagtgaaattgctacaactagccttcgggtatccttgatgtgccctttaggaaaaatgaggctgacaatcccatgccgtgcagtgacttgtacacatctgcagtgttttgatgctgccctctatctacaaatgaatgagaaaaagcccacctggatttgtcctgtgtgtgacaaaaaagctgcctatgaaagtctaatattagatgggctttttatggaaattctcaatgactgttctgatgtagatgagatcaaattccaagaagatggttcttggtgtccaatgagaccgaagaaagaagctatgaaagtatccagccaaccgtgtacaaaaatagaaagttcaagcgtcctcagtaagccttgttcagtgactgtagccagtgaggcaagcaagaagaaagtagatgttattgatcttacaatagaaagctcttctgacgaagaggaagaccctcctgccaaaaggaaatgcatctttatgtcagaaacacaaagcagcccaaccaaaggggttctcatgtatcagccatcttctgtaagggtgcccagtgtgacttcggttgatcctgctgctattccgccttcattaacagactactcagtaccattccaccatacgccaatatcaagcatgtcatcagatttgccaggtttggattttctttcccttattccagttgatccccagtactgtcctcctatgtttttggatagtctcacctcacccttaacagcaagcagtacgtctgtcaccaccaccagctcccatgaaagcagtactcatgttagttcatccagcagcaggagtgagacaggggtcataaccagcagtggaagtaacattcctgacatcatctcattggactaaaggaggactcacttgattctgggaatcattcatcagaactgctttttcttggatctctagtctgtggaaacgttcttttttttttttttttaataatttggtatttattgaaagtcagatggattcttttgctttctgaggggtgaacacagaagactgcaacaagaaccaaatgacatgcaaggatttttcttaattatgctgtactctcagcatcagatacattcaaccataactgtatcttcctgagagatggatttcactttcatacgttaatggatggagtctacaaatcagtgaaaaaagtttttgttaaaataaagagcaataaaatta

SEQ ID NO: 1795 - DNA, 1590 bp, Homo sapiens
gtgacgggcccggctgtagcggcggcggccgcggcgtcttaagcggcgcccagtgcaggatggtgctggaggcggcggcggccgtggtggcggcagcgtcgttggcggcagcgggagtgggtgcggcggcagcggcggcggcgcccgcgggtggtataaaatggcggatttcgaagagttgaggttcaaagcagtattcagcgatttcaagagaagttttttatttttgctttgacacctcaacaagttagagagatatgcatatccagggattttttgccaggtggtaggagagattatacagtccaagttcagttgagactttgcctggcagagacaagttgccctcaagaagataactatccaaatagtctatgtataaaagtaaatgggaagctatttcctttgcctggctatgcaccaccgcctaaaaatgggattgaacagaagcgccctggacgccccttgaatattacatctttagttaggttatcttcagctgtgccaaaccaaatttccatttcttgggcatcagaaattgggaagaattactctatgtctgtatatcttgtacggcagcttacatcagccatgttattacagagattaaaaatgaaaggtattagaaaccctgatcattccagagcactaattaaagaaaaacttactgcagatcctgatagtgaaattgctacaactagccttcgggtatccttgatgtgccctttaggaaaaatgaggctgacaatcccatgccgtgcagtgacttgtacacatctgcagtgttttgatgctgccctctatctacaaatgaatgagaaaaagcccacctggatttgtcctgtgtgtgacaaaaaagctgcctatgaaagtctaatattagatgggctttttatggaaattctcaatgactgttctgatgtagatgagatcaaattccaagaagatggttcttggtgtccaatgagaccgaagaaagaagctatgaaagtatccagccaaccgtgtacaaaaatagaaagttcaagcgtcctcagtaagccttgttcagtgactgtagccagtgaggcaagcaagaagaaagtagatgttattgatcttacaatagaaagctcttctgacgaagaggaagaccctcctgccaaaaggaaatgcatctttatgtcagaaacacaaagcagcccaaccaaaggggttctcatgtatcagccatcttctgtaagggtgcccagtgtgacttcggttgatcctgctgctattccgccttcattaacagactactcagtaccattccaccatacgccaatatcaagcatgtcatcagatttgccaggagaacaaagaagaaatgatattaataatgaactgaagcttggaacatcttctgatactgtgcaacagtgaatacaaaataaaacaaataatttgtatttatggagtggaaaacagcttatttcaaggaaaaatatgactgccttattattgctagtgccatattgtcaggtgcgaatggtgctcaaaagttgtatcattaaaatttgaaagtgctaaacatttacatatttaatcatgtagcagttatgttttgtt

SEQ ID NO: 1796 - DNA, 1683 bp, Homo sapiens
tttcctaaagcgaggaaaccaagccgggcgcctcttgcaatggagacggtcatttcttcagatagctccccagctgtggaaaatgagcatcctcaagagaccccagaatccaacaatagcgtgtatacttccttcatgaagtctcatcgctgctatgacctgattcccacaagctccaaattggttgtatttgatacgtccctgcaggtgaagaaagctttttttgctttggtgactaacggtgtacgagctgcccctttatgggatagtaagaagcaaagttttgtggtgctgagggctctgtcttgtcctctaggcatgctgaccatcactgatttcatcaatatcctgcaccgctactataaatcagccttggtacagatctatgagctagaagaacacaagatagaaacttggagagaggtgtatctccaggactcctttaaaccgcttgtctgcatttctcctaatgccagcttgtttgatgctgtctcttcattaattcggaacaagatccacaggctgccagttattgacccagaatcaggcaatactttgtacatcctcacccacaagcgcattctgaagttcctcaaattgtttatcactgagttccccaagccagagttcatgtccaagtctctggaagagctacagattggcacctatgccaatattgctatggttcgcactaccacccccgtctatgtggctctggggatttttgtacagcatcgagtctcagccctgccagtggtggatgagaaggggcgtgtggtggacatctactccaagtttgatgttatcaatctggcagcagaaaagacctacaacaacctagatgtatctgtgactaaagccttgcaacatcgatcacattactttgagggtgttctcaagtgctacctgcatgagactctggagaccatcatcaacaggctagtggaagcagaggttcaccgacttgtagtggtggatgaaaatgatgtggtcaagggaattgtatcactgtctgacatcctgcaggccctggtgctcacaggtggagagaagaagccctgagctgggggaaggggtcatgcagcaccaggggatatgcccaactcactgcctgctggaagctctgtgggaatcagatgaaacttgagggaattgtgactctgttccctgttcagggtcccctgcccttctatctgggagctagggaaggtatgggggaggaaagagaatggatttatagctacccttaccctcacacatacacttgaaaaaactttcagcctagccagttctagcccctgtcctcttagatatatccccctttctgggtgaactataggctctgtgcctctcagacaaattctgatctctaagagatccccagacctcacttgcctctgcctccatcttggccctgattcaaccctaagataatagcacaacaaaattcttcataaagatatttttattcacctgttccgtgctatatggaggaggccaagtccatttagtgacatttcttcccataatgtgagtggggaggattgtggggaggaggggctttgggttcctgtgtttgtgcatatgaagggagatgggggttaggtggaggaggagagcagcgtggttagctaaggttattgctttttgtggcaaatctaattaaatgacaggaatctcttc

SEQ ID NO: 1797 - DNA, 1497 bp, Homo sapiens
ctcttgcaatggagacggtgaggagtgcaggagggcggtcgggggcgctgtggagcctaagacacccccccaacccttaggagaccgggagggccgggcaggggctggcgctggtgtctagcaaacaaaaagcagccgggtgtctgccctatcccgtgaccctgttcctccgcttcttcgttgggcgcatctcctggaactgggccgcgtccccgccgcctttccgtcatttcttcagatagctccccagctgtggaaaatgagcatcctcaagagaccccagaatccaacaatagcgtgtatacttccttcatgaagtctcatcgctgctatgacctgattcccacaagctccaaattggttgtatttgatacgtccctgcaggtgaagaaagctttttttgctttggtgactaacggtgtacgagctgcccctttatgggatagtaagaagcaaagttttgtgggcatgctgaccatcactgatttcatcaatatcctgcaccgctactataaatcagccttggtacagatctatgagctagaagaacacaagatagaaacttggagagaggtgtatctccaggactcctttaaaccgcttgtctgcatttctcctaatgccagcttgtttgatgctgtctcttcattaattcggaacaagatccacaggctgccagttattgacccagaatcaggcaatactttgtacatcctcacccacaagcgcattctgaagttcctcaaattgtttatcactgagttccccaagccagagttcatgtccaagtctctggaagagctacagattggcacctatgccaatattgctatggttcgcactaccacccccgtctatgtggctctggggatttttgtacagcatcgagtctcagccctgccagtggtggatgagaaggggcgtgtggtggacatctactccaagtttgatgttatcaatctggcagcagaaaagacctacaacaacctagatgtatctgtgactaaagccttgcaacatcgatcacattactttgagggtgttctcaagtgctacctgcatgagactctggagaccatcatcaacaggctagtggaagcagaggttcaccgacttgtagtggtggatgaaaatgatgtggtcaagggaattgtatcactgtctgacatcctgcaggccctggtgctcacaggtggagagaagaagccctgagctgggggaaggggtcatgcagcaccaggggatatgcccaactcactgcctgctggaagctctgtgggaatcagatgaaacttgagggaattgtgactctgttccctgttcagggtcccctgcccttctatctgggagctagggaaggtatgggggaggaaagagaatggatttatagctacccttaccctcacacatacacttgaaaaaactttcagcctagccagttctagcccctgtcctcttagatatatccccctttctgggtgaactataggctctgtg

SEQ ID NO: 1798 - DNA, 4525 bp, Homo sapiens
cattctggggttcgtttagaggtttgaattttctcggagaaagacaggccggccacgaggaaaacagaaacaagccgcagcaacatctaagcccttgaaaggatcctgagagaggggggaaagggaaaacagcagccaccagcccaaccacttgtgtcttctgccccttcccacctatcttgcccaccccaccagcccacgctgcttgggacttgaaatctgtggccgaaggaccgtcactacataacttcaaaaataatcaaccaccctcccttcccaaaccacccaaattcactcatccagcgtttacttttttgaatccactcagaacttttttctgcgacccccctccctaaatggagttgggtgggggggaaatgaatactgagttggcctttattttttaaaagactttttgatccaatgaggccccctaaataattgagttttgggtcctggttggttgttttattttttttcctccaaaattttaccccctcccccctgagcccgaggtgctgacgtcgcaaaaaaattggataaaaccaccatcatgggttcgggtcccatagaccccaaagaacttctcaagggcctggacagcttccttaaccgagatggggaagtcaaaagtgtggatgggatttccaagatcttcagtttgatgaaggaagcacgaaagatggtgagtcgatgcacttacttgaacattctcctgcagacccgttcaccagaaatattggtcaaatttattgacgttggcggctacaaacttcttaacaattggctgacgtattcaaagacaaccaacaacattcccctcctccagcaaattctactgaccctgcagcatctaccgctcactgtagaccatctcaagcagaacaacacagctaaactggtgaagcagctgagcaagtcaagtgaggatgaagagctccggaaattggcctcagtccttgtcagcgactggatggctgtcatccgctctcagagcagtacccagcctgctgagaaagataagaagaaacgtaaagatgaaggaaaaagtcgaactacccttcctgagcgacctttgacagaggtgaaggctgagacccgggctgaggaggccccagagaagaagagggagaagcccaagtctcttcgcaccacagcacccagtcatgccaagttccgttccactggactagagctggagacaccatccttggtgcctgtgaagaagaatgccagcacagtggtggtttctgacaagtacaaccttaaacccatccccctcaaacgtcagagcaacgtagctgctccaggagatgccactccccctgcagagaagaaatacaagccactcaacacaacacctaatgccaccaaagagatcaaagtgaagatcatcccgccacagcctatggagggcctgggctttctggatgctcttaattcagcccctgttccaggcatcaaaattaagaagaaaaaaaaagtactgtcacctacggctgccaagccaagcccctttgaagggaaaacgagcacagaaccaagcacagccaaaccttcttccccagaaccagcaccaccttctgaggcaatggacgcagaccgtccaggcaccccggttccccctgttgaagtcccggagctcatggatacagcctctttggagccaggagctctggatgccaagccagtggagagtcctggagatcctaaccaactgacccggaaaggcaggaagaggaaaagtgtgacatggcctgaggaaggcaaactgagagaatatttctattttgaattggatgaaactgaacgagtaaatgtgaataagatcaaggactttggtgaggcggctaagcgagagatactgtcagaccgacatgcatttgagacagcgcggcgtctgagccatgataacatggaggagaaggtgccctgggtgtgcccccggcccctggttctgccctcacctcttgtcacccctggaagcaatagtcaggagcgatatatccaggctgagcgggagaagggaatccttcaggagctcttcctgaacaaggagagtcctcatgagcctgatcctgagccctacgagcccataccccctaaactcatccccctagatgaggagtgttccatggatgagactccgtatgttgagactctggaacctggggggtcaggtggctcacctgatggggcaggaggctccaagttgcctccagttctggccaatcttatgggaagcatgggtgctggaaagggcccccaaggccctggaggaggaggcattaatgtccaagagatcctcacctccatcatgggtagcccaaacagtcatccttcagaggaactactgaaacaaccagactattcggacaagatcaagcagatgctggtgccacatggactcctaggccctggcccaatagccaatggtttcccaccagggggtcctgggggccccaagggcatgcagcactttccccctggacctgggggacctatgccaggtccccatggaggccctggtgggccagtgggtccacgtcttctgggtcctccaccccctccccggggaggtgatcccttctgggatggcccgggcgaccctatgcggggtggcccaatgcgggggggtccaggaccaggtcctggaccataccatagaggccgaggtggccgaggaggaaacgaacctcctcctcctcctcctccattccgaggcgccagaggaggtcgctctggaggaggacccccaaatggacgagggggccctggtgggggcatggttggaggtggtgggcatcgtcctcacgaaggccctggtgggggcatgggcaacagcagtggacatcgtccccacgaaggccctggcggtggcatgggaagtgggcatcgcccccatgaaggccctggtggtagcatgggtgggggtggaggacatcgtccccacgaaggccctggcggtggcatcagtggtggcagtggccatcgtccccatgaaggccctggcggaggaatgggtgccggtggtggacatcgcccccacgaaggccctggcggaagcatgggtggaagtggtggacatcgtccccatgaaggccctggacacggggggccccatggccaccggcctcatgatgtccctggtcaccgaggccatgaccatcgagggccgccacctcatgagcaccgtggccatgatggtcctggccacgggggagggggccaccgagggcacgatggaggccacagccatggaggagacatgtcaaaccgccctgtctgccgacatttcatgatgaagggcaactgccgctatgagaacaactgtgccttctaccacccgggtgtcaatgggccccccctgccctagggaccatttgcctgccctgttcacacaacccctgtggactgcagcctcgctctttccaccctgttatggcttctgtgaggcccattttcccttttccccagctgatgaggagccggccccctcagttcccacttgcttgggttcctgggggttttctgatcactggtgcgcattgatgtacatattttcctccagtctggggaggagagagactggaaacgttcctggactgctgaagaggagacccagttggcttcactttttgagaagattcgccctgtaccccaaacccctttccagtattacccttaatgcttgagaacctaaagctggttatcctggcgaacacccctacccttctattgcgggtccccacatgcacacagaactctgacacaggatcagctgcacttaagaaatcatcccagctaagttcattattcctcatggggtggggagatgctgaaaggggtattgtatatcccactgcactgagagggctcaatcagctggatttgagttctggaacacacatcatccccacccctcccccagcgtgggctcaccattcttagtcctttctcaagtgggaccttcaactttctgtgaacacccagtctgcgtcctgggtctgctaggttcgatgatggcgaactcgtatctgcatccggtgcaagttttagctggcagaggtgagaccggtggtgctggtctgcctttgccaactatagccagtctggagacttgataaaatacttcagtgagaccagcttctcatcaacttgggcccggcgtgctgggcctgaaagtcacactacatgcactgcctttgggagtcagctcactccctgctcccacctggaaccttgccagcgtgaaggaggcttccaggtacttcaccctgtcaaccacctctgaatccccaccaggcgccttcctgggtggattcaacaagatgattttgccctttcccagttctctccttcactttggcatcagttgttttctatgaaaacagtggattggttgggttttgtgcagggtcttgggttagagccaaaatggatttgaggatgagtatttttttttttggttttgtatattttgtacattaataataaacagtggaaagagaagcagcttatttaa

SEQ ID NO: 1799 - DNA, 4525 bp, Homo sapiens; identical to SEQ ID NO: 1798

SEQ ID NO: 1800 - DNA, 4525 bp, Homo sapiens; identical to SEQ ID NO: 1798

SEQ ID NO: 1801 - DNA, 4525 bp, Homo sapiens; identical to SEQ ID NO: 1798

SEQ ID NO: 1802 - DNA, 4525 bp, Homo sapiens; identical to SEQ ID NO: 1798

SEQ ID NO: 1803 - DNA, 4525 bp, Homo sapiens; identical to SEQ ID NO: 1798

SEQ ID NO: 1804 - DNA, 4525 bp, Homo sapiens; identical to SEQ ID NO: 1798

SEQ ID NO: 1805 - DNA, 1488 bp, Homo sapiens
attctggggttcgtttagaggtttgaattttctcggagaaagacaggccggccacgaggaaaacagaaacaagccgcagcaacatctaagcccttgaaaggatcctgagagaggggggaaagggaaaacagcagccaccagcccaaccacttgtgtcttctgccccttcccacctatcttgcccaccccaccagcccacgctgcttgggacttgaaatctgtggccgaaggaccgtcactacataacttcaaaaataatcaaccaccctcccttcccaaaccacccaaattcactcatccagcgtttacttttttgaatccactcagaacttttttctgcgacccccctccctaaatggagttgggtgggggggaaatgaatactgagttggcctttattttttaaaagactttttgatccaatgaggccccctaaataattgagttttgggtcctggttggttgttttattttttttcctccaaaattttaccccctcccccctgagcccgaggtgctgacgtcgcaaaaaaattggataaaaccaccatcatgggttcgggtcccatagaccccaaagaacttctcaagggcctggacagcttccttaaccgagatggggaagtcaaaagtgtggatgggatttccaagatcttcagtttgatgaaggaagcacgaaagatggtgagtcgatgcacttacttgaacattctcctgcagacccgttcaccagaaatattggtcaaatttattgacgttggcggctacaaacttcttaacaattggctgacgtattcaaagacaaccaacaacattcccctcctccagcaaattctactgaccctgcagcatctaccgctcactgtagaccatctcaagcagaacaacacagctaaactggtgaagcagctgagcaagtcaagtgaggatgaagagctccggaaattggcctcagtccttgtcagcgactggatggctgtcatccgctctcagagcagtacccagcctgctgagaaagataagaagaaacgtaaagatgaaggaaaaagtcgaactacccttcctgagcgacctttgacagaggtgaaggctgagacccgggctgaggaggccccagagaagaagagggagaagcccaagtctcttcgcaccacagcacccagtcatgccaagttccgttccactggactagagctggagacaccatccttggtgcctgtgaagaagaatgccagcacagtggtggtttctgacaagtacaaccttaaacccatccccctcaaacgtcagagcaacgtagctgctccaggagatgccactccccctgcagagaagaaatacaagccactcaacacaacacctaatgccaccaaagagatcaaagtgaagatcatcccgccacagcctatggagggcctgggctttctggatgctcttaattcagcccctgttccaggcatcaaaattaagaagaaaaaaaaaaagaaa

SEQ ID NO: 1806 - DNA, 1488 bp, Homo sapiens; identical to SEQ ID NO: 1805

SEQ ID NO: 1807 - DNA, 1488 bp, Homo sapiens; identical to SEQ ID NO: 1805

SEQ ID NO: 1808 - DNA, 1488 bp, Homo sapiens; identical to SEQ ID NO: 1805

SEQ ID NO: 1809 - DNA, 1488 bp, Homo sapiens; identical to SEQ ID NO: 1805

SEQ ID NO: 1810 - DNA, 1488 bp, Homo sapiens; identical to SEQ ID NO: 1805

SEQ ID NO: 1811 - DNA, 1488 bp, Homo sapiens; identical to SEQ ID NO: 1805

SEQ ID NO: 1812 - DNA, 4932 bp, Homo sapiens
gcgcggcccgggcgcggggcggcggcagcggcggcgcgcggggaggcggggaggcggggggcccggccggacgcccctgcgccccctccccgcgccccggccgagggcggagcgcgctggccctgcagcctccggcccgcccccggcccgccgcctcccccgggacgtgggacgcgggcgcaggcggggtccgcgcggcgggcggcgggggacgggcggagtcaaaagtctattgaaaaagcagagagagaatgcctcggtgtgtaagtggagtgatgaggacctgatctctgggccgtgtgggaacactggctgccatttcatcacagtcaacctggactcacagaatttcaagagcttgtcggttgggtcaagaatgaacctacgcatgacggcgtgctgatcctgggtttctagtcatcctttttaagctgcaaagaagcatttgcagacgttgtctcatgggtaccgcttgccaactttggaggatgtgaagccggtagagaaataaagcatcgcccctctgcgcgcccctccccgtctgctagaatgtttctcatgaacgcttctccagtggttgctctccagtccaaatgggaggcctttggcccgccagggagctgtaggttccccaggtgcttctcggaggctgacgagggcgtggagagcgcgtcggtgagcgcccgggtgcagatgcttatcagcactctgcagcgcgacggggctgctcggggcaccagcgatgagcgcgccgcacagaggggccacagggcagagggatgccacgacgccaggccggctgccaagcccaccgtgcacaaggagccacccgcgttggctgtctgtggtctcgttgctgactttgaccccatgggggaggaggaaactacagactttggcccgttggtgctagattcagacagtgatgattccgtggacagggacattgaggaggccatccaggagtacctgaaggcaaagagtggagccgcacagcccggggccggcggggcccagccaggtgcagcccagccttccagggccgcaggcggaggcagtagatgtaagccggaaccggctcacggcagtgccccgactgccctgtgtcccccaaaacttgtacctggatcaggtggtggccccggcagccaggtgggatccagcaaggaccagggctccgcctccccggtcagtgtgagcagcgatgactccttcgagcagagcatcagggcggaaatagaacagtttctgaatgagaagagacagcatgagacccaaaaatgtgatgggtcagtggagaagaaaccagacacaaatgaaaattccgccaagtcactcttgaaatcccaccaagagccgcctacaaaggtggtgcatcggcagggcctgctgggcgtccagaaggagtttgccttccgcaaacctccccggttagcgaagatgaacgtccagcccagaagcctcaggtccaaggtcacaaccacgcaggagaacgagggcagcacgaagccggcaaccccctgccgcccttcagaagcagcacagaataaaggtgggatcaaaaggagcgccagcgctgcaaggaggggaaagcgagtcatgagtgcggcacaggcgtccgaggcgtccgactccagcagcgacgatggcattgaggaggccatccagctgtaccagctgcagaaaacacgcaaggaggccgacggggacctgccccagagggtccaactccgagaggagagagcgcctgaccctcccgcacacagcacaagcagtgccacaaaaagtgccttgcccgagacccacaggaaaacacccagcaagaagaagctagtggccaccaagaccatggaccctggtccagggggcctggacactgaccatgcccccaagctcctgaaggaaaccaaagctccacctccagcgagccctgcttccaggagtgagtttgtggaacggtcctcgtgccgggcggacacatctgctgagctgatgtgtgcagaagcaatcctggacatctccaagacgatcctgccggcccctgtagagggcagtgacgggtccctgtccgcaagcccactcttctactccccgaacgtgccttcccgctctgacggcgacagtagctccgtggacagcgatgacagcatcgagcaggaaatccggacatttttggccctaaaggcgcagtcagggagtttgctggccagaggtgagagctgcccgcaggctgcccagggtccacttttgccgcctggcctcaacagccagaccggcggccacaagacccctctctctaaaacaccagacccactgctgggctgcaaaaggaagcgtagaggtggtggccatgtgaggccatccacgcccaagaaaatgcaggaggtggtgaaagacggtagccaggatgccgaccacagccaggggagagctgagcccggccatgagaggcgagacctgcccatccagggcaaagccagtgaggccctgggaggggagggcaccgccaggggccctggcgacactcgcatgtcacagggccagggtaagacagacgaggcaaggcgcctagacgagaaagagagctctgaagacaaaagcagctccctggacagtgacgaggacctggacacagccatcaaggacttgttaaggtccaagcgaaagctcaagaagaggtgcagggagcccagggctgcgtgcaggaagaaggtcaggttcagcacagcccagacgcacttcttggagcagctgggcgggctccggagagactggaaagacaggggcccgccagtgctgaagagctgcctctccaagtccaagagagacagtggcgagggtcctgggaagaaaccccccagtgtctttggcagcacggcagagaggatgaggcaggagggtgccgcgagccaggacgcggccctggccttccgggtgaggagacccgcctccgcctctgcctccgaagggaatccattccccagggagtcccagggcccagctcccagccccggctccctgtctgatgacagcagttcagtggacagcaacgacagcatcgaactggagattaggaagtttttggcggaaaaggccaaggagtcagtgagcagttcagaagttcaggcagagggccccaccgctcttgggacagggggcccagccaggccagaggtgctgtgcaggaaggagcctgccccaccgcctggcgtgtgcacacgcagccagagggccaggggggtcccacatctggccgaagggcttcgaggcacagagagcgcaggagcacagggcacagctggtctgttcagccagggcgggaaggggctccctgctgctcctgcccgaggggatccggtgccgcccaggagcaccagcggcggtgtctccgccaaggggctctcagtgagcaggagaaatgtttacgttcacaaagaccagagcccacgaggggctgagcctgctgccaaaagtgcttttggtcagctgcccagctgtgccacagcgggcaccgaggcaggaggcgccagaggaacctttcacatgggctgcgggagcccgagcttcctgacccccagcccgggagcggagagggacgctggagcccaggccgaccgcacaccgccctggagcgacttcgcccaccagagtcggctgcccagcccgtgggtgctgcgctccgaaggcagagatgcagtgtggagggggggcgtcgggagcgagagagacaaggggtccgagggccccgcccggggcctgcccagcctgccccttgcgggcttctcgccgctgctgtccacccagctcttccactttggaaagggtgtctcctgggggggcaggcaggctggcctcttcagcccccacctggggctgcctctgcagggcccctccttctcggccttcagggaggcccaggccggacccagccctgtctttggaagcccacacttgctggcaaagaaggacggcggcccctggccaaccaggaaggcacaggcagggctgagtttgcatgacaggaggagctcgggctcggaggaaagcattttagacctgaggtatcgacgaagggtcaacagggatgaccaggagcaggacgccttgggcagtgacgccagtgacttcagcgacacctccacggaggacagtggcggcagctcagtagtgaaggtctaagccctcgagctgtgggttcgcgtcctgggttgcgtgcattcgtggaaagcggcgtagccgtgcgtgtgtgtgatggttccgtggctgcaaggaagggaaacagtctattatacatagccctgtatatatgtacaccaacatgaaacttttatttaacagacgtgtcctggtaaatatgatttttgtagctttttgtaaattatttaaagtgatgtaaaagatatttttggaaaatactgttgttcaattttgtagggtgttcctaactgcagttttctgtgttctgcatacaagtcttagcttaggaaacatttggttcttaccatcacagccaggttcacagaggctctgatgctttttggttgattgctggtgagaatggccggcggtggctgcagtggtagcctgaggaaggccaagctgccctccctgggaatcactcagatgccccaagatgtccgttgggaagctcccaggacagcactttttatacagaggacaccgcctcggccccacgtccttagaggccagagcacatctgaaaactgcaatcacagccgtccgctggaaaaacgtttcgaagcacagtggccagcgagcgagcacgtggctactccctgttgcatgtcaaatccacacagatgtcagcggcagctgctcggcagcccagccctgggcctgggtgggttcatgtccaatcttgttcgatcactagatgattctaacatcgaaataaacctctttttatatggc

SEQ ID NO: 1813 - DNA, 711 bp, Homo sapiens
ctggttaaccggagaaagctcctggtaaagaagaatccataacagaggcaaaacatactggccagttttcgcccactgctgaggtcctgagggcagccacagcctctgagccaaggggagttcagtgtccataagccttggaggcttgcttgcacaagaaccgctttgcactgcaattttggggtaggcaggagcttgtcggttgggtcaagaatgaacctacgcatgacggcgtgctgatcctgggtttctagtcatcctttttaagctgcaaagaagcatttgcagacgttgtctcatgggtaccgcttgccaactttggaggatgtgaagccggtagagaaataaagcatcgcccctctgcgcgcccctccccgtctgctagaatgtttctcatgaacgcttctccagtggttgctctccagtccaaatgggaggcctttggcccgccagggagctgtaggttccccaggtgcttctcggaggctgacgagggcgtggagagcgcgtcggtgagcgcccgggtgcagatgcttatcagcactctgcagcgcgacggggctgctcggggcaccagcgatgagcgcgccgcacagaggggccacagggcagagggatgccacgacgccaggccggctgccaagcccaccgtgcacaaggagccacccgcgttggctgtctgtggtctcgttgctgactttgaccccatgg

SEQ ID NO: 1814 - DNA, 2151 bp, Homo sapiens
cgcgggcccagcccccgccatgccgcccggcaaagtgctgcagccggtcctgaagatgaaggtggacgagctgttcctgtactggctcagcgaggccagcacgcagcggatgctgcaggactgcctgcgccggatcaaggcgcccgggcgggaccagccgaccccgggggacggggagcagcccggggcctggcccacagccccgctcgccgccccccggcccagcgggctcgaacccccgggaacccccgggccgggccctgcgctgcccctgggcgccgcctccagccccaggaacgcgccccacgttcgaggcacccgtagatccgcagggacgagagtagttcagacacggaaagaagagcctctgcccccggccacgagccaaagcattccgaccttctacttccccagaggacgcccgcaggactccgtcaacgtggatgccgtcatcagcaagatcgagagcaccttcgcccggttcccccacgagagggccaccatggatgacatgggcctggtggccaaggcctgcggctgccccctctactggaaggggccgctcttctatggcgccggcggggagcgcacgggctccgtgtccgtccacaagttcgtcgccatgtggagaaaaatcctccagaactgccacgacgacgcggccaagttcgtccatctgctcatgagccccggctgcaactacctggtgcaggaggactttgtccccttcttgcaggacgtggtgaacacgcacccggggctgtcgttcctgaaggaggcgtccgagttccactcgcgctacatcaccacggtcatccagcggatcttctacgccgtgaaccggtcctggtccggcaggatcacctgcgccgagctgcggaggagctccttcctgcagaatgtggcgctgctggaggaggaggcggacatcaaccagctgaccgaattcttctcgtacgagcatttctacgtcatctactgcaagttctgggagctggacacggaccacgacctgctcatcgacgcggacgacctggcgcggcacaatgaccacgccctttctaccaagatgatagacaggatcttctcaggagcagtcacacgaggcagaaaagtgcagaaggaagggaagatcagctatgccgactttgtctggtttttgatctctgaggaagacaaaaaaacaccgaccagcatcgagtactggttccgctgcatggacctggacggggacggcgccctgtccatgttcgagctcgagtacttctacgaggagcagtgccgaaggctggacagcatggccatcgaggccctgcccttccaggactgcctctgccagatgctggacctggtcaagccgaggactgaagggaagatcacgctgcaggacctgaagcgctgcaagctggctaacgtcttcttcgacaccttcttcaacatcgagaagtacctcgaccacgagcagaaagagcagatctccctgctcagggacggtgacagcggcggccccgagctctcggactgggagaagtacgcggccgaggagtacgacatcctggtggccgaggagactgcgggagagccctgggaggacgggttcgaggccgagctcagccctgtggagcagaagctgagtgcgctgcgctccccgctggcccagaggcccttcttcgaggcgccctcaccgctgggcgccgtggacctgtacgagtacgcatgcggggacgaggacctggagccgctgtgacgccgcccgcgagaacgccgccgcggggccgctccccacgtgccaccaccgggccaccgcggctcgtgtaaaaactgttgtggaaaatgagtgcgtttgtacggaatgataaacttttatttattcacagaagcgtgttgattgccgctgtgggttcgtggctggacctgcccagagctctgtgccagggggacacgtagggccgcgcgtgaatgggacgggttcccacacggacaccctctggcgcttgccgttcccgacccagcctgggttccggggcctgcgtctgtggaaagggtccgtgtgcgcacaacggtgaccggcggctcccgggcgcctcagtcctggacaggagcctccaccacaggctgtgtgaatgttttgtgtaaacgtacaaaaccgtt

SEQ ID NO: 1815 - DNA, 3300 bp, Homo sapiens
cgagccggccggccggcctggctcccctccccggccccgacgggcgggcggactgccctgaggaggcggggaggggagggctgggccggccggcgggcgggcgacgatgccgaacttctgcgctgcccccaactgcacgcggaagagcacgcagtccgacttggccttcttcaggttcccgcgggaccctgccagatgccagaagtgggtggagaactgtaggagagcagacttagaagataaaacacctgatcagctaaataaacattatcgattatgtgccaaacattttgagacctctatgatctgtagaactagtccttataggacagttcttcgagataatgcaataccaacaatatttgatcttaccagtcatttgaacaacccacatagtagacacagaaaacgaataaaagaactgagtgaagatgaaatcaggacactgaaacagaaaaaaattgatgaaacttctgagcaggaacaaaaacataaagaaaccaacaatagcaatgctcagaaccccagcgaagaagagggtgaagggcaagatgaggacattttacctctaacccttgaagagaaggaaaacaaagaatacctaaaatctctatttgaaatcttgattctgatgggaaagcaaaacatacctctggatggacatgaggctgatgaaatcccagaaggtctctttactccagataactttcaggcactgctggagtgtcggataaattctggtgaagaggttctgagaaagcggtttgagacaacagcagttaacacgttgttttgttcaaaaacacagcagaggcagatgctagagatctgtgagagctgtattcgagaagaaactctcagggaagtgagagactcacacttcttttccattatcactgacgatgtagtggacatagcaggggaagagcacctacctgtgttggtgaggtttgttgatgaatctcataacctaagagaggaatttataggcttcctgccttatgaagccgatgcagaaattttggctgtgaaatttcacactatgataactgagaagtggggattaaatatggagtattgtcgtggccaggcttacattgtctctagtggattttcttccaaaatgaaagttgttgcttctagacttttagagaaatatccccaagctatctacacactctgctcttcctgtgccttaaatatgtggttggcaaaatcagtacctgttatgggagtatctgttgcattaggaacaattgaggaagtttgttcttttttccatcgatcaccacaactgcttttagaacttgacaacgtaatttctgttctttttcagaacagtaaagaaaggggtaaagaactgaaggaaatctgccattctcagtggacaggcaggcatgatgcttttgaaattttagtggaactcctgcaagcacttgttttatgtttagatggtataaatagtgacacaaatattagatggaataactatatagctggccgagcatttgtactctgcagtgcagtgtcagattttgatttcattgttactattgttgttcttaaaaatgtcctatcttttacaagagcctttgggaaaaacctccaggggcaaacctctgatgtcttctttgcggccggtagcttgactgcagtactgcattcactcaacgaagtgatggaaaatattgaagtttatcatgaattttggtttgaggaagccacaaatttggcaaccaaacttgatattcaaatgaaactccctgggaaattccgcagagctcaccagggtaacttggaatctcagctaacctctgagagttactataaagaaaccctaagtgtcccaacagtggagcacattattcaggaacttaaagatatattctcagaacagcacctcaaagctcttaaatgcttatctctggtaccctcagtcatgggacaactcaaattcaatacgtcggaggaacaccatgctgacatgtatagaagtgacttacccaatcctgacacgctgtcagctgagcttcattgttggagaatcaaatggaaacacagggggaaagatatagagcttccgtccaccatctatgaagccctccacctgcctgacatcaagttttttcctaatgtgtatgcattgctgaaggtcctgtgtattcttcctgtgatgaaggttgagaatgagcggtatgaaaatggacgaaagcgtcttaaagcatatttgaggaacactttgacagaccaaaggtcaagtaacttggctttgcttaacataaattttgatataaaacacgacctggatttaatggtggacacatatattaaactctatacaagtaagtcagagcttcctacagataattccgaaactgtggaaaatacctaagagacttttaaaaataggctttcttatatttgatatttggaagaaaaagccgtaaggtgtatgtagaccacttaatcactaaatatctttgcctataggactccattgaatacattagccattgataatctacctgtttaaatggcccctgtttgaactctcaagctttgaagacctacctgttcttccagaagagaacgttgaaagtgccatgtttccttttgcgtgatctctgttgatggcactctggaattgtttcagttaagtcattttagacatagcatttattatcactgtggatctctacttgttgggtgttatgaattctttgaagaaatatattttgaagaggtgtgggaggaaggaatacattttataaaatgttgtagtgaagcccacaattgacctttgactaataggagttttaagtatgttaaaaatctatactggacagttacaagaaattaccggagaaaagcttgtgagctcaccaaacaaggatttcagtgtagattttgtctttcttgaacttaaagaaacaaatgacaaagtttgaatggaaaagcctgctgttgttccacatctcgttgctgtttacattcctttgtggagcctacatcttcctaagctttttagcaggtatatgttgaacacttctgtttcatggttgagacagaatcagaggccatggatactgacaactgatttgtctgttttttttctctgtctttttccatgactcttatatactgcctcatcttgatttataagcaaaacctggaaaacctacaaaataagtgttgtggtttatctagaaaaatatggaaaatattgctgttatttttggtgaagaaaatcaattttgtatagtttatttcaatctaaataaaatgtgaattttgtttaaa

SEQ ID NO: 1816 - DNA, 6795 bp, Homo sapiens
ttatagacgtgagccaccggcctcctccatatgaatttgaaagtccttttgtcaagttctcctagaacttcttttgggattttcattataattgctttgaattgacatctttacaatattagctattgtaaatttattactagtttagtattactgttagtaaacgaatattactagtttactgttacagtataaactattgtaaagtattaactagttctatccatgaagagaaaaaaaatcccataaaatacctatcaaataacagcaatcattgacaaaactaaatactagttttttgaaaagaatattagaatacttttaggagtacagaaaacgaaaaattttgagagcttttgttacagttgtttaaatgagaatgtatgcattcttagatcacttcttaaatacattatggttcttactggtatagatgatatattctggttgaaattgtttccagcacttttgaagaacttctttttaagttaatcctagtaagtcttctgagtttttcctctgttactgattgtatcatctgcaaataaggagaaatttgtctctttcagttcttattattttaattttttctgttgcctgtcttgtttagtcaagatccctggtactatgttgaacaattctagtaatgtcatacttgccttgccccattaagtataatgtttgctgttggtattgttagatagtttttatcaagttaaggaaattcccttctactcccatattcagagttttgttgtttttttttaagatggggtctcactctgtcacccaagccagagtgcagtggggcagacactgctcactgcagcctccacctcctgggctgaagcaatcctcttacctcagcctcccaagtagctgggaccacaggtgtgtgccaccatgcctggcttatttttttgtatttttttttatagatggagtcatgccatgttgcccagtttggtctcaaactcctgggctcaagcagtcctcttacctcagctccccaaagtgctgggattacaatagtgagccaccacgcctgacctatattctgtttttatatttaacttatcacatgctttcattgcatgtatttaatagacaagttcatttttttcattctttaatgcaataagtaatactaatggattttctgtgaaccatctgcatttctgtaatgaactctagttgactgcaatatgtctatttgcttttatataccattggattcaattggtcaatattttatttaggattttacatttgtgaatcttggtctgtagccttcttttcatgtactcttattacccagttataatatcaaggttctattggcctcataaaataagttgggtatcttttttttttttttctcctagaaaaatttgtgtaggtagatgttatctgctcttgaaagtaaggtagaacttggtaaaaccattagatggcttgcggtggatgagggaaagttttgattgccattctgctatctttattggttttctttctttcttgtgttttgttaatgtttctaaaagtttatgaaactttaataatcttttcaaagaaccagtagttttgtcagtgattgttgtacttatgaactattttattggtttttctttgattagggtgatttattttttgactctttttctagcttcttgaatgtttagctcatatttatgtgtattcaaagctataaaagtctctcttaggtccattttagctataccctacaactttagacatatagtgttgtcatgtctggctgtaggtattttgtaatttctctattttgttaacataggattgtttttcttagtttccagatgtggaattatttttaattgctatatgatattttaaattttaaatgttattaagagatacgtagaggatacatatagtctatgtgatgttgattctttctgatttttttgcatccattattgctattcaagtctgtgccagcctgattcttgttcctttttaggtaatcttcttttctccctcaaagctttttagaaggtttctttatatttgacattttaaaatttgctaacctgtatctagatgtgagttttttttttatgtaccttaatttgtcatcttacaactgaggacttacaccttaaattctgagaaatccttagtttttatttttctttatgcattttcccctctatttgtttatttctattttcctgggacttagatgaatactgacacttacattacagtcctccatatcagctttcttcttggtgtccatggaggactgattccaggagcttccctcagagagcaaaatccacagatacttgattcccttatatacagtggtgtagtatttgcatataacttacacacatcctcccgtgactttaaatcatttataatacctaatacaatgtagtgctatgtaaatagttgttctgttacattgtttagagaataatgacaagaacaaaaatctgtgtgttcagtatagacacaaccatccttttcttttttttttttttgagacagagtctcgctcttgttgcccaggctggagtgcaagggtgcgatctcagctcaccgcaacctccgcctcccgggttcaagcaattctcctgcctcagccccccgagtagctgggatcacaggcatgtgccaccacgcccggctctttttgtatttttagtagagacgagggttctccatgttggtcaggctggtcttgaactcccgacctcaggtgatcctcccgcctcagcttcccaaagtgctgggattacagacgtgagccaccatgcccggcacaaccatccattttcaaataatacctagattatttatgatacttaatacatttatgtgtttgtaacacctactacaatgtaaatgctatgtaaatagttatgctacgttatgtaggggaagaatgagaaaaaaagtctgtacatgttcaagatagatacaaccatccattttttccccagcattttcaatgcatggttggttaaatccatagatatgaagtgtaatatgtatcaggatgaggagctcaatcacttgctgtcctgtagctatcatttccctgtagtctgtccctcagagagcctcacatatctcacagcaggcatactcttcctgacccaccatccttataaacgtgcagtccgtaggataaggaggggatgtccaggttgaccagcctgctgatgtttcttgttatcagcaccatgtccagtgctgcccaacaggcatcctgctgtcttcagctgtcactggcattgctgcttttctgccacagaaagtaacaggtggctcatgatttaagcattgtagagggttggaaggaaagtaaaggatgcagctggaaagttcttcctttgtctaaccctattggtgccacttggcctactatgctctgtgtatgctctgtgtatctcttccatgctggtactttcaccttctgcttctcagggatttctcatcacttttgtgttgagtcctgagattcagcaacctccttcttatgggacatctccagggttaaattgggaagtaagatgatttgtgtcctcttgaatttaactccaagtgccatggtgtatttttgtgcctttcattagccagtaaacacttataacccaaagttacgatgatttaggtagaaaataagcaaaatgatgtattcttttttccctaagactttgttataaccttggagtcattaacagcttattctggttttctcattgtctgtttgtttgaagaatgtgtactatataaagaatttatgctcttgaaagaattaaattgactcagaataggcatttgtatttgtgagtctaagatgatacactagaggtcagttttttaaagatgatttgtttttttctttttttttcttgacatttagagtgaagatgaaatcaggacactgaaacagaaaaaaattgatgaaacttctgagcaggaacaaaaacataaagaaaccaacaatagcaatgctcagaaccccagcgaagaagagggtgaagggcaagatgaggacattttacctctaacccttgaagagaaggaaaacaaagaatacctaaaatctctatttgaaatcttgattctgatgggaaagcaaaacatacctctggatggacatgaggctgatgaaatcccagaaggtctctttactccagataactttcaggcactgctggagtgtcggataaattctggtgaagaggttctgagaaagcggtttgagacaacagcagttaacacgttgttttgttcaaaaacacagcagaggcagatgctagagatctgtgagagctgtattcgagaagaaactctcagggaagtgagagactcacacttcttttccattatcactgacgatgtagtggacatagcaggggaagagcacctacctgtgttggtgaggtttgttgatgaatctcataacctaagagaggaatttataggcttcctgccttatgaagccgatgcagaaattttggctgtgaaatttcacactatgataactgagaagtggggattaaatatggagtattgtcgtggccaggcttacattgtctctagtggattttcttccaaaatgaaagttgttgcttctagacttttagagaaatatccccaagctatctacacactctgctcttcctgtgccttaaatatgtggttggcaaaatcagtacctgttatgggagtatctgttgcattaggaacaattgaggaagtttgttcttttttccatcgatcaccacaactgcttttagaacttgacaacgtaatttctgttctttttcagaacagtaaagaaaggggtaaagaactgaaggaaatctgccattctcagtggacaggcaggcatgatgcttttgaaattttagtggaactcctgcaagcacttgttttatgtttagatggtataaatagtgacacaaatattagatggaataactatatagctggccgagcatttgtactctgcagtgcagtgtcagattttgatttcattgttactattgttgttcttaaaaatgtcctatcttttacaagagcctttgggaaaaacctccaggggcaaacctctgatgtcttctttgcggccggtagcttgactgcagtactgcattcactcaacgaagtgatggaaaatattgaagtttatcatgaattttggtttgaggaagccacaaatttggcaaccaaacttgatattcaaatgaaactccctgggaaattccgcagagctcaccagggtaacttggaatctcagctaacctctgagagttactataaagaaaccctaagtgtcccaacagtggagcacattattcaggaacttaaagatatattctcagaacagcacctcaaagctcttaaatgcttatctctggtaccctcagtcatgggacaactcaaattcaatacgtcggaggaacaccatgctgacatgtatagaagtgacttacccaatcctgacacgctgtcagctgagcttcattgttggagaatcaaatggaaacacagggggaaagatatagagcttccgtccaccatctatgaagccctccacctgcctgacatcaagttttttcctaatgtgtatgcattgctgaaggtcctgtgtattcttcctgtgatgaaggttgagaatgagcggtatgaaaatggacgaaagcgtcttaaagcatatttgaggaacactttgacagaccaaaggtcaagtaacttggctttgcttaacataaattttgatataaaacacgacctggatttaatggtggacacatatattaaactctatacaagtaagtcagagcttcctacagataattccgaaactgtggaaaatacctaagagacttttaaaaataggctttcttatatttgatatttggaagaaaaagccgtaaggtgtatgtagaccacttaatcactaaatatctttgcctataggactccattgaatacattagccattgataatctacctgtttaaatggcccctgtttgaactctcaagctttgaagacctacctgttcttccagaagagaacgttgaaagtgccatgtttccttttgcgtgatctctgttgatggcactctggaattgtttcagttaagtcattttagacatagcatttattatcactgtggatctctacttgttgggtgttatgaattctttgaagaaatatattttgaagaggtgtgggaggaaggaatacattttataaaatgttgtagtgaagcccacaattgacctttgactaataggagttttaagtatgttaaaaatctatactggacagttacaagaaattaccggagaaaagcttgtgagctcaccaaacaaggatttcagtgtagattttgtctttcttgaacttaaagaaacaaatgacaaagtttgaatggaaaagcctgctgttgttccacatctcgttgctgtttacattcctttgtggagcctacatcttcctaagctttttagcaggtatatgttgaacacttctgtttcatggttgagacagaatcagaggccatggatactgacaactgatttgtctgttttttttctctgtctttttccatgactcttatatactgcctcatcttgatttataagcaaaacctggaaaacctacaaaataagtgttgtggtttatctagaaaaatatggaaaatattgctgttatttttggtgaagaaaatcaattttgtatagtttatttcaatctaaataaaatgtgaattttgtttaaa

SEQ ID NO: 1817 - DNA, 2755 bp, Homo sapiens
attgattcgataggcgacgcggggagcggaagccctttacactacggtgtttccggcttcaagatggtcgcctaagctgtttagtgaaacttcttccacctttctccattcctctaggtgctttttctgaacctggatgtgaggcattaaaggatccgacggaaatagaattgaaggcattctaaaatggctaaccgtacagtgaaggatgcgcacagcatccatggcaccaaccctcaatatctggtggagaagatcattcgaacgcgaatctatgagtccaagtactggaaagaggagtgctttggacttacagctgaacttgtagtcgataaagccatggagttaaggtttgtgggtggcgtctatggtggcaacataaaaccaacaccctttctgtgtttaaccttgaagatgcttcaaattcaacccgagaaggatatcattgtagagtttatcaaaaatgaagatttcaagtatgtccgcatgctgggggcactttacatgaggctgacaggcactgcaattgattgctacaagtacttggaacctttgtacaatgactatcgaaaaatcaagagccagaaccgaaatggggagtttgaattgatgcatgttgatgagtttattgatgaactattgcacagtgagagagtctgtgatatcattctgccccgactacagaaacgctatgtattagaggaagctgagcaactggagcctcgagttagtgctctggaagaggacatggatgatgtggagtccagtgaagaggaagaagaggaggatgagaagttggaaagagtgccatcacctgatcaccgccggagaagctaccgagacttggacaagccccgtcgctctcccacactgcgctacaggaggagtaggagccggtctcccagaaggcggagtcgatctcccaaaaggagaagcccctcccctcgccgagaaaggcatcggagcaagagtccaagacgtcaccgcagcaggtcccgagatcggcggcacagatcccgttccaagtccccaggtcatcaccgtagtcacagacacaggagccactcaaagtctcccgaaaggtctaagaagagccacaagaagagccggagagggaatgagtaatggactcagtttggttttagtccacatggcctcctgtggatataaggatatctgtatgtggaaggattaagatctcccccaggcagctataagaatattttagtttttttcttatcaagtttctcaacctttatttttaatgaaggaggtgctgagttttgtatctttttaatcataatcaacatcagtttttgacccaactaaccttgactgtattcaaacttatgagagtataaaggatctggaggttggggatatgactgacaaggaaaggctgtggccacctgatgaccctttccctttttattaaaccggacacacctgtttcccatttcgctgtagtttagtttttggtttgttgtggttggaactgctttgagaatcctgggatttgtgctgctgctgttattcaaagatcaaaggagtaaaacatagttgctcctaacttttttccagcagcagcaagtggtaataaacatgaaaactggtttgtagcagttttgaaagaatagaatgcattcaaatgtaaggctgcttctggatcattaaagccagtttcatcaaacagttcaacagagagcagcacttaataccctttatacagcccattttttcatagtttcatttgttcttgcccacaagcttgaaatccaggttaaggtatccagcctttatcatataagcattgacattatccaggcctagtcagtagcagtagggtaacgggattgaaaaagatttgatggagaggaaagtatctaatattagtcatggttttgacctaaattgctagacagtcgtgccattcacaaagtcagaaaatacagcaggaagagacagcttttagaggggcagagaattagaggatggtggtagtaatgaaaatgatgcattcagtttaacaagtttaatttgagacagctatggtatagctaaaaacaaaagcccataaagttggagatagggaccagagtttaacatagcgatctaggccagaattgacaatgtttaagtaatggtggaatctgtcaataagacttcccagagtgttaatatatatcagaaatgcacacaacagaaccataggcaacaccaacacaggaagaaatagaagtcacctattgaaaactggaatggcccattcagaaagacaggagaattaggagagagtgagtgaaagaagccaagggtcaagaatgcagaagcaaaggaaggactaaaaagcctccacggacatcgataatcaagagattattaagatctttgctagaagagttcctttacctgtacttaactcccttaaaaagagaaaagtgatggaatgacttctgcaactgtagtcccagcaggaactgtgaagaccagctgccctgcaggatccagtttttcttgggaggttgtatctggtcataaggtaaacattctatatattctatgcctgctctagaattgaaagacttcagcagtattaaagcattttttaatcttatttgagctttcatattcttcaatggttcctttcgtaatacctgagttaataaaagtggtctgaaagagctcttacggtttctgatagaactatataggactaccttttaagattaaatataagcatctgtacgtaaatgta

SEQ ID NO: 1818 - DNA, 3728 bp, Homo sapiens
atcgagctccctggctgccggctcgccttctgcgtggagttctcgcggtctgggtttcgctgtctgctcttggcccggggtcattttgtcggcgtcgggtgccctctcttgcccagctggggcacagcgaggcggccccttctcccgacgacgttcgatggagtagggtcccagaccgttgtcccgaagagcgagatcgagcttggccccctcccccccctccttccctccctccttccttccgccgcaacatggctaacaacagccccgcgctgacaggcaactcgcagccgcagcaccaggcggctgcagctgcggctcagcaacagcagcagtgcggcggcggcggcgctaccaagccggcggtctccggcaagcagggcaatgtgctcccgctctggggcaacgagaagaccatgaacctcaaccccatgatcctgaccaacatcctgtcgtcgccttacttcaaagtacagctctacgagctcaagacctaccacgaggtggtggacgagatctactttaaggattgactcagtcttgcagcgaggctcggagcagcccagggtcgcaggtagaggtcacgcacgttgaaccatgggagaaaggaagcaggaaaacagcgggccagacagggatgtgcggaggggttcgaggtgttggaacaggaggaattgtttctacagcattttgcctgttatacaaattatttaccctgaagttaactcgaaagcaagtgatgggtcttataacacacacagactctccatatattagagcgcttggatttatgtatataagatatacacagccccctacagatctgtgggactggtttgaatccttccttgatgatgaagaggacctagatgtgaaggctggtggaggctgtgtaatgaccattggagaaatgctacgatcttttctcacaaaactggagtggttttctaccttgtttccaagaattccagttccagttcaaaagaatattgatcaacagattaaaacccgacctagaaaaatcaagaaagatgggaaggaaggtgctgaggaaatagacagacatgttgaacgcagacgttcaaggtctccaaggagatctctgagtccacggaggtccccaagaaggtcaagaagtagaagtcatcatcgggagggccatgggtcttctagttttgacagagaattagaaagagagaaagaacgccagcgactagagcgtgaagccaaagaaagggagaaagaacggcgaagatcccgaagtattgaccgggggttagaacgcaggcgcagcagaagtagggaaaggcatagaagtcgcagtcgaagtcgtgataggaaaggggatagaagggacagggatcgagaaagagagaaagaaaatgagagaggtagaagacgagatcgtgactatgataaggaaagaggaaatgaacgagaaaaagagagagagcgatcaagagaaaggtccaaggaacagagaagtaggggagaggtagaagagaagaaacataaagaagacaaagatgataggcggcacagagatgacaaaagagattccaagaaagagaaaaaacacagtagaagcagaagcagagaaaggaaacacagaagtaggagtcgaagtagaaatgcagggaaacgaagtagaagtagaagcaaagagaaatcaagtaaacataaaaatgaaagtaaagaaaaatcaaataaacgaagtcgaagtggcagtcaaggaagaactgacagtgttgaaaaatcaaaaaaacgggaacatagtcccagcaaagaaaaatctagaaagcgtagtagaagcaaagaacgttcccacaaacgagatcacagtgatagtaaggaccagtcagacaaacatgatcgtcgaaggagccaaagtatagaacaagagagccaagaaaaacagcataaaaacaaagatgagactgtgtgaaaatattttgtaaaagtggatcacattgaatcctataaatgattaaatctgcttttttcccccacgttgagattgtgcagtagttcgcactcctcaagctctccctgtaggctgcattttcatttcctctttcgtgtagggaagtgcctttgtaattccatttattgcattggtgttttcacccaattgttaagtttgatacatgatgcacagattgttcttgcatttttattgtttgtttttgaaatgtacagtctgtacatatgtcctgaaaatgttttaattcctttggcatggttgccatgttggttaaatttgtataaggcaataaactgccactaatctatttttgttttgtaggtgtgggattatggtttgtgtactgaagttagcatggctgtgcttttcgtaatagaatgctaaagactttgagaatggatcttggatgtctattataggagaagtatgtgctgccaatgtacaagaaggcagcattgtaggattaacattcttgtctactgtatattatcttggaaggctcttgttaatatgttacacttaatattctccacagttacctttagagagaatttatgagaagttagtttctgatgcagaggtttttaggctgtgatttcatcaaaagtccttttagcattctacctcaaagggacacttagtatgcctaaaatttattcacttagttttccttttttatttgaaaaaatacatgacatgtaatctttttttcttgaattctttctcagattttaaagtactatattaaagaaaaaaattaatgtctaaagcctagcattcttgcagaaccctatactaacatgtaatggggagagggtggggcagatgagtagagaaacagattcaagcctcaagcttccaaagcatttttataaatggaaaatccttaaattatgaaacagcttgatatagtgtcctttttttaaaattcagaactttttttattgataatggagattgctgtttgagtttttaaacttaatctagaacagaggagtattaaaagtaatgctgtgctgcattatttaagactatcagcaaattatttgatagattgttcttacaacttgtattctgattacagaaccatcatgagtgtggaataaatactggattaaatcctttatcctgggtcttggcttttcccccatttgttaaatttttttagcatatttatattgtggaaattgatgaaacgtcagtagagtcacactttgtgtacagggatgtcttagtgcccagatgacaagtgaattttggagaaatgcatagactgggattgggcatgtggtaatcaataatctttattagaatacttgataatggcagttccctttgtcagtggttgttacatgtgtcatttgattactttgttccatgtcaaagacgtttattgggataccttttacttggacaatatgttagcattttttaaaatttggacttgaaattctttaagataattcacccaattctttttagaaaagaaaatagaggcccaaagtaatgatgtcagtgctagggctaaaactcagtattctgacagtgtagtgaacctggcacgcacattgaggtttgttttatctcactggttatactggccaactaatgcgcactcagaagccaccttgcaaaaatgttaaatggagcaaacgagtacacttgcaagagtcctccatatgtgggcttaacatatgtaccactccattttagaaaaatctcattaaatgaattcttctaaaaa

SEQ ID NO: 1819 - DNA, 1591 bp, Homo sapiens
ggcagttggcggaagagatcgagctccctggctgccggctcgccttctgcgtggagttctcgcggtctgggtttcgctgtctgctcttggcccggggtcattttgtcggcgtcgggtgccctctcttgcccagctggggcacagcgaggcggccccttctcccgacgacgttcgatggagtagggtcccagaccgttgtcccgaagagcgagatcgagcttggccccctcccccccctccttccctccctccttccttccgccgcaacatggctaacaacagccccgcgctgacaggcaactcgcagccgcagcaccaggcggctgcagctgcggctcagcaacagcagcagtgcggcggcggcggcgctaccaagccggcggtctccggcaagcagggcaatgtgctcccgctctggggcaacgagaagaccatgaacctcaaccccatgatcctgaccaacatcctgtcgtcgccttacttcaaagtacagctctacgagctcaagacctaccacgaggtggtggacgagatctactttaaggtcacgcacgttgaaccatgggagaaaggaagcaggaaaacagcgggccagacagggatgtgcggaggggttcgaggtgttggaacaggaggaattgtttctacagcattttgcctgttatacaaattatttaccctgaagttaactcgaaagcaagtgatgggtcttataacacacacagactctccatatattagagcgcttggatttatgtatataagatatacacagccccctacagatctgtgggactggtttgaatccttccttgatgatgaagagttcttcaccctctagcttcttccaaatatcagtattcccacttgcatagaagtgcagaattgaagagttgggtgttacataaataggctaagtgtttggatgacttgttcaaggtgacaaaattttaattccagttttctgactcctagtacaccacacacacctttaaaaaagaaattttttaaattgtaattcgagtctccctaatttgaaatctgaaatactaagttagatttaaatcgtgtatgcattggctgggcgtggtggctcacattgtaatcccaacacttcgagagttcaagaccagcctgagcaatatagtgagacctcatctctacaaaaaaaagtttaaaaattagctgagcatagaggtatgcatcttagtcccacctacttgggaggctggggtgggaggatcacttgagcccaggagacagaatttgctgtgagccaagatcattgccactgcattccagcctgggtaacacagtaagaccctttctcaaaacaaaacaaaatatcatatatgcattaatttacttgcatggtgaagtccaacatgtcaaaaatgaaatgatgagctgtattgtccctatgtctacccagtctactactttgtgttttaaggttcataagactttttgagtgctatgtgtcagtagtctatttacagagttcatccaaagaatttattgaattaaaggatggttctaatggaaatctattgtgttttgttattacatgcacacctaaaaaaaaaaaaaa

SEQ ID NO: 1820 - DNA, 3693 bp, Homo sapiens
gggcagttggcggaagagatcgagctccctggctgccggctcgccttctgcgtggagttctcgcggtctgggtttcgctgtctgctcttggcccggggtcattttgtcggcgtcgggtgccctctcttgcccagctggggcacagcgaggcggccccttctcccgacgacgttcgatggagtagggtcccagaccgttgtcccgaagagcgagatcgagcttggccccctcccccccctccttccctccctccttccttccgccgcaacatggctaacaacagccccgcgctgacaggcaactcgcagccgcagcaccaggcggctgcagctgcggctcagcaacagcagcagtgcggcggcggcggcgctaccaagccggcggtctccggcaagcagggcaatgtgctcccgctctggggcaacgagaagaccatgaacctcaaccccatgatcctgaccaacatcctgtcgtcgccttacttcaaagtacagctctacgagctcaagacctaccacgaggtggtggacgagatctactttaaggtcacgcacgttgaaccatgggagaaaggaagcaggaaaacagcgggccagacagggatgtgcggaggggttcgaggtgttggaacaggaggaattgtttctacagcattttgcctgttatacaaattatttaccctgaagttaactcgaaagcaagtgatgggtcttataacacacacagactctccatatattagagcgcttggatttatgtatataagatatacacagccccctacagatctgtgggactggtttgaatccttccttgatgatgaagaggacctagatgtgaaggctggtggaggctgtgtaatgaccattggagaaatgctacgatcttttctcacaaaactggagtggttttctaccttgtttccaagaattccagttccagttcaaaagaatattgatcaacagattaaaacccgacctagaaaaatcaagaaagatgggaaggaaggtgctgaggaaatagacagacatgttgaacgcagacgttcaaggtctccaaggagatctctgagtccacggaggtccccaagaaggtcaagaagtagaagtcatcatcgggagggccatgggtcttctagttttgacagagaattagaaagagagaaagaacgccagcgactagagcgtgaagccaaagaaagggagaaagaacggcgaagatcccgaagtattgaccgggggttagaacgcaggcgcagcagaagtagggaaaggcatagaagtcgcagtcgaagtcgtgataggaaaggggatagaagggacagggatcgagaaagagagaaagaaaatgagagaggtagaagacgagatcgtgactatgataaggaaagaggaaatgaacgagaaaaagagagagagcgatcaagagaaaggtccaaggaacagagaagtaggggagaggtagaagagaagaaacataaagaagacaaagatgataggcggcacagagatgacaaaagagattccaagaaagagaaaaaacacagtagaagcagaagcagagaaaggaaacacagaagtaggagtcgaagtagaaatgcagggaaacgaagtagaagtagaagcaaagagaaatcaagtaaacataaaaatgaaagtaaagaaaaatcaaataaacgaagtcgaagtggcagtcaaggaagaactgacagtgttgaaaaatcaaaaaaacgggaacatagtcccagcaaagaaaaatctagaaagcgtagtagaagcaaagaacgttcccacaaacgagatcacagtgatagtaaggaccagtcagacaaacatgatcgtcgaaggagccaaagtatagaacaagagagccaagaaaaacagcataaaaacaaagatgagactgtgtgaaaatattttgtaaaagtggatcacattgaatcctataaatgattaaatctgcttttttcccccacgttgagattgtgcagtagttcgcactcctcaagctctccctgtaggctgcattttcatttcctctttcgtgtagggaagtgcctttgtaattccatttattgcattggtgttttcacccaattgttaagtttgatacatgatgcacagattgttcttgcatttttattgtttgtttttgaaatgtacagtctgtacatatgtcctgaaaatgttttaattcctttggcatggttgccatgttggttaaatttgtataaggcaataaactgccactaatctatttttgttttgtaggtgtgggattatggtttgtgtactgaagttagcatggctgtgcttttcgtaatagaatgctaaagactttgagaatggatcttggatgtctattataggagaagtatgtgctgccaatgtacaagaaggcagcattgtaggattaacattcttgtctactgtatattatcttggaaggctcttgttaatatgttacacttaatattctccacagttacctttagagagaatttatgagaagttagtttctgatgcagaggtttttaggctgtgatttcatcaaaagtccttttagcattctacctcaaagggacacttagtatgcctaaaatttattcacttagttttccttttttatttgaaaaaatacatgacatgtaatctttttttcttgaattctttctcagattttaaagtactatattaaagaaaaaaattaatgtctaaagcctagcattcttgcagaaccctatactaacatgtaatggggagagggtggggcagatgagtagagaaacagattcaagcctcaagcttccaaagcatttttataaatggaaaatccttaaattatgaaacagcttgatatagtgtcctttttttaaaattcagaactttttttattgataatggagattgctgtttgagtttttaaacttaatctagaacagaggagtattaaaagtaatgctgtgctgcattatttaagactatcagcaaattatttgatagattgttcttacaacttgtattctgattacagaaccatcatgagtgtggaataaatactggattaaatcctttatcctgggtcttggcttttcccccatttgttaaatttttttagcatatttatattgtggaaattgatgaaacgtcagtagagtcacactttgtgtacagggatgtcttagtgcccagatgacaagtgaattttggagaaatgcatagactgggattgggcatgtggtaatcaataatctttattagaatacttgataatggcagttccctttgtcagtggttgttacatgtgtcatttgattactttgttccatgtcaaagacgtttattgggataccttttacttggacaatatgttagcattttttaaaatttggacttgaaattctttaagataattcacccaattctttttagaaaagaaaatagaggcccaaagtaatgatgtcagtgctagggctaaaactcagtattctgacagtgtagtgaacctggcacgcacattgaggtttgttttatctcactggttatactggccaactaatgcgcactcagaagccaccttgcaaaaatgttaaatggagcaaacgagtacacttgcaagagtcctccatatgtgggcttaacatatgtaccactccattttagaaaaatctcattaaatgaattcttctaaaaa

SEQ ID NO: 1821 - DNA, 2868 bp, Homo sapiens
actgacgcatgcgcatcgtgccctggaccaggcggccgtggcgcgggtggcggctgctgtgctggctgtggggacggaggcggtgaagtgccatcttcggctaggtcgtcacaggctccggctcatggcatcaagtggcatccatcataagatcgttaactgaagacaatatgcaaaattctcacatggatgaatacagaaattctagtaatggcagcacaggcaacagttcagaggtagtggtagaacatcctactgatttcagtactgagattatgaacgttacagaaatggaacagtcacctgatgactctcccaatgtgaatgcatctacagaagaaactgaaatggcaagtgctgtggaccttccagtgacgctgacagaaacagaagcaaatttccctccagaatatgaaaaattttggaaaactgtagaaaataatcctcaggattttacaggctgggtatatttgcttcaatatgtagaacaggagaatcacttgatggctgccaggaaggcatttgacagatttttcatacactatccgtattgctatggttactggaaaaagtatgcagaccttgaaaagcggcacgacaacattaaaccatcagatgaggtttatcggcgggggcttcaggcaatacctcttagtgttgacctttggatacattatataaacttcttaaaagaaacattggaccctggtgatcctgagacaaacaatacaataagaggaacttttgagcatgctgttctagctgcaggaacagatttccgttctgacagactgtgggaaatgtatataaactgggaaaatgagcagggaaacctgagagaagttacagctatatatgatcgtattcttggtattccaacacagctgtatagtcatcattttcagagatttaaagaacatgtacagaataatttgcctagagatcttttaactggtgaacagtttattcagttgcgaagggaattagcttctgtaaatggtcatagtggtgatgatggtcctcctggtgatgatctaccatcgggaattgaagacataaccgatcctgcaaagctaattacagaaatagaaaacatgagacatagaatcattgagattcatcaagaaatgtttaattataatgagcatgaagttagtaaaaggtggacatttgaagaaggtattaaaagaccttactttcatgtgaaacctttggaaaaggcacaactaaaaaactggaaagaatacttagaatttgaaattgaaaatgggactcatgaacgagttgtggttctctttgaaagatgtgtcatatcatgtgccctctatgaggagttttggattaagtatgccaagtacatggaaaaccatagcattgaaggagtgaggcatgtcttcagcagagcttgtactatacatctcccaaagaaacccatggtgcatatgctttgggcagcttttgaggaacagcagggtaatattaatgaagccaggaatatcttgaaaacatttgaagaatgtgttctaggattggcaatggttcgtttacgaagagtaagtttagaacgacggcatggaaatctggaagaagctgaacatttgcttcaggatgccattaagaatgccaaatcaaataatgaatcttcattttatgctgtcaaactagcccggcatcttttcaaaatacagaaaaaccttccaaaatcaagaaaggtgcttttggaagcaatcgaaagagacaaagagaacacaaagttatacctcaatttacttgaaatggaatatagtggtgacctcaaacaaaatgaagaaaatatcctaaattgttttgacaaagctgtacatggttcattacctattaaaatgagaattacattttctcagagaaaagtggaatttcttgaagattttggttccgatgttaataagcttctgaatgcttatgatgaacatcaaacactcctgaaagaacaggattctttaaaaaggaaagcagaaaatggatcagaagaaccagaggaaaagaaagcacatacagaagatacaacttcatcatctacacagatgattgatggtgatttacaggcaaaccaagctgtatataattatagtgcgtggtatcaatacaattatcagaatccttggaattatggacaatattatcctccccctccaacctgatgggaaaaatgtaaatttcaaatgcagtgtgtgaaaagtatgaaattattattttttttaatgagggatgtaaacagtataagcttgttgtatttgataacctgtcttccttgtttctgtgtaacatgatttgtttagtaatagggggaaaatgtcaattagtagcttaccacagatactgtttcctaccatttataaaatttactttttattgaaaaactattttttgatttttgcattaagtggtctagaattcttttgcaatgcatttgcaacagaattttgtagccttaaggggtaggaagaaaaacctgactgcaaatcatgtcagtgtagtacaaaattctgaaaacacataagggctggttatttacctccttttttttttttttttttaaagaaaaaaggacttttaacctttgctgacaaggttttgtctgtttcagttatacttgtgaattgtgatctaactgcagaaaggatacattattaaaatactttgccttggaatagattataaatgagaaaatggaatgtttgcatccctttaaaaatgaaaatcatatcaaaagtatgttgtttcaggagactttgtatttagaatattcatgtaaaacttgtgaacaagctttcattttgatcaaactgatcttcatttttgtaataaaacggaagactcatccagtaa

SEQ ID NO: 1822 - DNA, 2331 bp, Homo sapiens
atgcagggactgctgcgctttgaagatcaagactctgcacgtggggatcagaacattgccatgttctatccaacctccacccaaatggtttatcggcgggggcttcaggcaatacctcttagtgttgacctttggatacattatataaacttcttaaaagaaacattggaccctggtgatcctgagacaaacaatacaataagaggaacttttgagcatgctgttctagctgcaggaacagatttccgttctgacagactgtgggaaatgtatataaactgggaaaatgagcagggaaacctgagagaagttacagctatatatgatcgtattcttggtattccaacacagctgtatagtcatcattttcagagatttaaagaacatgtacagaataatttgcctagagatcttttaactggtgaacagtttattcagttgcgaagggaattagcttctgtaaatggtcatagtggtgatgatggtcctcctggtgatgatctaccatcgggaattgaagacataaccgatcctgcaaagctaattacagaaatagaaaacatgagacatagaatcattgagattcatcaagaaatgtttaattataatgagcatgaagttagtaaaaggtggacatttgaagaaggtattaaaagaccttactttcatgtgaaacctttggaaaaggcacaaaaaaaactggaaagaatacttagaatttgaaattgaaaatgggactcatgaacgagttgtggttctctttgaaagatgtgtcatatcatgtgccctctatgaggagttttggattaagtatgccaagtacatggaaaaccatagcattgaaggagtgaggcatgtcttcagcagagcttgtactatacatctcccaaagaaacccatggtgcatatgctttgggcagcttttgaggaacagcagggtaatattaatgaagccaggaatatcttgaaaacatttgaagaatgtgttctaggattggcaatggttcgtttacgaagagtaagtttagaacgacggcatggaaatctggaagaagctgaacatttgcttcaggatgccattaagaatgccaaatcaaataatgaatcttcattttatgctgtcaaactagcccggcatcttttcaaaatacagaaaaaccttccaaaatcaagaaaggtgcttttggaagcaatcgaaagagacaaagagaacacaaagttatacctcaatttacttgaaatggaatatagtggtgacctcaaacaaaatgaagaaaatatcctaaattgttttgacaaagctgtacatggttcattacctattaaaatgagaattacattttctcagagaaaagtggaatttcttgaagattttggttccgatgttaataagcttctgaatgcttatgatgaacatcaaacactcctgaaagaacaggattctttaaaaaggaaagcagaaaatggatcagaagaaccagaggaaaagaaagcacatacagaagatacaacttcatcatctacacagatgattgatggtgatttacaggcaaaccaagctgtatataattatagtgcgtggtatcaatacaattatcagaatccttggaattatggacaatattatcctccccctccaacctgatgggaaaaatgtaaatttcaaatgcagtgtgtgaaaagtatgaaattattattttttttaatgagggatgtaaacagtataagcttgttgtatttgataacctgtcttccttgtttctgtgtaacatgatttgtttagtaatagggggaaaatgtcaattagtagcttaccacagatactgtttcctaccatttataaaatttactttttattgaaaaactattttttgatttttgcattaagtggtctagaattcttttgcaatgcatttgcaacagaattttgtagccttaaggggtaggaagaaaaacctgactgcaaatcatgtcagtgtagtacaaaattctgaaaacacataagggctggttatttacctccttttttttttttttttttaaagaaaaaaggacttttaacctttgctgacaaggttttgtctgtttcagttatacttgtgaattgtgatctaactgcagaaaggatacattattaaaatactttgccttggaatagattataaatgagaaaatggaatgtttgcatccctttaaaaatgaaaatcatatcaaaagtatgttgtttcaggagactttgtatttagaatattcatgtaaaacttgtgaacaagctttcattttgatcaaactgatcttcatttttgtaataaaacggaagactcatccagt

SEQ ID NO: 1823 - DNA, 3602 bp, Homo sapiens
ggctcggggcggtcccacagcgccccctgcggcccgggccgtggccgatggggcggggaggccgctggggatagctgggaccccggggagggcgagggaggccaagggtgagggaagagagcccgggaggggggatgggggcggggactgggggcgaaggggcgggggaggccatgatggagcctggccgggggcgaaaggtgcgagagtggcgggactgggtgaagagtgggattgggagaggtgggggtgggttcgcggagaaagatcgggaaagaagagagagggcggagatgaggggactgaggggaccaggggacaggtggggaccagtttcccctcctgggatatttggtgtgcgacatgcccttcccccagccccagcgcccgttccctttggaagcctgggtgctcctcagaccacttggggactccctgcttcaccttcctgcatttgcaagagcttgtctcctgaggtggagagggggcctctgaagaaaggggctcccagcccaggccatcaacaaactaacgactctgtgtgaccttggatgccccctccagggatccccccaccctttcctccgatggggctaccccccatgagtcagagaccaccagctatcccccccatgccacctggcatcctgcccccaatgcttccaccaatgggggcgccaccaccactcacacagataccaggaatggtacctccgatgatgccaggaatgctgatgccagcggtgcctgtcaccgcagcgacggctccgggtgcggacaccgccagctctgctgtggctgggacaggccctccgagggccctatggagtgagcatgtggccccagatgggcgcatctactactacaatgctgacgacaagcagtccgtgtgggagaagcccagcgtgctcaagtccaaggcagagctgctcctgtcccaatgtccctggaaagagtacaagtcggacacaggcaaaccttattactataacaaccagagtaaagagtcccgctggacccggcccaaggatctggatgacctagaggttctagtcaaacaagaggctgcagggaaacagcagcagcagctgccacagacacttcagccacagccacctcagccacagcctgaccccccacctgtgcctcctggccccaccccagtgcccacaggcctcctggaacctgagccaggtgggagtgaagattgtgatgtgttggaggccacccagcccctggaacaggggttcctgcagcagctggaggagggccccagcagttctggacagcatcagccacagcaggaggaggaggaatcaaagccagaaccagagaggtctggcctcagttggagcaaccgggagaaggcaaagcaggcattcaaggaactgctgagggacaaggctgtcccctccaatgcctcatgggaacaggccatgaagatggtggtcaccgacccccgttacagtgccttgcctaaactgagtgagaaaaagcaggcattcaatgcctacaaggcgcagcgggagaaggaggagaaggaggaggcccggctaagggccaaagaggccaagcagaccctgcagcatttcctggagcagcatgaacgcatgacctccaccacccgctaccggcgggcagaacagacctttggggagctggaggtctgggctgtggtccctgagagggatcgaaaagaggtttatgatgatgtcctcttcttcctggccaagaaggagaaggaacaggccaagcagctccggcgccgcaatatccaggccctaaagagcatcctggatgggatgagtagtgtcaacttccaaaccacgtggtcccaggcccagcagtacctcatggataaccccagctttgctcaggaccatcagctgcagaacatggacaaggaagatgcactgatctgttttgaggagcacatccgagctttggagagggaagaggaggaggaacgggagcgggcccggcttcgggagcgacgccaacaacgcaagaatcgggaggccttccagaccttcctggacgagctgcatgagacagggcagctgcactctatgtccacctggatggagctatatccagcagtcagcactgatgtccgctttgccaacatgctgggccagccgggctccacccctctggacttattcaagttctatgtggaggagttgaaggcacgattccatgatgaaaagaagatcattaaggacatccttaaggtgaacacggcctttgaggacttcgcccacgtcataagctttgacaagagggctgccgcactggacgcaggcaacatcaagctgaccttcaatagtctgctggagaaagcagaggcacgggagagggagcgggagaaggaggaggcacgcaggatgcggcgcagggaagctgcctttcgaagcatgctgaggcaggctgtgcctgctctggagctaggcactgcctgggaagaggtccgtgagcgttttgtgtgtgactcagcctttgagcagatcaccctggagtcggagcggatccggctcttccgggagttcctacaggtgctggagcagactgaatgccagcacctccacaccaaaggccgaaagcatggcaggaaaggcaagaagcaccatcacaagcgttcccactcaccctcaggctctgagtcagaagaagaggagctgcccccaccatctctccggccccccaagcggaggaggcggaacccctcagagtcaggctctgagccctcttcctcacttgattcagttgaaagtgggggtgctgcccttggaggacggggctccccttcctcccatcttcttggagcagatcatggccttcggaaagccaagaaaccaaaaaagaaaactaagaagagaagacacaagtcgaatagtcctgagagtgagacagaccctgaggagaaagctggcaaggagagcgatgagaaagaacaagaacaggacaaggacagggagctccaacaggcagagctccctaaccgttccccaggctttggaatcaagaaggagaagacaggctgggacacgtcagaaagtgagctgagtgagggtgagctggagaggcggcggcggacactcctacagcagctggatgatcaccagtgacccaatgagctgttctctgcctcgggtctgtgtgaggccatggctcctgggccaccctcaccgtctgcctcagacttcttccttagtctggtctgtgtccactttttctaaagtaaccccacccccagcacaccattgttggcacctctcaaggttgctcttggtgttcaagggtcccctactccctggactagtgcagtccttgccctcagccccagaccagagatgggtggtatatgccatgtggggtgggtgatgccagtagataaaagtgtgagagaaggggtctccagggaagagtcacaggctgttggacgcagcctgggtggcagagggcagggtcatcaccctctagcatcagtgcctgctcctgcctgccctggccctgaggctccaccacttcttcctccacccaggacctaatgtacgtgtgttttgttttttgttttttaaataacaatatttataacatgg

SEQ ID NO: 1824 - DNA, 3154 bp, Homo sapiens
gtcggttcccgattctggtccccggcccccagcagcgcctgcccccttcccaccggggccccccatgatgccaccacccttcatgccccctccagggatccccccaccctttcctccgatggggctaccccccatgagtcagagaccaccagctatcccccccatgccacctggcatcctgcccccaatgcttccaccaatgggggcgccaccaccactcacacagataccaggaatggtacctccgatgatgccaggaatgctgatgccagcggtgcctgtcaccgcagcgacggctccgggtgcggacaccgccagctctgctgtggctgggacaggccctccgagggccctatggagtgagcatgtggccccagatgggcgcatctactactacaatgctgacgacaagcagtccgtgtgggagaagcccagcgtgctcaagtccaaggcagagctgctcctgtcccaatgtccctggaaagagtacaagtcggacacaggcaaaccttattactataacaaccagagtaaagagtcccgctggacccggcccaaggatctggatgacctagaggttctagtcaaacaagaggctgcagggaaacagcagcagcagctgccacagacacttcagccacagccacctcagccacagcctgaccccccacctgtgcctcctggccccaccccagtgcccacaggcctcctggaacctgagccaggtgggagtgaagattgtgatgtgttggaggccacccagcccctggaacaggggttcctgcagcagctggaggagggccccagcagttctggacagcatcagccacagcaggaggaggaggaatcaaagccagaaccagagaggtctggcctcagttggagcaaccgggagaaggcaaagcaggcattcaaggaactgctgagggacaaggctgtcccctccaatgcctcatgggaacaggccatgaagatggtggtcaccgacccccgttacagtgccttgcctaaactgagtgagaaaaagcaggcattcaatgcctacaaggcgcagcgggagaaggaggagaaggaggaggcccggctaagggccaaagaggccaagcagaccctgcagcatttcctggagcagcatgaacgcatgacctccaccacccgctaccggcgggcagaacagacctttggggagctggaggtctgggctgtggtccctgagagggatcgaaaagaggtttatgatgatgtcctcttcttcctggccaagaaggagaaggaacaggccaagcagctccggcgccgcaatatccaggccctaaagagcatcctggatgggatgagtagtgtcaacttccaaaccacgtggtcccaggcccagcagtacctcatggataaccccagctttgctcaggaccatcagctgcagaacatggacaaggaagatgcactgatctgttttgaggagcacatccgagctttggagagggaagaggaggaggaacgggagcgggcccggcttcgggagcgacgccaacaacgcaagaatcgggaggccttccagaccttcctggacgagctgcatgagacagggcagctgcactctatgtccacctggatggagctatatccagcagtcagcactgatgtccgctttgccaacatgctgggccagccgggctccacccctctggacttattcaagttctatgtggaggagttgaaggcacgattccatgatgaaaagaagatcattaaggacatccttaaggaccggggcttctgcgtggaggtgaacacggcctttgaggacttcgcccacgtcataagctttgacaagagggctgccgcactggacgcaggcaacatcaagctgaccttcaatagtctgctggagaaagcagaggcacgggagagggagcgggagaaggaggaggcacgcaggatgcggcgcagggaagctgcctttcgaagcatgctgaggcaggctgtgcctgctctggagctaggcactgcctgggaagaggtccgtgagcgttttgtgtgtgactcagcctttgagcagatcaccctggagtcggagcggatccggctcttccgggagttcctacaggtgctggagcagactgaatgccagcacctccacaccaaaggccgaaagcatggcaggaaaggcaagaagcaccatcacaagcgttcccactcaccctcaggctctgagtcagaagaagaggagctgcccccaccatctctccggccccccaagcggaggaggcggaacccctcagagtcaggctctgagccctcttcctcacttgattcagttgaaagtgggggtgctgcccttggaggacggggctccccttcctcccatcttcttggagcagatcatggccttcggaaagccaagaaaccaaaaaagaaaactaagaagagaagacacaagtcgaatagtcctgagagtgagacagaccctgaggagaaagctggcaaggagagcgatgagaaagaacaagaacaggacaaggacagggagctccaacaggcagagctccctaaccgttccccaggctttggaatcaagaaggagaagacaggctgggacacgtcagaaagtgagctgagtgagggtgagctggagaggcggcggcggacactcctacagcagctggatgatcaccagtgacccaatgagctgttctctgcctcgggtctgtgtgaggccatggctcctgggccaccctcaccgtctgcctcagacttcttccttagtctggtctgtgtccactttttctaaagtaaccccacccccagcacaccattgttggcacctctcaaggttgctcttggtgttcaagggtcccctactccctggactagtgcagtccttgccctcagccccagaccagagatgggtggtatatgccatgtggggtgggtgatgccagtagataaaagtgtgagagaaggggtctccagggaagagtcacaggctgttggacgcagcctgggtggcagagggcagggtcatcaccctctagcatcagtgcctgctcctgcctgccctggccctgaggctccaccacttcttcctccacccaggacctaatgtacgtgtgttttgttttttgttttttaaataacaatatttataacatgg

SEQ ID NO: 1825 - DNA, 531 bp, Homo sapiens
gctaattgaggcgacccggggaggggcgggaccgcggactggatttcgacttccaaattcccacgaggtataggagtctgagggttgcacaggaccttatgcattgtttgactcctccagagcctttagagaaacttctatcaggcccgcctgctaggcactagtcggggagataatgtagccagggagatgtggcggacagaaagggcagagaggctctctgaggagcggatggaggatcgtgggccgctttactgagaaggaagagaccctgcgagaaggagtagtgtcgacttggtcccgtcagccggaccccacctggacggctggggccacttgtggtcgccgggaggtgtcacctctaactcttcgtgtcaggagtttttctacctctccggagttctttggctctcaggaacctagcacggcatcacgcgagtcccggctcagtcggttcccgattctggtccccggcccccagcagcgcctgcccccttcccaccggggccccccatgatgccaccacccttc

SEQ ID NO: 1826 - DNA, 1843 bp, Homo sapiens
gcacagtgacagcttcctttctcggaaacgcggcgcggccggctgccggaaaacagggcagacctgtatggttcgtttattcctggggttgtcatatcatggcttataatgacacagacagaaaccagactgagaagctcctaaaaagagtacgagaactggagcaagaggtgcaaagacttaaaaaggaacaggccaaaaataaggaggactcaaacattagagaaaattcagcaggagctggaaaaactaagcgtgcatttgatttcagtgctcatggccgaagacacgtagccctaagaatagcctatatgggctggggataccagggctttgctagtcaggaaaacacaaataataccattgaagagaaactgtttgaagctctaaccaagactcgactagtagaaagcagacagacatccaactatcaccgatgtgggagaacagataaaggagttagtgcctttggacaggtgatctcacttgaccttcgctctcagtttccaaggggcagggattccgaggactttaatgtaaaagaggaggctaatgctgctgctgaagagatccgttatacccacattctcaatcgggtactccctccagacatccgtatattggcctgggcccctgtagaaccaagcttcagtgctaggttcagctgccttgagcggacttaccgctattttttccctcgtgctgatttagatattgtaaccatggattatgcagctcagaagtatgttggcacccatgatttcaggaacttgtgtaaaatggatgtagccaacggtgtgattaattttcagaggactattctatctgctcaagtacagctagtgggccagagcccaggtgaggggagatggcaagaacctttccagttatgtcagtttgaagtgactggccaggcattcctttatcatcaagtccgatgtatgatggctatcctctttctgattggccaaggaatggagaagccagagattattgatgagctgctgaatatagagaaaaatccccaaaagcctcaatatagtatggctgtagaatttcctctagtcttatatgactgtaagtttgaaaatgtcaagtggatctatgaccaggaggctcaggagttcaatattacccacctacaacaactgtgggctaatcatgctgtcaaaactcacatgttgtatagtatgctacaaggactggacactgttccagtaccctgtggaataggaccaaagatggatggaatgacagaatggggaaatgttaagccctctgtcataaagcagaccagtgcctttgtagaaggagtgaagatgcgcacatataagcccctcatggaccgtcctaaatgccaaggactggaatcccggatccagcattttgtacgtaggggacgaattgagcacccacatttattccatgaggaagaaacaaaagccaaaagggactgtaatgacacactagaggaagagaatactaatttggagacaccaacgaagagggtctgtgttgacacagaaattaaaagcatcatttaaccatagacaatttgccaggatctaggaaccacctaatggtaggtggacagaaaaggaaaaaaaaaaaaatttacttgcaagtactaggaattcagatgatcagctcttaaaagaaaaaaaaaagcaaaaagactaaagccctattaaggaagttattgctttaataagaaatttcaaatattctcttatcccggtccaaaaggattaagcgattaaagaacgtaaaatggagatgtatttacatacacctggaaacctgtgccttgtattcaaattcattaaagcctaatcctgcaagt

SEQ ID NO: 1827 - DNA, 1790 bp, Homo sapiens
acagggcagacctgtatggttcgtttattcctggggttgtcatatcatggcttataatgacacagacagaaaccagactgagaagctcctaaaaagagtacgagaactggagcaagaggtgcaaagacttaaaaaggaacaggccaaaaataaggaggactcaaacattagagaaaattcagcaggagctggaaaaactaagcgtgcatttgatttcagtgctcatggccgaagacacgtagccctaagaatagcctatatgggctggggataccagggctttgctagtcaggaaaacacaaataataccattgaagagaaactgtttgaagctctaaccaagactcgactagtagaaagcagacagacatccaactatcaccgatgtgggagaacagataaaggagttagtgcctttggacaggtgatctcacttgaccttcgctctcagtttccaaggggcagggattccgaggactttaatgtaaaagaggaggctaatgctgctgctgaagagatccgttatacccacattctcaatcgggtactccctccagacatccgtatattggcctgggcccctgtagaaccaagcttcagtgctaggttcagctgccttgagcggacttaccgctattttttccctcgtgctgatttagatattgtaaccatggattatgcagctcagaagtatgttggcacccatgatttcaggaacttgtgtaaaatggatgtagccaacggtgtgattaattttcagaggactattctatctgctcaagtacagctagtgggccagagcccaggtgaggggagatggcaagaacctttccagttatgtcagtttgaagtgactggccaggcattcctttatcatcaagtccgatgtatgatggctatcctctttctgattggccaaggaatggagaagccagagattattgatgagctgctgaatatagagaaaaatccccaaaagcctcaatatagtatggctgtagaatttcctctagtcttatatgactgtaagtttgaaaatgtcaagtggatctatgaccaggaggctcaggagttcaatattacccacctacaacaactgtgggctaatcatgctgtcaaaactcacatgttgtatagtatgctacaaggactggacactgttccagtaccctgtggaataggaccaaagatggatggaatgacagaatggggaaatgttaagccctctgtcataaagcagaccagtgcctttgtagaaggagtgaagatgcgcacatataagcccctcatggaccgtcctaaatgccaaggactggaatcccggatccagcattttgtacgtaggggacgaattgagcacccacatttattccatgaggaagaaacaaaagccaaaagggactgtaatgacacactagaggaagagaatactaatttggagacaccaacgaagagggtctgtgttgacacagaaattaaaagcatcatttaaccatagacaatttgccaggatctaggaaccacctaatggtaggtggacagaaaaggaaaaaaaaaaaaatttacttgcaagtactaggaattcagatgatcagctcttaaaagaaaaaaaaaagcaaaaagactaaagccctattaaggaagttattgctttaataagaaatttcaaatattctcttatcccggtccaaaaggattaagcgattaaagaacgtaaaatggagatgtatttacatacacctggaaacctgtgccttgtattcaaattcattaaagcctaatcctgcaag

SEQ ID NO: 1828 - DNA, 9065 bp, Homo sapiens
ggcggcctagaagatggcggacggcgacagcggcagcgagcgcggcggcggcggtgggccgtgcgggttccagcccgcgtcccgcggcggcggcgagcaagagacgcaggagctggcctcgaagcggctggacatccagaacaagcgcttctacttagatgtgaagcagaacgccaagggccgcttcctcaagatcgccgaggtgggcgcgggcggttccaagagccgcctcacgctgtccatggcggtggccgccgagttccgcgactcgctgggcgacttcatagaacactacgcgcagctgggccctagcagccccgagcagctggcggctggcgccgaggagggcggcgggccgcggcgcgcgctcaagagcgaattcttggtgcgtgagaaccgcaagtactacctggacctcaaggagaaccagcgcggccgcttcctgcgcatccgccaaacggtcaaccgcggcggtggcggcttcggcgcgggccccgggccgggcggcttgcagagcggccagaccatcgcgctgcctgcgcagggcctcatcgagttccgcgacgcgctggcgaagctcatagacgactacggaggcgaggacgacgagctggcaggcggcccgggaggcggcgccgggggcccagggggcggcctgtatggagagctcccggagggcacctccatcaccgtggactccaagcgcttcttcttcgatgtgggctgcaacaaatacggggtgtttctgcgagtgagcgaggtgaagccgtcctaccgcaatgccatcaccgtacccttcaaagcctggggcaagttcggaggcgccttttgccggtatgcggatgagatgaaagaaatccaggaacgacagagggataagctttatgagcgacgtggtgggggcagcggcggcggcgaagagtcagagggtgaggaggtggatgaggattgaaacgggcagcttcccctacaggcctccacccaaccaccatccccttggctagagaattccctttcctgctcatccccagtgagctagtggagagggagcaagggaggccgcagagggaaaaaacaaaacgtaacacagttaagagaaataatcgtaagagaacagtgacggacaacttgagaaaagcagtcaagttccaaggaactgacagcaacctgcaaagaggaaaacagcatctcctcacctgcgtaaaattgtctcagcttctgttgtttctcaactgaggttcgtaaacccatcaggataatccctggagggaatagatccttgcacatccagggcaagaaacatgtccaagttacccagaccattgataacagttgcatttaggttgcacctgggtaatctggcataaaagatctctctaggcctcactgttgcggtgtctatcccttcacctccattgaaatcagcattttggatctaggtcttcatggaatccttgagaagagaggcctttacaattacccagttctgagggttcaggttcacgaaaagaaatgcaacttgggataatcatgaacaggttaaagataagatttcaagaagccatctaagaatacagaaccaaattggatccatttttttaaaaaaatggttttgcatggaacctggaccaaggcaaatgtcttttcttcgcagaattgttttccaggatgccagtggattcagatagcaatgcttggagtagaatccgttactaaaatagtttcaaagttgacaaaaaattttcaaagataaaagcagttttacattgggggttgctgaggtaggcacaagaaaaagtcaggcataaagcacaaggcagactgtttgagtggattggttgctgctcactaaagttgttcccctgatctctaaatatggaggtcattaccaagaaatgctttggtatgaatgagagccagatctccactgtgtgagccagtgaattatggctaattcggctgttacagccactggttggctggattttaaaccataaaacttgaagattacctacaaaagtaacagtgtggctataagcctgagctttaatggatatacatcctcacagaaaagttggaaataaccaaaactgaagtcttaatttaccttcagtttaatctgtggatttgttcaaatactaaagatcctcaggtccagaattccagcatcatttattcttttaaaatttttaagaacttgatccattgtatcagtacctcacaatcagagttggcaaatgatggatgagtgattcaagcagtgcacccggtggaagctgaaatccatctgtgaatggaactgaagtgaacgtgaatatgctgactatatcctggaagcatttttataccatcttgaaatttcaacaaactggcttttgccagttaatccagctgtctttcaagaataaaagttggggttttcaaggatcgcctcttctatattttaaatggattttcagtagaaatgatttttactaatcaagttaatcccaccccatcaaaaggtattcctagaaatgtcatagacctaggtaactttgaattgaatgggagctaacgttctttccaaagttttcaggtattctttgtgtgacaccttctcaaccaggaggcaagtaaccccgcctccacaatcttagtattttttttaaactgcatgcctgccccttatttgagctgcctttttaatttattgcatatcctttttattatcttattttggtattattcaatctatacaatctttttgtatttattgggaaatgagtaatatacaaaaaggttttcatgtatttgtggctgagagggcgggaaataattgtgtacataaaattaggcttttttaaaaaaatagattatgatgcagaatattgttgatcttagattaaaaagtggaagagccacaaacattggtgcccttttcagactatttctctactctcatcatccacagtagaatttttaaacagatttttttaaagcttttcttttaaatttttctccgttgcaaagaatgtttcctaaattgtatgggagcaatagtatttttgatgttttaatgacatccgtatacttgtactgtattttgtactacaaggcagctgtttttcaataatgtcctgctgtatttacctacgtgttttgagtgtctatttctttgctgcggagaacaaattcctaaatagttttagtaaaggagctgagaagctagcattaggtttgcagaaactatttaagtttcaactctgaggcagcaatgaaaatttaagttgcagctattagttgattgctgtaactttttcattttcaaaccatgtacaattcttgtatagaccaacttgttttcttgcttcagtggtggttctgttgctcagctgcagtgagccagttcaattttgcaaaggtgcagtacctctcctttttaaggggttggtttattcttttttctttttgtttggctgaattgcagtaactagccttgcctttctattctgtagaaatgacagggtcttcacaatccttcaccagtggctactaagctataattagctgaatagaaagaatgtggaagtggtctgaggcatatagagtatatgccaagaacactaccatatatggcatcagctttggttaccagagaaattttcttagtcattagaccatgtaacagtaatatatcatatgtaaatctttagatatcaatttgaaaatcctccaaaaaaaggagcaaagaatgcataagctatgtgttggcaaaagtaatttatattaaaattttgacctgcctatgtaagattaagtggtaatgtcatagtggtgggtttttaagtcttaaccaatctctaaggtttgtttctcctgcaagggatggttcatggcctctcttcccactgcaggaagattgcagaaggctgtggattaattgtagcatttcactgatcttcactccagtcactagggacaatagaaacctgcaaaacacagattcattcgtaaatattattaatagcttattaaaggaaatggtctttgttaattccagtcagataatggcattgtacagacatgggaaacaaccaatttttttgtttttcagttgttgctatgaatgattttgagcctttttttttaagcttggcaaacatcccagctaatcaaaatagtcatattcctgagaagtaggaaactaaaacttcttttcatataattgttagaaggtttgtttcccaaactaccatagttacaaaggtgaaaagccaaattttaggaacagaatcaaaagaataaaaatctgtgaagagatcctactactcttccttctatgttttggttttggtttctattgtccctatcatttcagcaagtggaacagcagcaagtttttcagtgcatatgctgcacaagaacaaaatataaatctgtatggcaccaaaaatcaaagtgaaaaccaaaccaaaaacccaaacaccctatgtaactatcggaggcatatacgtggtataaatgactgtagctgtgatacacacatggctacttgtcacatcactttccataattatttactgcaaaatgattgagaggcttttggtgcaggcagccgttaacctcctgcttcctttgttacctctggattactttgcagtaaattgcaggtcttttaagagatttaagcttcagttttctcaaaacaaaacaattatcctgtcttatctgaagatgcagggttgtgggcaaaagaggctggttataataatgccctcatattgagtggtctgtaaacggctgcacacttcaggcactgtagttgctgaagatgctttgttaaatgtgaccttgactggctttacaggggtgtagaatgtaatctacacaaggtgactttgcatctatcttgctcttgaggtggatgaaattgagaagctggagtgtgtaagccatgcacataagtattcttcactgtaaattttgttttcatttttaacccaattatggtactttatccaatgcacaactgatctctcagtagatattcatttgaaaatagtgtggccttgatcagtgagaaagggaaggagaaaagtgacttttttgcttatgtagaaatgactcatttgctgagagtttgtctttctgcagcactcttggtatatagtgatcggtctcctttttgattggggaaagttaatgtttttgaccctggagttaattcagttgagttatcttatatttttaggaagtatcagaattgctctgatgaataacaaagttgactgttttgatgtccaatctcaggttttagaatatagtggtgtaaagtcccactatttttaattcttaaaacaactttaatttcgtacaccctaaaagtcacatgcataaggcctgttcagagagcagagcctccatctttttgctccttttctactttgtacttcacttgaaaaaatatcaagtgactttacattgtatatttccattgtaaccctgacatttctcaaagataaagcactttttgatcatgaaatacatgaaatctttgtgtgatgtggatcatagtttctcaggctcccttagataattgcttatgaatattgttctaactctgtgtaagaagagtagaaatctttgctaatgttagaaggtttgtattattgatccagaatgcattttgctagtttccaatggatgggagagtaaataatgctgcattcacaatttaataagttactttcccttgagccttaaggtaactttttctttcctgtcaactacagcactgaagttatagtaagtgaatgagattatcagttttcagggttggttttagagtactgtaaatcaattagctgtcttcctaaagagttacaactcccattcagtatactggataatgggtgtgtgggtggggctggggagggcgggagatagtttgtagaaaagaaaaaagaaaaaaaaaaaaacacatttaccttaagaaaatacagacaaaaaagaataaagtatgtgtcatatgctccatttgagattccaaatgcggccgggcgtggtggctcacgcctgtaatcccagcactctgggaggctgaggtgggcgggtcagttcaggtcagcctggacaacatggtgaaaccccgtctctactaaaaatactaaaattagccgggcatggtggtgcatgcctgtagtcccagctacttgggaggctgaggcaggagaatggcatgaacccaggaagcggaggttgcagtgagccaagatcgcgccattgcactccagcctgggtaacagaacaagactccgtctcaaaaaataaataaataaattccaaatgtaaggtggaaatggcagattataacttcatttcccccatttttaacttagaaaaaacaaagtccttaattttcaagtattagccccccagaagtttcagcagatagctggactcttgaataatgatttcttttgatatgtctgactttgctatttaaagtctcctttcccagccctcagtcttaaaactcagttttattactgacggatttaacagactcttacttgaaaattgtccaattatcagtactgaaaattagatttggaaaatgaaaaaataataaaatcgcatcaagaaaacttattaccttagagattcccaattgatatctgtacccctgatccaagtaaggcctttatgaatgtattttatatttcctaaagaaatagggaatatgccatcagtgtaatcacctctattcacagtcatttaatttgaaaatctaactcatgtctcttgaattagacattccaattgggataggtagagtcatgttaaaacaatagaatagcaactgccatattggtagtttcactgctcaatatgatttctaataagagcagagctttattggaagctaaaactcatttttctccatagatgattctaacagtttaataaaaaagtataattatactttaagtgtcaacagattttgagtctagaagcaaatttcattttccttgtgttatatctaatatccattgacatgggtaagaaaactaattatgtctttttagtatgatgaaatgtgggcccagagtattggaaagaaagcaatagccctattcagtgtccactaggatggatattgcagaaggcatgagtttgtccttttttcccccttaccttaaataacacttcaatagctaactttttccaaaatatccatttaggccatctcttatttcttaaagccaaatatttcgtccccagtcttaactctgagttgcaagatcaggctggttggaagaatctttatatttagaaataggatggtgagtggtttgtttattctcttgtaaaattcctttttcagagacataactgcagggagagtcccaagagaactgaagaactggattatatcattaaacacatttgtgttgtaggaatttgggagtttcattttgaactgataagatattagacataaacccttgttccagcccacatgtgtcatccctgtgtacaaaagctctctggattctttttttttttttgagacggagtttcgctcttatcgtccaggctggagtgagtgtagtggcttgatctcagctcactgcaacctttgcctcccgggctcaagcgattctcctgcctcagcctcccaagtagctgggattacaagcatgtgccaccatgcccagctaattttctgtatttttagtagagacggggtttcaccatgttggccaggctggtctcgaactcctgacctcaagtgatctgcccgcctcagcttcccaaaatgctggaattacaggcatgagccatcacgcctagcctactctctgaatttctaaaagtcagtaggttgaccaaaaagtctagaaactggctttaagtcagtatgggacgtacttataaagagtccatggttttgcacgtttcggtagacaagtaaatctgagttatttttcaatgacttaccaatatttgaatagtaactaagatcgtcagtgtatctggacttctttttttgaagttctaaaacaattatagtagggatttattattttgggcctccatccagatgtttttccaagatcatttttaaaattcatttgtcttctgtttccagataacatactttccgttctataggaatcttcactgccaatcatagtatctaccagtggctttcttagactattcactccaaagctgggactgatgtcctgccagtagagaatctacagaaataatttgaatgaattaaaaccaaatcttgatagcaggagacagcttcctgatctagatgtacaattagagtttaggttggaaattactttaaaatgtgttttttggggatgtcttcaatctctgtgtaaatacccacatgcttatgcattgtaaaccaagtgtgtattcctgtgtatgaatttgtagaactgatttctgcttcaagagaagctgcacctttaattttataaggtcccctccacctgtaaccctataaatgtctgtaaataaaacactaaaatttgtagtgataggatcaatttgggaatatctgctgagagaccaaaaagttcatttttttaagtaccttggttaaagagtaaagattattcctcttattttttaaagaagaatgcactttaacaaacatagagctgcatgggcaattcaaacaaatctgtgaagtgcagtacccattcagaaatcacacttcctgaaaaccgttcaaaagcagagtccagacgggctgttgatctcactgcctgtaggttgaagctcagattctgatcaattttgagaggagcagggctgcttcaaaagagcaatgtgaatacagtcagaagcttcagactggtctgtaaaaatggcgggtcccgtatttaccactaactagcaaaactgacagaaaaactcacagagaaaaaatgtaagaatccttcctgctggtgtgcactccttacaatagacttttgcaaatggagttttacagtctatatttaaaaaaaattgtatgtttgtaacaaataaagtatgcagaaaagtgaatg

SEQ ID NO: 1829 - DNA, 2690 bp, Homo sapiens
ctttctcgcggcgctgcaaccctcccaccacagcccatccagccccgcccagcgcgccgcggtgcgcatgcgtggaggccctcgctgccgctgagcacctcgggaagtgtagtctcttcgcaggtgcggctgggcagctagagtcctgcatcccggtggaatccggagaagtgagaacattcccgccgcccggtcctcattcccatcttcccacctgtccagtcccctcgcactcccgctgcaccccacgcgccgggcttcagtcagagagtgcactgaggaagagcggagaccccctcttcccctcagcaggctgtgccgggggaggcggggtccaccgcccgccccccgccgtcgctctccccgcctccccttccctcccctcctggcgggtgcggggccggtgtccgaagtcaggcggcggcccccgcagcggccgcaggaggggcggctgcggtgggcgccgcgggcgatgcccctgcccggctgctccggcggggggcagtgcgagcggcggcggcgggggaggaggcggggggcggcggctgcggcggctgcagcagaggggccgagagctggcggtggcggcggcggtggtcgtgaagggcatcggcggcggcggtgatggcagagatgatgtgagtgcccgccggctggagacctggggccgcggagcgcgggacgggcggcggcggcgtgcgggagcggccccgggggcggcggagggatgcggggagcgcgggcagagccggagcggcggccgccaaccggccggcagtggctggagccccgcgctgcggcgccgggggagccgggcccggcgtgggggtcgcgggcggcggcggggcggtcaggccgaggggcgtctgcgattgttctcaacacccctcccccaccccatcccgtgtgtctgtttgttacttgcagctgaagatggaaagagccaggcgaaggggaggcggcggcggccgcggccgcggaggcaagaatgtagggggctctggcctaagcaagagtagactctatccccaggcccagcactcccactacccccactacgcggcctcagccacccctaatcaggccgggggcgcagccgaaatccaggagctggcctccaaacgagtggacatccagaaaaagaggttttacctagacgtgaagcaaagctcccggggccgcttcctaaagatagccgaagtctggatagggagaggccggcaggacaacatcagaaagagtaaactgaccctctccctgtctgtggcagcggagctgaaggactgtctaggggacttcatcgagcactatgcccacctgggcctgaaaggccaccggcaagagcatggccacagcaaagagcaaggctccagaaggaggcagaagcactcggcaccctccccaccagtctcggtggggtccgaagagcatcctcacagtgtcctgaaaacagactatatcgagagggacaataggaaatattacctagacctaaaggaaaatcagcggggtcgcttcctacggattagacaaaccatgatgcgggggactggcatgataggttattttggccacagtttgggccaagaacagactattgtcctcccagcacaaggaatgattgagtttcgtgatgccttggttcagctgattgaagactatggcgaaggagacatagaagaacgaagaggtggagacgatgacccgcttgaactcccagaggggacttctttcagagtggacaataaaaggttctactttgatgtgggctctaataaatatggaattttcctgaagctcacaaattaccccaaatccagagagaatatcaacctttttcactgttgtcaaatcaagcataaggaacagccccatgatactacaaaaacagttgaggaataaggaataaatctcttatgttacacctcagaataaaggcattcggtgaaagaaatgaactgaagttcatcatgaatgtaaggcctcagtacttgacattcctccacggaagggaagacaagtatcaacaccactggcatcatttccaaactgatcttatgttgaataatttccaccacattgaagtacctttcgactctatccagtttttgggttttgttttttttaattcatcaagcctttcgttttcaaaccaccatttgtcagccttgaggtagagagacatatagatttgaaaatactttcttaagagatcatgtaactatataactctgaatttaaaaattgaggggggagggataatttcaacccactgcctcttaccagaaacatttttttaaatctgtaactgctttagtgttaacagggtgcaaggtggtttttgtcccgtattgttcttaaaaggttctcatttattgtgattgtattgtactgtatgagaacaaatcataaattgccttgtattgtttataatagaccataccacgtactacttcagtttttatgttccaagtttttcagtgatgcatgttaacagttaggtcctaaaattctgtggtgctaattctcccatacccaatggtgcttttgtggatgctaactgcacacatgctgaacaaagcttgaagtttaaaactttcctcccttcctctgtttatatgaagtaaaatgaaataacttgaatttgtctcaaagtatcactgacaatctaataaacttgtttatatgtg

SEQ ID NO: 1830 - DNA, 2875 bp, Homo sapiens
ctttctcgcggcgctgcaaccctcccaccacagcccatccagccccgcccagcgcgccgcggtgcgcatgcgtggaggccctcgctgccgctgagcacctcgggaagtgtagtctcttcgcaggtgcggctgggcagctagagtcctgcatcccggtggaatccggagaagtgagaacattcccgccgcccggtcctcattcccatcttcccacctgtccagtcccctcgcactcccgctgcaccccacgcgccgggcttcagtcagagagtgcactgaggaagagcggagaccccctcttcccctcagcaggctgtgccgggggaggcggggtccaccgcccgccccccgccgtcgctctccccgcctccccttccctcccctcctggcgggtgcggggccggtgtccgaagtcaggcggcggcccccgcagcggccgcaggaggggcggctgcggtgggcgccgcgggcgatgcccctgcccggctgctccggcggggggcagtgcgagcggcggcggcgggggaggaggcggggggcggcggctgcggcggctgcagcagaggggccgagagctggcggtggcggcggcggtggtcgtgaagggcatcggcggcggcggtgatggcagagatgatgtgagtgcccgccggctggagacctggggccgcggagcgcgggacgggcggcggcggcgtgcgggagcggccccgggggcggcggagggatgcggggagcgcgggcagagccggagcggcggccgccaaccggccggcagtggctggagccccgcgctgcggcgccgggggagccgggcccggcgtgggggtcgcgggcggcggcggggcggtcaggccgaggggcgtctgcgattgttctcaacacccctcccccaccccatcccgtgtgtctgtttgttacttgcagctgaagatggaaagagccaggcgaaggggaggcggcggcggccgcggccgcggaggcaagaatgtagggggctctggcctaagcaagagtagactctatccccaggcccagcactcccactacccccactacgcggcctcagccacccctaatcaggccgggggcgcagccgaaatccaggagctggcctccaaacgagtggacatccagaaaaagaggttttacctagacgtgaagcaaagctcccggggccgcttcctaaagatagccgaagtctggatagggagaggccggcaggacaacatcagaaagagtaaactgaccctctccctgtctgtggcagcggagctgaaggactgtctaggggacttcatcgagcactatgcccacctgggcctgaaaggccaccggcaagagcatggccacagcaaagagcaaggctccagaaggaggcagaagcactcggcaccctccccaccagtctcggtggggtccgaagagcatcctcacagtgtcctgaaaacagactatatcgagagggacaataggaaatattacctagacctaaaggaaaatcagcggggtcgcttcctacggattagacaaaccatgatgcgggggactggcatgataggttattttggccacagtttgggccaagaacagactattgtcctcccagcacaaggaatgattgagtttcgtgatgccttggttcagctgattgaagactatggcgaaggagacatagaagaacgaagaggtggagacgatgacccgcttgaactcccagaggggacttctttcagagtggacaataaaaggttctactttgatgtgggctctaataaatatggaattttcctgaaggtaagtgaggtgagaccaccttaccgtaatactattactgttccattcaaagcttggacaaggtttggggagaattttatcaagtatgaagaagagatgaggaaaatttgcaacagccataaagaaaagagaatggatggcagaaaggccagtggtgaagaacaagaatgcctcgactagagtgaaattgaactccatcaggcaaaatttaaaatcacaaattggctaaaagtactgatccattatcctttgaagaagtttttcctcttttttggcccgttgttattagtaatacctctagtagttgatacttcaggaagtctgattctcatgttatgttacacatagatcactataattcttacgggaattccaaccttcccagagctaaatagtttagctgcttcaactgctccagactattgaagtatgcaaatcagcacaaaatgtgacattctgacattctaaataccataactaagatttacattgcactatgacataatcccgaaaaaagatacatatacttaaatagaagtgtgactttcccccaaaagtatttcaattctacttcattaaaagctgctaagcttacctgtagggcagttaccacagaaacagaaattgacctccggtatatataaatatttacttataaaagtacaagtagacgtatattgtccgttgaataactgaatataccatcaaaggatcaaatcttattacctaattaaaccttaaaaatataatgtcataatatttcttaagaatactatagtattctataatttcaaactttgtggtaaccctacattttatagttgccatatcaaagccatgggagagttttaattcgttattctaagtttagttacaatcccttctttacctctacttaatgttccatatatttttattgactttccaaagtttcaggaattacttttatgtcacattgagtgggaggcttcatccaatggctttgctatggaaatcttggtggtgtagcttttcatgctaatttaaagattgcaagaggtttcttccccaaaatatatcatggactcaaggtgttata

SEQ ID NO: 1831 - DNA, 1781 bp, Homo sapiens
aagtttaaattccgctccctccacgaaagagttgtagtgagtgaaaataaatattaaaacacacggaaatgtattttcctggctgcagcacctgccatcttgcctcggtaggactcattttcaaaaacagcagcttcttgaagccccagaacgcattcctgtgctacggaagacggaagagtagctctcggggtcagaaggcgaaggtcagaaggccgaattggcgggagaataggtttggtggtccgagatccgaggcaacggtggctcctcgaggtccacggtcccgggagtaatgtgaggattcttgcttttctggaagctaacacatagtcagtgccaaagtagtgacagaagaaatcttgagaggaagcatttttgtcttgtacttgaaacagctgctgggcccaccatggctcctgtgaagatcagccatgtggtatcattttcttctcaggatcccaagtatcctgtagagaacttgctaaacccagatagtccaaggagaccttggctcggctgccctcaggacaagagtgggcaattgaaagtagaactacagctggagagggcagtgcccactggctacattgatgtgggtaactgtggctgtgcgttcctgcaaattgatgtgggccattcttcctggcccctggacagacctttcataaccctgctccctgcaaccacgctaatgtctctaactgattcaaagcaggggaagaaccgctccggggtccgcatgtttaaagatggtaaagagggcaaaagcagaaaagatgggggtggtctttatgagaaacagagatgcagtactaaagaggactgtgagtgctattaggtgtagactgtgggagggagcctgtgcaggggtttaattatatctgttgggggcaaagggtggttaaggaatggtgtgcttgtgtgtgagatttgtgtggtgaggatgcatgctagctggggagatggagatttatgaactatttatatttatatataacttgtggttcggtagggcccaatatatagaacacacacacttattgattaatatatttttgtggccaggcgtggtggctcatgcctgtaatcccagcactttgggagactgggacaagtggatcatctgaggtcaggagttcgagaccagcctggccagcatggtgaaatcccatctctactaaaaatacaaaaattagccgggcatggtggtgagtgcctttaatcccagctactggggaggctgaggcggcagaattgcttgaacctgggaggcagaggttacaatgagccaagattgggccattgcactccagcctgggtgacaagagtgaaactctgtctcaaataataataataataataacaataatatgtttttgtgggtataagtgtggatgtaggatagatgtttatgtaagtgatggaaggctacatagtggttatagttgtgtagcatataatgtttactgaatttatacaaatctctgttcactaggcactacagaaaaacataagatctgattcctagcctctagggatgtacagtctcataaggatttgtctgttttaagttggaagtatttgtaatgttgtaaaggaagagtgacattggaggggcatatgatttggagaaagtgaggtactgactggacagtgttaggaactaaagatgtggagggttggtgatatcggaatgtgataccgtgagcatgtagagcacgtggtggtgtgagggaggttgaggtcttatgatccaggaagggccaatatatatctca

SEQ ID NO: 1832 - DNA, 2621 bp, Homo sapiens
agaatgacgtctgaaatgagcgccgacgctgcccaaacaggagcctgcgcatgcgctctgccctggcagcggccctgtgcagatccctgagcgtgtggcagcagtgcggtcgtggtccctccctatgcagcctggtttctagcgtgacacgcccttgacttgaggaccatgaaccgcagccgccaggtgacgtgcgtggcctgggtccgctgcggcgtggccaaagagacaccagacaaggtagagctgagtaaagaagaagtaaaacgcctcattgctgaggcaaaggagaaattgcaagaagaaggtggtggcagtgatgaagaggagacaggcagtccttcagaagatggcatgcagagtgcacgcacccaggcacgcccaagagagcccctggaggatggtgacccagaggatgacaggacgcttgatgatgatgagctggctgagtacgacttagataaatatgatgaggaaggtgacccagatgctgagactcttggtgaatctctcttgggtcttacggtctacgggagtaatgatcaagatccttacgttactctgaaagatacagaacaatatgaacgtgaagatttcttgattaagcccagtgataatcttatagtttgtggccgagctgaacaggaccagtgcaatttagaggtgcatgtttataatcaagaagaagactctttttatgtacaccatgatatactcttgtctgcatatcctctgagtgtggaatggctgaattttgatcctagcccagatgattctactggaaattacattgctgtaggaaacatgacccctgttattgaagtgtgggaccttgatatagtggactctttagagccagtcttcacactcggaagtaaactttcaaaaaagaagaaaaagaaaggaaagaagagttcctcagcagaagggcataccgatgctgtccttgacctttcatggaataagctaatcagaaatgttttagcaagtgcatcagctgacaacactgtaattctgtgggatatgtccttggggaaaccagcagctagcctcgctgtacacacagacaaggtccaaacactgcagtttcatccatttgaagcacagactctgatttctggctcatatgataagtcagtggctttgtatgactgccgaagtccagatgaaagccatcgaatgtggcgattcagtgggcagatagagagagtgacttggaatcacttttcaccttgtcatttcttggccagtacagatgacggctttgtatataatttggatgcacgttcagataagccaatttttacacttaatgcacacaatgatgaaatctctggtcttgatcttagcagtcaaatcaagggctgtctcgtgactgcttcagctgacaaatacgtgaagatctgggacatcttaggagataggccaagtctagttcattctagggacatgaaaatgggagttctcttctgttcttcatgttgccctgatttgccatttatttatgcctttggaggtcaaaaagaagggcttcgggtctgggatataagcacagtctcttcagtaaatgaagcatttggaagacgagagaggcttgttcttgggagtgcaagaaattcatctattagtggcccttttggcagcaggagctcagatacacccatggagtcttaatgaagatcatctaatttcctgcttaccttaactgggaattttaaaaagttggcctaaaaatgttccatgcgtggcagcaaccatgcagagtgactgaaacacaattcatttctgactgacattcctttctgcaactgcggtggcaccacaaatatccggtctttgtgcttgctcttcagatggatggtttgtaaggctcttgttgcatttcttaaaaaagagtaataaaaaggatttttaaaaagtaattccttaaacataccatctgtcacagttaatctagatttgtaaataggtagtaatttatagaatttttaaagcgtaaaatccggtaatattaaaagataggtaaacctaggcctggaaaggctgttatttggctaaaattgcacaggaggccatgaacagaggcaagtgccccagagactccactttcattcctaactgttctcaaattaatgctcatgattgagtattctcagtgcaactcgtagagtttgataagtaaaagttacatgcccctgttttcctagcatgatattcactgttatcaaagacaagaggcagaccattcattcattctcaaaacactgaatgccattctgtgcctagtgctatacaaggcatgggagattcagtgtgaataagtctttgctctccacctaacaagggacagttttaattatagattgtcttcctattaagtatgagttttagtaggcattaaaaatcgtaattagtttgataatatgagacccaaccctaacttgccagaagagtaatcagttcatgaaccattgatatttcctgtatatttcatgaatgtgacttcagtcattctagtgttaatactgtggaatgtcattggtgtagcaacgtgggttcaccaaaacacctttttatacaaaagacagatgtgtgaattaaagagattaaaggatagagta

SEQ ID NO: 1833 - DNA, 846 bp, Homo sapiens
gatccctgagcgtgtggcagcagtgcggtcgtggtccctccctatgcagcctggtttctagcgtgacacgcccttgacttgaggaccatgaaccgcagccgccaggtgacgtgcgtggcctgggtccgctgcggcgtggccaaagagacaccagacaaggtagagctgagtaaagaagaagtaaaacgcctcattgctgaggcaaaggagaaattgcaagaagaaggtggtggcagtgatgaagaggagacaggcagtccttcagaagatggcatgcagagtgcacgcacccaggcacgcccaagagagcccctggaggatggtgacccagaggatgacaggacgcttgatgatgatgagctggctgagtacgacttagataaatatgatgaggaaggtgacccagatgctgagactcttggtgaatctctcttgggtcttacggtctacgggagtaatgatcaagatccttacgttactctgaaagatacagaacaatatgaacgtgaagatttcttgattaagcccagtgataatcttatagtttgtggccgagctgaacaggaccagtgcaatttagaggtgcatgtttataatcaagaagaagactctttttatgtacaccatgatatactcttgtctgcatatcctctgagtgtggaatggctgaattttgatcctagcccagatgattctactggaaattacattgctgtaggaaacatgacccctgttattgaagtgtgggaccttgatatagtggactctttagagccagtcttcacactcggaagtaaactttcaaaaaagaagaaaaagaaaggaaagaaggtaaagaagaaaagg

SEQ ID NO: 1834 - DNA, 834 bp, Homo sapiens
gatccctgagcgtgtggcagcagtgcggtcgtggtccctccctatgcagcctggtttctagcgtgacacgcccttgacttgaggaccatgaaccgcagccgccaggtgacgtgcgtggcctgggtccgctgcggcgtggccaaagagacaccagacaaggtagagctgagtaaagaagaagtaaaacgcctcattgctgaggcaaaggagaaattgcaagaagaaggtggtggcagtgatgaagaggagacaggcagtccttcagaagatggcatgcagagtgcacgcacccaggcacgcccaagagagcccctggaggatggtgacccagaggatgacaggacgcttgatgatgatgagctggctgagtacgacttagataaatatgatgaggaaggtgacccagatgctgagactcttggtgaatctctcttgggtcttacggtctacgggagtaatgatcaagatccttacgttactctgaaagatacagaacaatatgaacgtgaagatttcttgattaagcccagtgataatcttatagtttgtggccgagctgaacaggaccagtgcaatttagaggtgcatgtttataatcaagaagaagactctttttatgtacaccatgatatactcttgtctgcatatcctctgagtgtggaatggctgaattttgatcctagcccagatgattctactggaaattacattgctgtaggaaacatgacccctgttattgaagtgtgggaccttgatatagtggactctttagagccagtcttcacactcggaagtaaactttcaaaaaagaagaaaaagaaaggaaagaagaaa

SEQ ID NO: 1835 - DNA, 569 bp, Homo sapiens
gtgcagatccctgagcgtgtggcagcagtgcggtcgtggtccctccctatgcagcctggtttctagcgtgacacgcccttgacttgaggaccatgaaccgcagccgccaggtgacgtgcgtggcctgggtccgctgcggcgtggccaaagagacaccagacaagagctgagtaaagaagaagtaaaacgcctcattgctgaggcaaaggagaaattgcaagaagaaggtggtggcagtgatgaagaggagacaggcagtccttcagaagatggcatgcagagtgcacgcacccaggcacgcccaagagagcccctggaggatggtgacccagaggatgacaggacgcttgatgatgatgagctggctgagtacgacttagataaatatgatgaggaaggtgacccagatgctgagactcttggtgaatctctcttgggtcttacggtctacgggagtaatgatcaagatccttacgttactctgaaagatacagaacaatatgaacgtgaagatttcttgattaagcccagtgataatcttatagtttgtggccgagctgaacaggacc

SEQ ID NO: 1836 - DNA, 8494 bp, Homo sapiens
agtcaagtcgttaaaataccaagtggaggcattctacagacaggtgtccacaccacggccacgcggacacggagtcggggaatctggatccccacatgcccgccgagaactctccagctcccgcttacaaagtttcctcgcatggtggtgatagtggactggatgggttaggaggaccaggtgtacaactaggaagcccagataagaaaaagcgcaaggcaaatacacagggaccttctttccctccattgtctgagtatgctccaccaccgaatccaaactctgaccatctagtggctgctaatccatttgatgacaactataatactatttcctataaaccactaccttcgtcaaatccatatcttggccctggttatcctggctttggaggctatagtacattcagaatgccacctcacgttcccccaagaatgtcttccccatactgtggtccttactcactcaggaaccagccacacccatttcctcagaatcctctgggcatgggttttaatcgacctcatgcttttaactttgggccacatgataattcaagtttcggtaatccatcttataataatgcactaagtcagaatgtcaacatgcctaatcaacattttagacaaaatcctgctgaaaatttcagtcaaattcctccacagaatgctagccaagtttctaaccccgatttggcatctaattttgttcctggaaataattcaaattttacttctccgttagaatctaatcattcttttattcctcccccaaacacttttggtcaagcaaaagcaccacccccaaaacaagactttactcaaggagcaaccaaaaacactaatcaaaattcctctgctcatccacctcacttgaatatggatgacacagtgaatcagagtaatattgaattaaaaaatgttaatcgaaacaatgcagtaaatcaggagaacagccgttcaagtagcactgaagccacaaacaataaccctgcaaatgggacgcagaataagccacgacaaccaagaggtgcagcagatgcctgcaccacagaaaaaagcaataaatcctctcttcacccaaaccgtcatggccattcgtcttctgacccagtgtatccttgtggaatttgtacaaacgaggtgaacgatgatcaggatgccatcttatgtgaggcctcttgtcagaaatggtttcatcggatctgtactggaatgactgaaacagcttatggcctcttaactgcagaagcatctgcagtatggggctgtgatacctgtatggctgacaaagatgtccagttaatgcgtactagagaaacttttggtccatctgcagtgggcagtgatgcttaatcaaaggcattaactaaagtgggtttattttcctgtgcattgcagaagttcattgacacaggattttaatgttttacattatttttttaaatgcatacacaaaaacattatttacttagtttttattaatcacttcatcactagagcaaattttttattgtctttgcttgctgtcttaaatgagaataatgtatatgggggtgctttagaaacataaataaatgttagttgttgttatttatcacaaacataaaagcctcttgaaacttcaaaataatatataacaaatgtaggcaagttttaacttttaaaagttagaatcattgaaaaacgtgtatttcagtgctgaactttggttgtaccatattaaagatttagttcaaaaagtttatcaaggatccacttaacacgtcttcacaacataatatatgtaactgtaacatgggggaaagcatacatttttatggattaaaaaaataatagtatgacaccagattcctcctccactagggtctttggaatcaatgaatttcatatttcaagtgagttttcaggatatctgtttgtacagatacgagacagatcttagcatatagtaaattctcagtaagtattgttgattaacttgtggatggtaccacatgaaattgctaatattagatcagttgaaaattgactgcaattagtaaagttggtataacgtacgttcccagttgtgctatttagaattatgatagtattatgctcctacttttctttgatattgagttgtcttgttattgtttattgttttccagagaaatactatagtatccacagaagaattgtgaatacttttttataattttgaactgggacatattgcagatgaggaaggtagaaacatccatttggccttagagggctctgctagtaaaagaactactcagtggtggtttgaaaaatcttgttctggggatctgaatttcaaaaatgaaccctaggggagatcaaaatccattttaaacaaagatcaattaagagccaaagtgaaatctaacttgcaaacaacaatttgaagccttgcagcagacttaaggaattcccgctctgactggggaaaagtataaaaatggacctgagagtaccctcttgagggatgatcaagaatggagacagttggagttgtgctcattaagattcaaaacagcagaaatccatttttggagcagattataacctgtggccaaaaaaaaaaaatgtgtgctgtttgacagctaatggcaatttatacaatcattggaggctggtaaagctccctaatatgttgccaccattatcattgcaaccaaaaaaattctgaagattgtgtggtgatctacgaaagagataaataattactgttatttaaacccaagtgaaacaatgacggcagcagcatattatcaagaaatttaaattatgcatgaaaatgtgatttaaaaacaatgtcctttgggtaacacacaagaacctacactttcacagacaaggactcgacctcacatgtcacaagctactaaagcaaagttaagtgacttgggctatgaaattttgtcatgtccattttagtcactggacctttattccatggactactgtctatcatttggagctttttctaagaaacaatgcattccccaatcgagatgaagtaactggaagatgttaacaatttatacagcctaacaaatgatgaattttataaaagttagacctttaatattctgttggaagaaaactattcatgctcctgatgcatattttgattgaataaaacttatttttttaaatacattgttttaattttgacctacaaaaacagcaatttcatatggtacaaggtaatacaaggttttctccatttacccttgactagttagaggtgagtacaaaatattttcagtagttgtaaaatatttatctttacaattttaggaaacaaaatgatataaactatacttctaggtactcctttgtgtgaaaactttaccagttgaagcaggttaaaatgcagtattttgggctgacaggcatttgatggtgttcagtagtgtacttgaagatctcattttacttggattttttattatacatatttctctaaatgtttaaggacctagttatgttgctcctgaaagtttaatgagtgctgatttttaataaatgatgcactgtatgctgtatgcctagttgtagcatcagatcatgatttattattaccctgaatagagctagatgatagatattttgagtagaactttccagtgttctcaggagttaacactttacatggtagtacttgagttgtgatcattactaaaatcaattatgcagtttcttaaaccctttatctctttaagtttcagtagttagctgtttttgtgaaaatgaaataacttctcccaagctagtctaaaggtatgtgttatgcaatataattcattttctatttccacatagttgtttttaaaaacctacaaacaggtgaatttttattcaggtgtttaggtcttcaaagcaccttacttaaataagaatctgtaaatattcaaaagaaaaactcacggttcattctgatagtgaatcatagccaaactgtaatcatagctgatgaatagcgttcatgtgtttgaattaattttcctgctagttctacatttgtctctacataatgctaagtcaaaagttatatagatgcttttggatggaataagtgatgaactgtaagaatagccagatgataatttgtctgaagaaggctattatacaaactgaaatggcttcttaggataaatgataagctgccttcaactttaaaaatatgcagtgatggaaaaaaacacaggtggaattgtaccttttttggtataatccctttccttcactgaaagtcctcatcttacacacacacacacacacacacaccccccacagtttctccaacatccttgagttttgcttaaattcaacctggctaactatgagcatctaggtttactcaccaaagctaggttattgacagaaaggtgggtttttttttgttttttttgttttgttttgttttgtttttgttttttgccagtcttgctctgttgcccaggctggagtgcagtgatgagatctcggctcactgcaacgtctgccttcctggttcaagtgattctcctgcctcagcctcctgagtagctgggattacagtcgcccaccatcacacctggctaatttttgtatttttagtagagacgggttcaccatgttggccaggctggtgtcaaactcctgacctcaagtgatctgcccgcctcagcctcccaaagtgctgggattacaggtgtaagccaccacgcctggccagacagaaaattttaaaaagcatcagttcctttctcagaacttgacttgctcatgcactagagaatttgtggtccacatgcttctaggtgttactcgattcactaatactgaaacagctcagcttgtgaaagataaattgttcttcagacagagtgcttagaattagatttgtgatcagtgttttccttttgtgtgaaatactttagagtactgctataattgttattcaaattagaaggttatatacataaaactaaagattttcttgtactagtgcttattcttcataaacacagtgtaaagaaatctacttttttggtggtttgttttagactcccaactctgcctagtggcagaaaaacctcttaatagtgtgggtcatcataaaatctgccaactttaatccaaataagtatcaagagtcttcattcaatattctttcaaacttgtttgtctcgaacaaattagagttttagcacttattgttcaatgtactatagtaattgtatttaatagtaagaaaatatataagcaatgattttttaaaagggagttctcaagagttttggatttctttctgccgtgtatagaggtttcttatgcatggacatttgtgctgttttatatctttttcaattaaaaaaaaatttaaaggcatcaggctccctaagttcatttgtaaatagtggcttggaactctacacaatagggaagctcctaaaggctcatttagaccataatctagttaatagtatcatgctgaactctcagttttctttaggaaaccaatcaatcagtgtaggagggagaaagaagcagaggtcttgtctttttcctgatgtgattaggaggttaagttctttggtgtgggtttctttgcatttgcccccttaccatgctaaactctggtgaaatgtataagcagccttggcttttcctctcctgggtgctctgtgcttcaacattttatatctttcctcccatcagaaatcctgtgtctttgtgtggcagtagtagttggctagactttaagagaaaagcattttctactaaggtatgaatgaagatagtgggaaaagtgtcattaaatttcttttttaaaaaagtatgtttattaagaatgaatctttaatatctaacatttcagacaatatgaccgcatttcagataccatgggaagcagtacatttagtgaattagctggtactgtctgagggtacttccagtttcctttaggctgttgtgacttttcacagcttcctctcctctaattctgaacttagagattttcttctcatttctaatttttagtagcttattgttccatccagtagagcattataaaagtcacatctgcatcttccaacttatggtacagtgatgggaatttggaagcacccctggagcaaagaggctagggatagcattaacatctcccaagacaagtggtataggggaaatgaaggaaagactgtggccatgtatatgccaggcgttaatacatcagagctgcctgtatttaatttaaaacttttgatgaaactcagtggataagcatctttgtcatattttgtcaataatacattacttgcaattatattaaaacttattctaaatacctgtacctttcttgttctgtagatgtgtagatgatgttgcttgtttgtcaaaatattatcttttataaaagaaagtcctgcttcttatcatgatgtatgtgacttaaatgattgtttcatattaaaactatttcttccttatgtactgtttacatatacctctttttgggatattagttcagtacttttatacaaatctgagtgtgttccacattggtgacatgtatttttgcagtaactttttgttttgttcttagaacatgtctaaagtaacacatgcactagtgctgtggtctgtggcaaaattactgtaattcaaattggaaaaaaaaatgtttccagactttgtccaacatttattcctatggcaaaggaaattactatgtaatactaattatttcttatgctggtatgttttaagctactctatgaagtatgtgaaacatcaatatttatggattaatagatggcctgatgtctttcaaatgggagaggagtaaattttagtgttaccaactcatgacacttgtaatacaataaatcttaaaatttttattttccacttacaggtatactttactaaataattaccttaaatggcagtgcatattaggattttttagcacatactactaaaattatatagtaacttttaacttgtgctgatatttcccaaccaaaaaagacatcattcacttcatcataaccaaaataagtagtactgtaatatttatcttcatttatttagacatgattaagataccgtaagactcctctaatttacctggaatttttagccattgattcaaggacttgaatgctgtttacttggtactacctaatgaaaggatttggtaataaaggttataatcacgattttaaagaaaaatgtttcatcttgaaggcaaatttttaagctttttatttagaggtgtttacttaagaatagtaatttaaaagcattcttattttgtcattaagacaagtacccaaaagaattgtaataagtaatacttggccaatgcaaatttgtacatttgaaatcatacacttgaaagaaaaaaatgaaggcttgtgagtgcttaaactgcatatctttttaaaaattcaaattttagacatatcagtttaaattatccttaataaggttttactatgtcagtgatgtatattacaaaatgtctacctatgttatgttaatgatatctctatactgcatcatattcggcatggttatggtatattttgtacttttgattgtggactattgataggattgatatagcaataaatctgattcagacttaatattttttaaaacgctagataccatactgtatcataatcctattatatttgacttgaatgcccaaaattttcatagttctatattttatgttaaaaatttagtattacatgttagggatttatttttgtctgctattttcacatacattcttttagaactgagtctgtttctatttagatcatagacgtctaaagaagtattattaattcatgaactgctttgtggaaaaatttaaataaagtatgaaatgactagattaccccaaattgtttatttttttttttggttaatgaccaggttacaattctcagacaaatgaaattggcttgataactgattgaatatagtagataatggaaagtttgactctttaagggcttccaagtgttaaatacattctcaattctgaattacttcatagtaactacttaaataatggtaagccaattctcctttttctttttgagatatttaacacaatttgcgtcttctgatcccattcccttcttccccaaaaaccatgctagaatttaaaattggaagagtttaatttgtcatctacattttagtttttttattctatagataagtaagaagacaagtagacgttctgctgtcaagacagtccatgttattgttggccattcttttcagggataatgcttaatgttatttgtgcgttgtataaggaatgttgtttatcagtatatagacctaccattagtagaaatgatgtatggcaggctttcttgaataatatgtattgtaagtttgtttcctatagtgttattatggttcagattcttttaaataaagctagtttttaaagagaaaaa

SEQ ID NO: 1837 - DNA, 2714 bp, Homo sapiens
ctcctcctcagagggcgctgtgagtgtgccgccagggccgggccgcgagcctcctgcttcccctgtcagcatcaaagagaccgaattcccgcggcctgggggggagtcatgctttgcggtctgtaatgtcagcagaacaggagaaggatcccatttcgctgaagagagttcgaggtggtgatagtggactggatgggttaggaggaccaggtgtacaactaggaagcccagataagaaaaagcgcaaggcaaatacacagggaccttctttccctccattgtctgagtatgctccaccaccgaatccaaactctgaccatctagtggctgctaatccatttgatgacaactataatactatttcctataaaccactaccttcgtcaaatccatatcttggccctggttatcctggctttggaggctatagtacattcagaatgccacctcacgttcccccaagaatgtcttccccatactgtggtccttactcactcaggaaccagccacacccatttcctcagaatcctctgggcatgggttttaatcgacctcatgcttttaactttgggccacatgataattcaagtttcggtaatccatcttataataatgcactaagtcagaatgtcaacatgcctaatcaacattttagacaaaatcctgctgaaaatttcagtcaaattcctccacagaatgctagccaagtttctaaccccgatttggcatctaattttgttcctggaaataattcaaattttacttctccgttagaatctaatcattcttttattcctcccccaaacacttttggtcaagcaaaagcaccacccccaaaacaagactttactcaaggagcaaccaaaaacactaatcaaaattcctctgctcatccacctcacttgaatatggatgacacagtgaatcagagtaatattgaattaaaaaatgttaatcgaaacaatgcagtaaatcaggagaacagccgttcaagtagcactgaagccacaaacaataaccctgcaaatgggacgcagaataagccacgacaaccaagaggtgcagcagatgcctgcaccacagaaaaaagcaataaatcctctcttcacccaaaccgtcatggccattcgtcttctgacccagtgtatccttgtggaatttgtacaaacgaggtgaacgatgatcaggatgccatcttatgtgaggcctcttgtcagaaatggtttcatcggatctgtactggaatgactgaaacagcttatggcctcttaactgcagaagcatctgcagtatggggctgtgatacctgtatggctgacaaagatgtccagttaatgcgtactagagaaacttttggtccatctgcagtgggcagtgatgcttaatcaaaggcattaactaaagtgggtttattttcctgtgcattgcagaagttcattgacacaggattttaatgttttacattatttttttaaatgcatacacaaaaacattatttacttagtttttattaatcacttcatcactagagcaaattttttattgtctttgcttgctgtcttaaatgagaataatgtatatgggggtgctttagaaacataaataaatgttagttgttgttatttatcacaaacataaaagcctcttgaaacttcaaaataatatataacaaatgtaggcaagttttaacttttaaaagttagaatcattgaaaaacgtgtatttcagtgctgaactttggttgtaccatattaaagatttagttcaaaaagtttatcaaggatccacttaacacgtcttcacaacataatatatgtaactgtaacatgggggaaagcatacatttttatggattaaaaaaataatagtatgacaccagattcctcctccactagggtctttggaatcaatgaatttcatatttcaagtgagttttcaggatatctgtttgtacagatacgagacagatcttagcatatagtaaattctcagtaagtattgttgattaacttgtggatggtaccacatgaaattgctaatattagatcagttgaaaattgactgcaattagtaaagttggtataacgtacgttcccagttgtgctatttagaattatgatagtattatgctcctacttttctttgatattgagttgtcttgttattgtttattgttttccagagaaatactatagtatccacagaagaattgtgaatacttttttataattttgaactgggacatattgcagatgaggaaggtagaaacatccatttggccttagagggctctgctagtaaaagaactactcagtggtggtttgaaaaatcttgttctggggatctgaatttcaaaaatgaaccctaggggagatcaaaatccattttaaacaaagatcaattaagagccaaagtgaaatctaacttgcaaacaacaatttgaagccttgcagcagacttaaggaattcccgctctgactggggaaaagtataaaaatggacctgagagtaccctcttgagggatgatcaagaatggagacagttggagttgtgctcattaagattcaaaacagcagaaatccatttttggagcagattataacctgtggccaaaaaaaaaaaatgtgtgctgtttgacagctaatggcaatttatacaatcattggaggctggtaaagctccctaatatgttgccaccattatcattgcaacc

SEQ ID NO: 1838 - DNA, 4331 bp, Homo sapiens
ggcttttcttccccttctgattttcccctccccccttttctccctttccgggtttggttccccccttttcttcccctctcccccctccttcccaagcccctttcccctcccccgtcccagtcccccctgcttcccagccctcggccccggggaagccccggccgagaaaagcccgcccccagaagcgcgccgccgccggccgtcggggccgagccgcagccgagcggccgtgggcccgggcggcgggcggagacgtgggcgccctccccgccaaggcccgtgcgagaggttagacttgtttcttatatgtgatgccattccagcactggactcatggaggctgagcatttattcaggagtccatagaggccactgtattctattgaagaacatgtctaacagtaacactactcaagagaccctggaaataatgaaagaatcagaaaaaaaactggtggaagaatctgtaaacaaaaacaagtttatatctaagactccaagtaaggaagaaattgagaaagaatgtgaagataccagtttgcgtcaggagacacagaggcggacatctaaccatggtcatgccaggaaaagagccaagtctaattccaagctaaagttggtgcgtagcctggcagtgtgtgaggagtcctccaccccatttgctgatgggccattagaaacccaggatataattcaattgcacatcagttgcccttctgacaaggaggaagaaaagtccacaaaagatgtctctgaaaaggaagacaaggacaaaaacaaagaaaagatcccaaggaagatgctgtccagagactccagccaggaatatacggactccactggaatagacctacatgaatttcttgtaaatacactgaaaaagaacccaagggacagaatgatgctgctaaaattagaacaggagattctggaatttattaatgacaacaataatcagttcaagaagttccctcagatgacctcatatcaccggatgctattacaccgggtagctgcctattttgggatggaccacaatgttgatcaaactgggaaagctgtcatcatcaacaaaactagtaacacaagaatccctgaacagaggttctcagaacatataaaggatgagaagaatacagaatttcaacagaggttcattctcaagagagatgatgccagtatggaccgagatgataaccagactggccagaacggatatctaaatgacatcagactctccaaagaagccttttcttctagctctcacaagagaaggcagatttttagggggaaccgtgaaggactgagccgcacctcaagcagccgccagagcagcacagacagcgaactcaaatccctggagccacgcccttggagcagcacagactctgatggctctgtccggagcatgcgaccccctgtcaccaaagctagcagcttcagtggaatctctatccttacccgaggtgacagcatcggcagcagtaaaggcggcagtgcgggaaggatctccaggccaggtatggcactaggtgccccagaagtgtgcaaccaggtcacctcatcccagtctgtccgggggcttctcccttgtactgcccagcagcaacagcagcagcagcagcagcaacttcctgctctcccacccacgcctcagcaacagccacccttgaataatcacatgatctcacaggcagatgacctcagcaacccctttggacaaatgagccttagtcgccaaggttctactgaagcagctgacccatctgcagctctattccagaccccacttatctcccagcaccctcagcagactagcttcatcatggcttccacgggtcagcccctccccacttccaactattccacctctagccatgcaccacctactcagcaagttctgccaccccaggggtacatgcagccccctcaacagatccaggtttcttactatccccctggacaatatcctaactccaaccagcaatatcgacctctctctcacccggtggcctatagcccccaacgtggtcagcagctgcctcagccatcccagcagcctggtttacagcccatgatgcctaaccagcagcaggcggcttaccaaggcatgattggggtccagcagccacagaaccagggcctgctcagcagccagaggagcagcatggggggccagatgcaaggcctggtggttcagtacactccactgccttcttaccaagttccagtgggtagtgactcgcaaaatgtggtccagccgcctttccagcaacccatgctggtccctgtgagccagtctgtgcaaggaggcctcccagcagcgggggtaccagtgtactatagcatgatcccacctgctcagcagaacggtacgagcccttctgtagggtttctgcaaccccctggctctgagcagtaccagatgcctcagtctccctctccctgcagtccaccacagatgccacagcagtactcaggagtgtcaccttctggaccaggtgtagtggtcatgcagctgaatgtccctaatggaccccagccccctcagaacccatccatggtccagtggagtcattgtaaatactacagcatggaccagcgggggcagaagcctggagacctgtacagtcctgacagcagcccccaggccaacacacaaatgagcagcagccctgtcacatctcctacccagtctccagcaccctctcctgtcaccagcctcagcagtgtctgcacaggactcagtcccctgcctgtcctcacacagttcccccggcctgggggtccagcacagggtgatgggcgctactcccttttgggccagccattacagtacaatctgtccatctgccctcccttgctccatggccagtcaacttacacggtgcaccagggacagagtggactgaagcatggaaaccggggcaagagacaagcactcaaatctgcctccactgacctggggacagcagatgttgtcctggggcgggtgctggaggtgacagatctccctgagggcatcacccgtactgaggcggacaaactcttcacgcagctcgccatgtctggcgccaagatccagtggctcaaggatgctcaggggctgcctggagggggtgggggggacaacagtgggactgctgagaatggccgccactcggacctcgctgccttgtacaccattgtggctgtgttccccagccccctggctgcccaaaatgcctcccttcgtctcaacaactccgtgagtcgcttcaaacttcgaatggccaaaaagaactatgacctgaggatcctggagcgagccagctcccaataaatggaggaggggaaagggactgtcacagaaggagcaagggcagggtggagggggttgaaggatcctgacagaccatggacagaggcaggaagtaaggaaactgatgttaaactggaacctaagacagtgatgaagatggaaacacagatacctacactggcattggactccttcttgctcccctgccatgggtcctctctttttccctggttgaccccccttgcatcactcttcttcccatcctcttctttttttttttttttttttttttgagacggagtttcgctcttgtcaccccagctggagtgcagtagcacgatcttggctaactgcaacctccagctcctgggttcaggtgattctcctgcctcagcctcccaagtagctggcactacagacacgcgccaccatgcccggctaatttttgtatttttagtagagacggagtttcaccatgttggccaggctggcctcaaactcctgacctcaggtgatccacctgccttggccttccagagtgctgggattacaggcgtgagccactgtgcctggcttccatcctcttctatcatttttttaaatctcttctcctatcataaaattaatttctcattttttggtcaggtagaattgggaaagtcccacactgtcctcctattaccttaacatcccaagcttcctttccttttttggtctttatgaatatatttatatggacagaattaagataaacaaaattgattgccccattctctcacttccccatcttgtcttcctagaccccacagagttaaaacttgggattcccctggcccccccagaacacttgtatattgtttgtttgaggttcgtgccgcagtaacagacacagtatttaattgcacatacagatgtttgctgggtatattcactgtaaattttatttaatctgtttttttgtttgtttgggggttatttggggggaggttggttttgtttttaaatataaaaaaaaaaatctgtcactgga

SEQ ID NO: 1839 - DNA, 3974 bp, Homo sapiens
gagtccatagaggccactgtattctattgaagaacatgtctaacagtaacactactcaagagaccctggaaataatgaaagaatcagaaaaaaaactggtggaagaatctgtaaacaaaaacaagtttatatctaagactccaagtaaggaagaaattgagaaagaatgtgaagataccagtttgcgtcaggagacacagaggcggacatctaaccatggtcatgccaggaaaagagccaagtctaattccaagctaaagttggtgcgtagcctggcagtgtgtgaggagtcctccaccccatttgctgatgggccattagaaacccaggatataattcaattgcacatcagttgcccttctgacaaggaggaagaaaagtccacaaaagatgtctctgaaaaggaagacaaggacaaaaacaaagaaaagatcccaaggaagatgctgtccagagactccagccaggaatatacggactccactggaatagacctacatgaatttcttgtaaatacactgaaaaagaacccaagggacagaatgatgctgctaaaattagaacaggagattctggaatttattaatgacaacaataatcagttcaagaagttccctcagatgacctcatatcaccggatgctattacaccgggtagctgcctattttgggatggaccacaatgttgatcaaactgggaaagctgtcatcatcaacaaaactagtaacacaagaatccctgaacagaggttctcagaacatataaaggatgagaagaatacagaatttcaacagaggttcattctcaagagagatgatgccagtatggaccgagatgataaccagactggccagaacggatatctaaatgacatcagactctccaaagaagccttttcttctagctctcacaagagaaggcagatttttagggggaaccgtgaaggactgagccgcacctcaagcagccgccagagcagcacagacagcgaactcaaatccctggagccacgcccttggagcagcacagactctgatggctctgtccggagcatgcgaccccctgtcaccaaagctagcagcttcagtggaatctctatccttacccgaggtgacagcatcggcagcagtaaaggcggcagtgcgggaaggatctccaggccaggtatggcactaggtgccccagaagtgtgcaaccaggtcacctcatcccagtctgtccgggggcttctcccttgtactgcccagcagcaacagcagcagcagcagcagcaacttcctgctctcccacccacgcctcagcaacagccacccttgaataatcacatgatctcacaggcagatgacctcagcaacccctttggacaaatgagccttagtcgccaaggttctactgaagcagctgacccatctgcagctctattccagaccccacttatctcccagcaccctcagcagactagcttcatcatggcttccacgggtcagcccctccccacttccaactattccacctctagccatgcaccacctactcagcaagttctgccaccccaggggtacatgcagccccctcaacagatccaggtttcttactatccccctggacaatatcctaactccaaccagcaatatcgacctctctctcacccggtggcctatagcccccaacgtggtcagcagctgcctcagccatcccagcagcctggtttacagcccatgatgcctaaccagcagcaggcggcttaccaaggcatgattggggtccagcagccacagaaccagggcctgctcagcagccagaggagcagcatggggggccagatgcaaggcctggtggttcagtacactccactgccttcttaccaagttccagtgggtagtgactcgcaaaatgtggtccagccgcctttccagcaacccatgctggtccctgtgagccagtctgtgcaaggaggcctcccagcagcgggggtaccagtgtactatagcatgatcccacctgctcagcagaacggtacgagcccttctgtagggtttctgcaaccccctggctctgagcagtaccagatgcctcagtctccctctccctgcagtccaccacagatgccacagcagtactcaggagtgtcaccttctggaccaggtgtagtggtcatgcagctgaatgtccctaatggaccccagccccctcagaacccatccatggtccagtggagtcattgtaaatactacagcatggaccagcgggggcagaagcctggagacctgtacagtcctgacagcagcccccaggccaacacacaaatgagcagcagccctgtcacatctcctacccagtctccagcaccctctcctgtcaccagcctcagcagtgtctgcacaggactcagtcccctgcctgtcctcacacagttcccccggcctgggggtccagcacagggtgatgggcgctactcccttttgggccagccattacagtacaatctgtccatctgccctcccttgctccatggccagtcaacttacacggtgcaccagggacagagtggactgaagcatggaaaccggggcaagagacaagcactcaaatctgcctccactgacctggggacagcagatgttgtcctggggcgggtgctggaggtgacagatctccctgagggcatcacccgtactgaggcggacaaactcttcacgcagctcgccatgtctggcgccaagatccagtggctcaaggatgctcaggggctgcctggagggggtgggggggacaacagtgggactgctgagaatggccgccactcggacctcgctgccttgtacaccattgtggctgtgttccccagccccctggctgcccaaaatgcctcccttcgtctcaacaactccgtgagtcgcttcaaacttcgaatggccaaaaagaactatgacctgaggatcctggagcgagccagctcccaataaatggaggaggggaaagggactgtcacagaaggagcaagggcagggtggagggggttgaaggatcctgacagaccatggacagaggcaggaagtaaggaaactgatgttaaactggaacctaagacagtgatgaagatggaaacacagatacctacactggcattggactccttcttgctcccctgccatgggtcctctctttttccctggttgaccccccttgcatcactcttcttcccatcctcttctttttttttttttttttttttttgagacggagtttcgctcttgtcaccccagctggagtgcagtagcacgatcttggctaactgcaacctccagctcctgggttcaggtgattctcctgcctcagcctcccaagtagctggcactacagacacgcgccaccatgcccggctaatttttgtatttttagtagagacggagtttcaccatgttggccaggctggcctcaaactcctgacctcaggtgatccacctgccttggccttccagagtgctgggattacaggcgtgagccactgtgcctggcttccatcctcttctatcatttttttaaatctcttctcctatcataaaattaatttctcattttttggtcaggtagaattgggaaagtcccacactgtcctcctattaccttaacatcccaagcttcctttccttttttggtctttatgaatatatttatatggacagaattaagataaacaaaattgattgccccattctctcacttccccatcttgtcttcctagaccccacagagttaaaacttgggattcccctggcccccccagaacacttgtatattgtttgtttgaggttcgtgccgcagtaacagacacagtatttaattgcacatacagatgtttgctgggtatattcactgtaaattttatttaatctgtttttttgtttgtttgggggttatttggggggaggttggttttgtttttaaatataaaaaaaaaaatctgtcactgg

SEQ ID NO: 1840 - DNA, 3776 bp, Homo sapiens
cgcctaggctggagcgccgtggtacagtcttgactcactgcaattctgcctcctgggttcaagtgattcttgtgcctcagccattgagtagctgggatgacaggcacatgcctagctaatttttgtattttttgtagagacggggtttcaccatgttgaccaggctggtcttgaactcctgaactcaattgatccgcctgccttggcctcccaaagtgctgggattacgggcatgagccactgcacccagcaatgagtagtcttaatgaggaaagtaggtcatagtaatctgcagaatactgtagataaagaaactgagaaaaacctatttggttcccatttagtaaatatctatattccttataatatgtctatttctcctaagaaactttccactttagacacttgtaagaaaaattaaaattggttgttattgcagttgtttgtcttatttcactttttttccccgggtttcccttcagtaatcagttcaagaagttccctcagatgacctcatatcaccggatgctattacaccgggtagctgcctattttgggatggaccacaatgttgatcaaactgggaaagctgtcatcatcaacaaaactagtaacacaagaatccctgaacagaggttctcagaacatataaaggatgagaagaatacagaatttcaacagaggttcattctcaagagagatgatgccagtatggaccgagatgataaccagggggaaccgtgaaggactgagccgcacctcaagcagccgccagagcagcacagacagcgaactcaaatccctggagccacgcccttggagcagcacagactctgatggctctgtccggagcatgcgaccccctgtcaccaaagctagcagcttcagtggaatctctatccttacccgaggtgacagcatcggcagcagtaaaggcggcagtgcgggaaggatctccaggccaggtatggcactaggtgccccagaagtgtgcaaccaggtcacctcatcccagtctgtccgggggcttctcccttgtactgcccagcagcaacagcagcagcagcagcagcaacttcctgctctcccacccacgcctcagcaacagccacccttgaataatcacatgatctcacaggcagatgacctcagcaacccctttggacaaatgagccttagtcgccaaggttctactgaagcagctgacccatctgcagctctattccagaccccacttatctcccagcaccctcagcagactagcttcatcatggcttccacgggtcagcccctccccacttccaactattccacctctagccatgcaccacctactcagcaagttctgccaccccaggggtacatgcagccccctcaacagatccaggtttcttactatccccctggacaatatcctaactccaaccagcaatatcgacctctctctcacccggtggcctatagcccccaacgtggtcagcagctgcctcagccatcccagcagcctggtttacagcccatgatgcctaaccagcagcaggcggcttaccaaggcatgattggggtccagcagccacagaaccagggcctgctcagcagccagaggagcagcatggggggccagatgcaaggcctggtggttcagtacactccactgccttcttaccaagttccagtgggtagtgactcgcaaaatgtggtccagccgcctttccagcaacccatgctggtccctgtgagccagtctgtgcaaggaggcctcccagcagcgggggtaccagtgtactatagcatgatcccacctgctcagcagaacggtacgagcccttctgtagggtttctgcaaccccctggctctgagcagtaccagatgcctcagtctccctctccctgcagtccaccacagatgccacagcagtactcaggagtgtcaccttctggaccaggtgtagtggtcatgcagctgaatgtccctaatggaccccagccccctcagaacccatccatggtccagtggagtcattgtaaatactacagcatggaccagcgggggcagaagcctggagacctgtacagtcctgacagcagcccccaggccaacacacaaatgagcagcagccctgtcacatctcctacccagtctccagcaccctctcctgtcaccagcctcagcagtgtctgcacaggactcagtcccctgcctgtcctcacacagttcccccggcctgggggtccagcacagggtgatgggcgctactcccttttgggccagccattacagtacaatctgtccatctgccctcccttgctccatggccagtcaacttacacggtgcaccagggacagagtggactgaagcatggaaaccggggcaagagacaagcactcaaatctgcctccactgacctggggacagcagatgttgtcctggggcgggtgctggaggtgacagatctccctgagggcatcacccgtactgaggcggacaaactcttcacgcagctcgccatgtctggcgccaagatccagtggctcaaggatgctcaggggctgcctggagggggtgggggggacaacagtgggactgctgagaatggccgccactcggacctcgctgccttgtacaccattgtggctgtgttccccagccccctggctgcccaaaatgcctcccttcgtctcaacaactccgtgagtcgcttcaaacttcgaatggccaaaaagaactatgacctgaggatcctggagcgagccagctcccaataaatggaggaggggaaagggactgtcacagaaggagcaagggcagggtggagggggttgaaggatcctgacagaccatggacagaggcaggaagtaaggaaactgatgttaaactggaacctaagacagtgatgaagatggaaacacagatacctacactggcattggactccttcttgctcccctgccatgggtcctctctttttccctggttgaccccccttgcatcactcttcttcccatcctcttctttttttttttttttttttttttgagacggagtttcgctcttgtcaccccagctggagtgcagtagcacgatcttggctaactgcaacctccagctcctgggttcaggtgattctcctgcctcagcctcccaagtagctggcactacagacacgcgccaccatgcccggctaatttttgtatttttagtagagacggagtttcaccatgttggccaggctggcctcaaactcctgacctcaggtgatccacctgccttggccttccagagtgctgggattacaggcgtgagccactgtgcctggcttccatcctcttctatcatttttttaaatctcttctcctatcataaaattaatttctcattttttggtcaggtagaattgggaaagtcccacactgtcctcctattaccttaacatcccaagcttcctttccttttttggtctttatgaatatatttatatggacagaattaagataaacaaaattgattgccccattctctcacttccccatcttgtcttcctagaccccacagagttaaaacttgggattcccctggcccccccagaacacttgtatattgtttgtttgaggttcgtgccgcagtaacagacacagtatttaattgcacatacagatgtttgctgggtatattcactgtaaattttatttaatctgtttttttgtttgtttgggggttatttggggggaggttggttttgtttttaaatataaaaaaaaaaatctgtcactgga

SEQ ID NO: 1841 - DNA, 2107 bp, Homo sapiens
tattttgggatggaccacaatgttgatcaaactgggaaagctgtcatcatcaacaaaactagtaacacaagaatccctgaacagaggttctcagaacatataaaggatgagaagaatacagaatttcaacagaggttcattctcaagagagatgatgccagtatggaccgagatgataaccagggggaaccgtgaaggactgagccgcacctcaagcagccgccagagcagcacagacagcgaactcaaatccctggagccacgcccttggagcagcacagactctgatggctctgtccggagcatgcgaccccctgtcaccaaagctagcagcttcagtggaatctctatccttacccgaggtgacagcatcggcagcagtaaaggcggcagtgcgggaaggatctccaggccaggtatggcactaggtgccccagaagtgtgcaaccaggtcacctcatcccagtctgtccgggggcttctcccttgtactgcccagcagcaacagcagcagcagcagcagcaacttcctgctctcccacccacgcctcagcaacagccacccttgaataatcacatgatctcacaggcagatgacctcagcaacccctttggacaaatgagccttagtcgccaaggttctactgaagcagctgacccatctgcagctctattccagaccccacttatctcccagcaccctcagcagactagcttcatcatggcttccacgggtcagcccctccccacttccaactattccacctctagccatgcaccacctactcagcaagttctgccaccccaggggtacatgcagccccctcaacagatccaggtttcttactatccccctggacaatatcctaactccaaccagcaatatcgacctctctctcacccggtggcctatagcccccaacgtggtcagcagctgcctcagccatcccagcagcctggtttacagcccatgatgcctaaccagcagcaggcggcttaccaaggcatgattggggtccagcagccacagaaccagggcctgctcagcagccagaggagcagcatggggggccagatgcaaggcctggtggttcagtacactccactgccttcttaccaagttccagtgggtagtgactcgcaaaatgtggtccagccgcctttccagcaacccatgctggtccctgtgagccagtctgtgcaaggaggcctcccagcagcgggggtaccagtgtactatagcatgatcccacctgctcagcagaacggtacgagcccttctgtagggtttctgcaaccccctggctctgagcagtaccagatgcctcagtctccctctccctgcagtccaccacagatgccacagcagtactcaggagtgtcaccttctggaccaggtgtagtggtcatgcagctgaatgtccctaatggaccccagccccctcagaacccatccatggtccagtggagtcattgtaaatactacagcatggaccagcgggggcagaagcctggagacctgtacagtcctgacagcagcccccaggccaacacacaaatgagcagcagccctgtcacatctcctacccagtctccagcaccctctcctgtcaccagcctcagcagtgtctgcacaggactcagtcccctgcctgtcctcacacagttcccccggcctgggggtccagcacagggtgatgggcgctactcccttttgggccagccattacagtacaatctgtccatctgccctcccttgctccatggccagtcaacttacacggtgcaccagggacagagtggactgaagcatggaaaccggggcaagagacaagcactcaaatctgcctccactgacctggggacagcagatgttgccctgtcatttcagccctgacaccaaggcaggaggctaggaggtctacaaatagcgactgggtagctggtgtgaacacagggggtactgggggggcttagcccccaaggaagaggaccagtttttccccagcaccaccatcaaggcctcgaggctcccagctccctctacagcctgtggactgacttagggaatcccgaacgatgacagaaaaggaggtgctggagtccc

SEQ ID NO: 1842 - DNA, 2123 bp, Homo sapiens
tcaaatccctggagccacgcccttggagcagcacagactctgatggctctgtccggagcatgcgaccccctgtcaccaaagctagcagcttcagtggaatctctatccttacccgaggtgacagcatcggcagcagtaaaggcggcagtgcgggaaggatctccaggccaggtatggcactaggtgccccagaagtgtgcaaccaggtcacctcatcccagtctgtccgggggcttctcccttgtactgcccagcagcaacagcagcagcagcagcagcaacttcctgctctcccacccacgcctcagcaacagccacccttgaataatcacatgatctcacagccagtcccggctctgcagccctctccgcagcctgttcagttctctccaagctcctgtccccaagtccttctgccagtctctccgccccagcagtacaacatggcagatgacctcagcaacccctttggacaaatgagccttagtcgccaaggttctactgaagcagctgacccatctgcagctctattccagaccccacttatctcccagcaccctcagcagactagcttcatcatggcttccacgggtcagcccctccccacttccaactattccacctctagccatgcaccacctactcagcaagttctgccaccccaggggtacatgcagccccctcaacagatccaggtttcttactatccccctggacaatatcctaactccaaccagcaatatcgacctctctctcacccggtggcctatagcccccaacgtggtcagcagctgcctcagccatcccagcagcctggtttacagcccatgatgcctaaccagcagcaggcggcttaccaaggcatgattggggtccagcagccacagaaccagggcctgctcagcagccagaggagcagcatggggggccagatgcaaggcctggtggttcagtacactccactgccttcttaccaagttccagtgggtagtgactcgcaaaatgtggtccagccgcctttccagcaacccatgctggtccctgtgagccagtctgtgcaaggaggcctcccagcagcgggggtaccagtgtactatagcatgatcccacctgctcagcagaacggtacgagcccttctgtagggtttctgcaaccccctggctctgagcagtaccagatgcctcagtctccctctccctgcagtccaccacagatgccacagcagtactcaggagtgtcaccttctggaccaggtgtagtggtcatgcagctgaatgtccctaatggaccccagccccctcagaacccatccatggtccagtggagtcattgtaaatactacagcatggaccagcgggggcagaagcctggagacctgtacagtcctgacagcagcccccaggccaacacacaaatgagcagcagccctgtcacatctcctacccagtctccagcaccctctcctgtcaccagcctcagcagtgtctgcacaggactcagtcccctgcctgtcctcacacagttcccccggcctgggggtccagcacagggtgatgggcgctactcccttttgggccagccattacagtacaatctgtccatctgccctcccttgctccatggccagtcaacttacacggtgcaccagggacagagtggactgaagcatggaaaccggggcaagagacaagcactcaaatctgcctccactgacctggggacagcagatgttgtcctggggcgggtgctggaggtgacagatctccctgagggcatcacccgtactgaggcggacaaactcttcacgcagctcgccatgtctggcgccaagatccagtggctcaaggatgctcaggggctgcctggagggggtgggggggacaacagtgggactgctgagaatggccgccactcggacctcgctgccttgtacaccattgtggctgtgttccccagccccctggctgcccaaaatgcctcccttcgtctcaacaactccgtgagtcgcttcaaacttcgaatggccaaaaagaactatgacctgaggatcctggagcgagccagctcccaataaatggaggaggggaaagggactgtcacagaaggagcaagggcagggtgg

SEQ ID NO: 1843 - DNA, 195 bp, Homo sapiens
gcagccgagcggccgtgggcccgggcggcgggcggagacgtgggcgccctccccgccaaggcccgtgcgaggagtccatagaggccactgtattctattgaagaacatgtctaacagtaacactactcaagagaccctggaaataatgaaagaatcagaaaaaaaactggtggaagaatctgtaaacaaaaacaa

SEQ ID NO: 1844 - DNA, 492 bp, Homo sapiens
ttgaaagtagggcgcagcctgagaggccggccggaccccgagtgctgtaggcgggctgggagatgggggccgccgccacccacattcccacacgcacccggcgccggcgcctcacgccgtgttagctcgcggcgccaagcccggagggtcccgcctgaggaagaaaggtcgtcgcccgcagcccagctggggctggaggcgcgacccggggtctcctcgcccgcacgcggaagaaaatgggcgctgtggcctcagtttccctcttttgttaaatacaagtaaggaacacaggcaacatgttctacacacatgtgcttatgagtaaacgagggccattggccaaaatatggcttgcagctcactgggagaagaaactcacaaaggcccatgtatttgaatgtaatctagagataaccattgaaaaaattctttcacccaaggtgaaaatagcacttcgaacttcaggacaccttcttttgggagttgttcgaa

SEQ ID NO: 1845 - DNA, 1659 bp, Homo sapiens
acctcagacgaggctttgaaagtagggcgcagcctgagaggccggccggaccccgagtgcttttgttaaatacaagtaaggaacacaggcaacatgttctacacacatgtgcttatgagtaaacgagggccattggccaaaatatggcttgcagctcactgggagaagaaactcacaaaggcccatgtatttgaatgtaatctagagataaccattgaaaaaattctttcacccaaggtgaaaatagcacttcgaacttcaggacaccttcttttgggagttgttcgaatctataacaggaaggcaaaatatcttttggcagattgcagtgaagcatttcttaaaatgaagatgacattttgcccaggactggttgaccttccaaaagagaattttgaagcatcttacaatgctatcacattgccagaagaatttcatgattttgacacccaaaatatgaatgctattgatgtttcagaacactttactcagaaccaaagcagaccagaagaaatcactcttagagaaaattttgacaatgatctaattttccaagctgagagctttggggaggaatctgaaattctcagaagacatagcttctttgatgacaacatattactgaattccagtggtcctttaattgaacatagttctggaagcctcactggagaacgatctctattctatgacagtggagatgggtttggagatgaaggagctgcaggagaaatgattgacaatctattgcaagatgatcagaatatcctgttagaagacatgcatttgaacagagaaatttccctgccttctgagcctcccaatagtttagcagttgaaccagataactcagagtgtatatgtgtacctgaaaatgaaaaaatgaatgaaacaatattattatcaactgaagaggaaggatttacccttgatccaattgatatttcagacattgctgagaaaaggaaaggcaaaaagaggagattgctcatagatcctatcaaggagctcagtagcaaagttatacataaacagcttacttcctttgcggacacactcatggttttggaacttgcacctcctacccaaagattgatgatgtggaagaagaggggaggagtgcatacacttctgtcaactgctgcccaggatttgattcatgctgaactgaaaatgttgtttacaaaatgctttctgtcctctggctttaaacttggaagaaaaatgatacagaaggagtcagtaagggaagaagtgggaaaccaaaatatagtagagacatccatgatgcaagagccaaattaccagcaagagttaagtaaaccccaaacttggaaggatgtgattggtggatctcagcatagctctcatgaggataccaataaaaatattaactctgaggagtcattgagcaatgaagaaaatattgagacagagagatggaatggaagaatacttcagatgttaaatcgtttacgggtcgctgatcagggccaggcggctgcagcagcgactgcagaggcgctgcgccaagccgggccggagtggtgcgagccggcggggctgcggagggccagtggactcagcccccgggataccgcccatcccaccccttactcggacccacagcctcatggccatgtccctgccaggaagtag

SEQ ID NO: 1846 - DNA, 1707 bp, Homo sapiens
cggcgccaagaacccggccaagctgacttggcgactcctcgcagcccctgctctggcacgccacacctcagacgaggctttgaaatttgttaaatacaagtaaggaacacaggcaacatgttctacacacatgtgcttatgagtaaacgagggccattggccaaaatatggcttgcagctcactgggagaagaaactcacaaaggcccatgtatttgaatgtaatctagagataaccattgaaaaaattctttcacccaaggtgaaaatagcacttcgaacttcaggacaccttcttttgggagttgttcgaatctataacaggaaggcaaaatatcttttggcagattgcagtgaagcatttcttaaaatgaagatgacattttgcccaggactggttgaccttccaaaagagaattttgaagcatcttacaatgctatcacattgccagaagaatttcatgattttgacacccaaaatatgaatgctattgatgtttcagaacactttactcagaaccaaagcagaccagaagaaatcactcttagagaaaattttgacaatgatctaattttccaagctgagagctttggggaggaatctgaaattctcagaagacatagcttctttgatgacaacatattactgaattccagtggtcctttaattgaacatagttctggaagcctcactggagaacgatctctattctatgacagtggagatgggtttggagatgaaggagctgcaggagaaatgattgacaatctattgcaagatgatcagaatatcctgttagaagacatgcatttgaacagagaaatttccctgccttctgagcctcccaatagtttagcagttgaaccagataactcagagtgtatatgtgtacctgaaaatgaaaaaatgaatgaaacaatattattatcaactgaagaggaaggatttacccttgatccaattgatatttcagacattgctgagaaaaggaaaggcaaaaagaggagattgctcatagatcctatcaaggagctcagtagcaaagttatacataaacagcttacttcctttgcggacacactcatggttttggaacttgcacctcctacccaaagattgatgatgtggaagaagaggggaggagtgcatacacttctgtcaactgctgcccaggatttgattcatgctgaactgaaaatgttgtttacaaaatgctttctgtcctctggctttaaacttggaagaaaaatgatacagaaggagtcagtaagggaagaagtgggaaaccaaaatatagtagagacatccatgatgcaagagccaaattaccagcaagagttaagtaaaccccaaacttggaaggatgtgattggtggatctcagcatagctctcatgaggataccaataaaaatattaactctgaggagtcattgagcaatgaagaaaatattgagacagagagatggaatggaagaatacttcagatgttaaatcgtttacgggtcgctgatcagggccaggcggctgcagcagcgactgcagaggcgctgcgccaagccgggccggagtggtgcgagccggcggggctgcggagggccagtggactcagcccccgggataccgcccatcccaccccttactcggacccacagcctcatggccatgtccctgccaggaagtagacggacctctgctggatcacgcag

SEQ ID NO: 1847 - DNA, 1808 bp, Homo sapiens
acctcagacgaggctttgaaagtagggcgcagcctgagaggccggccggaccccgagtgcttttgttaaatacaagtaaggaacacaggcaacatgttctacacacatgtgcttatgagtaaacgagggccattggccaaaatatggcttgcagctcactgggagaagaaactcacaaaggcccatgtatttgaatgtaatctagagataaccattgaaaaaattctttcacccaaggtgaaaatagcacttcgaacttcaggacaccttcttttgggagttgttcgaatctataacaggaaggcaaaatatcttttggcagattgcagtgaagcatttcttaaaatgaagatgacattttgcccaggactggttgaccttccaaaagagaattttgaagcatcttacaatgctatcacattgccagaagaatttcatgattttgacacccaaaatatgaatgctattgatgtttcagaacactttactcagaaccaaagcagaccagaagaaatcactcttagagaaaattttgacaatgatctaattttccaagctgagagctttggggaggaatctgaaattctcagaagacatagcttctttgatgacaacatattactgaattccagtggtcctttaattgaacatagttctggaagcctcactggagaacgatctctattctatgacagtggagatgggtttggagatgaaggagctgcaggagaaatgattgacaatctattgcaagatgatcagaatatcctgttagaagacatgcatttgaacagagaaatttccctgccttctgagcctcccaatagtttagcagttgaaccagataactcagagtgtatatgtgtacctgaaaatgaaaaaatgaatgaaacaatattattatcaactgaagaggaaggatttacccttgatccaattgatatttcagacattgctgagaaaaggaaaggcaaaaagaggagattgctcatagatcctatcaaggagctcagtagcaaagttatacataaacagcttacttcctttgcggacacactcatggttttggaacttgcacctcctacccaaagattgatgatgtggaagaagaggggaggagtgcatacacttctgtcaactgctgcccaggatttgattcatgctgaactgaaaatgttgtttacaaaatgctttctgtcctctggctttaaacttggaagaaaaatgatacagaaggagtcagtaagggaagaagtgggaaaccaaaatatagtagagacatccatgatgcaagagccaaattaccagcaagagttaagtaaaccccaaacttggaaggatgtgattggtggatctcagcatagctctcatgaggataccaataaaaatattaactctgagcaggatattgttgaaatggtgtctttagctgctgaggaatcatctttaatgaatgacttatttgcacaagaaattgaatatagtccagttgaattggagtcattgagcaatgaagaaaatattgagacagagagatggaatggaagaatacttcagatgttaaatcgtttacgggaatctaacaagatgggaatgcagtcctttagtctgatgaagctctgtagaaatagtgaccgaaaacaagcagctgccaaattttatagctttcttgtcctaaagaaacagctggctattgagctgagccagagtgctccctatgcagatattatagctacgatgggaccaatgttttataacatatgaaggaaacccagacatacagatttatggcatcactggaatttctg

SEQ ID NO: 1848 - DNA, 3926 bp, Homo sapiens
gttggaaagaaggaagcgcctggagcagcagaggaaagattatgcagcccctattcctactgttccgctggagttcctccctgaggtgattgaactgagctctggagaggaggacactctgcacattgtggacagcagtgaatctgtcagtgaagatgatgaggaagaagagaagggtggcacccatgtcaatgatgtcttaaaccagcgtgacgcccttgggcgggtccttgtcaacctaaaccaccctccagaggaggaaaatgtcttccttgccccacagttggcacgggctgtgaaacctcatcagattggcgggatccggttcctttacgataacctagtggagtctctggagaggtttaagaccagcagtggctttggctgtattctggcccacagcatgggtctggggaaaactttgcaagtgatctctttcatcgacgtcctcttccgccacacgccagccaaaacagtccttgccattgtgccggttaatactcttcagaattggctggcagagttcaacatgtggcttccacctcctgaagccctcccggctgacaacaagcctgaagaagtccagcctcggttctttaaagttcacatcttgaatgatgagcacaagacgatggcatctcgtgctaaagtgatggctgattgggtgtcagagggtggcgtgctgctgatggggtacgagatgtacagactcctcactctgaagaaatcatttgccacaggtagaccgaagaaaaccaagaagcgttctcacccagtcatcattgatctagatgaggaagatcggcagcaggagtttcggagagagtttgagaaggctttatgccgccctggccctgatgtagtaatctgtgatgagggacaccgcatcaaaaactgccaggccagcacctcacaggctctgaagaatatccgctctcgccgccgggtggtgctgactgggtaccctctgcaaaacaacctcattgagtactggtgcatggtggactttgtgcgcccagacttccttggcacccggcaggagttcagcaacatgtttgaacgccctatcctgaatgggcaatgtattgacagcacacctcaggacgtccgcctcatgcggtaccggagccatgtcctgcacagtcttctggagggctttgtgcagaggagaggccacactgtgctgaagattcatctccctgccaaggaagaaaatgtgatccttgtgcggctctccaagatccagcgagatttgtatacacagttcatggatcgcttccgggactgtggtagcagcggttggctggggctgaacccccttaaggcattctgtgtgtgttgcaagatctggaatcaccctgatgtgctgtatgaagcccttcagaaggagagcttggccaatgagcaggacctagacgtggaagaacttggctctgcagggaccagtgcccgctgtccaccacagggaacaaaaggcaagggagaggatagcaccttggcttcctcgatgggagaggcaaccaatagcaagttcctacagggcgttggcttcaaccctttccaggagcgaggcaacaacattgtcacatatgaatgggccaaggaccttctgactaattaccagactggagtcctagaaaactctcccaagatggtactgcttttccacctgattgaggaaagtgtgaagcttggggacaagatccttgtgtttagccagagtctttccaccttggctctcatcgaggaattccttggaaaacgagaagtaccctgtccacctggtaccgaggggcaaggagcacagaagtgggttcgaaacatcagctacttccggctagatggtagcacccctgcctttgagagggagcggcttattaatcagttcaatgatcccagcaacctcaccacctggctgttccttctctctacaagggccggatgcttgggtgtgaatctgattggtgccaaccgagtggtggtgtttgatgcttcctggaacccttgccatgatgcccaggcagtatgtcgggtataccgttatggccagaaaaagccctgttacatctatcgccttgtggctgattacactctagaaaagaagatctatgaccgtcagatttccaagcagggcatgtcagatcgggtggtggatgatctaaatccaatgctgaacttcacacggaaagaggtggaaaacctactgcactttgttgagaaggagccagctccccaagtttccttgaacgtaaaggggatcaaggagtcagtcctgcaactggcctgtctgaagtaccctcacctcatcaccaaggagcctttcgagcatgagtcattgctcttgaaccgaaaggatcacaagctaaccaaggctgagaaaaaagcagcaaagaaaagctatgaggaagacaaacgcacatcagtcccctatacccgcccatcgtatgcgcagtattaccctgccagcgatcagagcctgaccagcatccccgccttcagccagagaaactggcagccaactttgaagggtgatgaaaagcctgtggccagtgttcgtcctgtgcagtccacccccatccccatgatgccccggcatgtcccattgggaggaagtgtaagctctgcctccagcacaaatccatccatgaactttcccatcaactacttgcagcgtgcaggagtccttgtgcagaaggtggtcaccacgacagatattgttattcctggactcaacagctccacagatgtacaggcaagaattaatgctggtgagagcatccacatcatccgtgggacaaaagggacgtacatccgtaccagtgatggacggatctttgctgtccgggcaactggcaaaccaaaggttcctgaagatggtcggatggctgcctcaggttcccagggaccttcttgcgagtccacaagcaacggcagacacagtgcctcatcacccaaagcccccgaccctgaggggctggccaggcccgtctctcctgacagcccagagatcatcagtgagcttcagcagtatgcagatgtggctgctgcccgggaatcccgtcagagctccccaagcaccaatgccgccctgcctggccccccggcccaacttatggacagcagtgctgttcccgggacagctctcggaactgagcctcgactagggggtcattgcctcaatagttccctcttggtgactggccagccctgtggtgacaggcacccagtgctggacttaaggggccacaagcgaaagttggccacaccacctgctgcccaggagtcatcccgccggcggtccaggaagggtcatctgccagcccccgtgcagccgtatgaacacgggtatccagtctctggcgggtttgccatgccacccgtctccttaaaccataacctcaccacccccttcacctcccaggctggggagaactccctgtttatgggcagtaccccctcctactaccagctgtccaatttgctggcagatgcccgcctggtgtttccagtgactactgaccctctggtgccagcaggccccgtcagttcctcttccacggctacctcagtcactgccagcaacccctccttcatgctcaacccttctgtgccagggatactacccagctattcactcccattctcacagccactcctgtccgagccgaggatgtttgcgccttttccttcccctgtcttgcccagcaacctttcgcggggcatgtctatctatccaggctacatgtccccacatgcaggctacccagctggtggcctcctacggtcccaggtgcctccatttgactctcatgaggttgccgaggttgggttcagctccaatgatgatgaggataaagacgatgatgtgatagaggtcactgggaaatagctagggagcccctccccacctcacttggggcccccag

SEQ ID NO: 1849 - DNA, 4703 bp, Homo sapiens
tgtatgtaggctgggagtgtctgctgatcacttggagtgctgtcccttggaacaggaggagtaagattgagcacccctgcagtggaccatgagtcggtaatgcccactgaggacctctgggagccatgtcagacgaatctgcctcagggagcgatccagacctggacccggacgtggagctggaggatgcggaagaggaggaggaggaggaggaggtggcagtggaggagtgtgacagggatgatgaagaagacctgctggatgacccatccctggaaggcatgtgtggcactgagcatgcccagttgggagaagatgggcagcagccgccgcggtgcacttcaactacctcatctcagtctgagccttcagagcagcttaggcgccaccaaggcaagaacctagcctccgaggaccccaaaaagaagagagctcagaagccctcccacatgagaagaaacatacgaaagctactccgggaggatcaattggagcctgttaccaaagcagcacagcaagaagagttggaaagaaggaagcgcctggagcagcagaggaaagattatgcagcccctattcctactgttccgctggagttcctccctgaggaaattgctttaagggcaagtgacggtccccaactgcctcctcgggtcttggcccaggaagtcatttgtttggacagtagcagtggcagtgaggatgaaaaaagcagtcgagatgaggtgattgaactgagctctggagaggaggacactctgcacattgtggacagcagtgaatctgtcagtgaagatgatgaggaagaagagaagggtggcacccatgtcaatgatgtcttaaaccagcgtgacgcccttgggcgggtccttgtcaacctaaaccaccctccagaggaggaaaatgtcttccttgccccacagttggcacgggctgtgaaacctcatcagattggcgggatccggttcctttacgataacctagtggagtctctggagaggtttaagaccagcagtggctttggctgtattctggcccacagcatgggtctggggaaaactttgcaagtgatctctttcatcgacgtcctcttccgccacacgccagccaaaacagtccttgccattgtgccggttaatactcttcagaattggctggcagagttcaacatgtggcttccacctcctgaagccctcccggctgacaacaagcctgaagaagtccagcctcggttctttaaagttcacatcttgaatgatgagcacaagacgatggcatctcgtgctaaagtgatggctgattgggtgtcagagggtggcgtgctgctgatggggtacgagatgtacagactcctcactctgaagaaatcatttgccacaggtagaccgaagaaaaccaagaagcgttctcacccagtcatcattgatctagatgaggaagatcggcagcaggagtttcggagagagtttgagaaggctttatgccgccctggccctgatgtagtaatctgtgatgagggacaccgcatcaaaaactgccaggccagcacctcacaggctctgaagaatatccgctctcgccgccgggtggtgctgactgggtaccctctgcaaaacaacctcattgagtactggtgcatggtggactttgtgcgcccagacttccttggcacccggcaggagttcagcaacatgtttgaacgccctatcctgaatgggcaatgtattgacagcacacctcaggacgtccgcctcatgcggtaccggagccatgtcctgcacagtcttctggagggctttgtgcagaggagaggccacactgtgctgaagattcatctccctgccaaggaagaaaatgtgatccttgtgcggctctccaagatccagcgagatttgtatacacagttcatggatcgcttccgggactgtggtagcagcggttggctggggctgaacccccttaaggcattctgtgtgtgttgcaagatctggaatcaccctgatgtgctgtatgaagcccttcagaaggagagcttggccaatgagcaggacctagacgtggaagaacttggctctgcagggaccagtgcccgctgtccaccacagggaacaaaaggcaagggagaggatagcaccttggcttcctcgatgggagaggcaaccaatagcaagttcctacagggcgttggcttcaaccctttccaggagcgaggcaacaacattgtcacatatgaatgggccaaggaccttctgactaattaccagactggagtcctagaaaactctcccaagatggtactgcttttccacctgattgaggaaagtgtgaagcttggggacaagatccttgtgtttagccagagtctttccaccttggctctcatcgaggaattccttggaaaacgagaagtaccctgtccacctggtaccgaggggcaaggagcacagaagtgggttcgaaacatcagctacttccggctagatggtagcacccctgcctttgagagggagcggcttattaatcagttcaatgatcccagcaacctcaccacctggctgttccttctctctacaagggccggatgcttgggtgtgaatctgattggtgccaaccgagtggtggtgtttgatgcttcctggaacccttgccatgatgcccaggcagtatgtcgggtataccgttatggccagaaaaagccctgttacatctatcgccttgtggctgattacactctagaaaagaagatctatgaccgtcagatttccaagcagggcatgtcagatcgggtggtggatgatctaaatccaatgctgaacttcacacggaaagaggtggaaaacctactgcactttgttgagaaggagccagctccccaagtttccttgaacgtaaaggggatcaaggagtcagtcctgcaactggcctgtctgaagtaccctcacctcatcaccaaggagcctttcgagcatgagtcattgctcttgaaccgaaaggatcacaagctaaccaaggctgagaaaaaagcagcaaagaaaagctatgaggaagacaaacgcacatcagtcccctatacccgcccatcgtatgcgcagtattaccctgccagcgatcagagcctgaccagcatccccgccttcagccagagaaactggcagccaactttgaagggtgatgaaaagcctgtggccagtgttcgtcctgtgcagtccacccccatccccatgatgccccggcatgtcccattgggaggaagtgtaagctctgcctccagcacaaatccatccatgaactttcccatcaactacttgcagcgtgcaggagtccttgtgcagaaggtggtcaccacgacagatattgttattcctggactcaacagctccacagatgtacaggcaagaattaatgctggtgagagcatccacatcatccgtgggacaaaagggacgtacatccgtaccagtgatggacggatctttgctgtccgggcaactggcaaaccaaaggttcctgaagatggtcggatggctgcctcaggttcccagggaccttcttgcgagtccacaagcaacggcagacacagtgcctcatcacccaaagcccccgaccctgaggggctggccaggcccgtctctcctgacagcccagagatcatcagtgagcttcagcagtatgcagatgtggctgctgcccgggaatcccgtcagagctccccaagcaccaatgccgccctgcctggccccccggcccaacttatggacagcagtgctgttcccgggacagctctcggaactgagcctcgactagggggtcattgcctcaatagttccctcttggtgactggccagccctgtggtgacaggcacccagtgctggacttaaggggccacaagcgaaagttggccacaccacctgctgcccaggagtcatcccgccggcggtccaggaagggtcatctgccagcccccgtgcagccgtatgaacacgggtatccagtctctggcgggtttgccatgccacccgtctccttaaaccataacctcaccacccccttcacctcccaggctggggagaactccctgtttatgggcagtaccccctcctactaccagctgtccaatttgctggcagatgcccgcctggtgtttccagtgactactgaccctctggtgccagcaggccccgtcagttcctcttccacggctacctcagtcactgccagcaacccctccttcatgctcaacccttctgtgccagggatactacccagctattcactcccattctcacagccactcctgtccgagccgaggatgtttgcgccttttccttcccctgtcttgcccagcaacctttcgcggggcatgtctatctatccaggctacatgtccccacatgcaggctacccagctggtggcctcctacggtcccaggtgcctccatttgactctcatgaggttgccgaggttgggttcagctccaatgatgatgaggataaagacgatgatgtgatagaggtcactgggaaatagctagggagcccctccccacctcacttggggcccccagcaggttgcccaccaagctgaaaggcagtgatttagaccttttgagaataggacacttggcaggagggaaaaggaagaggacaaaggagggtggttggccaaagtggcagagctctgttgctgtttaacaaaagaggc

SEQ ID NO: 1850 - DNA, 1655 bp, Homo sapiens
aatcggcgccggccttgtctcggcattccgggctcgaaggctgtgcggtctgccaggagctgcggccccgtccggcccgggctggcatgggttggaattggagcctatcccccaacccgaaggctaacagcatcatgtggttactaactgttcctcattcaccggttgatgcctcccagaaaaaaacgccgccagccttcccagaaagccccgctgctgttccaccaacaaccactggagggccccaaacacagctgtgcatctacacagcttcccatcactcacactcgacaggtatcacctgattttgatacagcagcaggaagcttgttcccagcctaccagaaacaccaaaaccgggcgagacactcaagtcgaaaacctaccacctccaagtttccacatctaacttttgagagtccgcaatcttccagttcagagacattggggatccccttaatccgagagtgccccagtgaatcagaaaaggatgtttccagaagacccttagttccagtgctcagtccccaaagctgtgggaacatgtcagtgcaggcacttcagagcttaccttatgtgttcattccacctgatatccagaccccagagtcatcgtctgtgaaggaagaactcattccccaagatcagaaggaaaacagccttctaagctgcactcttcacactggcactcctaatagcccagagcctggacctgttctggttaaagacacccccgaggacaagtatggaataaaggtcacatggaggagacgacagcacctgcttgcttacctcagggagagagggaagctgagcagaagccaattccttgtgaaaagctgactgccatcagtaatctcaatagaaaagagatatgttttctggagtcataaaggaattcaattcctagggtttttgtttttgtttttgagatgtaatattgctctgttgcccaggctggagtgcagtggtatgatctcaccttactgcaaccaccacttcctgggttcaagcgattctcctgcctcagcctccccagtagctgggattacaggcaccagccaccatgcctggctaatttttttgtatttttagtagagatgtggtttctccatgttggccaggctggtctcaaaatcctgacctcaagtcatctgctggccttgacctcacaaagtgctggcccagccgagatttgttttctaagatactttgtgtcatgaacagttcagtttagtgtcatgaactattcacttcatatttttcttgtattaactgtttaaatttttaaaatatcttgtagtaactctttaaaatgtatgtaagtaaatggctgcagaaagtttttttagagaatcctgcttccatcagtaatacagcaatattaccccatccactaatggtctttgtttccttaaccactactcattaatccttaatcacctcattcaaactaattcattctgcatttttgagtaccaactcttgtcaggctcagtggcagcttctacgacctgatggatggaaaaaaatcaaactctgtgactctatggttgactgccacctctgcaaccttgactcatctgctgaaaaggcaagaagaagaaagggcagcaagccctgttttagggactacataagatgaggggagataa

SEQ ID NO: 1851 - DNA, 5450 bp, Homo sapiens
atgggcagctcccggctgagggtctttgaccctcatttggagaggaaagattccgccgcggcgctctcagaccgagagctgcccttgcctaccttcgatgtgccttatttcaaatacatcgacgaggaggatgaggacgatgaatggagcagccgctcgcagtcttccaccgaggatgactcagtggactctctgctctctgacagatatgtggtggtgtccgggaccccggagaagattttggagcaccttttgaatgacttgcacctggaagaagtccaggacaaagaaacagagaccctcctggatgacttccttctcacgtacactgtcttcatgacaactgatgacttgtgccaggctctgttaagaatctattctgctaagaagtatcaaggcaaagaggaaaactcagacgttccgcgtaggaaacgtaaagtcttgcatcttgtttcccagtggattgctctgtacaaagactggttacctgaagatgaacattcaaaaatgtttttaaagaccatatataggaatgtactggatgatgtttatgaatatccaatacttgaaaaagaattgaaagaatttcaaaagatacttggaatgcaccgtcgtcacactgtagatgaatattcaccacaaaaaaagaataaagcccttttccaccaattcagtcttaaggagaactggctccagcatagaggaactgtgactgaaacggaggaaattttctgccacgtgtatataacagagcactcctatgtcagtgtgaaggcaaaagtttccagtatagcccaagagattctgctctgcagccagctgggcaagcgagtgcagctggtgaaaaaattcatcaaaattgcggctcactgcaaagcccagagaaacctgaattctttctttgccattgtgatgggtctcaacactgcttctgtcagtcgactgtcgcagacctgggagaaaatccctgggaagtttaagaaacttttctctgaacttgaaagtttaacagatccttccctaaatcacaaagcctacagagatgcattcaaaaagatgaagccaccaaaaatccctttcatgcccttattgcttaaagatgtaacatttattcatgaaggaaataaaacttttttggataatcttgtcaattttgaaaagctgcatatgatcgcagacactgtccgaaccctgagacactgcaggactaaccagtttggtgacctgtctccaaaagagcatcaagagttaaagtcctatgttaatcacctgtatgtcattgacagccagcaggctctgtttgagctctcacacaggatcgagcctcgggtgtgagccccactgcctcacctcccctgtatctgcagcactttgagctacgggaatgtctatgccaagcacgttgctttcctgtgagaaaagaagttgctgagttttatcagtataacccaagacattcacaggaaagccagccaaagcgtgttcaggaagtgatgtcagccaccagagagggggagaggtttctccatgctactctcgggacaagaaggcagaaggagagtcagaagcattcttgagatggagaaggctggtttcttatgatcacattgttgatccagtccagttttcaatatgagatgtgccagcatcaagacaagacaacgtcttgacatgcaatgaccaaatatttcattaagagcgtgcatgaaacaggaaggagtttttactttgcctagttttagattactgtccataagctgtcaaagaagtcattcttttgaacacctgatgacagagacagcatctctagatctccagggaggagaggtttctgttgatacaacctgtgacatcaccaaaagccacttgtgtctagggagttagtgaggactgcagctagcatccatgctctgatgggcagatgaacaatgtcaaggtgtgcatcactttgcaccacaatcaactattgacacatgcttgcaggtgaaattagtttctgtacaactgatttgcagctataggcaaggtagatgaagttgctttgccagtaaggaaaaatagtaatctttaagaaattgactcattgtttaatttctggggattttctttatacttctaagcaggctcttatcttttattggacataatatgattttgaaaaagcacagtgcctgacacattgcaaacactcaccaactgcttgctgaggtgacagagtcacaaaagtctgcattcttgtgcctgatgatgcattttgcgtacctcatacaggctccttgcccacactatggaatgacagcagccagtgcagggaggttaagtgacatttaatgagtgaagcacttagcactctctaggtaataagatagtggtaattactagtgttttggcaaatgaaaaatgccctgaaatagccaaatgtctgattaatgttggcaacttagaagtcctataatccaactaccagccaaagcagggagcctttctataatttgcctttttttttttttttttcaaaatctgagtcttctaaaatcttattattcccatttttaccaattgaggctcctgtagcaaataagacctcttgatattttcaaggactggttagaggatttctttcaaccttcacatgaacaaaacagcctatgggtcaaaataatgaaatccacccctgcctgctagatacttgtcaccttgctaaaatgcaagggcctggtccattcattttccaaatgcaggagtcttggtgcacttctcactcttcctgcctgttcatctctttcatgcccacacagacctgtttcctttttgtctcatcaacgcctcattcatcctcattactgaggcgtgtccaatgctttttgacatctttatagcagtgctgtttcctgggctcaggaaccacactgagcttgagatactgctggaaggaaccatgtggagagaaggtttgggagaactttgagagagacttagtttggcccagcatgtaaaacttcagtcctgaacatttatagggttttatagaagggcatcctccagggctggtccattcagagaaatgctgcatgctgccgtcatggaatgtggcccacaggacaccagagccgtgagaaccggagagcagacttccctcacggctgggctgagcaaaccctccaaagccctcctcacgcagttactaacaatagcatgggcttacagcacaagcacgtgttctcacctttttcctatgccctggactaaggtttggccagtgtaatcatataaggccatcctgacattgtttctgtgtttcaaaatttggatttttatttacattagaactacattgctcctagtagaacattacctttaggggactaattttccatggagaactatttcagcatattgcatgctgctcagaccccaagtcagatatgcccaccaagccagatgaagctacacaaatgtggtatttaaatgcattttgtacagtgacttcagagtatctcacatgacatgggtgtaaactggctggggagaaaatgatgcttgttcacctcttcctccagccgtggttaggtggtcctaggggtagcagagggaagggaggattttgtgcagtcaagatttgcttttccatccttgtcttctgaatgtctaaaatctctgcatctttctgaagtttaacaactgtctccagaggtttgccaggcagcagctctcagaagtttccaaagctttgcagaatcttagatctggaattaaagaattcaagcccgaattgtgagaaccagatattactcaacagaaagctctttctaaggaatctgagctgttcactggtggacagtggtggggcttgagtgctccttgttaataggatgggccatgcaccctctctggatattcaccaaggcctcttcagaatagggtttgttctggctagaagcgtggtctagaagatggctaagctctttgccagctctcatttggagttttattattgcataaaatcttcgctcactctgcaaatcttacgtaatctggcaccttcggcaccaggtggtgcaggggcacttctaagtgggctctttttgttacagcacaactctcagacagtcctgtgggtctttggattcgtcagcattccagcaaactagccctgcttagaagttagcacaagacagcagaatgcaggaccccgtaggcaaaatcacaaccttgctattaaaaaaaattttgttttacatacacatttgcaggtgttccctagagtgtggtgttttgaatttgctctttgtcatctgtataattgccaaatgattatagtgatacacatgacctgcattcacttttttctagtttccttaattatgtttagaataaattcatttccctagaccgagaaccacaaacaggtagtgtggagcatacaccgaatttagaagcatgtggataaggtcagtgctcacactgcctagtccacagggagaggatgctgcatgaatatatacttgcctctgagtggaggagaaatcgtggcatgaaagagagagtaccagtgatgacttcttatccctggagctgggctttcactgctacccatatcccagccctgcgagtctgttctagccagcacagacaccgcagatccggaactgaatgttcctaaatggcgcagccaatccaggcttttcagaaactgggcaaaaacattaaaatggggacgatcgggtcttccgcagtggtccaacacaggatttcttttaaatgtttcaaaaacatgtccttaaaatttcagcctgcttcttagcgagtgggccagttttgcttaaaactggtgggggggcgggggggaagtttttaaaaattgccaaaaagttagatgcaaatgtattactgtataaagcaaagctgtatatactaaacattttttagcagagtaatatttatttgcatagtctatttattgtattcgtatcacactgttattaaatactgggatgaaatcagtgacctgaagcaagaaatcttgccttttaatgtatcattaattagggctgctgtgatattgtcagcttgcattaacaattagaagatagagaacccgccatcagggtgtctacctaacttctcagggactacacttggtagttttccaccatttaaagaactggtaaatatgaaacatttgttgagttaccagaattgccattaacagtgttttctttcccatattccatgctttctgcctctgtgtatatatataatatatatgtatatgactgtgctgtgtatttatcgaagctagtaagcaataatttatatgtaaaaatggccaagcaatataaggttaaaacttatataagtaacccttaccttatcttgtattttcaatttttttttaaaactgcttttccaaatatgagactatgttaaagacactattcatgcctctt

SEQ ID NO: 1852 - DNA, 6621 bp, Homo sapiens
gctgcggccgcggctgagggacctgcccgcgctgctgcggagcgggctcacgctgcggaggaagcggagcgccgctgggggccggactctatcaagaagaatatctaatccgtaccttgaacatacgccttcccagatttatggagagaattcttcttgtgcaggaagagcattgaggaatattattatcgttcaagcagctgacctgataaaggacagagtgaacctcaaggggttttacaggaggagctgcgttgggtcagagctggtagactggcttctagaacactgtcctttcgtccagtgcagatctatggccataggagtctggcaactcctactggacatgggaattatgttatcagtggaccagcatctatactttcaagatacttatgttttctaccagttttcctctgatgaatgtagctacttgtactgtgaatttgaaagagaagaagaatggcaaaatggtgtcaagcttttactgcaacttgtgcctctcattcctgccagaggtggcatctgtgaactgtctcatcagaaaattgaagactccgaagaaagcagtgatgaaattcttgtgcgtctaacatctgcggtgcagagagagctagcagctgttattgctttgaaagcaaggaagtctgcaattgaacaagatgaagaaaacaacgacaaacatgtagctgtaacagaagccgaaagtgttccagattctcaggcaggggtgatgtgcaagctccaggaaagagatgaaatcggacgaattgaactagtccagaagctggcaaaagaaaactatcagtttttgcagacggacaaaaaagaacaggagaagtctgaacaccaagatgatgaagtgacgactgttcaggttaaagagcaagaccagagcgtcctggtgctgaagaaagtgcagtgctgtggcccagcccccacagctgggagtgcggagagccattggagatatgtggtggtgtccgggaccccggagaagattttggagcaccttttgaatgacttgcacctggaagaagtccaggacaaagaaacagagaccctcctggatgacttccttctcacgtacactgtcttcatgacaactgatgacttgtgccaggctctgttaaggcactattctgctaagaagtatcaaggcaaagaggaaaactcagacgttccgcgtaggaaacgtaaagtcttgcatcttgtttcccagtggattgctctgtacaaagactggttacctgaagatgaacattcaaaaatgtttttaaagaccatatataggaatgtactggatgatgtttatgaatatccaatacttgaaaaagaattgaaagaatttcaaaagatacttggaatgcaccgtcgtcacactgtagatgaatattcaccacaaaaaaagaataaagcccttttccaccaattcagtcttaaggagaactggctccagcatagaggaactgtgactgaaacggaggaaattttctgccacgtgtatataacagagcactcctatgtcagtgtgaaggcaaaagtttccagtatagcccaagagatcctaaaagtcgtggcagaaaagatccagtatgcagaagaggatctggctctggtggccatcacattctctggggaaaagcatgaacttcagccaaatgacttagtcatctccaaatccctcgaggcatctggtcgaatatatgtctaccggaaagacctggcggacactttgaacccatttgcagaaaatgaggaatcacagcaaaggtcgatgaggattttgggaatgaacacttgggatcttgctctggaattaatgaattttgattggagtctattcaattcaattcacgagcaagagctgatctacttcacgttcagcagacagggaagtggggaacacactgcaaatctcagccttctgctccagagatgcaatgaggtccagctttgggtggccacggagattctgctctgcagccagctgggcaagcgagtgcagctggtgaaaaaattcatcaaaattgcggctcactgcaaagcccagagaaacctgaattctttctttgccattgtgatgggtctcaacactgcttctgtcagtcgactgtcgcagacctgggagaaaatccctgggaagtttaagaaacttttctctgaacttgaaagtttaacagatccttccctaaatcacaaagcctacagagatgcattcaaaaagatgaagccaccaaaaatccctttcatgcccttattgcttaaagatgtaacatttattcatgaaggaaataaaacttttttggataatcttgtcaattttgaaaagctgcatatgatcgcagacactgtccgaaccctgagacactgcaggactaaccagtttggtgacctgtctccaaaagagcatcaagagttaaagtcctatgttaatcacctgtatgtcattgacagccagcaggctctgtttgagctctcacacaggatcgagcctcgggtgtgagccccactgcctcacctcccctgtatctgcagcactttgagctacgggaatgtctatgccaagcacgttgctttcctgtgagaaaagaagttgctgagttttatcagtataacccaagacattcacaggaaagccagccaaagcgtgttcaggaagtgatgtcagccaccagagagggggagaggtttctccatgctactctcgggacaagaaggcagaaggagagtcagaagcattcttgagatggagaaggctggtttcttatgatcacattgttgatccagtccagttttcaatatgagatgtgccagcatcaagacaagacaacgtcttgacatgcaatgaccaaatatttcattaagagcgtgcatgaaacaggaaggagtttttactttgcctagttttagattactgtccataagctgtcaaagaagtcattcttttgaacacctgatgacagagacagcatctctagatctccagggaggagaggtttctgttgatacaacctgtgacatcaccaaaagccacttgtgtctagggagttagtgaggactgcagctagcatccatgctctgatgggcagatgaacaatgtcaaggtgtgcatcactttgcaccacaatcaactattgacacatgcttgcaggtgaaattagtttctgtacaactgatttgcagctataggcaaggtagatgaagttgctttgccagtaaggaaaaatagtaatctttaagaaattgactcattgtttaatttctggggattttctttatacttctaagcaggctcttatcttttattggacataatatgattttgaaaaagcacagtgcctgacacattgcaaacactcaccaactgcttgctgaggtgacagagtcacaaaagtctgcattcttgtgcctgatgatgcattttgcgtacctcatacaggctccttgcccacactatggaatgacagcagccagtgcagggaggttaagtgacatttaatgagtgaagcacttagcactctctaggtaataagatagtggtaattactagtgttttggcaaatgaaaaatgccctgaaatagccaaatgtctgattaatgttggcaacttagaagtcctataatccaactaccagccaaagcagggagcctttctataatttgcctttttttttttttttttcaaaatctgagtcttctaaaatcttattattcccatttttaccaattgaggctcctgtagcaaataagacctcttgatattttcaaggactggttagaggatttctttcaaccttcacatgaacaaaacagcctatgggtcaaaataatgaaatccacccctgcctgctagatacttgtcaccttgctaaaatgcaagggcctggtccattcattttccaaatgcaggagtcttggtgcacttctcactcttcctgcctgttcatctctttcatgcccacacagacctgtttcctttttgtctcatcaacgcctcattcatcctcattactgaggcgtgtccaatgctttttgacatctttatagcagtgctgtttcctgggctcaggaaccacactgagcttgagatactgctggaaggaaccatgtggagagaaggtttgggagaactttgagagagacttagtttggcccagcatgtaaaacttcagtcctgaacatttatagggttttatagaagggcatcctccagggctggtccattcagagaaatgctgcatgctgccgtcatggaatgtggcccacaggacaccagagccgtgagaaccggagagcagacttccctcacggctgggctgagcaaaccctccaaagccctcctcacgcagttactaacaatagcatgggcttacagcacaagcacgtgttctcacctttttcctatgccctggactaaggtttggccagtgtaatcatataaggccatcctgacattgtttctgtgtttcaaaatttggatttttatttacattagaactacattgctcctagtagaacattacctttaggggactaattttccatggagaactatttcagcatattgcatgctgctcagaccccaagtcagatatgcccaccaagccagatgaagctacacaaatgtggtatttaaatgcattttgtacagtgacttcagagtatctcacatgacatgggtgtaaactggctggggagaaaatgatgcttgttcacctcttcctccagccgtggttaggtggtcctaggggtagcagagggaagggaggattttgtgcagtcaagatttgcttttccatccttgtcttctgaatgtctaaaatctctgcatctttctgaagtttaacaactgtctccagaggtttgccaggcagcagctctcagaagtttccaaagctttgcagaatcttagatctggaattaaagaattcaagcccgaattgtgagaaccagatattactcaacagaaagctctttctaaggaatctgagctgttcactggtggacagtggtggggcttgagtgctccttgttaataggatgggccatgcaccctctctggatattcaccaaggcctcttcagaatagggtttgttctggctagaagcgtggtctagaagatggctaagctctttgccagctctcatttggagttttattattgcataaaatcttcgctcactctgcaaatcttacgtaatctggcaccttcggcaccaggtggtgcaggggcacttctaagtgggctctttttgttacagcacaactctcagacagtcctgtgggtctttggattcgtcagcattccagcaaactagccctgcttagaagttagcacaagacagcagaatgcaggaccccgtaggcaaaatcacaaccttgctattaaaaaaaattttgttttacatacacatttgcaggtgttccctagagtgtggtgttttgaatttgctctttgtcatctgtataattgccaaatgattatagtgatacacatgacctgcattcacttttttctagtttccttaattatgtttagaataaattcatttccctagaccgagaaccacaaacaggtagtgtggagcatacaccgaatttagaagcatgtggataaggtcagtgctcacactgcctagtccacagggagaggatgctgcatgaatatatacttgcctctgagtggaggagaaatcgtggcatgaaagagagagtaccagtgatgacttcttatccctggagctgggctttcactgctacccatatcccagccctgcgagtctgttctagccagcacagacaccgcagatccggaactgaatgttcctaaatggcgcagccaatccaggcttttcagaaactgggcaaaaacattaaaatggggacgatcgggtcttccgcagtggtccaacacaggatttcttttaaatgtttcaaaaacatgtccttaaaatttcagcctgcttcttagcgagtgggccagttttgcttaaaactggtgggggggcgggggggaagtttttaaaaattgccaaaaagttagatgcaaatgtattactgtataaagcaaagctgtatatactaaacattttttagcagagtaatatttatttgcatagtctatttattgtattcgtatcacactgttattaaatactgggatgaaatcagtgacctgaagcaagaaatcttgccttttaatgtatcattaattagggctgctgtgatattgtcagcttgcattaacaattagaagatagagaacccgccatcagggtgtctacctaacttctcagggactacacttggtagttttccaccatttaaagaactggtaaatatgaaacatttgttgagttaccagaattgccattaacagtgttttctttcccatattccatgctttctgcctctgtgtatatatataatatatatgtatatgactgtgctgtgtatttatcgaagctagtaagcaataatttatatgtaaaaatggccaagcaatataaggttaaaacttatataagtaacccttaccttatcttgtattttcaatttttttttaaaactgcttttccaaatatgagactatgttaaagacactattcatgcctctt

SEQ ID NO: 1853 - DNA, 6095 bp, Homo sapiens
agtttccctgcagccacagaggcacgcgctcccgtttccttttccctgcctgccttcccttcccttgctccatctcactcgctctctgcctcctctaccctccctccctctcttttctctccgcctctccagcgttctagctgactgcagagctcttagcagccagatggactcagttcccagtgaaaggacagggatggcaagatcttttagcatttaggggatgcctttgttagtaaccgttcacaatgggcagctcccggctgagggtctttgaccctcatttggagaggaaagattccgccgcggcgctctcagaccgagagctgcccttgcctaccttcgatgtgccttatttcaaatacatcgacgaggaggatgaggacgatgaatggagcagccgctcgcagtcttccaccgaggatgactcagtggactctctgctctctgacagatatgtggtggtgtccgggaccccggagaagattttggagcaccttttgaatgacttgcacctggaagaagtccaggacaaagaaacagagaccctcctggatgacttccttctcacgtacactgtcttcatgacaactgatgacttgtgccaggctctgttaaggcactattctgctaagaagtatcaaggcaaagaggaaaactcagacgttccgcgtaggaaacgtaaagtcttgcatcttgtttcccagtggattgctctgtacaaagactggttacctgaagatgaacattcaaaaatgtttttaaagaccatatataggaatgtactggatgatgtttatgaatatccaatacttgaaaaagaattgaaagaatttcaaaagatacttggaatgcaccgtcgtcacactgtagatgaatattcaccacaaaaaaagaataaagcccttttccaccaattcagtcttaaggagaactggctccagcatagaggaactgtgactgaaacggaggaaattttctgccacgtgtatataacagagcactcctatgtcagtgtgaaggcaaaagtttccagtatagcccaagagatcctaaaagtcgtggcagaaaagatccagtatgcagaagaggatctggctctggtggccatcacattctctggggaaaagcatgaacttcagccaaatgacttagtcatctccaaatccctcgaggcatctggtcgaatatatgtctaccggaaagacctggcggacactttgaacccatttgcagaaaatgaggaatcacagcaaaggtcgatgaggattttgggaatgaacacttgggatcttgctctggaattaatgaattttgattggagtctattcaattcaattcacgagcaagagctgatctacttcacgttcagcagacagggaagtggggaacacactgcaaatctcagccttctgctccagagatgcaatgaggtccagctttgggtggccacggagattctgctctgcagccagctgggcaagcgagtgcagctggtgaaaaaattcatcaaaattgcggctcactgcaaagcccagagaaacctgaattctttctttgccattgtgatgggtctcaacactgcttctgtcagtcgactgtcgcagacctgggagaaaatccctgggaagtttaagaaacttttctctgaacttgaaagtttaacagatccttccctaaatcacaaagcctacagagatgcattcaaaaagatgaagccaccaaaaatccctttcatgcccttattgcttaaagatgtaacatttattcatgaaggaaataaaacttttttggataatcttgtcaattttgaaaagctgcatatgatcgcagacactgtccgaaccctgagacactgcaggactaaccagtttggtgacctgtctccaaaagagcatcaagagttaaagtcctatgttaatcacctgtatgtcattgacagccagcaggctctgtttgagctctcacacaggatcgagcctcgggtgtgagccccactgcctcacctcccctgtatctgcagcactttgagctacgggaatgtctatgccaagcacgttgctttcctgtgagaaaagaagttgctgagttttatcagtataacccaagacattcacaggaaagccagccaaagcgtgttcaggaagtgatgtcagccaccagagagggggagaggtttctccatgctactctcgggacaagaaggcagaaggagagtcagaagcattcttgagatggagaaggctggtttcttatgatcacattgttgatccagtccagttttcaatatgagatgtgccagcatcaagacaagacaacgtcttgacatgcaatgaccaaatatttcattaagagcgtgcatgaaacaggaaggagtttttactttgcctagttttagattactgtccataagctgtcaaagaagtcattcttttgaacacctgatgacagagacagcatctctagatctccagggaggagaggtttctgttgatacaacctgtgacatcaccaaaagccacttgtgtctagggagttagtgaggactgcagctagcatccatgctctgatgggcagatgaacaatgtcaaggtgtgcatcactttgcaccacaatcaactattgacacatgcttgcaggtgaaattagtttctgtacaactgatttgcagctataggcaaggtagatgaagttgctttgccagtaaggaaaaatagtaatctttaagaaattgactcattgtttaatttctggggattttctttatacttctaagcaggctcttatcttttattggacataatatgattttgaaaaagcacagtgcctgacacattgcaaacactcaccaactgcttgctgaggtgacagagtcacaaaagtctgcattcttgtgcctgatgatgcattttgcgtacctcatacaggctccttgcccacactatggaatgacagcagccagtgcagggaggttaagtgacatttaatgagtgaagcacttagcactctctaggtaataagatagtggtaattactagtgttttggcaaatgaaaaatgccctgaaatagccaaatgtctgattaatgttggcaacttagaagtcctataatccaactaccagccaaagcagggagcctttctataatttgcctttttttttttttttttcaaaatctgagtcttctaaaatcttattattcccatttttaccaattgaggctcctgtagcaaataagacctcttgatattttcaaggactggttagaggatttctttcaaccttcacatgaacaaaacagcctatgggtcaaaataatgaaatccacccctgcctgctagatacttgtcaccttgctaaaatgcaagggcctggtccattcattttccaaatgcaggagtcttggtgcacttctcactcttcctgcctgttcatctctttcatgcccacacagacctgtttcctttttgtctcatcaacgcctcattcatcctcattactgaggcgtgtccaatgctttttgacatctttatagcagtgctgtttcctgggctcaggaaccacactgagcttgagatactgctggaaggaaccatgtggagagaaggtttgggagaactttgagagagacttagtttggcccagcatgtaaaacttcagtcctgaacatttatagggttttatagaagggcatcctccagggctggtccattcagagaaatgctgcatgctgccgtcatggaatgtggcccacaggacaccagagccgtgagaaccggagagcagacttccctcacggctgggctgagcaaaccctccaaagccctcctcacgcagttactaacaatagcatgggcttacagcacaagcacgtgttctcacctttttcctatgccctggactaaggtttggccagtgtaatcatataaggccatcctgacattgtttctgtgtttcaaaatttggatttttatttacattagaactacattgctcctagtagaacattacctttaggggactaattttccatggagaactatttcagcatattgcatgctgctcagaccccaagtcagatatgcccaccaagccagatgaagctacacaaatgtggtatttaaatgcattttgtacagtgacttcagagtatctcacatgacatgggtgtaaactggctggggagaaaatgatgcttgttcacctcttcctccagccgtggttaggtggtcctaggggtagcagagggaagggaggattttgtgcagtcaagatttgcttttccatccttgtcttctgaatgtctaaaatctctgcatctttctgaagtttaacaactgtctccagaggtttgccaggcagcagctctcagaagtttccaaagctttgcagaatcttagatctggaattaaagaattcaagcccgaattgtgagaaccagatattactcaacagaaagctctttctaaggaatctgagctgttcactggtggacagtggtggggcttgagtgctccttgttaataggatgggccatgcaccctctctggatattcaccaaggcctcttcagaatagggtttgttctggctagaagcgtggtctagaagatggctaagctctttgccagctctcatttggagttttattattgcataaaatcttcgctcactctgcaaatcttacgtaatctggcaccttcggcaccaggtggtgcaggggcacttctaagtgggctctttttgttacagcacaactctcagacagtcctgtgggtctttggattcgtcagcattccagcaaactagccctgcttagaagttagcacaagacagcagaatgcaggaccccgtaggcaaaatcacaaccttgctattaaaaaaaattttgttttacatacacatttgcaggtgttccctagagtgtggtgttttgaatttgctctttgtcatctgtataattgccaaatgattatagtgatacacatgacctgcattcacttttttctagtttccttaattatgtttagaataaattcatttccctagaccgagaaccacaaacaggtagtgtggagcatacaccgaatttagaagcatgtggataaggtcagtgctcacactgcctagtccacagggagaggatgctgcatgaatatatacttgcctctgagtggaggagaaatcgtggcatgaaagagagagtaccagtgatgacttcttatccctggagctgggctttcactgctacccatatcccagccctgcgagtctgttctagccagcacagacaccgcagatccggaactgaatgttcctaaatggcgcagccaatccaggcttttcagaaactgggcaaaaacattaaaatggggacgatcgggtcttccgcagtggtccaacacaggatttcttttaaatgtttcaaaaacatgtccttaaaatttcagcctgcttcttagcgagtgggccagttttgcttaaaactggtgggggggcgggggggaagtttttaaaaattgccaaaaagttagatgcaaatgtattactgtataaagcaaagctgtatatactaaacattttttagcagagtaatatttatttgcatagtctatttattgtattcgtatcacactgttattaaatactgggatgaaatcagtgacctgaagcaagaaatcttgccttttaatgtatcattaattagggctgctgtgatattgtcagcttgcattaacaattagaagatagagaacccgccatcagggtgtctacctaacttctcagggactacacttggtagttttccaccatttaaagaactggtaaatatgaaacatttgttgagttaccagaattgccattaacagtgttttctttcccatattccatgctttctgcctctgtgtatatatataatatatatgtatatgactgtgctgtgtatttatcgaagctagtaagcaataatttatatgtaaaaatggccaagcaatataaggttaaaacttatataagtaacccttaccttatcttgtattttcaatttttttttaaaactgcttttccaaatatgagactatgttaaagacactat

SEQ ID NO: 1854 - DNA, 5864 bp, Homo sapiens
atgggcagctcccggctgagggtctttgaccctcatttggagaggaaagattccgccgcggcgctctcagaccgagagctgcccttgcctaccttcgatgtgccttatttcaaatacatcgacgaggaggatgaggacgatgaatggagcagccgctcgcagtcttccaccgaggatgactcagtggactctctgctctctgacagatatgtggtggtgtccgggaccccggagaagattttggagcaccttttgaatgacttgcacctggaagaagtccaggacaaagaaacagagaccctcctggatgacttccttctcacgtacactgtcttcatgacaactgatgacttgtgccaggctctgttaagaatctattctgctaagaagtatcaaggcaaagaggaaaactcagacgttccgcgtaggaaacgtaaagtcttgcatcttgtttcccagtggattgctctgtacaaagactggttacctgaagatgaacattcaaaaatgtttttaaagaccatatataggaatgtactggatgatgtttatgaatatccaatacttgaaaaagaattgaaagaatttcaaaagatacttggaatgcaccgtcgtcacactgtagatgaatattcaccacaaaaaaagaataaagcccttttccaccaattcagtcttaaggagaactggctccagcatagaggaactgtgactgaaacggaggaaattttctgccacgtgtatataacagagcactcctatgtcagtgtgaaggcaaaagtttccagtatagcccaagagatcctaaaagtcgtggcagaaaagatccagtatgcagaagaggatctggctctggtggccatcacattctctggggataaagaaaagcatgaacttcagccaaatgacttagtcatctccaaatccctcgaggcatctggtcgaatatatgtctaccggaaagacctggcggacactttgaacccatttgcagaaaatgaggaatcacagcaaaggtcgatgaggattttgggaatgaacacttgggatcttgctctggaattaatgaattttgattggagtctattcaattcaattcacgagcaagagctgatctacttcacgttcagcagacagggaagtggggaacacactgcaaatctcagccttctgctccagagatgcaatgaggtccagctttgggtggccacggagattctgctctgcagccagctgggcaagcgagtgcagctggtgaaaaaattcatcaaaattgcggctcactgcaaagcccagagaaacctgaattctttctttgccattgtgatgggtctcaacactgcttctgtcagtcgactgtcgcagacctgggagaaaatccctgggaagtttaagaaacttttctctgaacttgaaagtttaacagatccttccctaaatcacaaagcctacagagatgcattcaaaaagatgaagccaccaaaaatccctttcatgcccttattgcttaaagatgtaacatttattcatgaaggaaataaaacttttttggataatcttgtcaattttgaaaagctgcatatgatcgcagacactgtccgaaccctgagacactgcaggactaaccagtttggtgacctgtctccaaaagagcatcaagagttaaagtcctatgttaatcacctgtatgtcattgacagccagcaggctctgtttgagctctcacacaggatcgagcctcgggtgtgagccccactgcctcacctcccctgtatctgcagcactttgagctacgggaatgtctatgccaagcacgttgctttcctgtgagaaaagaagttgctgagttttatcagtataacccaagacattcacaggaaagccagccaaagcgtgttcaggaagtgatgtcagccaccagagagggggagaggtttctccatgctactctcgggacaagaaggcagaaggagagtcagaagcattcttgagatggagaaggctggtttcttatgatcacattgttgatccagtccagttttcaatatgagatgtgccagcatcaagacaagacaacgtcttgacatgcaatgaccaaatatttcattaagagcgtgcatgaaacaggaaggagtttttactttgcctagttttagattactgtccataagctgtcaaagaagtcattcttttgaacacctgatgacagagacagcatctctagatctccagggaggagaggtttctgttgatacaacctgtgacatcaccaaaagccacttgtgtctagggagttagtgaggactgcagctagcatccatgctctgatgggcagatgaacaatgtcaaggtgtgcatcactttgcaccacaatcaactattgacacatgcttgcaggtgaaattagtttctgtacaactgatttgcagctataggcaaggtagatgaagttgctttgccagtaaggaaaaatagtaatctttaagaaattgactcattgtttaatttctggggattttctttatacttctaagcaggctcttatcttttattggacataatatgattttgaaaaagcacagtgcctgacacattgcaaacactcaccaactgcttgctgaggtgacagagtcacaaaagtctgcattcttgtgcctgatgatgcattttgcgtacctcatacaggctccttgcccacactatggaatgacagcagccagtgcagggaggttaagtgacatttaatgagtgaagcacttagcactctctaggtaataagatagtggtaattactagtgttttggcaaatgaaaaatgccctgaaatagccaaatgtctgattaatgttggcaacttagaagtcctataatccaactaccagccaaagcagggagcctttctataatttgcctttttttttttttttttcaaaatctgagtcttctaaaatcttattattcccatttttaccaattgaggctcctgtagcaaataagacctcttgatattttcaaggactggttagaggatttctttcaaccttcacatgaacaaaacagcctatgggtcaaaataatgaaatccacccctgcctgctagatacttgtcaccttgctaaaatgcaagggcctggtccattcattttccaaatgcaggagtcttggtgcacttctcactcttcctgcctgttcatctctttcatgcccacacagacctgtttcctttttgtctcatcaacgcctcattcatcctcattactgaggcgtgtccaatgctttttgacatctttatagcagtgctgtttcctgggctcaggaaccacactgagcttgagatactgctggaaggaaccatgtggagagaaggtttgggagaactttgagagagacttagtttggcccagcatgtaaaacttcagtcctgaacatttatagggttttatagaagggcatcctccagggctggtccattcagagaaatgctgcatgctgccgtcatggaatgtggcccacaggacaccagagccgtgagaaccggagagcagacttccctcacggctgggctgagcaaaccctccaaagccctcctcacgcagttactaacaatagcatgggcttacagcacaagcacgtgttctcacctttttcctatgccctggactaaggtttggccagtgtaatcatataaggccatcctgacattgtttctgtgtttcaaaatttggatttttatttacattagaactacattgctcctagtagaacattacctttaggggactaattttccatggagaactatttcagcatattgcatgctgctcagaccccaagtcagatatgcccaccaagccagatgaagctacacaaatgtggtatttaaatgcattttgtacagtgacttcagagtatctcacatgacatgggtgtaaactggctggggagaaaatgatgcttgttcacctcttcctccagccgtggttaggtggtcctaggggtagcagagggaagggaggattttgtgcagtcaagatttgcttttccatccttgtcttctgaatgtctaaaatctctgcatctttctgaagtttaacaactgtctccagaggtttgccaggcagcagctctcagaagtttccaaagctttgcagaatcttagatctggaattaaagaattcaagcccgaattgtgagaaccagatattactcaacagaaagctctttctaaggaatctgagctgttcactggtggacagtggtggggcttgagtgctccttgttaataggatgggccatgcaccctctctggatattcaccaaggcctcttcagaatagggtttgttctggctagaagcgtggtctagaagatggctaagctctttgccagctctcatttggagttttattattgcataaaatcttcgctcactctgcaaatcttacgtaatctggcaccttcggcaccaggtggtgcaggggcacttctaagtgggctctttttgttacagcacaactctcagacagtcctgtgggtctttggattcgtcagcattccagcaaactagccctgcttagaagttagcacaagacagcagaatgcaggaccccgtaggcaaaatcacaaccttgctattaaaaaaaattttgttttacatacacatttgcaggtgttccctagagtgtggtgttttgaatttgctctttgtcatctgtataattgccaaatgattatagtgatacacatgacctgcattcacttttttctagtttccttaattatgtttagaataaattcatttccctagaccgagaaccacaaacaggtagtgtggagcatacaccgaatttagaagcatgtggataaggtcagtgctcacactgcctagtccacagggagaggatgctgcatgaatatatacttgcctctgagtggaggagaaatcgtggcatgaaagagagagtaccagtgatgacttcttatccctggagctgggctttcactgctacccatatcccagccctgcgagtctgttctagccagcacagacaccgcagatccggaactgaatgttcctaaatggcgcagccaatccaggcttttcagaaactgggcaaaaacattaaaatggggacgatcgggtcttccgcagtggtccaacacaggatttcttttaaatgtttcaaaaacatgtccttaaaatttcagcctgcttcttagcgagtgggccagttttgcttaaaactggtgggggggcgggggggaagtttttaaaaattgccaaaaagttagatgcaaatgtattactgtataaagcaaagctgtatatactaaacattttttagcagagtaatatttatttgcatagtctatttattgtattcgtatcacactgttattaaatactgggatgaaatcagtgacctgaagcaagaaatcttgccttttaatgtatcattaattagggctgctgtgatattgtcagcttgcattaacaattagaagatagagaacccgccatcagggtgtctacctaacttctcagggactacacttggtagttttccaccatttaaagaactggtaaatatgaaacatttgttgagttaccagaattgccattaacagtgttttctttcccatattccatgctttctgcctctgtgtatatatataatatatatgtatatgactgtgctgtgtatttatcgaagctagtaagcaataatttatatgtaaaaatggccaagcaatataaggttaaaacttatataagtaacccttaccttatcttgtattttcaatttttttttaaaactgcttttccaaatatgagactatgttaaagacactattcatgcctctt

SEQ ID NO: 1855 - DNA, 1164 bp, Homo sapiens
cgccggagcgggtctccaggctggcgagcgcccaggacaggcatgttgttgggactggcggccatggagctgaaggtgtgggtggatggcatccagcgtgtggtctgtggggtctcagagcagaccacctgccaggaagtggtcatcgcactagcccaagcaataggccagactggccgctttgtgcttgtgcagcggcttcgggagaaggagcggcagttgctgccacaagagtgtccagtgggcgcccaggccacctgcggacagtttgccagcgatgtccagtttgtcctgaggcgcacagggcccagcctagctgggaggccctcctcagacagctgtccacccccggaacgctgcctaattcgtgccagcctccctgtaaagccacgggctgcgctgggctgtgagccccgcaaaacactgacccccgagccagcccccagcctctcacgccctgggcctgcggcccctgtgacacccacaccaggctgctgcacagacctgcggggcctggagctcagggtgcagaggaatgctgaggagctgggccatgaggccttctgggagcaagagctgcgccgggagcaggcccgggagcgagagggacaggcacgcctgcaggcactaagtgcggccactgctgagcatgccgcccggctgcaggccctggacgctcaggcccgtgccctggaggctgagctgcagctggcagcggaggcccctgggcccccctcacctatggcatctgccactgagcgcctgcaccaggacctggctgttcaggagcggcagagtgcggaggtgcagggcagcctggctctggtgagccgggccctggaggcagcagagcgagccttgcaggctcaggctcaggagctggaggagctgaaccgagagctccgtcagtgcaacctgcagcagttcatccagcagaccggggctgcgctgccaccgcccccacggcctgacaggggccctcctggcactcagggccctctgcctccagccagagaggagtccctcctgggcgctccctctgagtcccatgctggtgcccagcctaggccccgaggtggcccccatgacgcagaactcctggaggtagcagcagctcctgccccagagtggtgtcctctggcagcccagccccaggctctgtga

SEQ ID NO: 1856 - DNA, 1731 bp, Homo sapiens
ggcccgggtgcgccgcggcgctgggggcggcaggttgcggcggcgccggagcgggtctccaggctggcgagcgcccaggacaggcatgttgttgggactggcggccatggagctgaaggtgtgggtggatggcatccagcgtgtggtctgtggggtctcagagcagaccacctgccaggaagtggtcatcgcactagcccaagcaataggccagactggccgctttgtgcttgtgcagcggcttcgggagaaggagcggcagttgctgccacaagagtgtccagtgggcgcccaggccacctgcggacagtttgccagcgatgtccagtttgtcctgaggcgcacagggcccagcctagctgggaggccctcctcagacagctgtccacccccggaacgctgcctaattcgtgccagcctccctgtaaagccacgggctgcgctgggctgtgagccccgcaaaacactgacccccgagccagcccccagcctctcacgccctgggcctgcggcccctgtgacacccacaccaggctgctgcacagacctgcggggcctggagctcagggtgcagaggaatgctgaggagctgggccatgaggccttctgggagcaagagctgcgccgggagcaggcccgggagcgagagggacaggcacgcctgcaggcactaagtgcggccactgctgagcatgccgcccggctgcaggccctggacgctcaggcccgtgccctggaggctgagctgcagctggcagcggaggcccctgggcccccctcacctatggcatctgccactgagcgcctgcaccaggacctggctgttcaggagcggcagagtgcggaggtgcagggcagcctggctctggtgagccgggccctggaggcagcagagcgagccttgcaggctcaggctcaggagctggaggagctgaaccgagagctccgtcagtgcaacctgcagcagttcatccagcagaccggggctgcgctgccaccgcccccacggcctgacaggggccctcctggcactcaggtcggagtggttctggggggaggctgggaggtgaggacctggcccagccccactccaagctgacttcccaacccacagggccctctgcctccagccagagaggagtccctcctgggcgctccctctgagtcccatgctggtgcccagcctaggccccgagggtatgtctgtgccccacctccccctggggcaccgggccctcctgtggctgcagccacctcagcctgtgtcctcccgcagtggcccccatgacgcagaactcctggaggtagcagcagctcctgccccagagtggtgtcctctggcagcccagccccaggctctgtgacagcctagtgagggctgcaagaccatcctgcccggaccacagaaggagagttggcggtcacagagggctcctctgccaggcagtgggaagccctgggtttggcctcaggagctgggggtgcagtgggggactgccctagtccttgccaggtcgccagcaccctggagaagcatggggcgtagccagctcggaacttgccaggccccaaaggccacgactgcctgttggggacaggagatgcatggacagtgtgctcaagctgtgggcatgtgcttgcctgcgggagaggtccttcactgtgtgtacacagcaagagcatgtgtgtgccacttcccctaccccaacgtgaaaacctcaataaactgcc

SEQ ID NO: 1857 - DNA, 1928 bp, Homo sapiens
ccggtacttgggagcgcggggcgcgcctcgagccggccggacgccgactccaactggggagagttttccgcgatgcccggacggagagcgggggcggcgccgcacctgcgcccgccctgcggaacggggacgccctggctcccgccaggctggggtcgcggcgcgggcttcggtgcccgcggcggggaccgggactttcggggcgagcgcagcgattaggcggcagcggcggggctccccgggctggcgggggctgctcagacccggagtctgctccatctgcagggtcgaggtctgggttgcgaccccgagcgcctctgcggcctgagcaggtcggggtggggcgttcccatgccggcggccgcggggcctggcgtgcgggcgcctccgcgccgcccggggagggggcagtgtcctccgagccaggacaggcatgttgttgggactggcggccatggagctgaaggtgtgggtggatggcatccagcgtgtggtctgtggggtctcagagcagaccacctgccaggaagtggtcatcgcactagcccaagcaataggccagactggccgctttgtgcttgtgcagcggcttcgggagaaggagcggcagttgctgccacaagagtgtccagtgggcgcccaggccacctgcggacagtttgccagcgatgtccagtttgtcctgaggcgcacagggcccagcctagctgggaggccctcctcagacagctgtccacccccggaacgctgcctaattcgtgccagcctccctgtaaagccacgggctgcgctgggctgtgagccccgcaaaacactgacccccgagccagcccccagcctctcacgccctgggcctgcggcccctgtgacacccacaccaggctgctgcacagacctgcggggcctggagctcagggtgcagaggaatgctgaggagctgggccatgaggccttctgggagcaagagctgcgccgggagcaggcccgggagcgagagggacaggcacgcctgcaggcactaagtgcggccactgctgagcatgccgcccggctgcaggccctggacgctcaggcccgtgccctggaggctgagctgcagctggcagcggaggcccctgggcccccctcacctatggcatctgccactgagcgcctgcaccaggacctggctgttcaggagcggcagagtgcggaggtgcagggcagcctggctctggtgagccgggccctggaggcagcagagcgagccttgcaggctcaggctcaggagctggaggagctgaaccgagagctccgtcagtgcaacctgcagcagttcatccagcagaccggggctgcgctgccaccgcccccacggcctgacaggggccctcctggcactcagggccctctgcctccagccagagaggagtccctcctgggcgctccctctgagtcccatgctggtgcccagcctaggccccgaggtggcccccatgacgcagaactcctggaggtagcagcagctcctgccccagagtggtgtcctctggcagcccagccccaggctctgtgacagcctagtgagggctgcaagaccatcctgcccggaccacagaaggagagttggcggtcacagagggctcctctgccaggcagtgggaagccctgggtttggcctcaggagctgggggtgcagtgggggactgccctagtccttgccaggtcgccagcaccctggagaagcatggggcgtagccagctcggaacttgccaggccccaaaggccacgactgcctgttggggacaggagatgcatggacagtgtgctcaagctgtgggcatgtgcttgcctgcgggagaggtccttcactgtgtgtacacagcaagagcatgtgtgtgccacttcccctaccccaacgtgaaaacctcaataaactgcccgaagc

SEQ ID NO: 1858 - DNA, 1745 bp, Homo sapiens
tcccgcaccaggactctgcgcccgccagctccgcagggctccacctccctcgccgggactggtgaccctgcgaccccgcgacccctgcgcgtccagactactgcagctgcggacaggcatgttgttgggactggcggccatggagctgaaggtgtgggtggatggcatccagcgtgtggtctgtggggtctcagagcagaccacctgccaggaagtggtcatcgcactagcccaagcaataggccagactggccgctttgtgcttgtgcagcggcttcgggagaaggagcggcagttgctgccacaagagtgtccagtgggcgcccaggccacctgcggacagtttgccagcgatgtccagtttgtcctgaggcgcacagggcccagcctagctgggaggccctcctcagacagctgtccacccccggaacgctgcctaattcgtgccagcctccctgtaaagccacgggctgcgctgggctgtgagccccgcaaaacactgacccccgagccagcccccagcctctcacgccctgggcctgcggcccctgtgacacccacaccaggctgctgcacagacctgcggggcctggagctcagggtgcagaggaatgctgaggagctgggccatgaggccttctgggagcaagagctgcgccgggagcaggcccgggagcgagagggacaggcacgcctgcaggcactaagtgcggccactgctgagcatgccgcccggctgcaggccctggacgctcaggcccgtgccctggaggctgagctgcagctggcagcggaggcccctgggcccccctcacctatggcatctgccactgagcgcctgcaccaggacctggctgttcaggagcggcagagtgcggaggtgcagggcagcctggctctggtgagccgggccctggaggcagcagagcgagccttgcaggctcaggctcaggagctggaggagctgaaccgagagctccgtcagtgcaacctgcagcagttcatccagcagaccggggctgcgctgccaccgcccccacggcctgacaggggccctcctggcactcaggtcggagtggttctggggggaggctgggaggtgaggacctggcccagccccactccaagctgacttcccaacccacagggccctctgcctccagccagagaggagtccctcctgggcgctccctctgagtcccatgctggtgcccagcctaggccccgagggtatgtctgtgccccacctccccctggggcaccgggccctcctgtggctgcagccacctcagcctgtgtcctcccgcagtggcccccatgacgcagaactcctggaggtagcagcagctcctgccccagagtggtgtcctctggcagcccagccccaggctctgtgacagcctagtgagggctgcaagaccatcctgcccggaccacagaaggagagttggcggtcacagagggctcctctgccaggcagtgggaagccctgggtttggcctcaggagctgggggtgcagtgggggactgccctagtccttgccaggtcgccagcaccctggagaagcatggggcgtagccagctcggaacttgccaggccccaaaggccacgactgcctgttggggacaggagatgcatggacagtgtgctcaagctgtgggcatgtgcttgcctgcgggagaggtccttcactgtgtgtacacagcaagagcatgtgtgtgccacttcccctaccccaacgtg

SEQ ID NO: 1859 - DNA, 1450 bp, Homo sapiens
ggggagggggcagtgtcctccgagccaggacaggcatgttgttgggactggcggccatggagctgaaggtgtgggtggatggcatccagcgtgtggtctgtggggtctcagagcagaccacctgccaggaagtggtcatcgcactagcccaagcaataggccagactggccgctttgtgcttgtgcagcggcttcgggagaaggagcggcagttgctgccacaagagtgtccagtgggcgcccaggccacctgcggacagtttgccagcgatgtccagtttgtcctgaggcgcacagggcccagcctagctgggaggccctcctcagacagctgtccacccccggaacgctgcctaattcgtgccagcctccctgtaaagccacgggctgcgctgggctgtgagccccgcaaaacactgacccccgagccagcccccagcctctcacgccctgggcctgcggcccctgtgacacccacaccaggctgctgcacagacctgcggggcctggagctcagggtgcagaggaatgctgaggagctgggccatgaggccttctgggagcaagagctgcgccgggagcaggcccgggagcgagagggacaggcacgcctgcaggcactaagtgcggccactgctgagcatgccgcccggctgcaggccctggacgctcaggcccgtgccctggaggctgagctgcagctggcagcggaggcccctgggcccccctcacctatggcatctgccactgagcgcctgcaccaggacctggctgttcaggagcggcagagtgcggaggtgcagggcagcctggctctggtgagccgggccctggaggcagcagagcgagccttgcaggctcaggctcaggagctggaggagctgaaccgagagctccgtcagtgcaacctgcagcagttcatccagcagaccggggctgcgctgccaccgcccccacggcctgacaggggccctcctggcactcagtggcccccatgacgcagaactcctggaggtagcagcagctcctgccccagagtggtgtcctctggcagcccagccccaggctctgtgacagcctagtgagggctgcaagaccatcctgcccggaccacagaaggagagttggcggtcacagagggctcctctgccaggcagtgggaagccctgggtttggcctcaggagctgggggtgcagtgggggactgccctagtccttgccaggtcgccagcaccctggagaagcatggggcgtagccagctcggaacttgccaggccccaaaggccacgactgcctgttggggacaggagatgcatggacagtgtgctcaagctgtgggcatgtgcttgcctgcgggagaggtccttcactgtgtgtacacagcaagagcatgtgtgtgccacttcccctaccccaacgtgaaaacctcaataaactgcccgaagcagc

SEQ ID NO: 1860 - DNA, 473 bp, Homo sapiens
aggaagctggtgaagtgggggaggatgcgtgctccggagggccgccaccccaggaatgtgtggctggcgggtggggctggcacaggagggtggggcccgtgcggaggggcggcagcccagccgtttctagggcaggccaagaggatgaggagaggaggaccagcctgcgataggagtaggcaggtcctgacccggtgcctgcgccctccccacaggacaggcatgttgttgggactggcggccatggagctgaaggtgtgggtggatggcatccagcgtgtggtctgtggggtctcagagcagaccacctgccaggaagtggtcatcgcactagcccaagcaataggccagactggccgctttgtgcttgtgcagcggcttcgggagaaggagcggcagttgctgccacaagagtgtccagtgggcgcccaggccacctgcggacagtttgccagcgatgtccagtttgtcct

SEQ ID NO: 1861 - DNA, 4125 bp, Homo sapiens
ctctctgtgtgcgtgttcgcgcatgcgcgccgccgctgcactgccctcgcttcctgtgcgtcctcaggtcaccgcttgctctagttcccaggctttggcctccagtggacgagaatcgcggagcctgcggggctggaggcccggcccgggcccctcgggagcagaacaaccttagtgaggtggacaggaggggacctcgcgagcagacgcgcgccagcgacagcagccccgccccggcctctcgggagccgtggggcagaggctgcggagccccagaagggtctaccagccacagtctctgcacgtttccaagagcagcagaaaatgaacacattgcaggggccagtgtcattcaaagatgtggctgtggatttcacccaggaggagtggcagcagctggaccctgatgagaagataacttacagggatgtgatgttggagaactatagccatctagtttctgtgggatatgataccaccaagccaaacgtcatcattaagttggagcagggagaggagccgtggataatgggaggtgaatttccatgtcaacatagtccagaagcctggagagttgatgacctgatagagagaatccaagaaaacgaagacaaacattcaaggcaagctgcttgtatcaatagcaaaaccctgactgaagagaaagagaatacatttagtcaaatttacatggaaacaagccttgttccttcaagcataatagctcataattgtgtctcatgtggaaagaatttagaatctatttcgcaattaattagtagtgatggaagctatgctaggacaaaacctgatgagtgtaatgaatgtgggaaaacatatcatggagagaaaatgtgtgaatttaatcaaaatggggatacctattctcacaatgaagaaaatattcttcagaaaattagtattttggagaaaccctttgaatataatgaatgcatggaagccttagacaatgaggctgtttttattgctcataagagagcttacataggggagaagccctatgagtggaatgattctggaccagacttcatacagatgtcaaattttaatgcatatcagagatcacaaatggaaatgaagccctttgaatgcagtgaatgtggaaaatccttctgtaaaaagtcaaaattcatcatccaccagagggctcacacaggagagaaaccttatgaatgtaatgtatgtgggaaatccttcagccaaaagggaaccctcactgtacatcggagatcacacttagaggagaagccctataaatgtaatgaatgtgggaaaaccttttgtcagaagttacacctcactcaacacctaagaactcattcaggagagaaaccctacgaatgtagcgaatgtgggaaaaccttctgccaaaagacacatctcaccctgcaccagaggaatcattcaggagagaggccctatccatgtaacgaatgtgggaaatccttctcccgcaagtctgctctcagtgaccatcagagaactcacacgggagagaagctttataaatgtaatgaatgtgggaaatcctactaccgaaagtctactctgattacacatcagagaacacacacgggagagaagccctatcagtgtagcgagtgtgggaaattcttttctcgggtgtcatacctcactatacattatagaagtcatttagaagagaaaccctatgaatgtaatgaatgtggcaaaaccttcaatttaaattcagccttcattagacatcggaaagtacacacagaagagaaatcccatgaatgtagtgaatgtggaaagttctctcagttgtatctcaccgaccatcatacagctcatttagaagagaaaccctatgaatgtaatgaatgtgggaaaaccttccttgtaaattcagccttcgatgggcaccagccacttccaaaaggggagaaatcctatgaatgtaatgtatgtggaaagttattcaatgagttgtcatactatactgaacattatagaagtcattcagaagagaaaccttatggatgtagcgaatgtgggaaaaccttttcccataattcatccctcttcagacatcaaagagtacacacaggcgagaaaccctatgaatgttacgaatgtggaaaattcttctctcagaaatcatatctcactatacatcatcgaattcattcaggagagaaaccctatgaatgtagtaaatgtggaaaagtcttctctcggatgtcaaacctcactgtccactacagaagccattcaggagagaaaccctatgaatgtaatgaatgtgggaaagtcttttctcagaagtcatacctcactgtacactatagaactcattcaggagagaaaccctatgaatgtaacgagtgtgggaaaaaattccaccacagatcagccttcaatagccatcagagaattcatagaagaggaaatatgaacgtacttgatgtggaaaatctctgaagtcagatctcaatttttagaaaactctctgaatataatgaatatggggaatccaataggaagtcaaagcgtttatctgagagttcgtgttcctgaacggtgagaagcatttaggcattagagtcattttaatccaaattttcacagagaagaatcccgaagaatgtaacaagaagcaaagccttcagcaagatcatacgactcatcggacactaatttatataggagtgaagttttataaatatttaatatttattttggattcaaattgtatttacatatcagggaatcatacaaaggcaaaatctgtcaatatggtgaatgtggaaaatatattgtcttggaaatttgttgtaaaagccatatttctaatggaaaatcaggtgtttacaggaaagatctcagaggctatgagctctgaataaatcttcattgtataaaatgaagtttttaaattgtcaggagttgatcatgaggacagtagcattaaataagtatatggccgttttttatcatgtcttaaaaatgcaatctaatggtaattctatgcaagtttggaattggatgacttgtgaagaggcagttttcttatttgagtattaggatggcaaaatgtattaagacaggacatattgttggtgagataatatttaataggtataaaatggtaaaatacctagttttctatttagaggaatttacaaatgggtttttaacaaatgcctcattagtacaggaggcagtcgttttgtaaagttttcaactgcatctgagtaagataagattttctaaaagactattttgataaactatacatacataatttggaattgtttaagtctatttcagtgaaagagaacaagcatactgcccatactctaaaatatccccagctctcacaccacccttgttttttaacccataggtttgagtgtgcctagtgccaatattttgtaatttagaaattttattcacaaacttctgtttggtacaaatacagtgtcattgttttgtgcattctcctttttcccagtatttcagaacaaattgattcaagtttctagcagatattttttgatcaattaacttaatgtcctcgctccatttcttgctggaacagtttaggtacctaccacttcttcacatgacacaggggaatcctgattagtcaaaataataatgatttcattctctttgccagtaacttgttttatagtggtcatatgacctgatactgggtaaacaaaacaaagatggacttgttctgggaaaaggtaaaatggtaatcaaatagattgtgttccaggaatgcaaaggtggcttaatattcacaagtcagttgctattatacaccacctgtagaaaagtaatctggcatgcagaacattcttgtggtacaattaatgttcgtttatgatcttagcaaatgatggattgaaagggacttacttaactgcataaagagacttaaactacaacaaacaatatgcttaatgatgaaatagtgaacatttctcctaagattataaaaataagacaaggatatctgctgtcaatgattttattcggcattgttcagaaggacctaaccagaaaactaatgcaaggaagagaaacaaaaggcatagagattagaaaagaagtaaaactttaaaa

SEQ ID NO: 1862 - DNA, 6551 bp, Homo sapiens
ccagtggacgagaatcgcggagcctgcggggctggaggttgagcgcccgggccagcacctaggcgggcgcgggggtgtgcaggccagggttcgcgcgggccgggtggaggcttgagcggggacccccgagcttgagccccggagccggcggcgctggggccagaggggccggacgggaggtggcggaggtggcggcggaggcgaaggggcggcgggacgcgggcctggcccgtgtgtgtcctggcggcctggcccaggctgccgctgtacggtgagcccgagggaggcggatctgggtcccgggaaggacacccgcctggatttgccccttaggcccggcccgggcccctcgggagcagaacaaccttagtgaggtggacaggaggggacctcgcgagcagacgcgcgccagcgacagcagccccgccccggcctctcgggagccgtggggcagaggctgcggagccccagaagggtctaccagccacagtctctgcacgtttccaagagcagcagaaaatgaacacattgcaggggccagtgtcattcaaagatgtggctgtggatttcacccaggaggagtggcagcagctggaccctgatgagaagataacttacagggatgtgatgttggagaactatagccatctagtttctgtgggatatgataccaccaagccaaacgtcatcattaagttggagcagggagaggagccgtggataatgggaggtgaatttccatgtcaacatagtccagaagcctggagagttgatgacctgatagagagaatccaagaaaacgaagacaaacattcaaggcaagctgcttgtatcaatagcaaaaccctgactgaagagaaagagaatacatttagtcaaatttacatggaaacaagccttgttccttcaagcataatagctcataattgtgtctcatgtggaaagaatttagaatctatttcgcaattaattagtagtgatggaagctatgctaggacaaaacctgatgagtgtaatgaatgtgggaaaacatatcatggagagaaaatgtgtgaatttaatcaaaatggggatacctattctcacaatgaagaaaatattcttcagaaaattagtattttggagaaaccctttgaatataatgaatgcatggaagccttagacaatgaggctgtttttattgctcataagagagcttacataggggagaagccctatgagtggaatgattctggaccagacttcatacagatgtcaaattttaatgcatatcagagatcacaaatggaaatgaagccctttgaatgcagtgaatgtggaaaatccttctgtaaaaagtcaaaattcatcatccaccagagggctcacacaggagagaaaccttatgaatgtaatgtatgtgggaaatccttcagccaaaagggaaccctcactgtacatcggagatcacacttagaggagaagccctataaatgtaatgaatgtgggaaaaccttttgtcagaagttacacctcactcaacacctaagaactcattcaggagagaaaccctacgaatgtagcgaatgtgggaaaaccttctgccaaaagacacatctcaccctgcaccagaggaatcattcaggagagaggccctatccatgtaacgaatgtgggaaatccttctcccgcaagtctgctctcagtgaccatcagagaactcacacgggagagaagctttataaatgtaatgaatgtgggaaatcctactaccgaaagtctactctgattacacatcagagaacacacacgggagagaagccctatcagtgtagcgagtgtgggaaattcttttctcgggtgtcatacctcactatacattatagaagtcatttagaagagaaaccctatgaatgtaatgaatgtggcaaaaccttcaatttaaattcagccttcattagacatcggaaagtacacacagaagagaaatcccatgaatgtagtgaatgtggaaagttctctcagttgtatctcaccgaccatcatacagctcatttagaagagaaaccctatgaatgtaatgaatgtgggaaaaccttccttgtaaattcagccttcgatgggcaccagccacttccaaaaggggagaaatcctatgaatgtaatgtatgtggaaagttattcaatgagttgtcatactatactgaacattatagaagtcattcagaagagaaaccttatggatgtagcgaatgtgggaaaaccttttcccataattcatccctcttcagacatcaaagagtacacacaggcgagaaaccctatgaatgttacgaatgtggaaaattcttctctcagaaatcatatctcactatacatcatcgaattcattcaggagagaaaccctatgaatgtagtaaatgtggaaaagtcttctctcggatgtcaaacctcactgtccactacagaagccattcaggagagaaaccctatgaatgtaatgaatgtgggaaagtcttttctcagaagtcatacctcactgtacactatagaactcattcaggagagaaaccctatgaatgtaacgagtgtgggaaaaaattccaccacagatcagccttcaatagccatcagagaattcatagaagaggaaatatgaacgtacttgatgtggaaaatctctgaagtcagatctcaatttttagaaaactctctgaatataatgaatatggggaatccaataggaagtcaaagcgtttatctgagagttcgtgttcctgaacggtgagaagcatttaggcattagagtcattttaatccaaattttcacagagaagaatcccgaagaatgtaacaagaagcaaagccttcagcaagatcatacgactcatcggacactaatttatataggagtgaagttttataaatatttaatatttattttggattcaaattgtatttacatatcagggaatcatacaaaggcaaaatctgtcaatatggtgaatgtggaaaatatattgtcttggaaatttgttgtaaaagccatatttctaatggaaaatcaggtgtttacaggaaagatctcagaggctatgagctctgaataaatcttcattgtataaaatgaagtttttaaattgtcaggagttgatcatgaggacagtagcattaaataagtatatggccgttttttatcatgtcttaaaaatgcaatctaatggtaattctatgcaagtttggaattggatgacttgtgaagaggcagttttcttatttgagtattaggatggcaaaatgtattaagacaggacatattgttggtgagataatatttaataggtataaaatggtaaaatacctagttttctatttagaggaatttacaaatgggtttttaacaaatgcctcattagtacaggaggcagtcgttttgtaaagttttcaactgcatctgagtaagataagattttctaaaagactattttgataaactatacatacataatttggaattgtttaagtctatttcagtgaaagagaacaagcatactgcccatactctaaaatatccccagctctcacaccacccttgttttttaacccataggtttgagtgtgcctagtgccaatattttgtaatttagaaattttattcacaaacttctgtttggtacaaatacagtgtcattgttttgtgcattctcctttttcccagtatttcagaacaaattgattcaagtttctagcagatattttttgatcaattaacttaatgtcctcgctccatttcttgctggaacagtttaggtacctaccacttcttcacatgacacaggggaatcctgattagtcaaaataataatgatttcattctctttgccagtaacttgttttatagtggtcatatgacctgatactgggtaaacaaaacaaagatggacttgttctgggaaaaggtaaaatggtaatcaaatagattgtgttccaggaatgcaaaggtggcttaatattcacaagtcagttgctattatacaccacctgtagaaaagtaatctggcatgcagaacattcttgtggtacaattaatgttcgtttatgatcttagcaaatgatggattgaaagggacttacttaactgcataaagagacttaaactacaacaaacaatatgcttaatgatgaaatagtgaacatttctcctaagattataaaaataagacaaggatatctgctgtcaatgattttattcggcattgttcagaaggacctaaccagaaaactaatgcaaggaagagaaacaaaaggcatagagattagaaaagaagtaaaactttaaaaacgaaaaagaatataaatctctatttgcagatgccatgagtaaatttggtaagttccctgcataaaagttatgcaaaaagcattttatgatataccagcaaaaaacatggaaaatgaaattttgaaaagcaatgccacttcaaagatccctcaagtgcctagagggagaaaatgagttaatatgctttgaagaactgtatccagaaaataaaattacaaaggaggagagggataggattccaggacaatctcaaaactattgctttttcctaaattcattgcaaccttaaaatcctagcaagttctttaatgtaaattaacaagctaattctagaattcatatgcatattcaaaagtcgaataattgtcaaggctatcctgtagaatggacagagaggattgaaatttctaaatatcaagacctgttataaagccatagaaataatgaaggtgttaatttggcacaaggatgaaaaaactgactagtggaacagcatacagattcaaaagtagacccacgtgtataccatcacctgagttttgagaaaggtgacattgaagtgtagtgggggaaagggtgttctttccagtaaatgtactttgccaataaaattttgtaatttgataaaaagttatttggaggtggattgcagatctgaatatgaaatgtgaaagctttacaaagaaatcttaggacagtttgtaatcttggagtaagcaaaggtttattgagacccaaaaagcattaacccataaaattagaacttaatattaaatttgagaacttctatttatcagaaagaccaccagtaagaaaatgaacaggaaatcatggggaggagaagatatttgcagttcatgtatgtgacaacagcaccgagtatagcagaagtgttggcaaactttataaagcaaggcaccagatggtgaaaattttcagctttgtcacaactgctcatctttgctattgtgtgaaagcatccatacaccatgcattaaaaaaaaaatgagcatggctgcttcccagtaaaaccattcacaatcccaggtggcagtctggatttggtctgcactcatagttttctggtccctgatctcgaatatgtaaagagcacctacaaatcaacaagggggaaactggaaaaggcaaaagactttagaggatatccactcactttagaggatatccagacggccaataagcatgaaaagatgtgttagctttattagtaatcagggaaatgcaaacttaaaacatgtagcactgctacccatccatggaaatggttaaaatgaaaagcatgaaaaagcatcacgttttggcaaggatgtaagcaagaggaactgtacactactggtggaattgctcatcgataaaaccattttgaaagctggcactaaaagccaagcatatgtatactgttttacccaaacccagcaaaaatgcatgtgtctgtccaccaaaggacatgcactagaatatttatagcctaaaactgcacaaaacagaactatcttaaggcacatgtgcaatggaatgaataaagaagtggcatatgtccatggaatactgtaaaacagtgagcatgaatgaactagaagtccgtgtaataacgcagctgaatttaacaaaccttgctgaatgaaagactccagacacaaaagccaacatgctgtatgattccttctatataaattataaagacgggcaaaacttgtatacgtggtttaaaattagggtagcagttagccttggccaaggctgaaagggggcatttatctggtgctgggaataatctgtttctaaacctaggtgctaagtatttgagtgtgttttgagctgtgcacttaagatatgtgtatttttctgcatgtgtgttaaactttccataaaagttttctaaaatcacaaatggctaacatttgtgtcgctcatcactctaatcatatttttctagatgtgtatgaatatgctgcacaacaggaattaaatggcagattttgcataattctgtgcaggaaatacatatttatagtaattttgatggcaactactaagatttcctacgctgtccttaaagcttagcataatgtatattttaagtgaaatatttgagaaggttaaagaatcattacatactttgtcatcctatacttttgcatatataaataggtctgagctgcctcttcaataaagaagctaatgtgtaacatttcatatttccctaaac

SEQ ID NO: 1863 - DNA, 1001 bp, Homo sapiens
acagaatcattataaatcccagtagcagtctgctggccagccaagatgagacaaagttgcctaaaataagacttttttgactattctaaattgactcctcttgaccagcactgcttcatccaagctgctgacctcctcatggccgacttcaaagtgctcagtagtcaggacatcatgtgggccctgcacgagctcaaaggacactatgcaatcacccgaaaggtctaccagccacagtctctgcacgtttccaagagcagcagaaaatgaacacattgcaggggccagtgtcattcaaagatgtggctgtggatttcacccaggaggagtggcagcagctggaccctgatgagaagataacttacagggatgtgatgttggagaactatagccatctagtttctgtgggatatgataccaccaagccaaacgtcatcattaagttggagcagggagaggagccgtggataatgggaggtgaatttccatgtcaacatagtccagaagcctggagagttgatgacctgatagagagaatccaagaaaacgaagacaaacattcaagccgccctgcccgcaggccatgtggcccccgctgttgctgctgctgctgctgctcccggccgccccggtccccaccgccaaagccgctccccacccggatgctaacacccaggaaggccttcagaacctgctccaaggagtcggggctggcggagacggagagctgcgggcagactcacacctggccccgggctctggctgtattgatggggctgtggtggccacgcgaccagaaagccggggaggaagacctgcggttccgtgagaggcgtccagggctgcaggccacggcgacaggctccggggaacatggggctttccctgtccactcccaaggagtgtgggcctcaacgcattggcaggggacggccgtgtgccctctccagaccccacccccagatgcatttattagaaataataaagttctttcttagcta

SEQ ID NO: 1864 - DNA, 766 bp, Homo sapiens
ggctttggcctccagtggacgagaatcgcggagcctgcggggctggaggtctaccagccacagtctctgcacgtttccaagagcagcagaaaatgaacacattgcaggggccagtgtcattcaaagatgtggctgtggatttcacccaggaggagtggcagcagctggaccctgatgagaagataacttacagggatgtgatgttggagaactatagccatctagtttctgtgggatatgataccaccaagccaaacgtcatcattaagttggagcagggagaggagccgtggataatgggaggtgaatttccatgtcaacatagtccagccgccctgcccgcaggccatgtggcccccgctgttgctgctgctgctgctgctcccggccgccccggtccccaccgccaaagccgctccccacccggatgctaacacccaggaaggccttcagaacctgctccaaggagtcggggctggcggagacggagagctgcgggcagactcacacctggccccgggctctggctgtattgatggggctgtggtggccacgcgaccagaaagccggggaggaagacctgcggttccgtgagaggcgtccagggctgcaggccacggcgacaggctccggggaacatggggctttccctgtccactcccaaggagtgtgggcctcaacgcattggcaggggacggccgtgtgccctctccagaccccacccccagatgcatttattagaaataataaagttctttcttagcta

SEQ ID NO: 1865 - DNA, 1830 bp, Homo sapiens
ggttccagcgacagcagcactggactcgtccagagggcggcgggtgagcggctggggccccgtggagccaccatggaccccgcaggggcagcagacccctcagtgcctcccaatcctttgactcacctgagcctgcaggacagatcagagatgcagctgcagagcgaagccgacaggcggagcctcccgggcacttggaccaggtcatccccagagcacaccaccattctgaggggaggcgtgcgcaggtgcctgcagcaacagtgtgaacagactgtgcggatcctgcatgccaaggtggcccagaaatcatacggaaatgagaagcggttcttctgccccccgccctgtgtctacctctcggggcctggctggagggtgaagccagggcaggatcaagctcaccaggcgggggaaacggggcccacggtctgcggttacatgggactggacagcgcgtccggcagcgccactgagacgcagaagctgaatttcgagcagcagccggactccagggaattcggctgcgccaagaccctgtacatctcagatgcagacaagaggaagcactttcggctggtgctgcggctggtgctgcgcgggggccgggagctgggtaccttccacagccgccttatcaaggtcatctcgaagccctcgcagaagaagcagtcgctgaaaaacaccgatctgtgcatatcctccggctcaaaggtctccctcttcaaccgcctgcgctctcagacggtctccacacgctacctctctgtggaggatggggcctttgtggccagtgcacgacagtgggctgccttcacgctccacctggctgatgggcactctgcccaaggagacttcccaccgcgagagggctacgttcgctatggctccctggtgcagctcgtctgcacggtcaccggcatcacactacctcccatgatcatccgtaaagtagcaaaacagtgtgcgctccttgatgtggatgagcccatctcccagctgcacaagtgtgcattccagtttccaggcagtcccccaggagggggtggcacctacttatgccttgccacagagaaggtggtgcaatttcaggcctctccctgccccaaggaggcgaacagggctctgcttaacgacagctcttgctggaccatcatcggcaccgagtcggtggaattttccttcagcaccagcctggcgtgtaccctggagccggtcactccggtgcctctcatcagcaccctagagctgagcggcgggggcgacgtggccacgctggagctccacggagagaacttccacgcggggctcaaggtgtggtttggggacgtggaggcagaaaccatgtacaggagcccgcggtccctggtgtgcgtggtgccggacgtggcggccttctgcagcgactggcgctggctgcgcgctcccatcacaatccccatgagcctggtgcgcgccgacgggctcttctaccctagtgccttctccttcacctacaccccggaatacagcgtgcggccgggtcaccccggcgtccccgagcccgccaccgacgccgacgcgctcctggagagcatccatcaggagttcacgcgcaccaacttccacctcttcatccagacttaggcgcgcccggtagccccggctgcccaccctggagggctgcgcccgcgccaggcgcggggacgtgtttctgggttctaggccctgcttccttgcccctttgctgcagaagggcagctgaaggctcaccctagaaaccgggcctggtgggtcttacccggctcactccctcccttgtccttacacatacaggaagacaagacctga

SEQ ID NO: 1866 - DNA, 1636 bp, Homo sapiens
ggttccagcgacagcagcactggactcgtccagagggcggcgggtgagcggctggggccccgtggagccaccatggaccccgcaggggcagcagacccctcagtgcctcccaatcctttgactcacctgagcctgcaggacagatcagagatgcagctgcagagcgaagccgacaggcggagcctcccgggcacttggaccaggtcatccccagagcacaccaccattctgaggggaggcgtgcgcaggtgcctgcagcaacagtgtgaacagactgtgcggatcctgcatgccaaggtggcccagaaatcatacggaaatgagaagcggttcttctgccccccgccctgtgtctacctctcggggcctggctggagggtgaagccagggcaggatcaagctcaccaggcgggggaaacggggcccacggtctgcggttacatgggactggacagcgcgtccggcagcgccactgagacgcagaagctgaatttcgagcagcagccggactccagggaattcggctgcgccaagaccctgtacatctcagatgcagacaagaggaagcactttcggctggtgctgcggctggtgctgcgcgggggccgggagctgggtaccttccacagccgccttatcaaggtcatctcgaagccctcgcagaagaagcagtcgctgaaaaacaccgatctgtgcatatcctccggctcaaaggtctccctcttcaaccgcctgcgctctcagacggtctccacacgctacctctctgtggaggatggggcctttgtggccagtgcacgacagtgggctgccttcacgctccacctggctgatgggcactctgcccaaggagacttcccaccgcgagagggctacgttcgctatggctccctggtgcagctcgtctgcacggtcaccggcatcacactacctcccatgatcatccgtaaagtagcaaaacagtgtgcgctccttgatgtggatgagcccatctcccagctgcacaagtgtgcattccagtttccaggcagtcccccaggagggggtggcacctacttatgccttgccacagagaaggtggtgcaatttcaggcctctccctgccccaaggaggcgaacagggctctgcttaacgacagctcttgctggaccatcatcggcaccgagtcggtggaattttccttcagcaccagcctggcgtgtaccctggagccggtcactccggtgcctctcatcagcaccctagagctgagcggcgggggcgacgtggccacgctggagctccacggagagaacttccacgcggggctcaaggtgtggtttggggacgtggaggcagaaaccatgtacaggtacggggtggagcccgcggtccctggtgtgcgtggtgccggacgtggcggccttctgcagcgactggcgctggctgcgcgctcccatcacaatccccatgagcctggtgcgcgccgacgggctcttctaccctagtgccttctccttcacctacaccccggaatacagcgtgcggccgggtcaccccggcgtccccgagcccgccaccgacgccgacgcgctcctggagagcatccatcaggagttcacgcgcaccaacttccacctcttcatccagacttag

SEQ ID NO: 1867 - DNA, 1623 bp, Homo sapiens
ggttccagcgacagcagcactggactcgtccagagggcggcgggtgagcggctggggccccgtggagccaccatggaccccgcaggggcagcagacccctcagtgcctcccaatcctttgactcacctgagcctgcaggacagatcagagatgcagctgcagagcgaagccgacaggcggagcctcccgggcacttggaccaggtcatccccagagcacaccaccattctgaggggaggcgtgcgcaggtgcctgcagcaacagtgtgaacagactgtgcggatcctgcatgccaaggtggcccagaaatcatacggaaatgagaagcggttcttctgccccccgccctgtgtctacctctcggggcctggctggagggtgaagccagggcaggatcaagctcaccaggcgggggaaacggggcccacggtctgcggttacatgggactggacagcgcgtccggcagcgccactgagacgcagaagctgaatttcgagcagcagccggactccagggaattcggctgcgccaagaccctgtacatctcagatgcagacaagaggaagcactttcggctggtgctgcggctggtgctgcgcgggggccgggagctgggtaccttccacagccgccttatcaaggtcatctcgaagccctcgcagaagaagcagtcgctgaaaaacaccgatctgtgcatatcctccggctcaaaggtctccctcttcaaccgcctgcgctctcagacggtctccacacgctacctctctgtggaggatggggcctttgtggccagtgcacgacagtgggctgccttcacgctccacctggctgatgggcactctgcccaaggagacttcccaccgcgagagggctacgttcgctatggctccctggtgcagctcgtctgcacggtcaccggcatcacactacctcccatgatcatccgtaaagtagcaaaacagtgtgcgctccttgatgtggatgagcccatctcccagctgcacaagtgtgcattccagtttccaggcagtcccccaggagggggtggcacctacttatgccttgccacagagaaggtggtgcaatttcaggcctctccctgccccaaggaggcgaacagggctctgcttaacgacagctcttgctggaccatcatcggcaccgagtcggtggaattttccttcagcaccagcctggcgtgtaccctggagccggtcactccggtgcctctcatcagcaccctagagctgagcggcgggggcgacgtggccacgctggagctccacggagagaacttccacgcggggctcaaggtgtggtttggggacgtggaggcagaaaccatgtacagcccgcggtccctggtgtgcgtggtgccggacgtggcggccttctgcagcgactggcgctggctgcgcgctcccatcacaatccccatgagcctggtgcgcgccgacgggctcttctaccctagtgccttctccttcacctacaccccggaatacagcgtgcggccgggtcaccccggcgtccccgagcccgccaccgacgccgacgcgctcctggagagcatccatcaggagttcacgcgcaccaacttccacctcttcatccagacttag

SEQ ID NO: 1868 - DNA, 3275 bp, Homo sapiens
cgtgcgagtgtctccctctccctctcgctctctctctctctccctctctctctctcttttgtgagttatagcaaccgttgccttgtgaatcaagcgccatagtcaccgtagtcctggcgactgttacccatcaacaacaactactcctctcctcctcctcctcctcttcctcctcctcctccccaccaccaccatctccatcacccaccaacaacaccacaataatccacagccaaggccacttggtcattctggcattttatggtagagaatacgttgagtttggctctggaaggaatatgagagaccatcatgcagacatcagagactgggtcggacacaggctcgacagtgaccttacaaacatctgtggctagtcaagcagcagtgcctacgcaggtggtacagcaagtaccagtacaacaacaggtacagcaggtacagactgtgcagcaggtacaacatgtctatcccgctcaggtgcagtatgtggaaggaagcgatactgtctataccaatggagcaatccgaacaacaacgtatccttacacagagacacagatgtacagccaaaatactggagggaattactttgatactcaagggagttccgcccaggtgactaccgtggtctcatcccacagtatggtgggcactggtgggattcagatgggcgtcacaggaggacaactcatcagcagctctggaggaacctatctgatcggcaactcaatggagaattctggtcactcagtgacacacacaactcgggcctccccagcgacaattgaaatggcgattgagacgctgcaaaagtctgacggtctgtccactcacagaagctctcttctcaacagccatctccagtggctgttggacaattatgagacagcagaaggagtgagccttcccagaagcactctgtacaaccactaccttcgacactgtcaggaacacaaactggacccagtcaatgctgcctcttttggaaaattaataagatcaatttttatggggctacgaaccaggagattgggcactagaggaaactccaaataccactactatgggattcgtgtcaagccagattcccctcttaatcgtctgcaagaagacatgcagtatatggctatgagacaacaacccatgcaacagaaacaaaggtacaagcctatgcagaaagtggatggggttgcagatggtttcacaggaagtggtcaacagacaggcacatctgttgagcaaactgtaattgcccaaagccaacatcatcaacagtttttagatgcatctcgagcacttccagagtttggagaagttgaaatctcttctctgccagatggtactacctttgaggatatcaagtcactgcagagtctttatagagagcactgtgaggcaatattggacgttgttgtgaatcttcaatttagcctgatagaaaaattgtggcaaacattctggcgctattctccctctactccaactgatggcactaccattaccgaatcgagcaatctgagtgaaatagaaagtcgacttccgaaagcaaagctgataactctgtgcaaacatgagtctatcctgaaatggatgtgtaactgtgaccatgggatgtaccaggctttggtggagattctcatccccgacgtccttagacctattcctagtgccttgacccaagccattcgaaattttgcaaaaagccttgaaggttggctttccaatgccatgaacaatattccacagagaatgatacaaaccaaggttgccgctgtaagtgcctttgcccagactctgcgaagatacacgtcgcttaatcacctggcccaggcagctcgtgcagtgcttcagaacacttcccaaatcaaccagatgcttagtgacctcaaccgtgtcgactttgccaatgtccaggagcaggcttcctgggtgtgccagtgtgatgacaacatggttcagagactagaaacagacttcaagatgactcttcagcagcagagcaccctggagcagtgggctgcgtggcttgacaatgtgatgatgcaagcactgaaaccctatgaaggaagacccagttttcctaaagccgccaggcagtttctgctaaaatggtctttctacagctcaatggttattcgggacttaaccttacgcagtgctgctagctttggctccttccacctgatccgtctactctacgacgaatatatgttttacttagtagaacatcgtgttgctcaggcaacaggagagactcctatagcagtcatgggcgaggtaagagaggctgaaagagctgtgacccactgggttattaaaaataagccagaattacacttcagtctaaatacattattgattaaaaccatggttcctaaccaagtcagcctcagagccaggagggactgtggagttattgcaagagttccttaaattcctctgttcttatgtgcttaatcaaaagattctaaaattgtggattatatcatgtgaaagttcatggaatgtgtctctatattatacaggtacctatgtaaaagaaaaacttgagaaccactggaatatgaaaaatattttaagtgggaaaaagattggtgctcctgataaagcaaagggctgggaatacaatggaaaggattaaatatgtattttgtagactctttcccggtctccaagaacaaagtaaatgattctattttagaaggataaaaatggtaatgatgataactaacattttttggacacttactatgtgcgaggcacagttctatgttttttacatgtaataaagcacttaatgcaagtctttgagatacgttctactttattctgttttacaataagcatccgaggtttatgcagaaagctaaggcacagaaaggttaaatgattactcagctaaaaaatggtagagatttttttttcaaacacagtctgattttcaaacccatatgcttctaaccactaatgatgtaagggggaaaattctcttcttcagaatttctgaatagtcatcaaaatggcttatcaaaaagcttaaactctgaatataacaagggctggttaatataatgaggaatagatgcaaatgctcagatggttcagcactggcttattttgttatattgaatgcaggaggcgggggtagtttataccttgtcgaatcataccagattattaaatgtgacaaattacccaaggcggtaaaaaagacatgttcacttttaagctatgtgtatgtgcttatataaataaaaaagagtgaaaacaga

SEQ ID NO: 1869 - DNA, 2971 bp, Homo sapiens
agaccatcatgcagacatcagagactgggtcggacacaggctcgacagtgaccttacaaacatctgtggctagtcaagcagcagtgcctacgcaggtggtacagcaagtaccagtacaacaacaggtacagcaggtacagactgtgcagcaggtacaacatgtctatcccgctcaggtgcagtatgtggaaggaagcgatactgtctataccaatggagcaatccgaacaacaacgtatccttacacagagacacagatgtacagccaaaatactggagggaattactttgatactcaagggagttccgcccaggtgactaccgtggtctcatcccacagtatggtgggcactggtgggattcagatgggcgtcacaggaggacaactcatcagcagctctggaggaacctatctgatcggcaactcaatggagaattctggtcactcagtgacacacacaactcgggcctccccagcgacaattgaaatggcgattgagacgctgcaaaagtctgacggtctgtccactcacagaagctctcttctcaacagccatctccagtggctgttggacaattatgagacagcagaaggagtgagccttcccagaagcactctgtacaaccactaccttcgacactgtcaggaacacaaactggacccagtcaatgctgcctcttttggaaaattaataagatcaatttttatggggctacgaaccaggagattgggcactagaggaaactccaaataccactactatgggattcgtgtcaagccagattcccctcttaatcgtctgcaagaagacatgcagtatatggctatgagacaacaacccatgcaacagaaacaaaggtacaagcctatgcagaaagtggatggggttgcagatggtttcacaggaagtggtcaacagacaggcacatctgttgagcaaactgtaattgcccaaagccaacatcatcaacagtttttagatgcatctcgagcacttccagagtttggagaagttgaaatctcttctctgccagatggtactacctttgaggatatcaagtcactgcagagtctttatagagagcactgtgaggcaatattggacgttgttgtgaatcttcaatttagcctgatagaaaaattgtggcaaacattctggcgctattctccctctactccaactgatggcactaccattaccgaatcgagcaatctgagtgaaatagaaagtcgacttccgaaagcaaagctgataactctgtgcaaacatgagtctatcctgaaatggatgtgtaactgtgaccatgggatgtaccaggctttggtggagattctcatccccgacgtccttagacctattcctagtgccttgacccaagccattcgaaattttgcaaaaagccttgaaggttggctttccaatgccatgaacaatattccacagagaatgatacaaaccaaggttgccgctgtaagtgcctttgcccagactctgcgaagatacacgtcgcttaatcacctggcccaggcagctcgtgcagtgcttcagaacacttcccaaatcaaccagatgcttagtgacctcaaccgtgtcgactttgccaatgtccaggagcaggcttcctgggtgtgccagtgtgatgacaacatggttcagagactagaaacagacttcaagatgactcttcagcagcagagcaccctggagcagtgggctgcgtggcttgacaatgtgatgatgcaagcactgaaaccctatgaaggaagacccagttttcctaaagccgccaggcagtttctgctaaaatggtctttctacagctcaatggttattcgggacttaaccttacgcagtgctgctagctttggctccttccacctgatccgtctactctacgacgaatatatgttttacttagtagaacatcgtgttgctcaggcaacaggagagactcctatagcagtcatgggcgaggtaagagaggctgaaagagctgtgacccactgggttattaaaaataagccagaattacacttcagtctaaatacattattgattaaaaccatggttcctaaccaagtcagcctcagagccaggagggactgtggagttattgcaagagttccttaaattcctctgttcttatgtgcttaatcaaaagattctaaaattgtggattatatcatgtgaaagttcatggaatgtgtctctatattatacaggtacctatgtaaaagaaaaacttgagaaccactggaatatgaaaaatattttaagtgggaaaaagattggtgctcctgataaagcaaagggctgggaatacaatggaaaggattaaatatgtattttgtagactctttcccggtctccaagaacaaagtaaatgattctattttagaaggataaaaatggtaatgatgataactaacattttttggacacttactatgtgcgaggcacagttctatgttttttacatgtaataaagcacttaatgcaagtctttgagatacgttctactttattctgttttacaataagcatccgaggtttatgcagaaagctaaggcacagaaaggttaaatgattactcagctaaaaaatggtagagatttttttttcaaacacagtctgattttcaaacccatatgcttctaaccactaatgatgtaagggggaaaattctcttcttcagaatttctgaatagtcatcaaaatggcttatcaaaaagcttaaactctgaatataacaagggctggttaatataatgaggaatagatgcaaatgctcagatggttcagcactggcttattttgttatattgaatgcaggaggcgggggtagtttataccttgtcgaatcataccagattattaaatgtgacaaattacccaaggcggtaaaaaagacatgttcacttttaagctatgtgtatgtgcttatataaataaaaaagagtgaaaacaga

SEQ ID NO: 1870 - DNA, 364 bp, Homo sapiens
atgcagacatcagagactgggtcggacacaggctcgacagtgaccttacaaacatctgtggctagtcaagcagcagtgcctacgcaggtggtacagcaagtaccagtacaacaacaggtacagcaggtacagactgtgcagcaggtacaacatgtctatcccgctcaggtgcagtatgtggaaggaagcgatactgtctataccaatggagcaatgtccagggccccctggagcatgattttggaatcttcaccataaacttaaactactgttggcatttataccaaatgaaaaagacgcctgccacttcgacctttatgctctcagggaaaataaatggctttgtagacactgctagaggtca

SEQ ID NO: 1871 - DNA, 900 bp, Homo sapiens
cgtgcgagtgtctccctctccctctcgctctctctctctctccctctctctctctcttttgtgagttatagcaaccgttgccttgtgaatcaagcgccatagtcaccgtagtcctggcgactgttacccatcaacaacaactactcctctcctcctcctcctcctcttcctcctcctcctccccaccaccaccatctccatcacccaccaacaacaccacaataatccacagccaaggccacttggtcattctggcattttatggtagagaatacgttgagtttggctctggaaggaatatgagagaccatcatgcagacatcagagactgggtcggacacaggctcgacagtgaccttacaaacatctgtggctagtcaagcagcagtgcctacgcaggtggtacagcaagtaccagtacaacaacaggtacagcaggtacagactgtgcagcaggtacaacatgtctatcccgctcaggtgcagtatgtggaaggaagcgatactgtctataccaatggagcaatccgaacaacaacgtatccttacacagagacacagatgtacagccaaaatactggagggaattactttgatactcaagggagttccgcccaggtgactaccgtggtctcatcccacagtatggtgggcactggtgggattcagatgggcgtcacaggaggacaactcatcagcagctctggaggaacctatctgatcggcaactcaatggagaattctggtcactcagtgacacacacaactcgggcctccccagcgacagccaactcagtccctgaaatgaaactcctcagacagattaccatgaaccgtctgtttcctacactaaatcataaattgactgaaggttctgggcctcattttcaaagcatttaa

SEQ ID NO: 1872 - DNA, 2292 bp, Homo sapiens
cgtgcgagtgtctccctctccctctcgctctctctctctctccctctctctctctcttttgtgagttatagcaaccgttgccttgtgaatcaagcgccatagtcaccgtagtcctggcgactgttacccatcaacaacaactactcctctcctcctcctcctcctcttcctcctcctcctccccaccaccaccatctccatcacccaccaacaacaccacaataatccacagccaaggccacttggtcattctggcattttatggtagagaatacgttgagtttggctctggaaggaatatgagagaccatcatgcagacatcagagactgggtcggacacaggctcgacagtgaccttacaaacatctgtggctagtcaagcagcagtgcctacgcaggtggtacagcaagtaccagtacaacaacaggtacagcaggtacagactgtgcagcaggtacaacatgtctatcccgctcaggtgcagtatgtggaaggaagcgatactgtctataccaatggagcaatccgaacaacaacgtatccttacacagagacacagatgtacagccaaaatactggagggaattactttgatactcaagggagttccgcccaggtgactaccgtggtctcatcccacagtatggtgggcactggtgggattcagatgggcgtcacaggaggacaactcatcagcagctctggaggaacctatctgatcggcaactcaatggagaattctggtcactcagtgacacacacaactcgggcctccccagcgacaattgaaatggcgattgagacgctgcaaaagtctgacggtctgtccactcacagaagctctcttctcaacagccatctccagtggctgttggacaattatgagacagcagaaggagtgagccttcccagaagcactctgtacaaccactaccttcgacactgtcaggaacacaaactggacccagtcaatgctgcctcttttggaaaattaataagatcaatttttatggggctacgaaccaggagattgggcactagaggaaactccaaataccactactatgggattcgtgtcaagccagattcccctcttaatcgtctgcaagaagacatgcagtatatggctatgagacaacaacccatgcaacagaaacaaaggtacaagcctatgcagaaagtggatggggttgcagatggtttcacaggaagtggtcaacagacaggcacatctgttgagcaaactgtaattgcccaaagccaacatcatcaacagtttttagatgcatctcgagcacttccagagtttggagaagttgaaatctcttctctgccagatggtactacctttgaggatatcaagtcactgcagagtctttatagagagcactgtgaggcaatattggacgttgttgtgaatcttcaatttagcctgatagaaaaattgtggcaaacattctggcgctattctccctctactccaactgatggcactaccattaccgaatcgagcaatctgagtgaaatagaaagtcgacttccgaaagcaaagctgataactctgtgcaaacatgagtctatcctgaaatggatgtgtaactgtgaccatgggatgtaccaggctttggtggagattctcatccccgacgtccttagacctattcctagtgccttgacccaagccattcgaaattttgcaaaaagccttgaaggttggctttccaatgccatgaacaatattccacagagaatgatacaaaccaaggttgccgctgtaagtgcctttgcccagactctgcgaagatacacgtcgcttaatcacctggcccaggcagctcgtgcagtgcttcagaacacttcccaaatcaaccagatgcttagtgacctcaaccgtgtcgactttgccaatgtccaggagcaggcttcctgggtgtgccagtgtgatgacaacatggttcagagactagaaacagacttcaagatgactcttcagcagcagagcaccctggagcagtgggctgcgtggcttgacaatgtgatgatgcaagcactgaaaccctatgaaggaagacccagttttcctaaagccgccaggcagtttctgctaaaatggtctttctacagctcaatggttattcgggacttaaccttacgcagtgctgctagctttggctccttccacctgatccgtctactctacgacgaatatatgttttacttagtagaacatcgtgttgctcaggcaacaggagagactcctatagcagtcatgggcgaggtacctatgtaa

SEQ ID NO: 1873 - DNA, 2880 bp, Homo sapiens
cgtgcgagtgtctccctctccctctcgctctctctctctctccctctctctctctcttttgtgagttatagcaaccgttgccttgtgaatcaagcgccatagtcaccgtagtcctggcgactgttacccatcaacaacaactactcctctcctcctcctcctcctcttcctcctcctcctccccaccaccaccatctccatcacccaccaacaacaccacaataatccacagccaaggccacttggtcattctggcattttatggtagagaatacgttgagtttggctctggaaggaatatgagagaccatcatgcagacatcagagactgggtcggacacaggctcgacagtgaccttacaaacatctgtggctagtcaagcagcagtgcctacgcaggtggtacagcaagtaccagtacaacaacaggtacagcaggtacagactgtgcagcaggtacaacatgtctatcccgctcaggtgcagtatgtggaaggaagcgatactgtctataccaatggagcaatccgaacaacaacgtatccttacacagagacacagatgtacagccaaaatactggagggaattactttgatactcaagggagttccgcccaggtgactaccgtggtctcatcccacagtatggtgggcactggtgggattcagatgggcgtcacaggaggacaactcatcagcagctctggaggaacctatctgatcggcaactcaatggagaattctggtcactcagtgacacacacaactcgggcctccccagcgacactccagtggctgttggacaattatgagacagcagaaggagtgagccttcccagaagcactctgtacaaccactaccttcgacactgtcaggaacacaaactggacccagtcaatgctgcctcttttggaaaattaataagatcaatttttatggggctacgaaccaggagattgggcactagaggaaactccaaataccactactatgggattcgtgtcaagccagattcccctcttaatcgtctgcaagaagacatgcagtatatggctatgagacaacaacccatgcaacagaaacaaaggtacaagcctatgcagaaagtggatggggttgcagatggtttcacaggaagtggtcaacagacaggcacatctgttgagcaaactgtaattgcccaaagccaacatcatcaacagtttttagatgcatctcgagcacttccagagtttggagaagttgaaatctcttctctgccagatggtactacctttgaggatatcaagtcactgcagagtctttatagagagcactgtgaggcaatattggacgttgttgtgaatcttcaatttagcctgatagaaaaattgtggcaaacattctggcgctattctccctctactccaactgatggcactaccattaccgaatcgagcaatctgagtgaaatagaaagtcgacttccgaaagcaaagctgataactctgtgcaaacatgagtctatcctgaaatggatgtgtaactgtgaccatgggatgtaccaggctttggtggagattctcatccccgacgtccttagacctattcctagtgccttgacccaagccattcgaaattttgcaaaaagccttgaaggttggctttccaatgccatgaacaatattccacagagaatgatacaaaccaaggttgccgctgtaagtgcctttgcccagactctgcgaagatacacgtcgcttaatcacctggcccaggcagctcgtgcagtgcttcagaacacttcccaaatcaaccagatgcttagtgacctcaaccgtgtcgactttgccaatgtccaggagcaggcttcctgggtgtgccagtgtgatgacaacatggttcagagactagaaacagacttcaagatgactcttcagcagcagagcaccctggagcagtgggctgcgtggcttgacaatgtgatgatgcaagcactgaaaccctatgaaggaagacccagttttcctaaagccgccaggcagtttctgctaaaatggtctttctacagctcaatggttattcgggacttaaccttacgcagtgctgctagctttggctccttccacctgatccgtctactctacgacgaatatatgttttacttagtagaacatcgtgttgctcaggcaacaggagagactcctatagcagtcatgggcgagtttggtgatttaaatgccgtgtctcctggaaatctggataaagatgaaggcagtgaagtagaaagtgaaatggatgaagaactggatgactcttcagagcctcaagccaaaagagagaaaacagagctgagccaggcatttccagtgggctgcatgcagcctgttctcgagactggcgtgcaaccaagcctcctgaatccaattcacagcgagcacattgtcacaagtactcagactatcagacagtgcagcgctacaggaaatacctacactgcagtctaaagaatattaaagcgtatttttccagcttacattaaccctgttgatattgggcttaagttgaaaatttaataagcctgaaggtcgactgttgtcaaattctatctgtgctgaacattaactttttggagttgtgaaatggaatgggtgtatgtattttgccagatctttttttttaacgtaaacaaattatttgcttcttaataatgaattttttcccttagtttcaggtgtcaagaaggatttttacaacacttaatgtcaatgttttgttttcttataattaaaaagtaatttacattttttgtagcttaaaatattttattgttgattgttagtcttggtgtatgatttcatgtgtaagttttttaattagatgcacttctgtgaaatatc

SEQ ID NO: 1874 - DNA, 9307 bp, Homo sapiens
cgtgcgagtgtctccctctccctctcgctctctctctctctccctctctctctctcttttgtgagttatagcaaccgttgccttgtgaatcaagcgccatagtcaccgtagtcctggcgactgttacccatcaacaacaactactcctctcctcctcctcctcctcttcctcctcctcctccccaccaccaccatctccatcacccaccaacaacaccacaataatccacagccaaggccacttggtcattctggcattttatggtagagaatacgttgagtttggctctggaaggaatatgagagaccatcatgcagacatcagagactgggtcggacacaggctcgacagtgaccttacaaacatctgtggctagtcaagcagcagtgcctacgcaggtggtacagcaagtaccagtacaacaacaggtacagcaggtacagactgtgcagcaggtacaacatgtctatcccgctcaggtgcagtatgtggaaggaagcgatactgtctataccaatggagcaatccgaacaacaacgtatccttacacagagacacagatgtacagccaaaatactggagggaattactttgatactcaagggagttccgcccaggtgactaccgtggtctcatcccacagtatggtgggcactggtgggattcagatgggcgtcacaggaggacaactcatcagcagctctggaggaacctatctgatcggcaactcaatggagaattctggtcactcagtgacacacacaactcgggcctccccagcgacaattgaaatggcgattgagacgctgcaaaagtctgacggtctgtccactcacagaagctctcttctcaacagccatctccagtggctgttggacaattatgagacagcagaaggagtgagccttcccagaagcactctgtacaaccactaccttcgacactgtcaggaacacaaactggacccagtcaatgctgcctcttttggaaaattaataagatcaatttttatggggctacgaaccaggagattgggcactagaggaaactccaaataccactactatgggattcgtgtcaagccagattcccctcttaatcgtctgcaagaagacatgcagtatatggctatgagacaacaacccatgcaacagaaacaaaggtacaagcctatgcagaaagtggatggggttgcagatggtttcacaggaagtggtcaacagacaggcacatctgttgagcaaactgtaattgcccaaagccaacatcatcaacagtttttagatgcatctcgagcacttccagagtttggagaagttgaaatctcttctctgccagatggtactacctttgaggatatcaagtcactgcagagtctttatagagagcactgtgaggcaatattggacgttgttgtgaatcttcaatttagcctgatagaaaaattgtggcaaacattctggcgctattctccctctactccaactgatggcactaccattaccgaatcgagcaatctgagtgaaatagaaagtcgacttccgaaagcaaagctgataactctgtgcaaacatgagtctatcctgaaatggatgtgtaactgtgaccatgggatgtaccaggctttggtggagattctcatccccgacgtccttagacctattcctagtgccttgacccaagccattcgaaattttgcaaaaagccttgaaggttggctttccaatgccatgaacaatattccacagagaatgatacaaaccaaggttgccgctgtaagtgcctttgcccagactctgcgaagatacacgtcgcttaatcacctggcccaggcagctcgtgcagtgcttcagaacacttcccaaatcaaccagatgcttagtgacctcaaccgtgtcgactttgccaatgtccaggagcaggcttcctgggtgtgccagtgtgatgacaacatggttcagagactagaaacagacttcaagatgactcttcagcagcagagcaccctggagcagtgggctgcgtggcttgacaatgtgatgatgcaagcactgaaaccctatgaaggaagacccagttttcctaaagccgccaggcagtttctgctaaaatggtctttctacagctcaatggttattcgggacttaaccttacgcagtgctgctagctttggctccttccacctgatccgtctactctacgacgaatatatgttttacttagtagaacatcgtgttgctcaggcaacaggagagactcctatagcagtcatgggcgagtttggtgatttaaatgccgtgtctcctggaaatctggataaagatgaaggcagtgaagtagaaagtgaaatggatgaagaactggatgactcttcagagcctcaagccaaaagagagaaaacagagctgagccaggcatttccagtgggctgcatgcagcctgttctcgagactggcgtgcaaccaagcctcctgaatccaattcacagcgagcacattgtcacaagtactcagactatcagacagtgcagcgctacaggaaatacctacactgcagtctaaagaatattaaagcgtatttttccagcttacattaaccctgttgatattgggcttaagttgaaaatttaataagcctgaaggtcgactgttgtcaaattctatctgtgctgaacattaactttttggagttgtgaaatggaatgggtgtatgtattttgccagatctttttttttaacgtaaacaaattatttgcttcttaataatgaattttttcccttagtttcaggtgtcaagaaggatttttacaacacttaatgtcaatgttttgttttcttataattaaaaagtaatttacattttttgtagcttaaaatattttattgttgattgttagtcttggtgtatgatttcatgtgtaagttttttaattagatgcacttctgtgaaatatcaaaagaaatgatttttttgatttacactggaggcatgcccatttggcagcagatgcatcaaatttgcttttgaaaggtgcttttcattggacagaaccataagacactattttgataacattttgagtatggagagagaatacagagcatttttattatagtgctagagggtttggaaggtcatctatttttctctgaggaaaaaatgagctgtacatttatcagttcagagtaaatgacagaattgcaagagattatgctaatatgtacataatttgtgtacataattattaaaccatgttaacaatgcaagcttccgttaaacattgaattttaactattatttgcataccaattcctctgtttaaagactactgattctgtatttgggaccactgcacagatgcattctgctgttaagtgggggctgttatagttagatactgaagcagaaaaaaaagacttgactttttttttttaagtgtacatgctacttatgctgagctggacatacaggaaaccattccatttggatgactttcttttattccaggtctttttcctaatagtagttcaatatgctgctattataaacgagaatttatagaatgcaaggaatgtagcaacctacataacgttatttccttcaaaactatttcctggtttctaaagtatgtggatttaaattgtaaacagaacctgaaggcagtgtaactggcacacctcactgttacttatccccaattctgtaggatttggataggtggctggatggaccattgccattgaagaatgtacatcagggatcatcgtacctcggctattacatggtgccttaaaacagaactgaagctaaggtttagtaaggtttattttgttcatgtgactaactcttcaatccatttgacaaagtgtgcctgtcattttcagattcctgaagtaaggacaggtgacatgttcttcaaaggaaatttagggaaaacaaaggaaaacaaaaagacaaaaatcagtttccctctttgagtgaccgtggatctattttttattcttagagctgaatattacttgattacaaatcagattgcttaagggtgtggaatagcaggctagttttaataccaacttgttaacataaaatcatatatgttttagaccattcttatttagttacaattttagaaagttaacaaagtaagcaggtacttatcgaagtgcatcttttcagtctaaatgtttgtctgtgtgtctaggtgctggtgagtccacatggacacatgagtgcccatggggcaggagtctgctataaagtcagaaggtgagatcctagagagttacacccagccccattttaatttgcatgaaaagccaaggttcttttaagcactcaaattatttaatgattaaaacacaagaaaggcacatctgttcatttaaatagttgtaaaaaactaatcagcaaaaataaatagataataaagccaaaaaaaaggaaagcacaaaatgattgacagattatcaaatgaggcctatattaaacccaagatgtttatctttccagtggtattggggtaaggggggtggggggttggaaagacgaggtgagccagtctgtaaagttagaaataccaaatggcttatcgggtaatacacagtgtatttaagctgttgttgcttaattgcctcagactactcaaataacatcaacaacatttcttaagtaaaatttaaatattttagatgtaattttaaaaactgatccaaattttttattatacaactcactcatatatttgaaagtcttcactagcatagtagcatcaccttcatctaaatgtcatttaaattactgtccccctttttcctcccaaaaagacaatggatttgtaccaaaacacacacaaaaaaggcaaacaaaacatgataatctgcaaaagttcatgtatctacttcattgtgcataggaagtgtttacaggtaaaattaaaatcaaaaattgaaaaaacactcttcattttggctctcctttctgaattttttcagtttcctgtctctacccgccatcctttgagtgatactatatctgtattggaccaaatgtatttactggtttcattttgtttattgaatgactttaaatgtatttattatcattgtttaatttaatgttggatatatttgtatcattacaggaatctggtaataatgggcaaatttagattgatgaggcttagggatcggggatgctccaggattcaacatttcttccaattgttcatggtttgttctaaattaggacagattaagaactaataaaacattattacatttgaacttgactcaataaaaatattctgatctcctttatgaatattaggaatattctttgtgattagtgtaagtagtttggatcaaaacataaaaagaagacctatggtttatgctacttctagttatttgtagttcacagtaaaacatgcacagacatacacacaaacattttcatcaatttcgaatttgaattgtgaaaaatatataagaaaataaaaacaatttatacatttgagcaaattgagcaatcacatttattgcatttatttccctttttcccttttttcactcattgaaagtgtgggttttctaaataatattagacactaacactcaacagatttattcacaaatgacacaagtacacattttaagacttctttgtatttcttgcaattataaccaatcactagtcatgaaatatacctacataaaccaagtcctacactttcagtgaggaagaatgtaaggaaggtatgttgactgttttcaagtttcagaaaagatattttcatatgataggattgagtatcatgggtatagtttgatcttgacatatagtttgaaaatcatactcaaaagatttgcattcatgaaaccagtgaacaatagggtggaatggatgaaccatctccttggaagacagggcccaattttcaattttttctttggctatcaagttgctagtcacttattcaggattttcatccaaactgtgtttggactgactgtataagtcttactgccttttcagaaatctgctttcctttgtgtgatttttcttgtactgtatagcacggtttatgcacctctctttagatggtgtactttaaaaacaaaagtaaaatttagaaaatggttttaacactgcatacctaaaattagtagtgtgcagcattgactgcctttgatttgtagtagacaagtaaaaatgaatacgttcttgtagaatgctgtaaaagttattcaggaatgaatacggttttagtgccgtaatcatgaatctttttatatgaatgcactgtctaaaagtgctaaatgcattttcaaatttttaaaaattcctcagatgatatatttgaaatgtctaaaataatgctgtgcttgaaacattagtgtaaaaggaaaaaaaaaatagtgtcactgtgatgttggtcctccctgtgtggacacaagtagaaagaaaaaacttggcaagtcacctttgtgtacaatttgaggcagtggttatatacaataaattgacctttattatatcccccagacacacacattcttggtgagaaaagaacaaccatccagaaattgagatgagaacttttgtgatctgtatgaatcacagcagatcatgggggaggaggattggcatgcagtgctgttgaaaattgggcttgttgttagatcagaacaacctccatgtatatggttagaacgaatcaattaatggaatcctagtatttctgcaagtttggtgatttttaaaaactggaatagaagcattaattcagtgcttagttctagtattagaaaacccctttgatgtaatgccttgtattaaccctttgagcattgtaagatatacaatgggggacaaaagcctttcagatcatttatttagacttagaccggtaaagtatactctatatccaaatgtctaattatgctgtttttttaaaggggggggtaggaagagaaagtgtttccacgccgaacacttgcattttatatacaactcttaatttttcttcaagagggcttgatatatttattcccaaatattcactgccatctaagtaagtgtactgtttacagaaaaaaaaaatcaacttttctagtatcacaccatagtctctagaaaaggaggacaaatacatgggcctggatagacctatgtcataactgatttctgcacattgaaggtacctagattgcctttaaaaggtataaagaaagggttaagtttcttttttttttgtcttttttttcccaaaatgaatcaaaagatctcatttatttagctttagaaagtacaagtgtaagtaaagccttaggaagaaaggagttcgagtggattaagagaatctgaactctttgggggcagttaggctatttggagttagatcgctcataaaatattgtttgcgaatttcacacagggcataattttatctatgctccaaaactttaatacgttgtcaaaaaattatatatagatagaatggagagcaaagcacttgattttaagctcatctgtcaggagatgctatgactactgcttctgatatctctaaatgtcagtctgcttacaccattgctgattttgttcaagggaatctcttcgtgcacttgattccctctgttccctgcgtgatcgaacatgaaagcagtgttgtctgcagatgtgcttgcgctgccctagctgggtgcaaataagagtgtaacctattctgatgtctggtgaaaggacatccatagcatagtgcaagtatgccgtaaacgttgctttttaggcagtttaggaagtcagaccatgcaaattactcatgtgttaacatgcaatactcaaagggttttaatttaactctcttcttttgaattcttcatgatgatttactgtaaatgcttctcagtttgcatgccttgatcattgctgctagtgattttatgtgccagtagacctgagtttagtttaccaattttacttaaatagtaaaagccacttacaaagtgactgcctaggatttttttttcctttcatttgaaataattgataatatgtttttttaaaaagaaaaatgtgttttgtctcttcttttatttggttctggtttgattctttttctcccctctttcctttgttttttttttttaaataaattatgatgttgggattggaagccctgagtaatgaaaatctttggtaagaattgtttatgtagctcaataacgaggacaacaaatattctttagaagaattttgattctggggaggaaagaaaatataaaaactcccattgactgttgataaccaagtaaatttttccttcagtaaattagtatttttgaagaaacgatcgccttgttttaacttgctaaacaacaattttaaatgacccaataaagaatctattgaactttattcgtttaaaaagcatcttttgtaccaaagcaaatttttttctctactcatttccatcatcaatttggacctatggtggtgaccaatgcattggttacagaaactttaagtgagtgccttgagaaaacttggaaatttgtgcctgaggtggtaaacttttaattaggttaattgtagtgcttaccaatcagtaacttcactatcactcagggctttcgtaccttctaggtaaaacttctttcattgtgtttttttaagatactgtatttttttttaagtgccatcatttaaatttcacttagtaagtggcagattacattattcagtcccacaagcacagaaacatagtaacactaggagatatttgaacatttattttacaatcgactgaatatattatgtaaatgaggtaagcaacttttgtagagattgtatgtgtgagataatgtaatgttcttttccagtttttggactacagttgaataaactttttaattatttaaaaacatctttaccgaataacatgtgatggttttttgtataatgtatttgattttgtaaatacgtatttcctgatgtgatttttgtgagaaatgctaaatcttttagtatatcatgtcctctcaaaattggcaggagctaaataatagtttgtgggcgatttgtattgtgtactgtacaataactggggaacttttataattataaaaatatatattaacttttagtgtgttgtttaaacaaatgactggaacatactaaagatattagtaggatttttctgaatatttcagacttgaactcaggctagctttcttgtgtttttcaaaacaaaatggtgtcttgtcttttaaaatcaataaatttgtttccttgttacaaata

SEQ ID NO: 1875 - DNA, 492 bp, Homo sapiens
gtacagcaggtacagactgtgcagcaggtacaacatgtctatcccgctcaggtgcagtatgtggaaggaagcgatactgtctataccaatggagcaatccgaacaacaacgtatccttacacagagacacagatgtacagccaaaatactggagggaattactttgatactcaagggagttccgcccaggtgactaccgtggtctcatcccacagtatggtgggcactggtgggattcagatgggcgtcacaggaggacaactcatcagcagctctggaggaacctatctgatcggcaactcaatggagaattctggtcactcagtgacacacacaactcgggcctccccagcgacagccaactcagtccctgaaatgaaactcctcagacagattaccatgaaccgtctgtttcctacactaaatcataaattgactgaaggttctgggcctcattttcaaagcatttaataaaatgggactttgaatgac

SEQ ID NO: 1876 - DNA, 526 bp, Homo sapiens
gtacagcaggtacagactgtgcagcaggtacaacatgtctatcccgctcaggtgcagtatgtggaaggaagcgatactgtctataccaatggagcaatccgaacaacaacgtatccttacacagagacacagatgtacagccaaaatactggagggaattactttgatactcaagggagttccgcccaggtgactaccgtggtctcatcccacagtatggtgggcactggtgggattcagatgggcgtcacaggaggacaactcatcagcagctctggaggaacctatctgatcggcaactcaatggagaattctggtcactcagtgacacacacaactcgggcctccccagcgacactttttctgttttcctgtgtccctttttccctaggccaactcagtccctgaaatgaaactcctcagacagattaccatgaaccgtctgtttcctacactaaatcataaattgactgaaggttctgggcctcattttcaaagcatttaataaaatgggactttgaatgac

SEQ ID NO: 1877 - DNA, 869 bp, Homo sapiens
cttccctcccccacccctccccgtgcgagtgtctccctctccctctcgctctctctctctctccctctctctctctcttttgtgagttatagcaaccgttgccttgtgaatcaagcgccatagtcaccgtagtcctggcgactgttacccatcaacaacaactactcctctcctcctcctcctcctcttcctcctcctcctccccaccaccaccatctccatcacccaccaacaacaccacaataatccacagccaaggccacttggtcattctggcattttatggtagagaatacgttgagtttggctctggaaggaatatgagcagccatggaggatactctagtttctttgggaagataaacactcaatctgctagttaagagacaaagctcaagagaaataagctgaagctgtaacctccatttcaaacttgtggttctgcagaccatcatgcagacatcagagactgggtcggacacaggctcgacagtgaccttacaaacatctgtggctagtcaagcagcagtgcctacgcaggtggtacagcaagtaccagtacaacaacaggtacagcaggtacagactgtgcagcaggtacaacatgtctatcccgctcaggtgcagtatgtggaaggaagcgatactgtctataccaatggagcaatccgaacaacaacgtatccttacacagagacacagatgtacagccaaaatactggagggaattactttgatactcaagggagttccgcccaggtgactaccgtggtctcatcccacagtatggtgggcactggtgggattcagatgggcgtcacaggaggacaactcatcagcagctctggaggaacctatctgatcggcaa

SEQ ID NO: 1878 - DNA, 633 bp, Homo sapiens
gagcaggcttcctgggtgtgccagtgtgatgacaacatggttcagagactagaaacagacttcaagatgactcttcagcagcagagcaccctggagcagtgggctgcgtggcttgacaatgtgatgatgcaagcactgaaaccctatgaaggaagacccagttttcctaaagccgccaggcagtttctgctaaaatggtctttctacagctcaatggttattcgggacttaaccttacgcagtgctgctagctttggctccttccacctgatccgtctactctacgacgaatatatgttttacttagtagaacatcgtgttgctcaggcaacaggagagactcctatagcagtcatgggcgaggtacctatgtaaaagaaaaacttgagaaccactggaatatgaaaaatattttaagtgggaaaaagattggtgctcctgataaagcaaagggctgggaatacaatggaaaggattaaatatgtattttgtagactctttcccggtctccaagaacaaagtaaatgattctattttagaaggataaaaatggtaatgatgataactaacattttttggacacttactatgtgcgaggcacagttctatgttttttacatgtaataaagcact

SEQ ID NO: 1879 - DNA, 740 bp, Homo sapiens
acttctgcttccactacaaacagtactttaaagacaggccttccactgccattcagaaagcagccatggaggatactctagtttctttgggaagataaacactcaatctgctagttaagagacaaagctcaagagaaataagctgaagctgtaacctccatttcaaacttgtggttctgcagaccatcatgcagacatcagagactgggtcggacacaggctcgacagtgaccttacaaacatctgtggctagtcaagcagcagtgcctacgcaggtggtacagcaagtaccagtacaacaacaggtacagcaggtacagactgtgcagcaggtacaacatgtctatcccgctcaggtgcagtatgtggaaggaagcgatactgtctataccaatggagcaatccgaacaacaacgtatccttacacagagacacagatgtacagccaaaatactggagggaattactttgatactcaagggagttccgcccaggtgactaccgtggtctcatcccacagtatggtgggcactggtgggattcagatgggcgtcacaggaggacaactcatcagcagctctggaggaacctatctgatcggcaactcaatggagaattctggtcactcagtgacacacacaactcgggcctccccagcgacaattgaaatggcgattgagacgctgcaaaagtctgacggtctgtccactcacagaagctctcttctcaacagccatgta

SEQ ID NO: 1880 - DNA, 822 bp, Homo sapiens
actacaaacagtactttaaagacaggccttccactgccattcagaaagccatggaggatactctagtttctttgggaagataaacactcaatctgctagttaagagacaaagctcaagagaaataagctgaagctgtaacctccatttcaaacttgtggttctgcagaccatcatgcagacatcagagactgggtcggacacaggctcgacagtgaccttacaaacatctgtggctagtcaagcagcagtgcctacgcaggtggtacagcaagtaccagtacaacaacaggtacagcaggtacagactgtgcagcaggtacaacatgtctatcccgctcaggtgcagtatgtggaaggaagcgatactgtctataccaatggagcaatccgaacaacaacgtatccttacacagagacacagatgtacagccaaaatactggagggaattactttgatactcaagggagttccgcccaggtgactaccgtggtctcatcccacagtatggtgggcactggtgggattcagatgggcgtcacaggaggacaactcatcagcagctctggaggaacctatctgatcggcaactcaatggagaattctggtcactcagtgacacacacaactcgggcctccccagcgacactccagtggctgttggacaattatgagacagcagaaggagtgagccttcccagaagcactctgtacaaccactaccttcgacactgtcaggaacacaaactggacccagtcaatgctgcctcttttggaaaattaataagatcaatttttatggggctacgaaccaggagattgg

SEQ ID NO: 1881 - DNA, 814 bp, Homo sapiens
cagaaaatacaaatgtgcatagacagctctgggggagtgttttatatatctgtctgtctctctcggtatatatagccagctgtatggcaccagtgcaatggtggtatagttctaacctcagtaatatttggtaaacttaaactatttttaaagtccattttcttttttatcctcatttgccatctattcatttgctacatttattcacaccagcaatctgagtgaaatagaaagtcgacttccgaaagcaaagctgataactctgtgcaaacatgagtctatcctgaaatggatgtgtaactgtgaccatgggatgtaccaggctttggtggagattctcatccccgacgtccttagacctattcctagtgccttgacccaagccattcgaaattttgcaaaaagccttgaaggttggctttccaatgccatgaacaatattccacagagaatgatacaaaccaaggttgccgctgtaagtgcctttgcccagactctgcgaagatacacgtcgcttaatcacctggcccaggcagctcgtgcagtgcttcagaacacttcccaaatcaaccagatgcttagtgacctcaaccgtgtcgactttgccaatgtccaggagcaggcttcctgggtgtgccagtgtgatgacaacatggttcagagactagaaacagacttcaagatgactcttcagcagcagagcaccctggagcagtgggctgcgtggcttgacaatgtgatgatgcaagcactgaaaccctatgaaggaagacccagttttcctaaagccgccaggcagtttctgctaaaatgg

SEQ ID NO: 1882 - DNA, 3378 bp, Homo sapiens
agagtgagttccaggtgggaaggcagttatgacagttgagaagtagtagaagacacggaaggcacagaaggcagacttcgctcagcacaaagaattttctgataaccatactggcaaaatgaactgggctgccttcggagggtctgaattcttcatcccagaaggcattcagatagattcgagatgcccactaagcagaaatatcacggaatggtaccattactatggcattgcagtgaaagaaagctcccaatattatgatgtgatgtattccaagaaaggagctgcctgggtgagtgagacgggcaagaaagaagtgagcaaacagacagtggcatattcaccccggtccaaactcggaacactgctgccagaatttcccaatgtcaaagatctaaatctgccagccagcctgcctgaggagaaggtttctacctttattatgatgtacagaacacactgtcagagaatactggacactgtaataagagccaactttgatgaggttcaaagtttccttctgcacttttggcaaggaatgccgccccacatgctgcctgtgctgggctcctccacggtggtgaacattgtcggcgtgtgtgactccatcctctacaaagctatctccggggtgctgatgcccactgtgctgcaggcattacctgacagcttaactcaggtgattcgaaagtttgccaagcaactggatgagtggctaaaagtggctctccacgacctcccagaaaacttgcgaaacatcaagttcgaattgtcgagaaggttctcccaaattctgagacggcaaacatcactaaatcatctctgccaggcatctcgaacagtgatccacagtgcagacatcacgttccaaatgctggaagactggaggaacgtggacctgaacagcatcaccaagcaaaccctttacaccatggaagactctcgcgatgagcaccggaaactcatcacccaattatatcaggagtttgaccatctcttggaggagcagtctcccatcgagtcctacattgagtggctggataccatggttgaccgctgtgttgtgaaggtggctgccaagagacaagggtccttgaagaaagtggcccagcagttcctcttgatgtggtcctgtttcggcacaagggtgatccgggacatgaccttgcacagcgcccccagcttcgggtcttttcacctaattcacttaatgtttgatgactacgtgctctacctgttagaatctctgcactgtcaggagcgggccaatgagctcatgcgagccatgaagggagaaggaagcactgcagaagtccgagaagagatcatcttgacagaggctgccgcaccaaccccttcaccagtgccatcgttttctccagcaaaatctgccacatctgtggaagtgccacctccctcttcccctgttagcaatccttcccctgagtacactggcctcagcactacaggagcaatgcagtcttacacgtggtctctaacatacacagtgacgacggctgctgggtccccagctgagaactcccaacagctgccctgtatgaggaacactcatgtgccttcttcctccgtcacacacaggataccagtttatccccacagagaggaacatggatacacgggaagctataactatgggagctatggcaaccagcatcctcaccccatgcagagccagtatccggccctccctcatgacacagctatctctgggccactccactatgccccttaccacaggagctctgcacagtacccttttaatagccccacttcccggatggaaccttgtttgatgagcagtactcccagactgcatcctaccccagtcactccccgctggccagaggtgccctcagccaacacgtgctacacaagcccgtctgtgcattctgcgaggtacggaaactctagtgacatgtatacacctctgacaacgcgcaggaattctgaatatgagcacatgcaacactttcctggctttgcttacatcaacggagaggcctctacaggatgggctaaatgactgctatcataggcatccatatttaatattaataataataattaataataataataaacccaacacccatcccccagaagactttatctctatacattgtaactcatgggctattcctaagtgcccattttcctaatgaacatgaggatgggatcaatgtgggatgaataaactttagttcagaaacaggacttactaaaagtcagtgggactgggtttctgtagccaagccagacttgactgtttctgtagagcactatctcgggcaggccattctgtgccttttccctctgttccatgactttgctttgtgttggcaaccacttctagtaagctactgattttcctgttgacaaaatctctttagtcttgaaggatggatactggagacagaatctggtttgtgttcttggatgggcacataatttaccaagagcattcaccttgccatctgtcttgtcattgtactgtacaaggaacagccctcagacgtgttctgcacatcccttcttcctggtggtaccatccctatttcctggagcaccagggctaaatggggagctatctggaaactctagattttctgtcatacccacatctgtcacagtacctgcattgtcttggaatgtaagcactgtcttgagggaaggaagaggtctgttctgtattgccttaagttgattgaggtttgtaggagactggttcttctacatacaaggatttgtcttaagtttgcacaatggctagtgtcagcaaaaggcaggagagggtttttgttttttttttaagttctatgagaatgtggatttatggcattgagtatcacactcagctctgctgtgttaactttgtgaaactggatggaacaaactttaacttaccaagcaccaagtgtgaaagtgactttcacggttccttcataaaactataataatatccgacactttgatagaaaaaaattcaaagctgtgcctttgagcctatactatactgtgtatgtgtggaaataaaaatgtattgtacttttggagaattttttgtaggcatttttctgtcagatttgtagtaatttgtgaggtttgttagagattaatataggttttctttctgtattataaaatgcaccaagcaattatggtggacctattaccctatgggtaagaaataaatggaaatatgacatcggatgtttcagcaactgttctgtaaataaaatctttgatcacaccactcagtgtgataattgtgtctacagctaaaatggaaatagttttatctgtacagttgtgcaagatatgaatggtttcacactcaaataaaaaatattgaaacga

SEQ ID NO: 1883 - DNA, 2565 bp, Homo sapiens
gttgccatggcaacccactgacctgagccaccccctggagaggccacagctgctggcttcctgggcttctccaaactcctgtgtgtcgccactgccaccggcagggagccaggagagagacagaaaggggctgagacagaatgatcaaaaggagagcccaccctggtgcgggaggcgacaggaccaggcctcgacggcgccgttccactgagagctggattgaaagatgtctcaacgaaagtgaaaacaaacgttattccagccacacatctctggggaatgtttctaatgatgaaaatgaggaaaaagaaaataatagagcatccaagccccactccactcctgctactctgcaatggctggaggagaactatgagattgcagagggggtctgcatccctcgcagtgccctctatatgcattacctggatttctgcgagaagaatgatacccaacctgtcaatgctgccagctttggaaagatcataaggcagcagtttcctcagttaaccaccagaagactcgggacccgaggacagtcaaagtaccattactatggcattgcagtgaaagaaagctcccaatattatgatgtgatgtattccaagaaaggagctgcctgggtgagtgagacgggcaagaaagaagtgagcaaacagacagtggcatattcaccccggtccaaactcggaacactgctgccagaatttcccaatgtcaaagatctaaatctgccagccagcctgcctgaggagaaggtttctacctttattatgatgtacagaacacactgtcagagaatactggacactgtaataagagccaactttgatgaggttcaaagtttccttctgcacttttggcaaggaatgccgccccacatgctgcctgtgctgggctcctccacggtggtgaacattgtcggcgtgtgtgactccatcctctacaaagctatctccggggtgctgatgcccactgtgctgcaggcattacctgacagcttaactcaggtgattcgaaagtttgccaagcaactggatgagtggctaaaagtggctctccacgacctcccagaaaacttgcgaaacatcaagttcgaattgtcgagaaggttctcccaaattctgagacggcaaacatcactaaatcatctctgccaggcatctcgaacagtgatccacagtgcagacatcacgttccaaatgctggaagactggaggaacgtggacctgaacagcatcaccaagcaaaccctttacaccatggaagactctcgcgatgagcaccggaaactcatcacccaattatatcaggagtttgaccatctcttggaggagcagtctcccatcgagtcctacattgagtggctggataccatggttgaccgctgtgttgtgaaggtggctgccaagagacaagggtccttgaagaaagtggcccagcagttcctcttgatgtggtcctgtttcggcacaagggtgatccgggacatgaccttgcacagcgcccccagcttcgggtcttttcacctaattcacttaatgtttgatgactacgtgctctacctgttagaatctctgcactgtcaggagcgggccaatgagctcatgcgagccatgaagggagaaggaagcactgcagaagtccgagaagagatcatcttgacagaggctgccgcaccaaccccttcaccagtgccatcgttttctccagcaaaatctgccacatctgtggaagtgccacctccctcttcccctgttagcaatccttcccctgagtacactggcctcagcactacaggagcaatgcagtcttacacgtggtctctaacatacacagtgacgacggctgctgggtccccagctgagaactcccaacagctgccctgtatgaggaacactcatgtgccttcttcctccgtcacacacaggataccagtttatccccacagagaggaacatggatacacgggaagctataactatgggagctatggcaaccagcatcctcaccccatgcagagccagtatccggccctccctcatgacacagctatctctgggccactccactatgccccttaccacaggagctctgcacagtacccttttaatagccccacttcccggatggaaccttgtttgatgagcagtactcccagactgcatcctaccccagtcactccccgctggccagaggtgccctcagccaacacgtgctacacaagcccgtctgtgcattctgcgaggtacggaaactctagtgacatgtatacacctctgacaacgcgcaggaattctgaatatgagcacatgcaacactttcctggctttgcttacatcaacggagaggcctctacaggatgggctaaatgactgctatcataggcatccatatttaatattaataataataattaataataataataaacccaacacccatcccccagaagactttatctctatacattgtaactcatgggctattcctaagtgcccattttcctaatgaacatgaggatgggatcaatgtgggatgaataaactttagttcagaaacagg

SEQ ID NO: 1884 - DNA, 3955 bp, Homo sapiens
atctgacgagcggccattcatcaggccggctggcctatcaatgacattgctcccatcggggctcctataaaatgatgctttttcccatgaaacatccgcaaacattttgacgggtttggctttgcccggctggattactgagtgtccccttgctcgctcgctttttctctctcccccttctccgagctcgctcccttctctccctctctctcctcttttcttctttctcttttctttcctcttctttttcttttcttttcctttcctcctttatccttgtgccccctcactttctgcgtctctctctctccccttctccctccctccctcccttcctccctgggcatctctagcacaggggatccccaaacatcaggacttttggggggcgcctgtgctgtccatgggaagagcatgcattgtgggttactggaggaacccgacatggattccacagagagctggattgaaagatgtctcaacgaaagtgaaaacaaacgttattccagccacacatctctggggaatgtttctaatgatgaaaatgaggaaaaagaaaataatagagcatccaagccccactccactcctgctactctgcaatggctggaggagaactatgagattgcagagggggtctgcatccctcgcagtgccctctatatgcattacctggatttctgcgagaagaatgatacccaacctgtcaatgctgccagctttggaaagatcataaggcagcagtttcctcagttaaccaccagaagactcgggacccgaggacagtcaaagtaccattactatggcattgcagtgaaagaaagctcccaatattatgatgtgatgtattccaagaaaggagctgcctgggtgagtgagacgggcaagaaagaagtgagcaaacagacagtggcatattcaccccggtccaaactcggaacactgctgccagaatttcccaatgtcaaagatctaaatctgccagccagcctgcctgaggagaaggtttctacctttattatgatgtacagaacacactgtcagagaatactggacactgtaataagagccaactttgatgaggttcaaagtttccttctgcacttttggcaaggaatgccgccccacatgctgcctgtgctgggctcctccacggtggtgaacattgtcggcgtgtgtgactccatcctctacaaagctatctccggggtgctgatgcccactgtgctgcaggcattacctgacagcttaactcaggtgattcgaaagtttgccaagcaactggatgagtggctaaaagtggctctccacgacctcccagaaaacttgcgaaacatcaagttcgaattgtcgagaaggttctcccaaattctgagacggcaaacatcactaaatcatctctgccaggcatctcgaacagtgatccacagtgcagacatcacgttccaaatgctggaagactggaggaacgtggacctgaacagcatcaccaagcaaaccctttacaccatggaagactctcgcgatgagcaccggaaactcatcacccaattatatcaggagtttgaccatctcttggaggagcagtctcccatcgagtcctacattgagtggctggataccatggttgaccgctgtgttgtgaaggtggctgccaagagacaagggtccttgaagaaagtggcccagcagttcctcttgatgtggtcctgtttcggcacaagggtgatccgggacatgaccttgcacagcgcccccagcttcgggtcttttcacctaattcacttaatgtttgatgactacgtgctctacctgttagaatctctgcactgtcaggagcgggccaatgagctcatgcgagccatgaagggagaaggaagcactgcagaagtccgagaagagatcatcttgacagaggctgccgcaccaaccccttcaccagtgccatcgttttctccagcaaaatctgccacatctgtggaagtgccacctccctcttcccctgttagcaatccttcccctgagtacactggcctcagcactacaggagcaatgcagtcttacacgtggtctctaacatacacagtgacgacggctgctgggtccccagctgagaactcccaacagctgccctgtatgaggaacactcatgtgccttcttcctccgtcacacacaggataccagtttatccccacagagaggaacatggatacacgggaagctataactatgggagctatggcaaccagcatcctcaccccatgcagagccagtatccggccctccctcatgacacagctatctctgggccactccactatgccccttaccacaggagctctgcacagtacccttttaatagccccacttcccggatggaaccttgtttgatgagcagtactcccagactgcatcctaccccagtcactccccgctggccagaggtgccctcagccaacacgtgctacacaagcccgtctgtgcattctgcgaggtacggaaactctagtgacatgtatacacctctgacaacgcgcaggaattctgaatatgagcacatgcaacactttcctggctttgcttacatcaacggagaggcctctacaggatgggctaaatgactgctatcataggcatccatatttaatattaataataataattaataataataataaacccaacacccatcccccagaagactttatctctatacattgtaactcatgggctattcctaagtgcccattttcctaatgaacatgaggatgggatcaatgtgggatgaataaactttagttcagaaacaggacttactaaaagtcagtgggactgggtttctgtagccaagccagacttgactgtttctgtagagcactatctcgggcaggccattctgtgccttttccctctgttccatgactttgctttgtgttggcaaccacttctagtaagctactgattttcctgttgacaaaatctctttagtcttgaaggatggatactggagacagaatctggtttgtgttcttggatgggcacataatttaccaagagcattcaccttgccatctgtcttgtcattgtactgtacaaggaacagccctcagacgtgttctgcacatcccttcttcctggtggtaccatccctatttcctggagcaccagggctaaatggggagctatctggaaactctagattttctgtcatacccacatctgtcacagtacctgcattgtcttggaatgtaagcactgtcttgagggaaggaagaggtctgttctgtattgccttaagttgattgaggtttgtaggagactggttcttctacatacaaggatttgtcttaagtttgcacaatggctagtgtcagcaaaaggcaggagagggtttttgttttttttttaagttctatgagaatgtggatttatggcattgagtatcacactcagctctgctgtgttaactttgtgaaactggatggaacaaactttaacttaccaagcaccaagtgtgaaagtgactttcacggttccttcataaaactataataatatccgacactttgatagaaaaaaattcaaagctgtgcctttgagcctatactatactgtgtatgtgtggaaataaaaatgtattgtacttttggagaattttttgtaggcatttttctgtcagatttgtagtaatttgtgaggtttgttagagattaatataggttttctttctgtattataaaatgcaccaagcaattatggtggacctattaccctatgggtaagaaataaatggaaatatgacatcggatgtttcagcaactgttctgtaaataaaatctttgatcacaccactcagtgtgataattgtgtctacagctaaaatggaaatagttttatctgtacagttgtgcaagatatgaatggtttcacactcaaataaaaaatattgaaacg

SEQ ID NO: 1885 - DNA, 1948 bp, Homo sapiens
atggccgagggggtgccggcctcgccgtcgagcggcgagggtagccggggcccgcacagcggcgtcatccagtggttggtcgacaacttctgcatttgcgaagagtgcagcgtccctcgctgtctcatgtatgagatttacgtggagacctgtgggcaaaacactgagaaccaagtcaacccggccacctttgggaagcttgtgagattggtttttccggaccttggcacccggaggctgggcactagaggaagtgccaggtatcattatgatggaatctgtatcaagaaaagctctttcttctatgcccagtattgctacctgataggtgaaaaaaggtatcacagtggagatgccattgcctttgaaaaatctactaattataacagcattatccaacaagaagcaacatgtgaagatcattcaccgatgaagacagacccagttggatcccctttgtctgaattcaggagatgtccatttctggagcaagaacaggcaaagaaatactcctgtaatatgatggccttccttgctgacgaatactgcaactattgtcgagacattttacgaaatgtggaggacttgcttacttccttctggaagtctctgcagcaagacacagtcatgctgatgtcattgcctgacgtgtgccagctctttaaatgctacgacgtccagctgtacaagggaattgaggatgttctccttcatgacttcttggaagatgtttctattcagtacctgaaatctgtgcagttatttagtaagaaatttaagctgtggctccttaatgctttggaaggtgttccagccctcttgcagatctccaaactcaaagaagttactctatttgtcaaaagactaagaagaaagacgtacctttccaacatggctaagactatgcgaatggtattgaaaagtaagaggcgtgtcagcgttttgaagtcagatctacaggccatcatcaatcaaggcactttggctacttctaagaaagccctggcaagtgaccggagtggcgcagatgaactggagaacaacccagagatgaaatgtttaagaaacttaatttctttgctgggaacatcaacagatctcagggtattcctcagctgtctgtcttcacatctccaagcatttgtgttccagacaagcagaagcaaagaagagtttaccaaattggccgccagcttccagctgagatggaatcttcttctcactgctgtaagcaaagccatgaccctctgccacagagatagttttggctcctggcatctgtttcacttgttgcttttggaatatatgattcatatacttcagtcatgcctagaggaggaagaggaggaggaggacatggggactgtcaaggaaatgctaccagatgacccgactctcggccagccagaccaggcacttttccattctctgaattcctcactgtcgcaggcgtgtgccagccccagcatggagccactgggggtgatgcccacacacatgggccagggccgatatcccgtgggtgtgagcaacatggtcctcaggatcctgggcttcctggtggacactgccatgggcaataagctcatccaggtgctgttggaagatgaaaccactgaaagcgcagttaaactcagccttcctatgggacaagaagccctcataaccctaaaagatggacaacaatttgtgattcagatatcagatgtaccccaaagctctgaagatatttatttcagagaaaacaatgctaatgtgtgagattatttatttgaatagagaataagaaaactgatagacttgcattcttaaaaatattaaatactaaagtttttctattgacgaaagatgatgttatgtatataatagatgtagcattgtctattttatgtttatatgtatttcaaggaggtggtttcgataaaatatgtaaactgatttggagaat

SEQ ID NO: 1886 - DNA, 1686 bp, Homo sapiens
ataactccaacgctcaagcaagtcaaggacacccacggactcaacaccgcgaccagattggaaaaggtgttggtcgacaacttctgcatttgcgaagagtgcagcgtccctcgctgtctcatgtatgagatttacgtggagacctgtgggcaaaacactgagaaccaagtcaacccggccacctttgggaagtgtgaagatcattcaccgatgaagacagacccagttggatcccctttgtctgaattcaggagatgtccatttctggagcaagaacaggcaaagaaatactcctgtaatatgatggccttccttgctgacgaatactgcaactattgtcgagacattttacgaaatgtggaggacttgcttacttccttctggaagtctctgcagcaagacacagtcatgctgatgtcattgcctgacgtgtgccagctctttaaatgctacgacgtccagctgtacaagggaattgaggatgttctccttcatgacttcttggaagatgtttctattcagtacctgaaatctgtgcagttatttagtaagaaatttaagctgtggctccttaatgctttggaaggtgttccagccctcttgcagatctccaaactcaaagaagttactctatttgtcaaaagactaagaagaaagacgtacctttccaacatggctaagactatgcgaatggtattgaaaagtaagaggcgtgtcagcgttttgaagtcagatctacaggccatcatcaatcaaggcactttggctacttctaagaaagccctggcaagtgaccggagtggcgcagatgaactggagaacaacccagagatgaaatgtttaagaaacttaatttctttgctgggaacatcaacagatctcagggtattcctcagctgtctgtcttcacatctccaagcatttgtgttccagacaagcagaagcaaagaagagtttaccaaattggccgccagcttccagctgagatggaatcttcttctcactgctgtaagcaaagccatgaccctctgccacagagatagttttggctcctggcatctgtttcacttgttgcttttggaatatatgattcatatacttcagtcatgcctagaggaggaagaggaggaggaggacatggggactgtcaaggaaatgctaccagatgacccgactctcggccagccagaccaggcacttttccattctctgaattcctcactgtcgcaggcgtgtgccagccccagcatggagccactgggggtgatgcccacacacatgggccagggccgatatcccgtgggtgtgagcaacatggtcctcaggatcctgggcttcctggtggacactgccatgggcaataagctcatccaggtgctgttggaagatgaaaccactgaaagcgcagttaaactcagccttcctatgggacaagaagccctcataaccctaaaagatggacaacaatttgtgattcagatatcagatgtaccccaaagctctgaagatatttatttcagagaaaacaatgctaatgtgtgagattatttatttgaatagagaataagaaaactgatagacttgcattcttaaaaatattaaatactaaagtttttctattgacgaaagatgatgttatgtatataatagatgtagcattgtctattttatgtttatatgtatttc

SEQ ID NO: 1887 - DNA, 278 bp, Homo sapiens
aactccaacgctcaagcaagtcaaggacacccacggactcaacaccgcgaccagattggaaaaggtgttggtcgacaacttctgcatttgcgaagagtgcagcgtccctcgctgtctcatgtatgagatttacgtggagacctgtgggcaaaacactgagaaccaagtcaacccggccacctttgggaagatggccttccttgctgacgaatactgcaactattgtcgagacattttacgaaatgtgaggaactgagaacttgagagggtggaggact

SEQ ID NO: 1888 - DNA, 3292 bp, Homo sapiens
cccggcggggggaggttggggacgggcctggcagttgtgaactcgaacctgccgctgtcgccgcggcggggcggggagcgagagtgggccgcggaggccggccttcgggctccatggacgggcgccgcgtccctgcacagcccgccgcagaggtaaggctggcctctctgcagtcagaggtctgagctctgccatggggataggggtgtctttattactgcagttttctctaacacctgggggctaccggagtgtgggccgaagcaggcgctgcagccgcggaagtatccccaggaacatccccaagaggagctggaaaaagcctcatccccagctctgcagtctccaggggagctcagtgtctgtttgtccagcttctcagagttgctgtgcagctcggatgtggcataggaaacagcagacacagggagagggcagcataaggcactgtagggagcagtggccacattttctgcagaggaagaaccgatgctggaacgtcgttgcaggggccccctggccatgggcctggcccagccccgactcctttctgggccctcccaggagtcaccccagaccctggggaaggagtcccgcgggctgaggcaacaaggcacgtcagtggcccagtctggtgcccaagccccaggcagggcccatcgctgtgcccactgtcgaaggcacttccctggctgggtggctctgtggcttcacacccgccggtgccaggcccggctgcccttgccctgccctgagtgtggccgtcgctttcgccatgcccccttcttagcactgcaccgccaggtccatgctgctgccaccccagacctgggctttgcctgccacctctgtgggcagagcttccgaggctgggtggccctggttctgcatctgcgggcccattcagctgcaaagcggcccatcgcttgtcccaaatgcgagagacgcttctggcgacgaaagcagcttcgagctcatctgcggcggtgccaccctcccgccccggaggcccggcccttcatatgcggcaactgtggccggagctttgcccagtgggaccagctagttgcccacaagcgggtgcacgtagctgaggccctggaggaggccgcagccaaggctctggggccccggcccaggggccgccccgcggtgaccgccccccggcccggtggagatgccgtcgaccgccccttccagtgtgcctgttgtggcaagcgcttccggcacaagcccaacttgatcgctcaccgccgcgtgcacacgggcgagcggccccaccagtgccccgagtgcgggaagcgctttaccaataagccctatctgacttcgcaccggcgcatccacaccggcgagaagccctacccgtgcaaagagtgcggccgccgcttccggcacaaacccaacctgctgtctcacagcaagattcacaagcgatccgaggggtcggcccaggccgcccccggcccggggagcccccagctgccagccggcccccaggagtccgcggccgagcccaccccggcggtacctctgaaaccggcccaggagccgccgccaggggccccgccagagcacccgcaggacccgatcgaagcccccccctccctctacagctgcgacgactgcggcaggagcttccggctggagcgcttcctgcgggcccaccagcggcagcacaccggggagcggcccttcacctgcgccgagtgcgggaagaacttcggcaagaagacgcacctggtggcgcactcgcgcgtgcactccggcgagcggcccttcgcctgcgaggagtgcggccgccgcttctcccagggcagccatctggcggcgcatcggcgcgaccacgcccccgatcggcccttcgtgtgtcccgactgcggcaaggccttccgccacaaaccctacctggcggcgcaccggcgcatccacaccggcgagaagccctacgtctgccccgactgcggcaaagccttcagccagaagtccaacctggtgtcgcaccggcgcatccacacgggcgagcggccctacgcctgtcccgactgcgaccgcagcttcagccagaagtccaacctcatcacccaccgcaagagccacatccgggacggcgccttctgctgtgccatctgtggccagaccttcgacgacgaggagagactcctggcccaccagaagaagcacgatgtctgagacggtgggcggggccgtgttggctgagagagggctggggtccttcgtggtgggagtcgcagtgggctgggggtgcctgcctagtgctggagtaggggacaatgggaatcctagaggggatggaagacgcggggagtgagctgggtgggccctgctagcgagagaggtcaaccccggtggccagggaacccacttccaagcgcagggacgccggcctccagctggtgtgtgctaaggctccgtcctgactgccctgtgccctggaaaagcagcaatagcatccgccccttagagccctctggctagaggagccaccagtggaaaggaagaccctccatcctctggtattaacgccttaatgcccctgtcttttactgtaagttacttaagatcatttttggaagcaggcgtggtagagtcctgtaaatgaatgctctgggctagatacagcttggagaacctgctggccttgttagacagcacttgggcctttgccagcagcaagaggtgaagcgaagccactcttacctctcccttcccctcccacctgccccctgcgtaggcacccagacttggagagacccgtctgctgttaatacttccatcctcttccttcccaaagagcagatcccaaggcatttactccttggtctgtctcgctttatctgtcgcccctcccagcgctgagagcctcccctggctgtcagcagcactgtgtccaggctcttgtctgaacaccgcagcccctccttcgctccttccagagctcagcatgtcacggcaaggactgccgcattggtgatggagggccagctgaggggaagttgctggtgagtttccttttctccatttctagcatatggacacctggcctctgcttgagcacttaggtgacaggaacttccgcacctcctgaggccctggatgattctaattgttagaaattctaattgttagaaatccttccttataatgaatgaattctgctttcctataatttctacctattgggccttgttctgttctctggaactaaacagaacaaccatttacccctccttttcaaactagagaataaagatttggttttagaactggt

SEQ ID NO: 1889 - DNA, 2876 bp, Homo sapiens
gggaggggagaaacaggggcagagtgagttggtctctggagtgactgtgcttttccaccctcagcagaggaagaaccgatgctggaacgtcgttgcaggggccccctggccatgggcctggcccagccccgactcctttctgggccctcccaggagtcaccccagaccctggggaaggagtcccgcgggctgaggcaacaaggcacgtcagtggcccagtctggtgcccaagccccaggcagggcccatcgctgtgcccactgtcgaaggcacttccctggctgggtggctctgtggcttcacacccgccggtgccaggcccggctgcccttgccctgccctgagtgtggccgtcgctttcgccatgcccccttcttagcactgcaccgccaggtccatgctgctgccaccccagacctgggctttgcctgccacctctgtgggcagagcttccgaggctgggtggccctggttctgcatctgcgggcccattcagctgcaaagcggcccatcgcttgtcccaaatgcgagagacgcttctggcgacgaaagcagcttcgagctcatctgcggcggtgccaccctcccgccccggaggcccggcccttcatatgcggcaactgtggccggagctttgcccagtgggaccagctagttgcccacaagcgggtgcacgtagctgaggccctggaggaggccgcagccaaggctctggggccccggcccaggggccgccccgcggtgaccgccccccggcccggtggagatgccgtcgaccgccccttccagtgtgcctgttgtggcaagcgcttccggcacaagcccaacttgatcgctcaccgccgcgtgcacacgggcgagcggccccaccagtgccccgagtgcgggaagcgctttaccaataagccctatctgacttcgcaccggcgcatccacaccggcgagaagccctacccgtgcaaagagtgcggccgccgcttccggcacaaacccaacctgctgtctcacagcaagattcacaagcgatccgaggggtcggcccaggccgcccccggcccggggagcccccagctgccagccggcccccaggagtccgcggccgagcccaccccggcggtacctctgaaaccggcccaggagccgccgccaggggccccgccagagcacccgcaggacccgatcgaagcccccccctccctctacagctgcgacgactgcggcaggagcttccggctggagcgcttcctgcgggcccaccagcggcagcacaccggggagcggcccttcacctgcgccgagtgcgggaagaacttcggcaagaagacgcacctggtggcgcactcgcgcgtgcactccggcgagcggcccttcgcctgcgaggagtgcggccgccgcttctcccagggcagccatctggcggcgcatcggcgcgaccacgcccccgatcggcccttcgtgtgtcccgactgcggcaaggccttccgccacaaaccctacctggcggcgcaccggcgcatccacaccggcgagaagccctacgtctgccccgactgcggcaaagccttcagccagaagtccaacctggtgtcgcaccggcgcatccacacgggcgagcggccctacgcctgtcccgactgcgaccgcagcttcagccagaagtccaacctcatcacccaccgcaagagccacatccgggacggcgccttctgctgtgccatctgtggccagaccttcgacgacgaggagagactcctggcccaccagaagaagcacgatgtctgagacggtgggcggggccgtgttggctgagagagggctggggtccttcgtggtgggagtcgcagtgggctgggggtgcctgcctagtgctggagtaggggacaatgggaatcctagaggggatggaagacgcggggagtgagctgggtgggccctgctagcgagagaggtcaaccccggtggccagggaacccacttccaagcgcagggacgccggcctccagctggtgtgtgctaaggctccgtcctgactgccctgtgccctggaaaagcagcaatagcatccgccccttagagccctctggctagaggagccaccagtggaaaggaagaccctccatcctctggtattaacgccttaatgcccctgtcttttactgtaagttacttaagatcatttttggaagcaggcgtggtagagtcctgtaaatgaatgctctgggctagatacagcttggagaacctgctggccttgttagacagcacttgggcctttgccagcagcaagaggtgaagcgaagccactcttacctctcccttcccctcccacctgccccctgcgtaggcacccagacttggagagacccgtctgctgttaatacttccatcctcttccttcccaaagagcagatcccaaggcatttactccttggtctgtctcgctttatctgtcgcccctcccagcgctgagagcctcccctggctgtcagcagcactgtgtccaggctcttgtctgaacaccgcagcccctccttcgctccttccagagctcagcatgtcacggcaaggactgccgcattggtgatggagggccagctgaggggaagttgctggtgagtttccttttctccatttctagcatatggacacctggcctctgcttgagcacttaggtgacaggaacttccgcacctcctgaggccctggatgattctaattgttagaaattctaattgttagaaatccttccttataatgaatgaattctgctttcctataatttctacctattgggccttgttctgttctctggaactaaacagaacaaccatttacccctccttttcaaactagagaataaagatttggttttagaa

SEQ ID NO: 1890 - DNA, 2969 bp, Homo sapiens
cccggcggggggaggttggggacgggcctggcagttgtgaactcgaacctgccgctgtcgccgcggcggggcggggagcgagagtgggccgcggaggccggccttcgggctccatggacgggcgccgcgtccctgcacagcccgccgcagagcagaggaagaaccgatgctggaacgtcgttgcaggggccccctggccatgggcctggcccagccccgactcctttctgggccctcccaggagtcaccccagaccctggggaaggagtcccgcgggctgaggcaacaaggcacgtcagtggcccagtctggtgcccaagccccaggcagggcccatcgctgtgcccactgtcgaaggcacttccctggctgggtggctctgtggcttcacacccgccggtgccaggcccggctgcccttgccctgccctgagtgtggccgtcgctttcgccatgcccccttcttagcactgcaccgccaggtccatgctgctgccaccccagacctgggctttgcctgccacctctgtgggcagagcttccgaggctgggtggccctggttctgcatctgcgggcccattcagctgcaaagcggcccatcgcttgtcccaaatgcgagagacgcttctggcgacgaaagcagcttcgagctcatctgcggcggtgccaccctcccgccccggaggcccggcccttcatatgcggcaactgtggccggagctttgcccagtgggaccagctagttgcccacaagcgggtgcacgtagctgaggccctggaggaggccgcagccaaggctctggggccccggcccaggggccgccccgcggtgaccgccccccggcccggtggagatgccgtcgaccgccccttccagtgtgcctgttgtggcaagcgcttccggcacaagcccaacttgatcgctcaccgccgcgtgcacacgggcgagcggccccaccagtgccccgagtgcgggaagcgctttaccaataagccctatctgacttcgcaccggcgcatccacaccggcgagaagccctacccgtgcaaagagtgcggccgccgcttccggcacaaacccaacctgctgtctcacagcaagattcacaagcgatccgaggggtcggcccaggccgcccccggcccggggagcccccagctgccagccggcccccaggagtccgcggccgagcccaccccggcggtacctctgaaaccggcccaggagccgccgccaggggccccgccagagcacccgcaggacccgatcgaagcccccccctccctctacagctgcgacgactgcggcaggagcttccggctggagcgcttcctgcgggcccaccagcggcagcacaccggggagcggcccttcacctgcgccgagtgcgggaagaacttcggcaagaagacgcacctggtggcgcactcgcgcgtgcactccggcgagcggcccttcgcctgcgaggagtgcggccgccgcttctcccagggcagccatctggcggcgcatcggcgcgaccacgcccccgatcggcccttcgtgtgtcccgactgcggcaaggccttccgccacaaaccctacctggcggcgcaccggcgcatccacaccggcgagaagccctacgtctgccccgactgcggcaaagccttcagccagaagtccaacctggtgtcgcaccggcgcatccacacgggcgagcggccctacgcctgtcccgactgcgaccgcagcttcagccagaagtccaacctcatcacccaccgcaagagccacatccgggacggcgccttctgctgtgccatctgtggccagaccttcgacgacgaggagagactcctggcccaccagaagaagcacgatgtctgagacggtgggcggggccgtgttggctgagagagggctggggtccttcgtggtgggagtcgcagtgggctgggggtgcctgcctagtgctggagtaggggacaatgggaatcctagaggggatggaagacgcggggagtgagctgggtgggccctgctagcgagagaggtcaaccccggtggccagggaacccacttccaagcgcagggacgccggcctccagctggtgtgtgctaaggctccgtcctgactgccctgtgccctggaaaagcagcaatagcatccgccccttagagccctctggctagaggagccaccagtggaaaggaagaccctccatcctctggtattaacgccttaatgcccctgtcttttactgtaagttacttaagatcatttttggaagcaggcgtggtagagtcctgtaaatgaatgctctgggctagatacagcttggagaacctgctggccttgttagacagcacttgggcctttgccagcagcaagaggtgaagcgaagccactcttacctctcccttcccctcccacctgccccctgcgtaggcacccagacttggagagacccgtctgctgttaatacttccatcctcttccttcccaaagagcagatcccaaggcatttactccttggtctgtctcgctttatctgtcgcccctcccagcgctgagagcctcccctggctgtcagcagcactgtgtccaggctcttgtctgaacaccgcagcccctccttcgctccttccagagctcagcatgtcacggcaaggactgccgcattggtgatggagggccagctgaggggaagttgctggtgagtttccttttctccatttctagcatatggacacctggcctctgcttgagcacttaggtgacaggaacttccgcacctcctgaggccctggatgattctaattgttagaaattctaattgttagaaatccttccttataatgaatgaattctgctttcctataatttctacctattgggccttgttctgttctctggaactaaacagaacaaccatttacccctccttttcaaactagagaataaagatttggttttagaactggt

SEQ ID NO: 1891 - DNA, 679 bp, Homo sapiens
cgctgtcgccgcggcggggcggggagcgagagctggcctctctgcagtcagaggtctgagctctgccatggggataggggtgtctttattactgcagttttctctaacacctgggggctaccggagtgtgggccgaagcaggcgctgcagccgcggaagtatccccaggaacatccccaagaggagctggaaaaagcctcatccccagctctgcagtctccaggcagaggaagaaccgatgctggaacgtcgttgcaggggccccctggccatgggcctggcccagccccgactcctttctgggccctcccaggagtcaccccagaccctggggaaggagtcccgcgggctgaggcaacaaggcacgtcagtggcccagtctggtgcccaagccccaggcagggcccatcgctgtgcccactgtcgaaggcacttccctggctgggtggctctgtggcttcacacccgccggtgccaggcccggctgcccttgccctgccctgagtgtggccgtcgctttcgccatgcccccttcttagcactgcaccgccaggtccatgctgctgccaccccagacctgggctttgcctgccacctctgtgggcagagcttccgaggctgggtggccctggttctgcatctgcgggcccattcagctgcaaagcggcccatcgcttgt

SEQ ID NO: 1892 - DNA, 2058 bp, Homo sapiens
ggaggttggggacgggcctggcagttgtgaactcgaacctgccgctgtcgccgcggcggggcggggagcgagagtgggccgcggaggccggccttcgggctccatggacgggcgccgcgtccctgcacagcccgccgcagaggtaaggctggcctctctgcagtcagaggtctgagctctgccatggggataggggtgtctttattactgcagttttctctaacacctgggggctaccggagtgtgggccgaagcaggcgctgcagccgcggaagtatccccaggaacatccccaagaggagctggaaaaagcctcatccccagctctgcagtctccaggcagaggaagaaccgatgctggaacgtcgttgcaggggccccctggccatgggcctggcccagccccgactcctttctgggccctcccaggagtcaccccagaccctggggaaggagtcccgcgggctgaggcaacaaggcacgtcagtggcccagtctggtgcccaagccccaggcagggcccatcgctgtgcccactgtcgaaggcacttccctggctgggtggctctgtggcttcacacccgccggtgccaggcccggctgcccttgccctgccctgagtgtggccgtcgctttcgccatgcccccttcttagcactgcaccgccaggtccatgctgctgccaccccagacctgggctttgcctgccacctctgtgggcagagcttccgaggctgggtggccctggttctgcatctgcgggcccattcagctgcaaagcggcccatcgcttgtcccaaatgcgagagacgcttctggcgacgaaagcagcttcgagctcatctgcggcggtgccaccctcccgccccggaggcccggcccttcatatgcggcaactgtggccggagctttgcccagtgggaccagctagttgcccacaagcgggtgcacgtagctgaggccctggaggaggccgcagccaaggctctggggccccggcccaggggccgccccgcggtgaccgccccccggcccggtggagatgccgtcgaccgccccttccagtgtgcctgttgtggcaagcgcttccggcacaagcccaacttgatcgctcaccgccgcgtgcacacgggcgagcggccccaccagtgccccgagtgcgggaagcgctttaccaataagccctatctgacttcgcaccggcgcatccacaccggcgagaagccctacccgtgcaaagagtgcggccgccgcttccggcacaaacccaacctgctgtctcacagcaagattcacaagcgatccgaggggtcggcccaggccgcccccggcccggggagcccccagctgccagccggcccccaggagtccgcggccgagcccaccccggcggtacctctgaaaccggcccaggagccgccgccaggggccccgccagagcacccgcaggacccgatcgaagcccccccctccctctacagctgcgacgactgcggcaggagcttccggctggagcgcttcctgcgggcccaccagcggcagcacaccggggagcggcccttcacctgcgccgagtgcgggaagaacttcggcaagaagacgcacctggtggcgcactcgcgcgtgcactccggcgagcggcccttcgcctgcgaggagtgcggccgccgcttctcccagggcagccatctggcggcgcatcggcgcgaccacgcccccgatcggcccttcgtgtgtcccgactgcggcaaggccttccgccacaaaccctacctggcggcgcaccggcgcatccacaccggcgagaagccctacgtctgccccgactgcggcaaagccttcagccagaagtccaacctggtgtcgcaccggcgcatccacacgggcgagcggccctacgcctgtcccgactgcgaccgcagcttcagccagaagtccaacctcatcacccaccgcaagagccacatccgggacggcgccttctgctgtgccatctgtggccagaccttcgacgacgaggagagactcctggcccaccagaagaagcacgatgtctga

SEQ ID NO: 1893 - DNA, 583 bp, Homo sapiens
agaggaagcccagcaacttctgctctttcttaatttctagaaaagagtgaagagaggccttttcaaagttcgcaggatcgggcctttttgtgctccactttggaacaaatcggaagctagggccttccagcagaggaagaaccgatgctggaacgtcgttgcaggggccccctggccatgggcctggcccagccccgactcctttctgggccctcccaggagtcaccccagaccctggggaaggagtcccgcgggctgaggcaacaaggcacgtcagtggcccagtctggtgcccaagccccaggcagggcccatcgctgtgcccactgtcgaaggcacttccctggctgggtggctctgtggcttcacacccgccggtgccaggcccggctgcccttgccctgccctgagtgtggccgtcgctttcgccatgcccccttcttagcactgcaccgccaggtccatgctgctgccaccccagacctgggctttgcctgccacctctgtgggcagagcttccgaggctgggtggccctggttctgcatctgcgggcccattcagctgcaaagcggcccatcgctt

SEQ ID NO: 1894 - DNA, 2256 bp, Homo sapiens
gctccactttggaacaaatcggaagctagggccttccaggtaaggctggcctctctgcagtcagaggtctgagctctgccatggggataggggtgtctttattactgcagttttctctaacacctgggggctaccggagtgtgggccgaagcaggcgctgcagccgcggaagtatccccaggaacatccccaagaggagctggaaaaagcctcatccccagctctgcagtctccaggggagctcagtgtctgtttgtccagcttctcagagttgctgtgcagctcggatgtggcataggaaacagcagacacagggagagggcagcataaggcactgtagggagcagtggccacattttctgcagaggaagaaccgatgctggaacgtcgttgcaggggccccctggccatgggcctggcccagccccgactcctttctgggccctcccaggagtcaccccagaccctggggaaggagtcccgcgggctgaggcaacaaggcacgtcagtggcccagtctggtgcccaagccccaggcagggcccatcgctgtgcccactgtcgaaggcacttccctggctgggtggctctgtggcttcacacccgccggtgccaggcccggctgcccttgccctgccctgagtgtggccgtcgctttcgccatgcccccttcttagcactgcaccgccaggtccatgctgctgccaccccagacctgggctttgcctgccacctctgtgggcagagcttccgaggctgggtggccctggttctgcatctgcgggcccattcagctgcaaagcggcccatcgcttgtcccaaatgcgagagacgcttctggcgacgaaagcagcttcgagctcatctgcggcggtgccaccctcccgccccggaggcccggcccttcatatgcggcaactgtggccggagctttgcccagtgggaccagctagttgcccacaagcgggtgcacgtagctgaggccctggaggaggccgcagccaaggctctggggccccggcccaggggccgccccgcggtgaccgccccccggcccggtggagatgccgtcgaccgccccttccagtgtgcctgttgtggcaagcgcttccggcacaagcccaacttgatcgctcaccgccgcgtgcacacgggcgagcggccccaccagtgccccgagtgcgggaagcgctttaccaataagccctatctgacttcgcaccggcgcatccacaccggcgagaagccctacccgtgcaaagagtgcggccgccgcttccggcacaaacccaacctgctgtctcacagcaagattcacaagcgatccgaggggtcggcccaggccgcccccggcccggggagcccccagctgccagccggcccccaggagtccgcggccgagcccaccccggcggtacctctgaaaccggcccaggagccgccgccaggggccccgccagagcacccgcaggacccgatcgaagcccccccctccctctacagctgcgacgactgcggcaggagcttccggctggagcgcttcctgcgggcccaccagcggcagcacaccggggagcggcccttcacctgcgccgagtgcgggaagaacttcggcaagaagacgcacctggtggcgcactcgcgcgtgcactccggcgagcggcccttcgcctgcgaggagtgcggccgccgcttctcccagggcagccatctggcggcgcatcggcgcgaccacgcccccgatcggcccttcgtgtgtcccgactgcggcaaggccttccgccacaaaccctacctggcggcgcaccggcgcatccacaccggcgagaagccctacgtctgccccgactgcggcaaagccttcagccagaagtccaacctggtgtcgcaccggcgcatccacacgggcgagcggccctacgcctgtcccgactgcgaccgcagcttcagccagaagtccaacctcatcacccaccgcaagagccacatccgggacggcgccttctgctgtgccatctgtggccagaccttcgacgacgaggagagactcctggcccaccagaagaagcacgatgtctgagacggtgggcggggccgtgttggctgagagagggctggggtccttcgtggtgggagtcgcagtgggctgggggtgcctgcctagtgctggagtaggggacaatgggaatcctagaggggatggaagacgcggggagtgagctgggtgggccctgctagcgagagaggtcaaccccg

SEQ ID NO: 1895 - DNA, 5732 bp, Homo sapiens
gtgagggcggcgatgagagcgaaagttgcgctcggctcgtcgctgggggcttgaagcggctccgcgctctgcccgtttgggcctcccccgactcggactcgcgcccgtgggctcccgccgcgcccgcccggccccgcgccggccccgcgccccctcccccgtctcggcgccccctcctcaggagccgcgggtccccgccactttcgcacggccccggcccccgccgatgccggccatggtggagaagggccccgaggtctcagggaagcggagagggaggaacaacgcggccgcctccgcctccgccgccgccgcctccgccgccgcctcggccgcctgcgcctcgccagccgccactgccgcctcgggcgccgccgcctcctcagcctcggccgccgccgcctcagccgccgccgcccccaataatggccagaataaaagtttggcggcggcggcgcccaatggcaacagcagcagcaactcctgggaggaaggcagctcgggctcgtccagcgacgaggagcacggtggcggtggcatgagggtcggaccccagtaccaggcggtggtgcccgacttcgaccccgccaaactggcaagacgcagtcaagaacgggacaatcttggcatgttggtctggtcacccaatcaaaatctgtcagaagcaaagttggatgaatacattgccattgccaaagaaaagcatgggtacaacatggaacaggctcttgggatgctcttctggcataaacataatatcgaaaagtcattggctgatttgcccaactttacccctttcccagatgagtggactgtggaagataaagtcttatttgagcaagcctttagttttcatgggaaaacttttcatagaatccaacaaatgcttccagataaatctatagcaagtctggtgaaattttactattcttggaagaagacgaggactaaaactagtgtgatggatcgccatgcccggaaacaaaaacgggagcgggaggagagcgaggatgaactggaagaggcaaatggaaacaatcccattgacattgaggttgatcaaaacaaggaaagcaaaaaggaggttccccctactgagacagttcctcaggtcaaaaaagaaaaacatagcacacaagctaaaaatagagcaaaaaggaaacctccaaaaggaatgtttctttctcaagaagatgtggaggctgtttctgccaatgccactgctgctaccacggtgctgagacaactagacatggaattggtttcagtcaaacgacagatccagaatattaaacagacaaacagtgctctcaaagaaaaacttgatggtggaatagaaccatatcgacttccagaggtcattcagaaatgtaatgcacgttggactacagaagagcagcttctcgccgtacaagccatcaggaaatatggccgagattttcaggcaatctcagacgtgattgggaacaaatcagtggtacaagtgaaaaacttttttgtaaattatcgacgccgcttcaacatagatgaagttttacaagaatgggaggcagaacatggtaaagaagagaccaatgggcccagtaaccagaagcctgtgaagtccccagataattccattaagatgcccgaagaggaagacgaggctcctgttctggatgtcagatatgcatctgcctcctgagaaactggtggctttgaacacttggtgtggactactgtgttatccgggatatcaggtattatgagacatcacctagccatctgcatcacatctctctggacaagcagctattaccaaaaaaggcatatacttccagtcctgtgctccatctgccttaattctttgctcgttcctccatgttggcgccacttcccagagagctccactgcatctcacactctgcccacgtgctggggaagtctcacggcctgcacatctcttgtgactctgggaaccgcctctcccgccggagcccccgagccccaccaatggcagctcttcccagtcagcagcttcagagcaggcagtctccttggaaggcccgactctgttcctgcatggcctgcagtttctactttgtgcatagagtcattttcagagtcaccgcgaccctgttggccttctagaaagtttcttttgttcttttctgagacaaccacctaagtgataatacgcttttttggaaactaatatatattgccagactgcatcataacctttatcatgccaagcatcctgatgcaactcacatttccctaaacatggggtacagttatgatttataaattgagttggcttaaatctccctcttctcccttcccaagtgttacaaagatcatttactgcaactgtcgttggacactgtagcttaaagggaacgtggacctcaatgctttctgccttcaacttttcagcattgtgaccccagggtggttgccaccccatcttttcctgaccccccccacccccccacctccaagaggttcggcccacatcactgtacctggtgcttgtaaatttggaattggtgccttctccttttggcaaccatggttatcaatcctttttctgttttagtgtcttatttcttctttcaagttatttgctagccaaagatgacatcactgagattaggagacaggggagagcttgctgcagattctgacagtgcagattttaaatgtcaggatattagaatagctggcgctggtttatgaaagctgcgcgttgttccgcgttctctcggtgtgcctggccttttatgtggcactctgtatgtcagtttgtgtccttcatgtgctgatgtgattacacaaacaccatgcactctcttttcatatcagagtacaggacagagaagtgatcaatgtattggtctagtgagactgagatgaaaagaaataacctacagagtggtctgtaatgccttttggttggactgggaacaagtaaaaatttctaataaacattttgagacttccagaatcacttttgttatcttatcagaccatgggcctgctgagggttgagcagacagcctgcattctaacataccctgttcccaccccacggccattcagactgcactcaatacgctgaagtcgcttttgttgttgttgttgttgtttgcatcatttggatttttttcctgctttcaataccaaaaaaatgcagatgctttaaggcctaaacagaattctgaagaatttaaaatatgcaattaaagtttgatatgttttgtctcccaagcaccttgttttttgttgttgttgttgttgttgaagtcagctgattttctctttagaaagagggtcagctagaaacctaggttttttggaattgtaaatttttttttagtatagtctggagagaaaggtcattcaaaaggaaagtacaatgggacttgctgcccttcatcatctcgttcccgtgccaggtgtgtgttggtcacgtaaaagcctgggaagcatcagaggagtcccggattgctgctgctacctggagacagggttagcaaaataacactagtgatgagggagaggcttcttttcaccataagcctgctgtgtacaccgagggcggcaggagaagcatgggaaggagtcagcctaagtttgcacattgcataaagggtacactaaggtatgagctgaagctttaggttctccgtgcttccctcaagacctccttcttgctaacagaagcagtaggcaattgctgcagtgcgtttctcaccctgccaataggtctgtctgtatctctgttaaggaaaatagcctggtccctcctggcagtgcttggaagcttgatgctaatttttatatagcgtggcaaactgaccagcagtgccaggccttgatctgtattctgcactatccctttacttggttcctggcactgaatggtctccagccctgaagaatcacgtgtgatcacagcagctgacctgggctttctccccgagaggaaggggcatgtcatttttatttgacagagggaaaatgggagctgtccttgactgcctttgttgtgctttcccgcgtaagatagcactgtgttttaaactgttgcattacactgtctttgcaatgatgtaaatgtaagaaatcacttagctttaaaagcgcagtggtttgatcttatttatatgaagactttttaacatatcaagaattaggtgcattggcaggtagggtttggggtgtgataactgcttcagatggaatgttcacttaagctttgtcttcttaaaaattatcaatgtgaatgtcataattatatatatttttgtggaaaattttctcctaagtataagttattgtgcaaaatatagtgtcattgatgcaaataatagtttaacttttagtttagaactcctaaaagatataaattgtattgcatatgcattaaaagtttgttttatttaattttatgtagatgtgtgaagtgttaggtaaaatttttttcacttatccatttaaacaccttgttacttgaatattgtgttgactggtctgcaacagtgatccattctgtaatatagctcttttaactgggaaggaaccacaccccagttgtgccgattacattagtgttggcacacagtcgggtgctagtgtaacacaaatgccgcgttgtctgggtgtacagtgtttgtggagacgccacttcctcaaaatggtttttgattgtttttaacctataagacgttctgatgctcacaaacctctattcaacacacaaaacaaacatgaaaaggtagttagttgggttgtaacagcttactggggtggactcataaaacagtggctttctgttcatctaaagtttcctcagataccacagaccactgttaagtgtgctcattgtcactttaaatttcaacgataccctatttttgtcattctaaatatcagatgtactattggtataattgcacaccaaaaataagccaaacagtgcattacgctaactggatccctgcttttatgtgagctaaggaaagatggagccaactccaacgagggcctctttttctctcttgtctagcctgtttctaaaccgaatgatccaggattcaagcttctattgtcaagtgaaactttcctcagatggactccaggtagccaggtcacctaaacctagtggtcctgtgcgatgctctttctgccagtccctgaatctctgcagcttctcttacctgtcttacctgtagtaaagcacaattgcagtggcgtcgcattcagaagaagggaaggtcagcagaggctatgcatgttgtgtgatgatgagtgtttacagccaccttctcctaaaacgaaatttataccggggtggatagtattccattaggtagacttatcgactttgctaagtgctttttagacagcttaaaaaattttcaagattttaaaagatgtataaggttaagtttgcaaatataatggaaatgctgtatatcttttgaagtgatgaaatccacgttggaattttaaagaaaatatgttgtaataatgctgttgtaagtaatattttaatgtctctttgcctgttttctatttcagcacattcattgtggtgaatgttcatagcattataactgcttagccattgaatgataacatttgttagtggaaattggaaaatttatttgtgaaattctgcagaattcatttttctatttccaatatttgctgaggttaaataaaaattttcaagccattgatgt

SEQ ID NO: 1896 - DNA, 5518 bp, Homo sapiens
atggtggagaagggccccgaggtctcagggaagcggagagggaggaacaacgcggccgcctccgcctccgccgccgccgcctccgccgccgcctcggccgcctgcgcctcgccagccgccactgccgcctcgggcgccgccgcctcctcagcctcggccgccgccgcctcagccgccgccgcccccaataatggccagaataaaagtttggcggcggcggcgcccaatggcaacagcagcagcaactcctgggaggaaggcagctcgggctcgtccagcgacgaggagcacggtggcggtggcatgagggtcggaccccagtaccaggcggtggtgcccgacttcgaccccgccaaactggcaagacgcagtcaagaacgggacaatcttggcatgttggtctggtcacccaatcaaaatctgtcagaagcaaagttggatgaatacattgccattgccaaagaaaagcatgggtacaacatggaacaggctcttgggatgctcttctggcataaacataatatcgaaaagtcattggctgatttgcccaactttacccctttcccagatgagtggactgtggaagataaagtcttatttgagcaagcctttagttttcatgggaaaacttttcatagaatccaacaaatgcttccagataaatctatagcaagtctggtgaaattttactattcttggaagaagacgaggactaaaactagtgtgatggatcgccatgcccggaaacaaaaacgggagcgggaggagagcgaggatgaactggaagaggcaaatggaaacaatcccattgacattgaggttgatcaaaacaaggaaagcaaaaaggaggttccccctactgagacagttcctcaggtcaaaaaagaaaaacatagcacacaagctaaaaatagagcaaaaaggaaacctccaaaaggaatgtttctttctcaagaagatgtggaggctgtttctgccaatgccactgctgctaccacggtgctgagacaactagacatggaattggtttcagtcaaacgacagatccagaatattaaacagacaaacagtgctctcaaagaaaaacttgatggtggaatagaaccatatcgacttccagaggtcattcagaaatgtaatgcacgttggactacagaagagcagcttctcgccgtacaagccatcaggaaatatggccgagattttcaggcaatctcagacgtgattgggaacaaatcagtggtacaagtgaaaaacttttttgtaaattatcgacgccgcttcaacatagatgaagttttacaagaatgggaggcagaacatggtaaagaagagaccaatgggcccagtaaccagaagcctgtgaagtccccagataattccattaagatgcccgaagaggaagacgaggctcctgttctggatgtcagatatgcatctgcctcctgagaaactggtggctttgaacacttggtgtggactactgtgttatccgggatatcaggtattatgagacatcacctagccatctgcatcacatctctctggacaagcagctattaccaaaaaaggcatatacttccagtcctgtgctccatctgccttaattctttgctcgttcctccatgttggcgccacttcccagagagctccactgcatctcacactctgcccacgtgctggggaagtctcacggcctgcacatctcttgtgactctgggaaccgcctctcccgccggagcccccgagccccaccaatggcagctcttcccagtcagcagcttcagagcaggcagtctccttggaaggcccgactctgttcctgcatggcctgcagtttctactttgtgcatagagtcattttcagagtcaccgcgaccctgttggccttctagaaagtttcttttgttcttttctgagacaaccacctaagtgataatacgcttttttggaaactaatatatattgccagactgcatcataacctttatcatgccaagcatcctgatgcaactcacatttccctaaacatggggtacagttatgatttataaattgagttggcttaaatctccctcttctcccttcccaagtgttacaaagatcatttactgcaactgtcgttggacactgtagcttaaagggaacgtggacctcaatgctttctgccttcaacttttcagcattgtgaccccagggtggttgccaccccatcttttcctgaccccccccacccccccacctccaagaggttcggcccacatcactgtacctggtgcttgtaaatttggaattggtgccttctccttttggcaaccatggttatcaatcctttttctgttttagtgtcttatttcttctttcaagttatttgctagccaaagatgacatcactgagattaggagacaggggagagcttgctgcagattctgacagtgcagattttaaatgtcaggatattagaatagctggcgctggtttatgaaagctgcgcgttgttccgcgttctctcggtgtgcctggccttttatgtggcactctgtatgtcagtttgtgtccttcatgtgctgatgtgattacacaaacaccatgcactctcttttcatatcagagtacaggacagagaagtgatcaatgtattggtctagtgagactgagatgaaaagaaataacctacagagtggtctgtaatgccttttggttggactgggaacaagtaaaaatttctaataaacattttgagacttccagaatcacttttgttatcttatcagaccatgggcctgctgagggttgagcagacagcctgcattctaacataccctgttcccaccccacggccattcagactgcactcaatacgctgaagtcgcttttgttgttgttgttgttgtttgcatcatttggatttttttcctgctttcaataccaaaaaaatgcagatgctttaaggcctaaacagaattctgaagaatttaaaatatgcaattaaagtttgatatgttttgtctcccaagcaccttgttttttgttgttgttgttgttgttgaagtcagctgattttctctttagaaagagggtcagctagaaacctaggttttttggaattgtaaatttttttttagtatagtctggagagaaaggtcattcaaaaggaaagtacaatgggacttgctgcccttcatcatctcgttcccgtgccaggtgtgtgttggtcacgtaaaagcctgggaagcatcagaggagtcccggattgctgctgctacctggagacagggttagcaaaataacactagtgatgagggagaggcttcttttcaccataagcctgctgtgtacaccgagggcggcaggagaagcatgggaaggagtcagcctaagtttgcacattgcataaagggtacactaaggtatgagctgaagctttaggttctccgtgcttccctcaagacctccttcttgctaacagaagcagtaggcaattgctgcagtgcgtttctcaccctgccaataggtctgtctgtatctctgttaaggaaaatagcctggtccctcctggcagtgcttggaagcttgatgctaatttttatatagcgtggcaaactgaccagcagtgccaggccttgatctgtattctgcactatccctttacttggttcctggcactgaatggtctccagccctgaagaatcacgtgtgatcacagcagctgacctgggctttctccccgagaggaaggggcatgtcatttttatttgacagagggaaaatgggagctgtccttgactgcctttgttgtgctttcccgcgtaagatagcactgtgttttaaactgttgcattacactgtctttgcaatgatgtaaatgtaagaaatcacttagctttaaaagcgcagtggtttgatcttatttatatgaagactttttaacatatcaagaattaggtgcattggcaggtagggtttggggtgtgataactgcttcagatggaatgttcacttaagctttgtcttcttaaaaattatcaatgtgaatgtcataattatatatatttttgtggaaaattttctcctaagtataagttattgtgcaaaatatagtgtcattgatgcaaataatagtttaacttttagtttagaactcctaaaagatataaattgtattgcatatgcattaaaagtttgttttatttaattttatgtagatgtgtgaagtgttaggtaaaatttttttcacttatccatttaaacaccttgttacttgaatattgtgttgactggtctgcaacagtgatccattctgtaatatagctcttttaactgggaaggaaccacaccccagttgtgccgattacattagtgttggcacacagtcgggtgctagtgtaacacaaatgccgcgttgtctgggtgtacagtgtttgtggagacgccacttcctcaaaatggtttttgattgtttttaacctataagacgttctgatgctcacaaacctctattcaacacacaaaacaaacatgaaaaggtagttagttgggttgtaacagcttactggggtggactcataaaacagtggctttctgttcatctaaagtttcctcagataccacagaccactgttaagtgtgctcattgtcactttaaatttcaacgataccctatttttgtcattctaaatatcagatgtactattggtataattgcacaccaaaaataagccaaacagtgcattacgctaactggatccctgcttttatgtgagctaaggaaagatggagccaactccaacgagggcctctttttctctcttgtctagcctgtttctaaaccgaatgatccaggattcaagcttctattgtcaagtgaaactttcctcagatggactccaggtagccaggtcacctaaacctagtggtcctgtgcgatgctctttctgccagtccctgaatctctgcagcttctcttacctgtcttacctgtagtaaagcacaattgcagtggcgtcgcattcagaagaagggaaggtcagcagaggctatgcatgttgtgtgatgatgagtgtttacagccaccttctcctaaaacgaaatttataccggggtggatagtattccattaggtagacttatcgactttgctaagtgctttttagacagcttaaaaaattttcaagattttaaaagatgtataaggttaagtttgcaaatataatggaaatgctgtatatcttttgaagtgatgaaatccacgttggaattttaaagaaaatatgttgtaataatgctgttgtaagtaatattttaatgtctctttgcctgttttctatttcagcacattcattgtggtgaatgttcatagcattataactgcttagccattgaatgataacatttgttagtggaaattggaaaatttatttgtgaaattctgcagaattcatttttctatttccaatatttgctgaggttaaataaaaattttcaagccattgatgtaataaaatatgaaatgaaagc

SEQ ID NO: 1897 - DNA, 2604 bp, Homo sapiens
gcgcccagccgctgaacggcgtgggcaggtgggcggtggggttccagggcgccccgaggacagggggccccgacttcaggggaaccccaaccctgaggggcgtacatagtaatcacgccccagccgcaccggaccttgcgctcatcccttgcgtcccccacttctgcacaaacttttctgacgccctggctcgtgggggtcgtggagagcgctggggctaccaggtgggctcccaccccgccggaccctagccacgctgacctcctgcctctcctaacctcagtggcgacctctccaggccgggccgggctcggcactcggagcgagtgcggcaaccactgtcgctctccgaaggctcctgcgccccccggggcagctgggcggggtaatgccctcagtgatggagaagccgagcgcgggctctgggatcctgtcccgtagccgggccaagacggtgcccaacggcggacagccccactcggaggatgacagcagcgaggaggagcactcgcacgacagcatgatccgcgttggaaccaattaccaggccgtaattccggagtgcaagcctgagagccccgcacgctacagcaacaaggagctgaaggggatgctggtgtggtcacccaaccactgtgtgtcagatgccaagcttgacaagtacattgcgatggccaaggagaagcatggctacaacattgagcaggcgctgggcatgcttctgtggcataagcacgatgtggagaagtcgctggccgacctggccaacttcaccccattccctgacgagtggacagtagaggacaaggtgctgtttgaacaggcctttggcttccatggcaaatgcttccagcggatccagcagatgctgcctgacaagttgattcccagcctggtgaaatactactactcttggaagaagacccgcagccgaactagtgtgatggacagacaggcccggcggctggggggccgcaaggacaaagaagacagtgatgagctcgaagagggtcgaggaggcgtgagtgagggagagcccgatcctgcagatcccaagagagagcctctaccctctcggcccctgaatgcacgcccaggccctgggaaaaaggaggtccaggtgtctcagtaccgccaccatcccttgcgaacccggcgtcgcccacccaagggcatgtacctgagccctgaaggcctcacggcagtgtcaggaagcccggaccttgccaacctcacgctccgaggtcttgactctcagctcatctccctcaagcgccaggtacagagcatgaagcagacgaacagcagcctgcgccaagccctggagggcggtattgatccactacgccccccggaggccaacaccaagttcaactcccgctggaccacagatgagcagcttttggctgttcaagccatccgtaggtatggcaaagactttggggctattgcagaggtgattgggaacaagactctgacccaggtgaagactttctttgtgagctaccggcgccgcttcaatctggaggaggtgctgcaggaatgggaggctgagcaggatggggcccctggagccccagtccccatggaggaggctaggagaggggctccattgccagccccagccctagaggaagatgatgaggtccagattacatcggtctccacgtccgtgccccgatcagtgccccctgcgccaccaccccctccacctcccacctcgctgtcccagccacccccgctgctgaggccacctttgcccacggctcccactctgctccgacagccacccccactgcagcagggccgcttcctccagccccggctggcccccaaccagcccccaccgcctctcatccgccccgctctggctgccccccgccacagcgcccgccctggccctcagcccccacccaccctgattggaacccctctggagcccccagcaccctcactctgagccctgacgtcctccaccaaccacgggctccaggacccctttgctggccatccccaggcatctctggtgtcactgaggacagaagggactagggctctggcggggtctttgtaagaccagagtttcggacagcccagccccgccctttgggttctgcatgtgttcctggcagctgggcctgtctcctggggccatggccgggctcaggggcctttgagctggcctgagggcactttcgcttcctggccggtactggaatggctgtgtcctagtctgctggggcttggcctctgggtcctgccctttgtgtgtccggggtagtgaccttagcgtggagtggggagagggcagttgggtgtgctggctgttctcattcctctttcccttcttttagcaataagtctggggtgaggtggggagggaggctgcagggggggaggtgggcagaggggccttacagcagcagaggctggaagagaagctctgtcttcaggggccagctgggaaatgctaaggagctgagggtgcccaccaagcccaccttccagaaacttggagaaatgggggttgggaacttatgcagacatggatttatttttcaacattttttaaaaattaaaaaaaataaaatctaagcttactga

SEQ ID NO: 1898 - DNA, 4246 bp, Homo sapiens
gagttgatatcttcccatccacccgccgcttctttcctccatctagcgatttttattttttaagtgtctcttcctttttctttcttttcttcttttttattttttatatatattttttggcattgctttgcagatgttgggatgagagtcggagccgaataccaagctcggatccctgaatttgatccaggtgctacaaagtacacagataaagacaatggagggatgcttgtatggtctccatatcacagtatcccagatgccaaattggatgaatacattgcaattgcaaaggaaaagcatggctacaatgtggaacaggcacttggcatgttgttctggcataaacataacattgagaagtcccttgctgatctccctaatttcactccctttccggatgagtggacagtggaagataaagtcctatttgaacaagcctttagttttcatggaaagagctttcacaggattcagcaaatgcttccagataagacaattgcaagccttgtaaaatattactattcttggaaaaaaactcgctctaggacaagtttgatggatcgccaggctcgtaaactagctaatagacataatcagggtgacagtgatgatgatgtagaagaaacacatccaatggatgggaatgatagtgattatgatcccaaaaaagaagccaaaaaagagggtaatactgaacaacctgtccaaactagcaagattggacttggaagaagagagtatcagagtttacaacatcgccatcattctcagcgttctaagtgccgtccacctaagggcatgtatttaacccaggaagatgtggtagcagtttcctgtagtcccaatgcagccaacaccatcctgaggcaactggacatggagttgatctctctaaaacgtcaggttcagaatgctaagcaagtaaacagtgcacttaaacagaaaatggaaggtggaattgaagaattcaaacctcctgagtcaaatcagaaaattaatgcccgttggaccacagaggagcagcttctagcagtgcaaggtgtccgcaaatatggtaaagattttcaagctattgcagatgtaattggcaacaagactgttggccaagtgaagaacttctttgtaaactacaggcgtcggtttaacttagaggaggtattgcaggagtgggaagcagaacaaggaacccaggcttctaatggtgatgcttctactttaggggaggagacaaaaagtgcttctaatgtgccatcagggaagagcactgatgaagaagaggaggcacagaccccacaggctcctcggacactgggtccatcacctcctgccccatcatccactccaacaccaacagcccctattgccactctgaaccagcctccaccacttcttcgtccaacactgcctgctgccccggctcttcaccggcagcctcctccactccagcagcaggctcggttcatccagccccggccaactttaaatcagcctccaccacctcttattcgccctgctaattccatgccaccccgtctaaacccaagaccggtgttgtccacggttggtggtcaacagccaccatcacttattggaattcagacagattcacagtcctcactgcactaaaaattaaattggacacagctgcagtaacttttcaccccatcattataccagtgctcatctgactgatgaaaaagaggaaagaataatcatttctagatactgaggctgcgaactagttctgtggcagtggactagcataagtggatgtctaagaaatttttcagttcactagactaaaatgttttacaacaaaaagcctccagttagcctcctttctagagtatatgttcagcaatgttgatctcataaaaggaaaaacaaaagatttaagtattctatataccaagtttttgttttgtttttactgtatttattttattgaggttctttatattcctgcctcttcatagtcaaggctcttagtacaggaatattgacttaggaattgtgaaaactccttaagtttcttaagttaaggatgtttggcttttttctttaattttttaaaaaccattttcctatgttaggagtgcaagaatagccagcatttccgattttgacatatgttcattttatgcatatttaagaaattatagctgcatatcccttctttcaaaaaatgttgcttttttttttaaaggaattttaatatattcctttaaaagaaagcaatttaatcaattgcaaagcaattatataaaaccacaaagaatgtactgaacctactaaccctttaacatacagtttagggtcctagcgcagagtccttgtttaaaggtcattgactcatcatctgtcagtaatgagaggattggaagaataattttgcatacaaatgaggacttaatttgttgaaatataatctctttaagttccttgaaaatggagttggttttttttgtttctaaatgctatctgcttttaactagtagttgcctacatctggggacttcagagaagaattatattttgttagttaagtagacacagtggttatggaagcatttctttacagtaccctttacatgtttggtttctgaacttaaaattgccctcatacttaataatatggtctgcatttaatatgaaaggtgttttattgataaatctattgtactatttggatacatttgtgtattccttgcagccaacctgtattcgtgggattggtgtagggttaaatcatcaacattatttcataaaataagaatttgttctgtgttatctaaagatgtatcagtatattgtcacagttgtgctgttaactaaaaatgctgagacccctttttatagaaaaacaaaaagacatcaagtcttcttaattcaacccataatcattaagtacttaacaaagaatattttacaagtgatagtatttcaacaatgtgtaattaatatttttgatacagtgatttcatattggaatcattatttgtgcaaagggacagacagatcacttagattgctatactagtggacataggctacatgtttgcacattcacattcttatcacgtgtagaatacttcacaaaatagtcaacatctaaggccctaatttatgttttgaaagatcatgtgttcccaaagtattccctattgttggctccacagccttaaagtgctatagatttaaattcattgattagttttaatttttaattttagactgtgtatttccataaataccctacgtactggcatatttgaaactctttttccaggttaggtccttttctttctcattgaatcatcttaaatagttcttggccctgaatttagctgatttaaaattcttaatattcaagaatttatacttattttttccttaaaagccacaggggacagttaaatatcttaaaatatctaaaacattttttaaagcacttagattgtcttacgtatgtgcatactatacctttacagcgtttattgtcttgtctcttgtcagtagaccttcagtacacagtatgtgggatatgtcagtcaagttggtcagcaccagcatctgtccagctgttcagtatattgtgattcattaaaaaatctcttctatcccagacatgggccaaggtgctgtatctgagggatgtgctgtaatttgatttacatgcattagagcacacagtagaaaaactttagcttcattagtaatatgacacatgtatatagtgagatgtctttattgtgtgctttgcatattttgtaaatattttgcacgtcattatttttcttttttgtttaagcagtgtttggcctggaagagtgatatgcttgctgcttaatcaaaggattaaagatttaaagatgtctatgtcttctatttttatataatttcatgttctatgaggaatttagtacctcttcactgtgaaattcgaaataatgatttttataaaagcaaaactagaaatcttttaatgacaattttcattaatttcagggttatcatttttgagaaatctacaccaaagtggttttttaaaattacataactaaaaataaaccacactgtggatacatcttataaaactaatggaaacaatgtttttctatatgatttaattctagtgtaatatggatgaggtaagagtaagttatgatcaaactttttatgttcttaataagcttgcaattgagtaaaatagaatataaaataaaggtgaaataatataaaa

SEQ ID NO: 1899 - DNA, 2525 bp, Homo sapiens
agagcgcggtgcggccgaggggcgcccgggactgcgcggggcgggcggcggcggagggaggaggggagagaggcggggccggggcgggttgttgtgaggcgactgcgctactgccggagcggggcggttatggcggctccatattaacagcctcctcctcctccgccgccgccgccgtctcctcctcctcctcctttccctcccgcccgcgctctaagccatctccgccttcaccctgacgcctgcctcttcccctcacctttccccctcccctgttctaccatgcccggcatgatggagaaagggcccgagttactggggaagaaccgatcggccaacggcagcgccaagagcccggcaggcggcggcggcagcggcgcctcgtccaccaacggcgggctgcactactcagagcccgagagcggctgcagcagcgacgacgagcacgatgttgggatgagagtcggagccgaataccaagctcggatccctgaatttgatccaggtgctacaaagtacacagataaagacaatggagggatgcttgtatggtctccatatcacagtatcccagatgccaaattggatgaatacattgcaattgcaaaggaaaagcatggctacaatgtggaacaggcacttggcatgttgttctggcataaacataacattgagaagtcccttgctgatctccctaatttcactccctttccggatgagtggacagtggaagataaagtcctatttgaacaagcctttagttttcatggaaagagctttcacaggattcagcaaatgcttccagataagacaattgcaagccttgtaaaatattactattcttggaaaaaaactcgctctaggacaagtttgatggatcgccaggctcgtaaactagctaatagacataatcagggtgacagtgatgatgatgtagaagaaacacatccaatggatgggaatgatagtgattatgatcccaaaaaagaagccaaaaaagagggtaatactgaacaacctgtccaaactagcaagattggacttggaagaagagagtatcagagtttacaacatcgccatcattctcagcgttctaagtgccgtccacctaagggcatgtatttaacccaggaagatgtggtagcagtttcctgtagtcccaatgcagccaacaccatcctgaggcaactggacatggagttgatctctctaaaacgtcaggttcagaatgctaagcaagtaaacagtgcacttaaacagaaaatggaaggtggaattgaagaattcaaacctcctgagtcaaatcagaaaattaatgcccgttggaccacagaggagcagcttctagcagtgcaaggcacagaccccacaggctcctcggacactgggtccatcacctcctgccccatcatccactccaacaccaacagcccctattgccactctgaaccagcctccaccacttcttcgtccaacactgcctgctgccccggctcttcaccggcagcctcctccactccagcagcaggctcggttcatccagccccggccaactttaaatcagcctccaccacctcttattcgccctgctaattccatgccaccccgtctaaacccaagaccggtgttgtccacggttggtggtcaacagccaccatcacttattggaattcagacagattcacagtcctcactgcactaaaaattaaattggacacagctgcagtaacttttcaccccatcattataccagtgctcatctgactgatgaaaaagaggaaagaataatcatttctagatactgaggctgcgaactagttctgtggcagtggactagcataagtggatgtctaagaaatttttcagttcactagactaaaatgttttacaacaaaaagcctccagttagcctcctttctagagtatatgttcagcaatgttgatctcataaaaggaaaaacaaaagatttaagtattctatataccaagtttttgttttgtttttactgtatttattttattgaggttctttatattcctgcctcttcatagtcaaggctcttagtacaggaatattgacttaggaattgtgaaaactccttaagtttcttaagttaaggatgtttggcttttttctttaattttttaaaaaccattttcctatgttaggagtgcaagaatagccagcatttccgattttgacatatgttcattttatgcatatttaagaaattatagctgcatatcccttctttcaaaaaatgttgcttttttttttaaaggaattttaatatattcctttaaaagaaagcaatttaatcaattgcaaagcaattatataaaaccacaaagaatgtactgaacctactaaccctttaacatacagtttagggtcctagcgcagagtccttgtttaaaggtcattgactcatcatctgtcagtaatgagaggattggaagaataattttgcatacaaatgaggacttaatttgttgaaatataatctctttaagttccttgaaaa

SEQ ID NO: 1900 - DNA, 2041 bp, Homo sapiens
ctcctcctccgccgccgccgccgtctcctcctcctcctcctttccctcccgcccgcgctctaagccatctccgccttcaccctgacgcctgcctcttcccctcacctttccccctcccctgttctaccatgcccggcatgatggagaaagggcccgagttactggggaagaaccgatcggccaacggcagcgccaagagcccggcaggcggcggcggcagcggcgcctcgtccaccaacggcgggctgcactactcagagcccgagagcggctgcagcagcgacgacgagcacgatgttgggatgagagtcggagccgaataccaagctcggatccctgaatttgatccaggtgctacaaagtacacagataaagacaatggagggatgcttgtatggtctccatatcacagtatcccagatgccaaattggatgaatacattgcaattgcaaaggaaaagcatggctacaatgtggaacaggcacttggcatgttgttctggcataaacataacattgagaagtcccttgctgatctccctaatttcactccctttccggatgagtggacagtggaagataaagtcctatttgaacaagcctttagttttcatggaaagagctttcacaggattcagcaaatgcttccagataagacaattgcaagccttgtaaaatattactattcttggaaaaaaactcgctctaggacaagtttgatggatcgccaggctcgtaaactagctaatagacataatcagggtgacagtgatgatgatgtagaagaaacacatccaatggatgggaatgatagtgattatgatcccaaaaaagaagccaaaaaagagggtaatactgaacaacctgtccaaactagcaagattggacttggaagaagagagtatcagagtttacaacatcgccatcattctcagcgttctaagtgccgtccacctaagggcatgtatttaacccaggaagatgtggtagcagtttcctgtagtcccaatgcagccaacaccatcctgaggcaactggacatggagttgatctctctaaaacgtcaggttcagaatgctaagcaagtaaacagtgcacttaaacagaaaatggaaggtggaattgaagaattcaaacctcctgagtcaaatcagaaaattaatgcccgttggaccacagaggagcagcttctagcagtgcaaggtgtccgcaaatatggtaaagattttcaagctattgcagatgtaattggcaacaagactgttggccaagtgaagaacttctttgtaaactacaggcgtcggtttaacttagaggaggtattgcaggagtgggaagcagaacaaggaacccaggcttctaatggtgatgcttctactttaggggaggagacaaaaagtgcttctaatgtgccatcagggaagagcactgatgaagaagaggaggcacagaccccacaggctcctcggacactgggtccatcacctcctgccccatcatccactccaacaccaacagcccctattgccactctgaaccagcctccaccacttcttcgtccaacactgcctgctgccccggctcttcaccggcagcctcctccactccagcagcaggctcggttcatccagccccggccaactttaaatcagcctccaccacctcttattcgccctgctaattccatgccaccccgtctaaacccaagaccggtgttgtccacggttggtggtcaacagccaccatcacttattggaattcagacagattcacagtcctcactgcactaaaaattaaattggacacagctgcagtaacttttcaccccatcattataccagtgctcatctgactgatgaaaaagaggaaagaataatcatttctagatactgaggctgcgaactagttctgtggcagtggactagcataagtggatgtctaagaaatttttcagttcactagactaaaatgttttacaacaaaaagcctccagttagcctcctttctagagtatatgttcagcaatgttgatctcataaaa

SEQ ID NO: 1901 - DNA, 1827 bp, Homo sapiens
actgccggagcggggcggttatggcggctccatattaacagcctcctcctcctccgccgccgccgccgtctcctcctcctcctcctttccctcccgcccgcgctctaagccatctccgccttcaccctgacgcctgcctcttcccctcacctttccccctcccctgttctaccatgcccggcatgatggagaaagggcccgagttactggggaagaaccgatcggccaacggcagcgccaagagcccggcaggcggcggcggcagcggcgcctcgtccaccaacggcgggctgcactactcagagcccgagagcggctgcagcagcgacgacgagcacgatgttgggatgagagtcggagccgaataccaagctcggatccctgaatttgatccaggtgctacaaagtacacagataaagacaatggagggatgcttgtatggtctccatatcacagtatcccagatgccaaattggatgaatacattgcaattgcaaaggaaaagcatggctacaatgtggaacaggcacttggcatgttgttctggcataaacataacattgagaagtcccttgctgatctccctaatttcactccctttccggatgagtggacagtggaagataaagtcctatttgaacaagcctttagttttcatggaaagagctttcacaggattcagcaaatgcttccagataagacaattgcaagccttgtaaaatattactattcttggaaaaaaactcgctctaggacaagtttgatggatcgccaggctcgtaaactagctaatagacataatcagggtgacagtgatgatgatgtagaagaaacacatccaatggatgggaatgatagtgattatgatcccaaaaaagaagccaaaaaagagggtaatactgaacaacctgtccaaactagcaagattggacttggaagaagagagtatcagagtttacaacatcgccatcattctcagcgttctaagtgccgtccacctaagggcatgtatttaacccaggaagatgtggtagcagtttcctgtagtcccaatgcagccaacaccatcctgaggcaactggacatggagttgatctctctaaaacgtcaggttcagaatgctaagcaagtaaacagtgcacttaaacagaaaatggaaggtggaattgaagaattcaaacctcctgagtcaaatcagaaaattaatgcccgttggaccacagaggagcagcttctagcagtgcaaggtgtccgcaaatatggtaaagattttcaagctattgcagatgtaattggcaacaagactgttggccaagtgaagaacttctttgtaaactacaggcgtcggtttaacttagaggaggtattgcaggagtgggaagcagaacaaggaacccaggcttctaatggtgatgcttctactttaggggaggagacaaaaagtgcttctaatgtgccatcagggaagagcactgatgaagaagaggaggtgtgtttgtgtatggaatttgagctaatatgagttgaggaatcaccattttgtgtggtattctgtaaggttaatttgtcaagaggactagctaaattgagcatgaaaggttgacaatacacttcttcagtggtgcatctctcgtgactcttaagtcataatgacatgctaagttctgattctagaagaatggagagtgtattgttctttcatagtcttatttttattttcagtgttaagctgtttacaaataaagatgcctgtttggtagcctcattggtttttggtttttggttttgttttgtttaaaataaaagaagcttgtgcttccaataaa

SEQ ID NO: 1902 - DNA, 540 bp, Homo sapiens
aaacgctgccagaaagcagctctcgcttcacctctgccgggggactccgccctctcccccagcgctccaagcggagaccgcagatgttgggatgagagtcggagccgaataccaagctcggatccctgaatttgatccaggtgctacaaagtacacagataaagacaatggagggatgcttgtatggtctccatatcacagtatcccagatgccaaattggatgaatacattgcaattgcaaaggaaaagcatggctacaatgtggaacaggcacttggcatgttgttctggcataaacataacattgagaagtcccttgctgatctccctaatttcactccctttccggatgagtggacagtggaagataaagtcctatttgaacaagcctttagttttcatggaaagagctttcacaggattcagcaaatgcttccagataagacaattgcaagccttgtaaaatattactattcttggaaaaaaactcgctctaggacaagtttgatggatcgccaggctcgtaaactagctaatag

SEQ ID NO: 1903 - DNA, 564 bp, Homo sapiens
gcattacagagcacaactccttccaggctggaaacgctgccagaaagcagctctcgcttcacctctgccgggggactccgccctctcccccagcgctccaagcggagaccgcaggtcagcaagaactgaaaacgcgtctactgggccagaaagggcccgagttactggggaagaaccgatcggccaacggcagcgccaagagcccggcaggcggcggcggcagcggcgcctcgtccaccaacggcgggctgcactactcagagcccgagagcggctgcagcagcgacgacgagcacgatgttgggatgagagtcggagccgaataccaagctcggatccctgaatttgatccaggtgctacaaagtacacagataaagacaatggagggatgcttgtatggtctccatatcacagtatcccagatgccaaattggatgaatacattgcaattgcaaaggaaaagcatggctacaatgtggaacaggcacttggcatgttgttctggcataaacataacattgagaagtcccttgctgatctccctaatttcactccctttccgg

SEQ ID NO: 1904 - DNA, 2127 bp, Homo sapiens
gcgccaggcccgctggggcaggtgtcccgtggaaatcgacggaggggctgccgtgggcggtgggagccatgttcctgagcccgggcgaggggccggcaaccgagggtgggggtctggggccgggcgaggaggcccccaagaagaagcaccggaggaaccgcaccaccttcaccacctaccagctgcaccagctggagcgggcgttcgaggcctctcactacccggatgtgtacagccgtgaggagctggcagccaaggtgcacctacctgaggtgcgcgtgcaggtgtggttccagaaccgccgggccaagtggcgccgccaggagcggctggagtcaggctcgggtgccgtggcagctccgagactccccgaggccccagcgctgccgttcgcccgccccccggccatgtcgctgcccctggagccctggttgggccccggaccgccggccgtgccaggcctcccccgcctcctgggcccgggcccggggctgcaagcgtccttcgggcctcatgcctttgctcccaccttcgcagatggcttcgccctggaggaggcgtccctgcggctgctggccaaggaacatgcacaggctctggacagggcctggccgccagcctgagcctgccgccctcccgggccccctcctcggcccaacccgagaaccggggacgtgccctggtgacagccaccacgccttggcctaggccgaggtcatggagcaaccgtggtcaggccaggccaccaccactggggagcgggaccagagagacaggctgctgggttccctgcccccatcccgtctcccaccccatcgccacccgtcctgctggcagcggactggcccccagtgtcaggcaggaggtgacccaagtattctcaggccaggtgcggggacctcctcccctcctggggcctcagtctcctgtctgttaattgggcgtgggggcctccgaggttcgagggctgcgaggctgtgggtggcgggaccgctgactctgtaagatgagtgtaaatctctctgcttctcctaatccccatcagcagagctgcccactctccaggctcccagtcccctggaaataacaaatagcagcagctcccgcgagcctggtctcctctcaccgtgtgctcgccatgtgagcactcccctctccgttgtgccctggacctcgggcacagctgtcagcccattctatagagagggaaaccggggcttaggcaggaagccaggtccccaaagtcgcacggccaggagtggatggagctgcctttcagacccatcaccggtcctaccgtccggggcacagcgacaggttctggagagagggtgggtcccgggccaggtgctggtgggcctccaggtggaggcgggctgatgctgggtgtgtcgtcatcgtcagaccgttcctcacgtccccacagaccccaggccctgtgcatgtccccagtggaggcatggccagcatctgctctgtccaacccagccgcatcgcccaagagctctgagcaaggaggctgtcgcggggccgagaacccgctgggactggcaagcacggctggcccagtgcagcaggagggggccctgaggcatgggatgggacagtctgggccagcgccacctcccgggacagaagtgcggcaccagggcaggagctgcagtagctaccctccccgtctccagcctgggctccccagatcactcccagatcaccaggtcaccccatctctaggcggcacctcacacaccagtcctgtggtccaacgccccgccatcacccaatgtcaccgcacaccaggcagtggggacacggcagtaagcacaagaaagatttttttttttaaagctaaaccaggccaggtgcggtggctcatgcctgtaatcccagtgctttgggaggctgaggtgggaggattgcttgagaccagcctgggtgacacagcaagaccccatctccacaaacgtttttaaaatgtgccgggtgtactggtgcacacctgtcatcccagctacccaagaagctgaggcaagaggatcacttgagcccagaaggtcgaggctgcagggagctgtgatcacactgctgcactccagcctgtgcaacagagccagaccctgactcaat

SEQ ID NO: 1905 - DNA, 2428 bp, Homo sapiens
ccacagcagacgcagcgccaggcccgctggggcaggtgtcccgtggaaatcgacggaggggctgccgtgggcggccgtgacagtcacagagaggggaagagaaaacagggacggtgacacacacagagagaaggaagagcagacagaggcacagcaggagacccccccaagcccgaggaggacagcctggggatgcagagcgcatgccggccccagtggagggaaccgatttccccggagccgggaggcaagcctggggctcccctgccctgtccctgccggtagcccccccagccgtctccccaccatctgtcccgctgccgtcccaccaggtgggagccatgttcctgagcccgggcgaggggccggcaaccgagggtgggggtctggggccgggcgaggaggcccccaagaagaagcaccggaggaaccgcaccaccttcaccacctaccagctgcaccagctggagcgggcgttcgaggcctctcactacccggatgtgtacagccgtgaggagctggcagccaaggtgcacctacctgaggtgcgcgtgcaggtgtggttccagaaccgccgggccaagtggcgccgccaggagcggctggagtcaggctcgggtgccgtggcagctccgagactccccgaggccccagcgctgccgttcgcccgccccccggccatgtcgctgcccctggagccctggttgggccccggaccgccggccgtgccaggcctcccccgcctcctgggcccgggcccggggctgcaagcgtccttcgggcctcatgcctttgctcccaccttcgcagatggcttcgccctggaggaggcgtccctgcggctgctggccaaggaacatgcacaggctctggacagggcctggccgccagcctgagcctgccgccctcccgggccccctcctcggcccaacccgagaaccggggacgtgccctggtgacagccaccacgccttggcctaggccgaggtcatggagcaaccgtggtcaggccaggccaccaccactggggagcgggaccagagagacaggctgctgggttccctgcccccatcccgtctcccaccccatcgccacccgtcctgctggcagcggactggcccccagtgtcaggcaggaggtgacccaagtattctcaggccaggtgcggggacctcctcccctcctggggcctcagtctcctgtctgttaattgggcgtgggggcctccgaggttcgagggctgcgaggctgtgggtggcgggaccgctgactctgtaagatgagtgtaaatctctctgcttctcctaatccccatcagcagagctgcccactctccaggctcccagtcccctggaaataacaaatagcagcagctcccgcgagcctggtctcctctcaccgtgtgctcgccatgtgagcactcccctctccgttgtgccctggacctcgggcacagctgtcagcccattctatagagagggaaaccggggcttaggcaggaagccaggtccccaaagtcgcacggccaggagtggatggagctgcctttcagacccatcaccggtcctaccgtccggggcacagcgacaggttctggagagagggtgggtcccgggccaggtgctggtgggcctccaggtggaggcgggctgatgctgggtgtgtcgtcatcgtcagaccgttcctcacgtccccacagaccccaggccctgtgcatgtccccagtggaggcatggccagcatctgctctgtccaacccagccgcatcgcccaagagctctgagcaaggaggctgtcgcggggccgagaacccgctgggactggcaagcacggctggcccagtgcagcaggagggggccctgaggcatgggatgggacagtctgggccagcgccacctcccgggacagaagtgcggcaccagggcaggagctgcagtagctaccctccccgtctccagcctgggctccccagatcactcccagatcaccaggtcaccccatctctaggcggcacctcacacaccagtcctgtggtccaacgccccgccatcacccaatgtcaccgcacaccaggcagtggggacacggcagtaagcacaagaaagatttttttttttaaagctaaaccaggccaggtgcggtggctcatgcctgtaatcccagtgctttgggaggctgaggtgggaggattgcttgagaccagcctgggtgacacagcaagaccccatctccacaaacgtttttaaaatgtgccgggtgtactggtgcacacctgtcatcccagctacccaagaagctgaggcaagaggatcacttgagcccagaaggtcgaggctgcagggagctgtgatcacactgctgcactccagcctgtgcaacagagccagaccctgactcaatacaaataaaaaacaaatctaaaacaaaa

SEQ ID NO: 1906 - DNA, 2145 bp, Homo sapiens
cgctggggcaggtgtcccgtggaaatcgacggaggggctgccgtgggcggtgggagccatgttcctgagcccgggcgaggggccggcaaccgagggtgggggtctggggccgggcgaggaggcccccaagaagaagcaccggaggaaccgcaccaccttcaccacctaccagctgcaccagctggagcgggcgttcgaggcctctcactacccggatgtgtacagccgtgaggagctggcagccaaggtgcacctacctgaggtgcgcgtgcaggtgtggttccagaaccgccgggccaagtggcgccgccaggagcggctggagtcaggctcgggtgccgtggcagctccgagactccccgaggccccagcgctgccgttcgcccgccccccggccatgtcgctgcccctggagccctggttgggccccggaccgccggccgtgccaggcctcccccgcctcctgggcccgggcccggggctgcaagcgtccttcgggcctcatgcctttgctcccaccttcgcagatggcttcgccctggaggaggcgtccctgcggctgctggccaaggaacatgcacaggctctggacagggcctggccgccagcctgagcctgccgccctcccgggccccctcctcggcccaacccgagaaccggggacgtgccctggtgacagccaccacgccttggcctaggccgaggtcatggagcaaccgtggtcaggccaggccaccaccactggggagcgggaccagagagacaggctgctgggttccctgcccccatcccgtctcccaccccatcgccacccgtcctgctggcagcggactggcccccagtgtcaggcaggaggtgacccaagtattctcaggccaggtgcggggacctcctcccctcctggggcctcagtctcctgtctgttaattgggcgtgggggcctccgaggttcgagggctgcgaggctgtgggtggcgggaccgctgactctgtaagatgagtgtaaatctctctgcttctcctaatccccatcagcagagctgcccactctccaggctcccagtcccctggaaataacaaatagcagcagctcccgcgagcctggtctcctctcaccgtgtgctcgccatgtgagcactcccctctccgttgtgccctggacctcgggcacagctgtcagcccattctatagagagggaaaccggggcttaggcaggaagccaggtccccaaagtcgcacggccaggagtggatggagctgcctttcagacccatcaccggtcctaccgtccggggcacagcgacaggttctggagagagggtgggtcccgggccaggtgctggtgggcctccaggtggaggcgggctgatgctgggtgtgtcgtcatcgtcagaccgttcctcacgtccccacagaccccaggccctgtgcatgtccccagtggaggcatggccagcatctgctctgtccaacccagccgcatcgcccaagagctctgagcaaggaggctgtcgcggggccgagaacccgctgggactggcaagcacggctggcccagtgcagcaggagggggccctgaggcatgggatgggacagtctgggccagcgccacctcccgggacagaagtgcggcaccagggcaggagctgcagtagctaccctccccgtctccagcctgggctccccagatcactcccagatcaccaggtcaccccatctctaggcggcacctcacacaccagtcctgtggtccaacgccccgccatcacccaatgtcaccgcacaccaggcagtggggacacggcagtaagcacaagaaagatttttttttttaaagctaaaccaggccaggtgcggtggctcatgcctgtaatcccagtgctttgggaggctgaggtgggaggattgcttgagaccagcctgggtgacacagcaagaccccatctccacaaacgtttttaaaatgtgccgggtgtactggtgcacacctgtcatcccagctacccaagaagctgaggcaagaggatcacttgagcccagaaggtcgaggctgcagggagctgtgatcacactgctgcactccagcctgtgcaacagagccagaccctgactcaatacaaataaaaaacaaatctaaaacaaaa

SEQ ID NO: 1907 - DNA, 2385 bp, Homo sapiens
gctcccattggctgatgttggcgcgaaggtgcgcgagtcagccctcgcgctgggggcgcaggaaacaatagaggccgcgcgcacagagcgagctcttgcagcctccccgcccctcccgcaacgctcgaccccaggattcccccggctcgcctgcccgccatggccgacaaggaagcagccttcgacgacgcagtggaagaacgagtgatcaacgaggaatacaaaatatggaaaaagaacaccccttttctttatgatttggtgatgacccatgctctggagtggcccagcctaactgcccagtggcttccagatgtaaccagaccagaagggaaagatttcagcattcatcgacttgtcctggggacacacacatcggatgaacaaaaccatcttgttatagccagtgtgcagctccctaatgatgatgctcagtttgatgcgtcacactacgacagtgagaaaggagaatttggaggttttggttcagttagtggaaaaattgaaatagaaatcaagatcaaccatgaaggagaagtaaacagggcccgttatatgccccagaacccttgtatcatcgcaacaaagactccttccagtgatgttcttgtttttgactatacaaaacatccttctaaaccagatccttctggagagtgcaacccagacttgcgtctccgtggacatcagaaggaaggctatgggctttcttggaacccaaatctcagtgggcacttacttagtgcttcagatgaccataccatctgcctgtgggacatcagtgccgttccaaaggagggaaaagtggtagatgcgaagaccatctttacagggcatacggcagtagtagaagatgtttcctggcatctactccatgagtctctgtttgggtcagttgctgatgatcagaaacttatgatttgggatactcgttcaaacaatacttccaaaccaagccactcagttgatgctcacactgctgaagtgaactgcctttctttcaatccttatagtgagttcattcttgccacaggatcagctgacaagactgttgccttgtgggatctgagaaatctgaaacttaagttgcattcctttgagtcacataaggatgaaatattccaggttcagtggtcacctcacaatgagactattttagcttccagtggtactgatcgcagactgaatgtctgggatttaagtaaaattggagaggaacaatccccagaagatgcagaagacgggccaccagagttgttgtttattcatggtggtcatactgccaagatatctgatttctcctggaatcccaatgaaccttgggtgatttgttctgtatcagaagacaatatcatgcaagtgtggcaaatggcagagaacatttataatgatgaagaccctgaaggaagcgtggatccagaaggacaagggtcctagatatgtctttacttgttgtgattttagactccccttttttcttctcaaccctgagagtgatttaacactggttttgagacagactttattcagctatccctctatataataggtaccaccgataatgctattagcccaaaccgtgggtgttttctaaatattaataggggggcttgattcaacaaagccacagacttaacgttgaaattttcttcaggaattttctagtaacccaggtctaaagtagctacagaaaggggaatattatgtgtgattatttttcttcttatgctatatccccaagtttttcagactcatttaagtaaaggctagagtgagtaaggaatagagccaaatgaggtaggtgtctgagccatgaagtataaatactgaaagatgtcacttttattcaggaaatagggggagattcaagtcatatagattcctactcgaaaatcttgacacctgactttccaggatgcacattttcatacgtagaccagtttcctcttggtttcttcagttaagtcaaaacaacacgttcctctttccccatatattcatatatttttgctcgttagtgtatttcttgagctgttttcatgttgtttatttcctgtctgtgaaatggtgtttttttttttgttgttggtttttttttttttttttttaacttgggaccaccaagttgtaaagatgtatgtttttacctgacagttataccacaggtagactgtcaagttgagaagagtgaatcaataacttgtatttgttttaaaaattaaattaatccttgataagagttgctttttttttttaggagttagtccttgaccactagtttgatgccatctccattttgggtgacctgtttcaccagcaggcctgttactctccatgactaactgtgtaagtgcttaaaatggaataaattgcttttctacataa

SEQ ID NO: 1908 - DNA, 1788 bp, Homo sapiens
aggagcgctcccattggctgatgttggcgcgaaggtgcgcgagtcagccctcgcgctgggggcgcaggaaacaatagaggccgcgcgcacagagcgagctcttgcagcctccccgcccctcccgcaacgctcgaccccaggattcccccggctcgcctgcccgccatggccgacaaggaagccttcgacgacgcagtggaagaacgagtgatcaacgaggaatacaaaatatggaaaaagaacaccccttttctttatgatttggtgatgacccatgctctggagtggcccagcctaactgcccagtggcttccagatgtaaccagaccagaagggaaagatttcagcattcatcgacttgtcctggggacacacacatcggatgaacaaaaccatcttgttatagccagtgtgcagctccctaatgatgatgctcagtttgatgcgtcacactacgacagtgagaaaggagaatttggaggttttggttcagttagtggaaaaattgaaatagaaatcaagatcaaccatgaaggagaagtaaacagggcccgttatatgccccagaacccttgtatcatcgcaacaaagactccttccagtgatgttcttgtttttgactatacaaaacatccttctaaaccagatccttctggagagtgcaacccagacttgcgtctccgtggacatcagaaggaaggctatgggctttcttggaacccaaatctcagtgggcacttacttagtgcttcagatgaccataccatctgcctgtgggacatcagtgccgttccaaaggagggaaaagtggtagatgcgaagaccatctttacagggcatacggcagtagtagaagatgtttcctggcatctactccatgagtctctgtttgggtcagttgctgatgatcagaaacttatgatttgggatactcgttcaaacaatacttccaaaccaagccactcagttgatgctcacactgctgaagtgaactgcctttctttcaatccttatagtgagttcattcttgccacaggatcagctgacaagactgttgccttgtgggatctgagaaatctgaaacttaagttgcattcctttgagtcacataaggatgaaatattccaggttcagtggtcacctcacaatgagactattttagcttccagtggtactgatcgcagactgaatgtctgggatttaagtaaaattggagaggaacaatccccagaagatgcagaagacgggccaccagagttgttgtttattcatggtggtcatactgccaagatatctgatttctcctggaatcccaatgaaccttgggtgatttgttctgtatcagaagacaatatcatgcaagtgtggcaaatggcagagaacatttataatgatgaagaccctgaaggaagcgtggatccagaaggacaagggtcctagatatgtctttacttgttgtgattttagactccccttttttcttctcaaccctgagagtgatttaacactggttttgagacagactttattcagctatccctctatataataggtaccaccgataatgctattagcccaaaccgtgggtgttttctaaatattaataggggggcttgattcaacaaagccacagacttaacgttgaaattttcttcaggaattttctagtaacccaggtctaaagtagctacagaaaggggaatattatgtgtgattatttttcttcttatgctatatccccaagtttttcagactcatttaagtaaaggctagagtgagtaaggaata

SEQ ID NO: 1909 - DNA, 580 bp, Homo sapiens
ttccctgggaccgatttcggtcgcagctggcgaagccagcggtggggcccccggccagtgtttgtttctcttcctgcctccgatatcggtttctcggcctctgtcccgagcgtggggacaccgcttcctacccacaaggctcggagctcgggcctcctcgtcgggcttgtgagtttcggcgcgcacgagcgtgctccgaaggcctggctggccccttggcctggaacggcagccttcgacgacgcagtggaagaacgagtgatcaacgaggaatacaaaatatggaaaaagaacaccccttttctttatgatttggtgatgacccatgctctggagtggcccagcctaactgcccagtggcttccagatgtaaccagaccagaagggaaagatttcagcattcatcgacttgtcctggggacacacacatcggatgaacaaaaccatcttgttatagccagtgtgcagctccctaatgatgatgctcagtttgatgcgtcacactacgacagtgagaaaggagaatttggaggttttggttcagttagtggaaaaattgaaatagaaatcaagatcaacc

SEQ ID NO: 1910 - DNA, 1674 bp, Homo sapiens
gggtgcctgggctgagccgcggcctcgacatggcctaacagtgagggcaggcccgagtttgccgagtgcagtccccgcagccttcgacgacgcagtggaagaacgagtgatcaacgaggaatacaaaatatggaaaaagaacaccccttttctttatgatttggtgatgacccatgctctggagtggcccagcctaactgcccagtggcttccagatgtaaccagaccagaagggaaagatttcagcattcatcgacttgtcctggggacacacacatcggatgaacaaaaccatcttgttatagccagtgtgcagctccctaatgatgatgctcagtttgatgcgtcacactacgacagtgagaaaggagaatttggaggttttggttcagttagtggaaaaattgaaatagaaatcaagatcaaccatgaaggagaagtaaacagggcccgttatatgccccagaacccttgtatcatcgcaacaaagactccttccagtgatgttcttgtttttgactatacaaaacatccttctaaaccagatccttctggagagtgcaacccagacttgcgtctccgtggacatcagaaggaaggctatgggctttcttggaacccaaatctcagtgggcacttacttagtgcttcagatgaccataccatctgcctgtgggacatcagtgccgttccaaaggagggaaaagtggtagatgcgaagaccatctttacagggcatacggcagtagtagaagatgtttcctggcatctactccatgagtctctgtttgggtcagttgctgatgatcagaaacttatgatttgggatactcgttcaaacaatacttccaaaccaagccactcagttgatgctcacactgctgaagtgaactgcctttctttcaatccttatagtgagttcattcttgccacaggatcagctgacaagactgttgccttgtgggatctgagaaatctgaaacttaagttgcattcctttgagtcacataaggatgaaatattccaggttcagtggtcacctcacaatgagactattttagcttccagtggtactgatcgcagactgaatgtctgggatttaagtaaaattggagaggaacaatccccagaagatgcagaagacgggccaccagagttgttgtttattcatggtggtcatactgccaagatatctgatttctcctggaatcccaatgaaccttgggtgatttgttctgtatcagaagacaatatcatgcaagtgtggcaaatggcagagaacatttataatgatgaagaccctgaaggaagcgtggatccagaaggacaagggtcctagatatgtctttacttgttgtgattttagactccccttttttcttctcaaccctgagagtgatttaacactggttttgagacagactttattcagctatccctctatataataggtaccaccgataatgctattagcccaaaccgtgggtgttttctaaatattaataggggggcttgattcaacaaagccacagacttaacgttgaaattttcttcaggaattttctagtaacccaggtctaaagtagctacagaaaggggaatattatgtgtgattatttttcttcttatgctatatccccaagtttttcagactcatttaagtaaaggctagag

SEQ ID NO: 1911 - DNA, 783 bp, Homo sapiens
gttgctgatgatcagaaacttatgatttgggatactcgttcaaacaatacttccaaaccaagccactcagttgatgctcacactgctgaagtgaactgcctttctttcaatccttatagtgagttcattcttgccacaggatcagctgacaagactgttgccttgtgggatctgagaaatctgaaacttaagttgcattcctttgagtcacataaggatgaaatattccaggttcagtggtcacctcacaatgagactattttagcttccagtggtactgatcgcagactgaatgtctgggatttaagtaaaattggagaggaacaatccccagaagatgcagaagacgggccaccagagttgttgtttattcatggtggtcatactgccaagatatctgatttctcctggaatcccaatgaaccttgggtgatttgttctgtatcagaagacaatatcatgcaagtgtggcaaatggcagagaacatttataatgatgaagaccctgaaggaagcgtggatccagaaggacaagggtcctagatatgtctttacttgttgtgattttagactccccttttttcttctcaaccctgagagtgatttaacactggttttgagacagactttattcagctatccctctatataataggagttagtccttgaccactagtttgatgccatctccattttgggtgacctgtttcaccagcaggcctgttactctccatgactaactgtgtaagtgcttaaaatggaataaattgcttttctacataa

SEQ ID NO: 1912 - DNA, 632 bp, Homo sapiens
agttccctgggaccgatttcggtcgcagctggcgaagccagcggtggggcccccggccagtgtttgtttctcttcctgcctccgatatcggtttctcggcctctgtcccgagcgtggggacaccgcttcctacccacaaggctcggagctcgggcctcctcgtcgggcttgtgagtttcggcgcgcacgagcgtgctccgaaggcctggctggccccttggcctggaacgggtaacggagtgtttggcggggatggcccgaggagtttcggcgccgcgaaagtggagagtgtggatgcctctgccgtggggatttagacaaatcacctccatttcatgcagccttcgacgacgcagtggaagaacgagtgatcaacgaggaatacaaaatatggaaaaagaacaccccttttctttatgatttggtgatgacccatgctctggagtggcccagcctaactgcccagtggcttccagatgtaaccagaccagaagggaaagatttcagcattcatcgacttgtcctggggacacacacatcggatgaacaaaaccatcttgttatagccagtgtgcagctccctaatgatgatgctcagtttgatgcgtcacactacgacagtgagaaaggag

SEQ ID NO: 1913 - DNA, 1547 bp, Homo sapiens
agaggccgcgcgcacagagcgagctcttgcagcctccccgcccctcccgcaacgctcgaccccaggattcccccggctcgcctgcccgccatggccgacaaggaagcagccttcgacgacgcagtggaagaacgagtgatcaacgaggaatacaaaatatggaaaaagaacaccccttttctttatgatttggtgatgacccatgctctggagtggcccagcctaactgcccagtggcttccagatgtaaccagatccttctggagagtgcaacccagacttgcgtctccgtggacatcagaaggaaggctatgggctttcttggaacccaaatctcagtgggcacttacttagtgcttcagatgaccataccatctgcctgtgggacatcagtgccgttccaaaggagggaaaagtggtagatgcgaagaccatctttacagggcatacggcagtagtagaagatgtttcctggcatctactccatgagtctctgtttgggtcagttgctgatgatcagaaacttatgatttgggatactcgttcaaacaatacttccaaaccaagccactcagttgatgctcacactgctgaagtgaactgcctttctttcaatccttatagtgagttcattcttgccacaggatcagctgacaagactgttgccttgtgggatctgagaaatctgaaacttaagttgcattcctttgagtcacataaggatgaaatattccaggttcagtggtcacctcacaatgagactattttagcttccagtggtactgatcgcagactgaatgtctgggatttaagtaaaattggagaggaacaatccccagaagatgcagaagacgggccaccagagttgttgtttattcatggtggtcatactgccaagatatctgatttctcctggaatcccaatgaaccttgggtgatttgttctgtatcagaagacaatatcatgcaagtgtggcaaatggcagagaacatttataatgatgaagaccctgaaggaagcgtggatccagaaggacaagggtcctagatatgtctttacttgttgtgattttagactccccttttttcttctcaaccctgagagtgatttaacactggttttgagacagactttattcagctatccctctatataataggtaccaccgataatgctattagcccaaaccgtgggtgttttctaaatattaataggggggcttgattcaacaaagccacagacttaacgttgaaattttcttcaggaattttctagtaacccaggtctaaagtagctacagaaaggggaatattatgtgtgattatttttcttcttatgctatatccccaagtttttcagactcatttaagtaaaggctagagtgagtaaggaatagagccaaatgaggtaggtgtctgagccatgaagtataaatactgaaagatgtcacttttattcaggaaatagggggagattcaagtcatatagattcctactcgaaaatcttgacacctgactttccaggatgcacattttcatacgtaga

SEQ ID NO: 1914 - DNA, 755 bp, Homo sapiens
aactagctccaccctctaacccccactccagctgcagacgccacggagtttgtgcaggggcgcagcgctccagccatggcgcgttcgctcgtccacgacaccgtgttctactgcctgagtgtataccaggtaaaaataagccccacacctcagctgggggcagcatcaagcgcagaaggccatgttggccaaggagctccaggcctcatgggtaatatgaaccctgagggcggtgtgaaccacgagaacggcatgaaccgcgatggcggcatgatccccgagggcggcggtggaaaccaggagcctcggcagcagccgcagcccccgccggaggagccggcccaggcggccatggagggtccgcagcccgagaacatgcagccacgaactcggcgcacgaagttcacgctgttgcaggtggaggagctggaaagtgttttccgacacactcaataccctgatgtgcccacaagaagggaacttgccgaaaacttaggtgtgactgaagacaaagtgcgggtttggtttaagaataaaagggccagatgtaggcgacatcagagagaattaatgctcgccaatgaactacgtgctgacccagacgactgtgtctacatcgtcgtggactagccctagaatgccatccttcttcaggagctagtttggagatgggtttttctggtgccactgacacctgggctgcccatgccgctcaggctacccttatctcctctgcacttatgttatcaataaag

SEQ ID NO: 1915 - DNA, 1309 bp, Homo sapiens
aacccacagcaaatagcgggaagcagaaaagcaagagaggaggtctctaagtggatacactgttgctgagtctagacaccagaagaacgttgcaggcggcgactcacagttctagcactgcctaggagagcgtggtggccccagctcagaatctgcagaagtgcacagctccatccacaccactcagggtatggagcctccggaccagtgtagccagtatatgaccagcttgctcagccctgcagtcgacgacgagaaagaactacaggatatgaatgctatggtgctgtcgcttactgaagaggtcaaagaggaggaagaggatgcacagcctgagcctgagcaaggcacagcagcaggagaaaagttaaagtcggcaggagcccaaggcggagaagaaaaagatggcggcggagaagaaaaagatggcggcggcgccggagttcctggccacctatgggaaggagacctcgagggcaccagcggcagcgatggcaacgttgaggacagcgaccagagcgagaaggaacctgggcagcagtattcgcgcccacagggcgccgtcggggggctggagcctggcaacgcgcagcagcccaacgtccacgccttcaccccattgcagctgcaggagctggagcgcattttccaacgcgagcagttccccagtgagttcctgcgaaggaggctggcaagaagcatgaatgtgactgaactcgcagtgcagatttggtttgagaatagaagagccaaatggaggagacatcagagggcattaatggcaagaaacatgctgcccttcatggcagtgggccagcctgtcatggtaaccgcagctgaggccataacggcacccttgttcatcagcgggatgagagatgattacttctgggaccacagccattccagcagcctgtgtttccccatgccaccctttcctcctccgtccttgccccttccactcatgcttcttccacctatgccacccgctggccaggctgaatttggcccattcccttttgttatcgtgccttctttcacattccccaatgtctaagggatagcctctgtgccactttttgccagagtgtctttgagccagattcatattttgcatagcaccccatcaaaagtagttcatcaaatgtctattaaacgttttaaagaaaagtacatcattgacccatttttagggcacttgtaaaaatgtttctataaatatgtgaagggtatgtacatttgttttgtgtgtcacatggggtcagtaagttctcaataaaaattgttaagaaatgccattcaaaccgaa

SEQ ID NO: 1916 - DNA, 1690 bp, Homo sapiens
aacccacagcaaatagcgggaagcagaaaagcaagagaggaggtctctaagtggatacactgttgctgagtctagacaccagaagaacgttgcaggcggcgactcacagttctagcactgcctaggagagcgtggtggccccagctcagaatctgcagaagtgcacagctccatccacaccactcagggtatggagcctccggaccagtgtagccagtatatgaccagcttgctcagccctgcagtcgacgacgagaaagaactacaggatatgaatgctatggtgctgtcgcttactgaagaggtcaaagaggaggaagaggatgcacagcctgagcctgagcaaggcacagcagcaggagaaaagttaaagtcggcaggagcccaaggcggagaagaaaaagatggcggcggagaagaaaaagatggcggcggcgccggagttcctggccacctatgggaaggaaacctcgagggcaccagcggcagcgatggcaacgttgaggacagcgaccagagcgagaaggaacctgggcagcagtattcgcgcccacagggcgccgtcggggggctggagcctggcaacgcgcagcagcccaacgtccacgccttcaccccattgcagctgcaggagctggagtgcattttccaacgcgagcagttccccagtgagttcctgcgaaggaggctggcaagaagcatgaatgtgactgaactcgcagtgcagatttggtttgagaatagaagagccaaatggaggagacatcagagggcattaatggcaagaaacatgctgcccttcatggcagtgggccagcctgtcatggtaaccgcagctgaggccataacggcacccttgttcatcagcgggatgagagatgattacttctgggaccacagccattccagcagcctgtgtttccccatgccaccctttcctcctccgtccttgccccttccactcatgcttcttccacctatgccacccgctggccaggctgaatttggcccattcccttttgttatcgtgccttctttcacattccccaatgtctaagggatagcctctgtgccactttttgccagagtgtctttgagccagattcatattttgcatagcaccccatcaaaagtagttcatcaaatgtctattaaacgttttaaagaaaagtacatcattgacccatttttagggcacttgtaaaaatgtttctataaatatgtgaagggtatgtacatttgttttgtgtgtcacatggggtcagtaagttctcaataaaaattgttaagaaatgccattcaaaccgaatgtcacggactctcgtctcatgcagtaatcttgagtcaccatctgggggctgtgcatgtcacagaattttcccatgtgcccatggcaggcttacaccgacccagacattctcttccacccccacccccaacaccccatactcatctcctctctgcccccattgataccaggtacatgtgcaggatggggtggtgtgagtccctaatgagagaatagtgtgtttcaagttactgccagggtggaaaacagcaaaaccaaaatggtatcgggaaggaagccatgcccactcttaaaaattcattaagttttttcttgctatggaagacttctttaaagtaattttcttgtaaaagtgtaagtgtaaataatgccatgaaatta

SEQ ID NO: 1917 - DNA, 3121 bp, Homo sapiens
cgggacgaggagaagccaaacgtaaagacaccaggagtttctcgggcccagctgtggctgctgccggggagccccaagccttggcgggtccttgcggcgaataggagtctggtcaggcgtcaggctagtccgacgaagagtgggtgtgatcagcactggaaaagatgcctgcccctgctgccacatatgaaagagtagtttacaaaaacccttccgagtaccactacatgaaagtctgcctagaatttcaagattgtggagttggactgaatgctgcacagttcaaacagctgcttatttcggctgtgaaggacctgtttggggaggttgatgccgccttacctttggacatcctaacctatgaagagaagaccttgtcagccatcttgagaatatgtagcagtggtcttgtcaaattgtggagctctttgaccctgttaggatcctataaaggcaaaaaatgtgctttccgggtgattcaggtttctccatttcttcttgcattatctggtaatagtagggaactagtattggattgaatgaatagtcttccattttggaaacgttcatccactctcatatttattttttggtgcctgcatgtttgaagactgaagcaggctaaaagctcttgatgaaatttgagggtgctgaagatgttcccactaatttccagccatcacctttggtggggtgggcttcggaggacagtctgtctgaacctgccagtgctgaccctgcagcactttcagcatatgcacatcaaagttggagaccgcgctgaacttaggagggccttcacacagactgatgtggctaccttctcagaattaacaggggatgtcaatcctttgcatttgaatgaagactttgcaaaacacaccaagtttggaaatacaattgtacatggagttttgatcaacggacttatctcagctctcctaggaactaaaatgccagggccaggctgtgtatttctttcccaggaaattagctttccagcccctttatatattggagaagttgttttagcttctgcagaagtgaaaaagctgaagcggttcattgctattattgcagtgtcatgttctgtaatagaaagtaaaaagactgttatggaaggctgggttaaagttatggttccagaagcttccaaatcctgaaatagatgttttaaagatgcaacctcaaacaccaatgctgttgttaaagagcctatggggaattgctgctctttaccaaagaatggttgataggcccagaagcccatcttagttaggggaagggagcaggaagagggttgttcaaatgcccactttccagtttggccttatgcttcatgcagacttgagtgtatgcaggatttcattatctgcctgggttttttgtttgttttttgttttttaattcaagaagtaggctgggcccggtggctcatgcctgtaatcctggcactttgggaggctgcggcaggcggatcacttgaggtcaggagtccaagaccagcctggccaacatggtgaaaccccatctctaccaaaaaaaaaaaaaaaaaaaaagtgcaactagctgtgcttggtgacttggccctgtagtcccagttgcttgggaggctgaggtgggagaattgcttgggcctgagagctggaggttatggtgagaaactgagattgcaccactgcactgtagcctgagtgacagagcgagaccctgtctcaagaaagaagtattgggaaggttatttaaagactctacttttaaatcaggcgtggcagctcacgcctgtaatcccagcattttgggaggctgaggcaggcgaatcacttgaggtcaggagttcaagaccagcctggccaacatgtgaaaccccatctctactaaaaatacaaaaactaaccgggcatggtggcgggcacctgtaatcccagctacttgggaggctgaggcaggagaatctcttgaacctgggaggttgcagtgagctgaaatcacaccactgcacttcagcctgggtgacagagcaaaactccacctcaaaaaaaaaaaaaagattctacttttagaaattcagacctagatagatttgcatttggataacaaatccctacctatagccatgtggaagcagcttgtcactgtattttaactgtgtaacaattattgaaggcgaaaatagaagttgggtcatctttgaacacctaccttttatcaatgaatatttttagactgttcttcagtatctgagtcagagtttattgtaatttgttatttacaccaaggtggcatcttagtctaccttcagtgagacttgcgtttcaggggaggggcgtatgtgcatcctcggtctcagttatgtaaacggtctgatctgtaaaatagtggtagcacatgccatgtgggatagttggtggagatgatagatggagttaagcacagggcccagcctgtcagcagtagctactattattgttgcccatttcccctgcaactgaggtgagaggttttcctgagtttgaagctgactggcccacagttaaacgtaacagaccagtttttcagggtgtcagccaacctctattagtgttcttaagtacagtttctgttataaaagttcagattattccttgaaaatttggatctacctcccattattatgagtaatacatgcttatagtaaaaaaaaaaaaattgtaagaaataaatattaagaagattatggaggccaaattcttaagactttgggggctggggtcagggaggttatattgaaggggagatgtgcctaacatgttactactaaatggccatcccaacacagccaacacttttgtttcccatttttttttgtttcccgttttttaataaaattgagatataattcacataccataaaattcaccttttaaaagtgtacagtttagtggttttcagaatatccacaaagttgtacaaccatcaccaaatcaattttttatagcatttttcatcacccccaaaagaacctcccattagcagtcaatccatttctctcctccagtctttgggaatcaccagtctactttctgtctctatgggtttccctgttctggacatttcataaaagttcatacaatgtatgatc

SEQ ID NO: 1918 - DNA, 3379 bp, Homo sapiens
acgcttcgtggggcgggacgaggagaagccaaacgtaaagacaccaggagtttctcgggcccagctgtggctgctgccggggagccccaagccttggcgggtccttgcggcgaataggagtctggtcaggcgtcaggctagtccgacgaagagtgggtaggtggaagccttccaaagagcggcggttgtctgggagccgtctcagttggccgcgacccgggcgcatgcgcggggcgggcggtgcgccttgggtagcttgtcctctccgaccccgggcgctgagggcctctgtacggcgccgcgtagggtctcggccgcagaacgtggccgagaggcccgggcgagacttcgggaccgtgtcctgagcgctctccatgcgcccggcgcgaggtgtgatcagcactggaaaagatgcctgcccctgctgccacatatgaaagagtagtttacaaaaacccttccgagtaccactacatgaaagtctgcctagaatttcaagattgtggagttggactgaatgctgcacagttcaaacagctgcttatttcggctgtgaaggacctgtttggggaggttgatgccgccttacctttggacatcctaacctatgaagagaagaccttgtcagccatcttgagaatatgtagcagtggtcttgtcaaattgtggagctctttgaccctgttaggatcctataaaggcaaaaaatgtgctttccgggtgattcaggtttctccatttcttcttgcattatctggtaatagtagggaactagtattggattgaatgaatagtcttccattttggaaacgttcatccactctcatatttattttttggtgcctgcatgtttgaagactgaagcaggctaaaagctcttgatgaaatttgagggtgctgaagatgttcccactaatttccagccatcacctttggtggggtgggcttcggaggacagtctgtctgaacctgccagtgctgaccctgcagcactttcagcatatgcacatcaaagttggagaccgcgctgaacttaggagggccttcacacagactgatgtggctaccttctcagaattaacaggggatgtcaatcctttgcatttgaatgaagactttgcaaaacacaccaagtttggaaatacaattgtacatggagttttgatcaacggacttatctcagctctcctaggaactaaaatgccagggccaggctgtgtatttctttcccaggaaattagctttccagcccctttatatattggagaagttgttttagcttctgcagaagtgaaaaagctgaagcggttcattgctattattgcagtgtcatgttctgtaatagaaagtaaaaagactgttatggaaggctgggttaaagttatggttccagaagcttccaaatcctgaaatagatgttttaaagatgcaacctcaaacaccaatgctgttgttaaagagcctatggggaattgctgctctttaccaaagaatggttgataggcccagaagcccatcttagttaggggaagggagcaggaagagggttgttcaaatgcccactttccagtttggccttatgcttcatgcagacttgagtgtatgcaggatttcattatctgcctgggttttttgtttgttttttgttttttaattcaagaagtaggctgggcccggtggctcatgcctgtaatcctggcactttgggaggctgcggcaggcggatcacttgaggtcaggagtccaagaccagcctggccaacatggtgaaaccccatctctaccaaaaaaaaaaaaaaaaaaaaagtgcaactagctgtgcttggtgacttggccctgtagtcccagttgcttgggaggctgaggtgggagaattgcttgggcctgagagctggaggttatggtgagaaactgagattgcaccactgcactgtagcctgagtgacagagcgagaccctgtctcaagaaagaagtattgggaaggttatttaaagactctacttttaaatcaggcgtggcagctcacgcctgtaatcccagcattttgggaggctgaggcaggcgaatcacttgaggtcaggagttcaagaccagcctggccaacatgtgaaaccccatctctactaaaaatacaaaaactaaccgggcatggtggcgggcacctgtaatcccagctacttgggaggctgaggcaggagaatctcttgaacctgggaggttgcagtgagctgaaatcacaccactgcacttcagcctgggtgacagagcaaaactccacctcaaaaaaaaaaaaaagattctacttttagaaattcagacctagatagatttgcatttggataacaaatccctacctatagccatgtggaagcagcttgtcactgtattttaactgtgtaacaattattgaaggcgaaaatagaagttgggtcatctttgaacacctaccttttatcaatgaatatttttagactgttcttcagtatctgagtcagagtttattgtaatttgttatttacaccaaggtggcatcttagtctaccttcagtgagacttgcgtttcaggggaggggcgtatgtgcatcctcggtctcagttatgtaaacggtctgatctgtaaaatagtggtagcacatgccatgtgggatagttggtggagatgatagatggagttaagcacagggcccagcctgtcagcagtagctactattattgttgcccatttcccctgcaactgaggtgagaggttttcctgagtttgaagctgactggcccacagttaaacgtaacagaccagtttttcagggtgtcagccaacctctattagtgttcttaagtacagtttctgttataaaagttcagattattccttgaaaatttggatctacctcccattattatgagtaatacatgcttatagtaaaaaaaaaaaaattgtaagaaataaatattaagaagattatggaggccaaattcttaagactttgggggctggggtcagggaggttatattgaaggggagatgtgcctaacatgttactactaaatggccatcccaacacagccaacacttttgtttcccatttttttttgtttcccgttttttaataaaattgagatataattcacataccataaaattcaccttttaaaagtgtacagtttagtggttttcagaatatccacaaagttgtacaaccatcaccaaatcaattttttatagcatttttcatcacccccaaaagaacctcccattagcagtcaatccatttctctcctccagtctttgggaatcaccagtctactttctgtctctatgggtttccctgttctggacatttcataaaagttcatacaatgtatgatcctttggaactg

SEQ ID NO: 1919 - DNA, 805 bp, Homo sapiens
agtttctcgggcccagctgtggctgctgccggggagccccaagccttggcgggtccttgcggcgaataggagtctggtcaggcgtcaggctagtccgacgaagagtggccctcttgacttactgtaggtgtgatcagcactggaaaagatgcctgcccctgctgccacatatgaaagagtagtttacaaaaacccttccgagtaccactacatgaaagtctgcctagaatttcaagattgtggagttggactgaatgctgcacagttcaaacagctgcttatttcggctgtgaaggacctgtttggggaggttgatgccgccttacctttggacatcctaacctatgaagagaagaccttgtcagccatcttgagaatatgtagcagtggtcttgtcaaattgtggagctctttgaccctgttaggatcctataaaggcaaaaaatgtgctttccgggtgattcaggtttctccatttcttcttgcattatctggtaatagtagggaactagtattggattgaatgaatagtcttccattttggaaacgttcatccactctcatatttattttttggtgcctgcatgtttgaagactgaagcaggctaaaagctcttgatgaaatttgagggtgctgaagatgttcccactaatttccagccatcacctttggtggggtgggcttcggaggacagtctgtctgaacctgccagtgctgaccctgcagcactttcagcatatgcacatcaaagttggagaccgcgctgaacttaggagggccttcacacagactgatgtggctacc

SEQ ID NO: 1920 - DNA, 3049 bp, Homo sapiens
cttttcagaagaggtcacgcccgcttccccacgcgcctcggggaacagcctggcccaaagcctcactcctcacgtcccaggggtggacgggggtccgggagcctcgagctccgggcaggcgtggcgaggctgaagtctgggtcttccgcgccccgcgaggaccacgccgcgacgtaatcgcccgcggggaggcgcggagtggagccgcagccagctcctcccgcactctgctgaccgcgcactagctgtccttgaggcaagaatacttgggagcggaaaaaaggtgggggtgttccccggggcgggggaggaggggcaaggccccagcaagcctcttggaaatctctccctgggaggggacgaggggcggccttcagttgcaaatgggaagggctcggataccggatttgaagcagtgtttgcacggcaagcgcagcttttatttagactgccggtttgtgagggttggctctcagagcgctgatggcgattatagtggaacttcaccttcacctgctcatgcgccccgcagcgcgcccgctcccacgcccgcgtagctgaggacccagactcgccaggaaaggctagtgaggctggggcccgggcgggcccggccgggccgggtcaggggaggggcctggcggcaggggcggggcctcagctaaaggcgcggagcacccggcgccgagagcgctgagtagagcggcgcccgctcgagagaagtggggccgagatcgcgccgtcccagcccgcccgccggcgtctgcgctgctccggcgcccttacccctgctggcccttgcaaggcgcgaccggcggccatgcagccccggggctgaggccgccccatggcaaagccggcggtcccggcgacgacggcgcatggagaacttccgtaaggtgcgctccgaagaggcgccagcggggtgcggggccgagggaggcggcccgggctccggccccttcgcagacctggcgccgggcgcggtgcacatgcgggtcaaggaaggcagcaagatccggaacctgatggccttcgccaccgccagcatggcgcagccagccacgcgcgccatcgtcttcagcggctgcggccgggccaccaccaaaaccgtcacgtgcgccgagatcctcaagcgccgcctggcgggcctgcaccaggtcacgcggctgcgctaccggagcgtacgcgaggtgtggcagagcctcccgcctgggcccacgcagggtcagacgcctggcgagccggccgctagtctcagcgtacttaagaacgtgcccggcctcgccatcctactttccaaggacgcgctggatccgcgacagcccggctaccagcccccgaatccccatcctggtccctcgtccccgccagccgcgccagcgtccaagaggagcctaggggaacccgcagctggagaaggctccgcgaagcgatcgcaacccgagccaggggttgcggacgaggatcagacggcctgaaactccggactgtgggccacctagtccggcaggatcttccgccagcgcctccaccttcagatgtacctccagcctttcactcctcggtcctccggagcccacaacctggacacagctcctcaagacaggtagcatggaccttaaggcgacaagagaggggccccaggagtggcaggagaggatccccgaccaccctagggaaacttcgtgcgataattgctgcttatgcccgtgttgcgtgaagacacggaacttcaccttttctgggaccttctttgggggagaatggtggacagtgggattctggaaacttgtttgggacccccaagggttaaagccacccagcattcacgaagagcacctgaagtatggaagctgagaagagttattggaatcacccccaccgttgacagaggaaggcagggggtgagaattaactgcttgagggtaggagagtctgagatgtgggggccctattccgctccccgccctgggacagttttcctttctagttttctttcccctgcttcagaggagcatctctgagggttctagctcttttaacaccccttttccccctgctggcccagagggagacccaggactgaactctccaggcctcctcccctgagccctgcagctggctggagtcttgcttccaataaaacaagcacaaaaatggctgtgtcccccattttttttctaaccacccgcctgtgcagagacagctctcgcctggccccttgtgtctcccctcccctccagccttgcgtcctgagtctttggagtcttcagggtcaggcacagagactgaacagcttcaaaatggtgcaaggcactgcccagtccctggcttcttcctctctcctcccccactccgccctcccgggctggccctggcctcagaggctgttgcaaatgggggcccgtgtacccctgtacatcgccactaagggaaagggagcggcacattgtttttctgggaggggaaggaaggagtggaaggacagcatcgatgaactctcctggaggtcactgcaaagggtggcagaccctgctgaggtccctgaatctgcagcctccagacaataaactgaaccttacccagaaggctggcacaaagcccccagctctgtgggtaggatctccccttcactgccctctctctgagaaaggacagcacacccttgggaaagggggaggagagagactgagcacaaatccactgctggaaattactattcagcagagaagctgggtcttgggctgtgaatcactgcaggcctcctgataagctgctgcctccagccctgcacagctgtctgttgagagataacagcctcataagcttctctgcccaactccaagccagctggggggtgggggtgctgctgtgtgctggaagagctctggtgagttgggggtggcatacagccccaggatctcagaagcagatctcatcccatgcaactcagcagcacccctggaaagggggagatgcggaagaatgtatttataagtcattttgctggcagaaccctgaaataaatcctgctggtgacaagaga

SEQ ID NO: 1921 - DNA, 1184 bp, Homo sapiens
caaagccggcggtcccggcgacgacggcgcatggagaacttccgtaaggtgcgctccgaagaggcgccagcggggtgcggggccgagggaggcggcccgggctccggccccttcgcagacctggcgccgggcgcggtgcacatgcgggtcaaggaaggcagcaagatccggaacctgatggccttcgccaccgccagcatggcgcagccagccacgcgcgccatcgtcttcagcggctgcggccgggccaccaccaaaaccgtcacgtgcgccgagatcctcaagcgccgcctggcgggcctgcaccaggtcacgcggctgcgctaccggagcgtacgcgaggtgtggcagagcctcccgcctgggcccacgcagggtcagacgcctggcgagccggccgctagtctcagcgtacttaagaacgtgcccggcctcgccatcctactttccaaggacgcgctggatccgcgacagcccggctaccagcccccgaatccccatcctggtccctcgtccccgccagccgcgccagcgtccaagaggagcctaggggaacccgcagctggagaaggctccgcgaagcgatcgcaacccgagccaggggttgcggacgaggatcagacggcctgaaactccggactgtgggccacctagtccggcaggatcttccgccagcgcctccaccttcagatgtacctccagcctttcactcctcggtcctccggagcccacaacctggacacagctcctcaagacaggtagcatggaccttaaggcgacaagagaggggccccaggagtggcaggagaggatccccgaccaccctagggaaacttcgtgcgataattgctgcttatgcccgtgttgcgtgaagacacggaacttcaccttttctgggaccttctttgggggagaatggtggacagtgggattctggaaacttgtttgggacccccaagggttaaagccacccagcattcacgaagagcacctgaagtatggaagttttcctttctagttttctttcccctgcttcagaggagcatctctgagggttctagctcttttaacaccccttttccccctgctggcccagagggagacccaggactgaactctccaggcctcctcccctgagccctgcagctggctggagtcttgcttccaataaaacaagcacaaaa

SEQ ID NO: 1922 - DNA, 1764 bp, Homo sapiens
cagtgtgctgggtaccaggcgactccgggacagggggtctcggccgtcggcgtcatggtttcgcgcgtgcagctcccgcctgagatccagctggctcagcgcctggcggggaatgagcaggtgacccgggaccgggcggtgaggaagctccggaaatacatcgtcgccaggactcagcgggccgcaggtggttttacgcacgacgagctgctgaaggtgtggaaaggactgttttattgcatgtggatgcaggacaagccactcctccaggaagaattaggaaggactatttcccagctcgttcatgcttttcagaccacggaggcgcagcacctgttccttcaggccttctggcagaccatgaatcgcgagtggacgggcattgacaggctgcgcctggataaattctacatgctcatgcggatggtcctgaacgagtccttgaaggttctgaagatgcaaggctgggaagaaagacagatcgaggagctgctagagctgctgatgactgagatcctgcaccccagcagccaggcccccaacggtgtgaagagccacttcatcgagatcttcctggaggagctgaccaaagtgggcgccgaggagcttacggcagaccagaacctgaagttcatcgaccccttctgcagaattgctgcccggaccaaggattccttggttttgaacaacatcactcgaggcatctttgagacgattgtggagcaggccccgcttgccattgaagacctcctgaatgaactggacacacaggatgaggaggtggcgtcggacagtgatgagtcctctgagggtggtgagcgtggagacgcgctgtcccagaagaggtctgagaagccgcccgcaggctccatctgcagggctgaacctgaggctggtgaggagcaggcaggtgacgacagggacagtggcggccccgttctccagtttgactacgaggcagttgctaacagactgtttgaaatggccagccgccagagcaccccttctcagaacagaaagcgtctctacaaagtgatccggaaacttctgccctggttctcaggcattttccctgaagatgagatcccagagaaggcctgcaggcgcctgcttgaagggaggcggcagaagaagacgaagaagcagaagcgtctgctcaggttgcagcaggagagagggaaaggtgagaaggagcccccgagcccgggcatggagaggaagaggagcaggaggaggggtgtaggggccgaccccgaggcgcgggcagaggctggtgagcagccaggcacagctgagcgggccctgctccgagatcagcccaggggccgtggccagagaggggctcgccagagaaggaggacacctcggcccctgaccagtgcccgagcaaaggcggccaatgtccaggagccggagaagaagaagaaacgcagggagtgatgtggccgggccaaggacaggcagggagggaggccaggcctcgcttgcaccgcgggacgaggctgaccgggctgttctgtagactcaggaccgtggctccagaactcctgtgccaggcgggagggaagggcggcactggagagatgggcccatcattaggggccagcatcccaggaactggacctttccccagagcctccgcctgtggctgtgatgaccttgggccagaaggtcaaactccgaagactgaaactctgcctgcagcaggactggccgcccctgctgtggggggttcagaaaataaaatgccgcgcagcccttgcc

SEQ ID NO: 1923 - DNA, 3022 bp, Homo sapiens
gcgggctgtgacgtcacgccacgcgccggggccaggaggaggcgggcgcaggaggcgcgtgctcagtgtgctgggtaccaggcgactccgggacagggggtctcggccgtcggcgtcatggtttcgcgcgtgcagctcccgcctgagatccagctggctcagcgcctggcggggaatgagcaggtgacccgggaccgggcggtgaggaagctccggaaatacatcgtcgccaggactcagcgggccgcaggtggttttacgcacgacgagctgctgaaggtgtggaaaggactgttttattgcatgtggatgcaggacaagccactcctccaggaagaattaggaaggactatttcccagctcgttcatgcttttcagaccacggaggcgcagcacctgttccttcaggccttctggcagaccatgaatcgcgagtggacgggcattgacaggctgcgcctggataaattctacatgctcatgcggatggtcctgaacgagtccttgaaggttctgaagatgcaaggctgggaagaaagacagatcgaggagctgctagagctgctgatgactgagatcctgcaccccagcagccaggcccccaacggtgtgaagagccacttcatcgagatcttcctggaggagctgaccaaagtgggcgccgaggagcttacggcagaccagaacctgaagttcatcgaccccttctgcagaattgctgcccggaccaaggattccttggttttgaacaacatcactcgaggcatctttgagacgattgtggagcaggccccgcttgccattgaagacctcctgaatgaactggacacacaggatgaggaggtggcgtcggacagtgatgagtcctctgagggtggtgagcgtggagacgcgctgtcccagaagaggtctgagaagccgcccgcaggctccatctgcagggctgaacctgaggctggtgaggagcaggcaggtgacgacagggacagtggcggccccgttctccagtttgactacgaggcagttgctaacagactgtttgaaatggccagccgccagagcaccccttctcagaacagaaagcgtctctacaaagtgatccggaagctgcaggacctggcaggaggcattttccctgaagatgagatcccagagaaggcctgcaggcgcctgcttgaagggaggcggcagaagaagacgaagaagcagaagcgtctgctcaggttgcagcaggagagagggaaaggtgagaaggagcccccgagcccgggcatggagaggaagaggagcaggaggaggggtgtaggggccgaccccgaggcgcgggcagaggctggtgagcagccaggcacagctgagcgggccctgctccgagatcagcccaggggccgtggccagagaggggctcgccagagaaggaggacacctcggcccctgaccagtgcccgagcaaaggcggccaatgtccaggagccggagaagaagaagaaacgcagggagtgatgtggccgggccaaggacaggcagggagggaggccaggcctcgcttgcaccgcgggacgaggctgaccgggctgttctgtagactcaggaccgtggctccagaactcctgtgccaggcgggagggaagggcggcactggagagatgggcccatcattaggggccagcatcccaggaactggacctttccccagagcctccgcctgtggctgtgatgaccttgggccagaaggtcaaactccgaagactgaaactctgcctgcagcaggactggccgcccctgctgtggggggttcagaaaataaaatgccgcgcagcccttgccaggggaagtgtcgcttcaggtgtgtcctacggacgtgtgggaggtggcaggcgccagcctccgagcagtgtggtggtttatattcatgtttgtggaaaaatcttgcaagacatttctcctttcacagaactgcccaggtgttaacagggctgtctggacggggctcttttgcttccccctcaatctggggtctagagttgtgcaaggaattcagctccagtaaggcctggattgcccggggtgagcgtgtgtgtggtgggaagacctggcttccgcgagagccttgttcctggaggcaggagcgccccgccatcctgggtacccgcgggtccgcaggctgcgcacctctttccctcagccaggtcaccctcagcgtcctccctgcccctctccccttcacacctgctggagcctgtgagggaggtggcgggtccccactgtggcgacggagagctgacagtagcccagggctttccacctgcatggaacaagggcctgtctgccgccagcgctgtggccacagcctgcataggtgacaaggggccgctgcgttgggttttgcccgcatcttctgttccatgggtgcccagccagccaggccgtgtgggatccagcgagaggccagggcttggagtgggcctgggaccaggaaggacctctaggctgtggctggccttgtgcagaccctggactgcatccggttccccaaagccctgctgcattcgagtgtcccccaaccccgggcaggtggcacctggtgacacctccttcagtcccactcagctgggcggccggggcaggcttagggcacagttaggggccaaggagagggaaggccagggcccctgttctaggggttagggttctttccccaaaggaacttaaaaagacaagcgtggccaggcacagtggctcacacctgtaatcccagcactttgggaggccgaggtggccagatcacctgaggtcaggagtttgagaccagactgaccaacatggagaaaccccatctctactaaaatacaaaattagccaggcgtggtggcacatgcctgtaatcccagctactcgggaggctgaggcaggagaattgcttgaacctgggaggcagaggttgtggtgagctaagatcacgccattgcactccagcctgggcaacgagagggaaactctgtttcaaaaaaaaaaaaaaaaa

SEQ ID NO: 1924 - DNA, 6560 bp, Homo sapiens
ggctgtcacgctttggtttccgggtcggttctggcaggtctgagcgctccgacttccagaggagcgctgtgcacgtggagaagagcggggactcggcgaccctgccctcccgaccctcatgttcgaagagcctgagtgggccgaggcggccccagtagccgcgggccttgggcccgtaatctcacgacctccgcctgcggcctcctcgcaaaacaagggctccaagcgccgccagctcttggccacattacgggccctagaggcagcatctctttcccagcatccccccagcctatgtataagtgactctgaggaggaggaggaggaaaggaagaagaaatgccccaaaaaggcatcatttgccagtgcctctgctgaagtagggaagaaagggaagaagaaatgtcaaaaacagggcccaccttgcagtgactctgaggaagaagtagaaaggaagaagaaatgccacaaacaggctcttgttggcagtgactctgctgaagatgagaaaagaaagaggaaatgccagaaacatgcccctataaattcagcccagcacctggacaatgttgaccaaacaggtcccaaagcctggaagggtagtactacaaatgatccaccaaagcaaagccctgggtccacttcccctaaaccccctcatacattaagccgcaagcagtggcggaaccggcaaaagaacaagagaagatgtaagaacaagtttcagccacctcaggtgccagaccaggccccagctgaggcccccacagagaagacagaggtgtctcctgttcccaggacagacagccatgaggctcgggcaggggctttgcgagcccgcatggcacagcggctggatggggcccgatttcgctacctcaatgaacagttgtactcagggcccagcagtgctgcacagcgtctcttccaggaagaccctgaggcttttcttctctaccaccgcggcttccagagccaagtgaagaagtggccactgcagccagtggaccgcatcgccagggatcttcgccagcggcctgcatccctagtggtggctgacttcggctgtggggattgccgcttggcttcaagtatccggaaccctgtgcattgctttgacttggcttctctggaccctagggtcactgtgtgtgacatggcccaggttcctctggaggatgagtctgtggatgtggctgtgttttgcctttcactgatgggaaccaacatcagggacttcctagaggaggcaaatagagtactgaagccagggggtctcctgaaagtggctgaggtcagcagccgctttgaggatgttcgaacctttctgcgggctgtgaccaagctaggcttcaagattgtctccaaggacctgaccaacagccatttcttcttgtttgatttccaaaagactgggccccctctggtagggcccaaggctcagctttcaggcctgcagcttcagccatgtctctacaagcgcaggtgacctctggatcttccttgaaaggggaggcagatctcaaactccaggctcagaactgtgaagactgtttccagcctggctgtgagccaagacctggttcctggtggaccctgaggacaaagtgtgataaaacctctggctcagacttgctctactgaaggcttcttggttataagatgcataaagtcactggggctagctaaacaataaagagtttattgtgagaacatggggatatctgtctcatgacacttcaggtgttatgaaaactagatggtttggaattcaaggcatctttaggttttgctcttctttccaactaagaagccacatggccttcctgtcctgccatctccactctgctgtcatctgatctgtctacagatcagcttcctctgctcacccatagcttctgctccttcagcttcagtttgcccaggccttcaaggttgcagacaggcagctgttgctgtttgactctgaggcaactggttgtccaccaacatcttggctcaagacatcagtctgagccaccaacttgagactgtttggttgtccccataccgagcatttctagtggtttatctttcccctctcccctcatctccatttttggaaccatatagcatcaagccactcccaacacctattgtcctgtgggactttgggatgtatatagctgagagcacagattttggaatcaggtagacctggatttaattcttggcctgctacccagaggcacttaaagtcatttaatctctgtatatcacattcctcatttggaaaatggtagaatttttgtcttgcagggtggttgtgtgggttaactggagaaatctgtagccagggctgggaacataggaggtgctcagtaaactagctatgactattatgtgttgtaagccttattgttttttgaagatcttccctaggctggttggaggctgaggggtaaagaatggatttgttgactaaggaagcctctgggagaggctagacctttcaacaggcctgcttcataggctatttaatgacttttaatagattctgagcttctgtccttggaggggtagtgagggagctgggtctctgttcataaacaacttgttgatgccatgtgggcttgggggcattgggctgttcattggcggaagagtctgtccactatctctgccttgcagtggactcagatcagcatgtcctgggaaagctataggcaaggtgctgagggaaggtgagtttgaatgatagattctaggcctcccccaaaaggtatctgccatgtgcccaggtataaagatatggcctcttgtacttgtttccaggaatacctgacagtacccattgggagatcataggttctatgccctgagccagttggatgcctctaataaggggatggaggttttgaaacaggctgtagtccagagggcatgtttggaggctgggctgtgaatcattaggcaggcactacacagtgcctctacacgtactgttctttctgctggatattcatcggactggcagtttgctcatctttccgaacagcctagttgtttcctattctactcccaaagcaaaatcagttcttcatctgtactctcaaagtactatgtgaagagtgctacttcagcttctaaatattgcattgtgattcctttgtgcatttggctgctgttttctcaagccatgtttatctttgtattcccggagcttgtcatttgagatatagccagtgtacttattcacctagggagagataaggaatgacagggtccagttgagtgggatagatgagaacaggggtgttatagaaacccaggtactagggcacaagatgagggcactgttgactagtcatgatggaagaagtaggcagacaggagaacttcattaggtagaattggtgggatgttgaggttggtaagagaggaatctgaagtaagttccaggttgctcaactgtgggtaggctggtgatgccattcaaagtgttggattttaggaagtgggacatgcgtgaaatctgtgctgggggtctgggaatcagcagcctagaggtggtaattaaagtcagaatagatgagatattcagggtaagataatgagaagagaaaatggctcagaatagaactgaggagcatgtcatggatgggtaaaggaaaatgaagcagtgaaggtgatggaagaggagaaggttcacccagagatgtaggagtaaaaccaggagagttaatttttttttttttttttttttaagacagagtcttgctctgtggcccaggctggaatgcggtggcgtgatctcaggtcactgaaacctctgcctgctggttcaagcacttctcctgcctcagactcccgagtagctgggaatacaggcacatgccaccacgcccagctaatttttgtatttttagtagtgacggggtttcaccatgttggccaggctggtctcgaactcctgacctcgagtgatcggcctgcctcggcctcccaaagtgctgggattacaggcatgagccactgtgcccagccagtgttttttttttttttttttttatgggaggatgggcaggttgttagctgtcgagtgctattgagatgagagagaactcagaatgcagtggggtaaggattgctgagtaatgtggagggcctgtttgaggtaaatggcagtggtaagaggttgctccattatgaaagccctcttccagagttcctgatagggccccagaagttcatttctgattgctttgattttttttcaggggagcaggaagccagtttatcatttgagagtgagaataggggagaggaaatatcttccaggcccacagtgcatagaaatacccagtcagggcaaaatgatttatctgtttacctctcctcatcacttgggcccagagcaatcagcagtgattaggtagagaggagccgagcagagggaagagcataccaatcactcctccctttcccagtgcaggctcctagacttagctggggcagagctgggagaggaaaaagggatttaaaactgcaacaggtgcagattattgttacacaggattagacattctaattaattgagattatgtttgttccttaaactgatcacaggactatctattaagaacatcacaacctcgctgcagcttttctccatagcagggagagtacctcccagtgaataaaatttggagggtggtaagagacaagaataaaattgggtttggttatccgtgcctcatgcttgttcagcatccctttgagagttctccaaataaatagttactgcttctgcagttattggtgtgctccagcttctgttcccataatatagtccagtcctaagggaacacagttctaaaagaaacaacatgatcttggcagagacaccgctcagctccaaacccaaccatttatgtaactgcacaaaactctctacagcttttcacagagaccagtaattagaacctttcatcccctggtcatcctccttcccaggtgaattctctgaccagccatctggttttaggatacccaactcctgcagtaactgccttactggtggtctaattgcttctactcgtgtccctaaagcaattaattttccacacagccatgtgatctttttaaaatgtaaatcagcttatgtcacttctctgcttaaaatccttcaatggattctcactgcctcgagaacaaaagacaaacttttcaggccccgtgtgatcttgcccaggcctccgtcaccatcaccatctgcatcttaacccactcctcccctttcacaaaactccagccacacagacttgctttttattcctcaagctttccaaactgtttctactgagagtctttgcacatgctccatcttccttgaatactctttccccagtgagctcattttcatcttcctgaattcataccactattacctttgcttctgtggaagaaactggccagatgctcacccaaatgtcctctttctggacacaggtaaactgcatttcccagctccatgcatctaggcctatgtgagtagttctcaacagtggaaaatgagtggaagtgatgtttcaatactagaccaaggcagttaaagggtggctgagccatttccattattctcttcctccttcctcttcaaggtaaccttgaagcacatgttttgacggtgatggagtcatagcatagaagaagtctgaatacctgagttactatttagggcataatagctacttgaccaaaaacatccatattggactttgaacaagaaaataaacttgattacattctgctagtgagttttgagggtgttttagcagttatcattatatacactggatatatcttctatggtatcctgtccaccttactcttgaccacagtaccctctttgtttccttcagggtgtttcagatatttaattatcttgccagatgccagtcaacactttctttttgtcccatgagtttaaaatcaggggaaaacatgtactcccaataggaagttgagatactcttttttttttaaatccgtcattgtgactgtgaccggaaaaacaaatcccactaaagaatgtcctaaacagatgtttttttttgtcatataacctggagttaggtgatttggcattggttctggagctgaaggatgttagggatgaggtctctgtagttttcttgtctcatggtcacgaaatgaagtgttattgattaagcagggatgccctacttagtattagacttcttggaagtctccttaattgccacagcccctatctttttggcttcgtttcaagggtccttctacattgttaatactctggtataaatacgttccattattccctataacatgactgaaaccaatctaaagtattaacattttaaatatgtttttgggccaagtgcagtggctcttatctgtgatcccagctactaggaaggctgaggtgggaggattgcttgagcccaggaatttcaggctgtagtgagctatgattgtgccactgtactccggcctggataactgagatcctgtctcaataaataaataaaacaatt

SEQ ID NO: 1925 - DNA, 1578 bp, Homo sapiens
aggcggctggggagctgggagggttcagctgccacgtgagttctgcggccgctgctacacgcctggtgggcagcatgtcggcaacagcggctgctcgtaagcggggaaagccggcctctggggccggggctggcgcgggggccggcaagcggcggcgaaaggccgactctgcgggggacaggggcaaatccaagggtggcggcaagatgaatgaggagatctccagcgactctgagagcgagagcctagctccaaggaagcctgaggaggaggaggaggaggagctggaggaaactgcacaggaaaagaagctgcgcttggccaagctctacctagagcagctccgtcagcaagaggaggagaaggctgaggcccgtgcatttgaggaggaccaggtggcggggcgcctgaaggaggatgtgcttgagcagaggggcaggctgcagaagttggtggcaaaagagatccaggccccagcctcagctgacattcgcgttttacgggggcaccagctctctatcacatgtttggtcgtcacccccgatgactcagccatcttctctgctgccaaagactgcagcatcattaagtggagcgtggagagtggacggaagctgcatgtgattcctcgagccaagaagggtgccgagggaaagccccctggccacagcagccacgtcctctgcatggccatctcctccgacggcaagtaccttgcctctggtgaccgcagcaagctcattctcatttgggaggcccagagctgccagcacttgtacaccttcacaggacaccgggatgcagtgtcgggtctggcattccgcagaggcacccaccagctctacagcacatcccacgatcgctccgtgaaggtgtggaatgtggcagagaactcctacgtggagacgctcttcggacaccaggacgctgtggctgcactggatgccttgagccgggagtgctgtgtgacggctgggggccgggatgggactgtacgtgtgtggaagatccccgaggagtcccagcttgtcttctatggccaccagggctccatcgactgcatccacctaatcaatgaggagcacatggtgtccggcgcggacgatggctctgtggccttgtggggtctctccaagaagcgaccacttgccctgcagcgtgaagctcacgggctgcggggagagccaggcctggagcagcccttctggatatcgtcggtggcagccctcctcaacacagaccttgtggccacaggctcccacagctcctgtgtgcggctttggcagtgtggggaaggcttccggcagcttgaccttctctgtgacatccccctggtgggttttatcaacagcctcaagttctccagctctggggacttcctggtggctggggtagggcaggagcacaggcttggccgatggtggagaatcaaagaggctcggaattctgtctgcatcatcccactccgcagggtccctgtacccccagctgctggttcctgacactcttatcctccttatttaagtccttcccaggctatgccccaccctctttgtattaaaagcctcctcttttggg

SEQ ID NO: 1926 - DNA, 1385 bp, Homo sapiens
aaaggagccaagaccatggcgaaagccggggataagagcagcagcagcgggaagaaaagtctaaaacggaaagccgctgccgaagaacttcaggaggctgcaggcgctggggatggggcgacggaaaacggggtccaacccccgaaagcggctgcctttccgccaggctttagcatttcggagattaaaaacaaacagcggcgacacttaatgttcacgcggtggaaacagcagcagcggaaggaaaagttggcagctaagaaaaaacttaaaaaagaaagagaggctcttggcgataaggctccaccaaagcctgtacccaagaccattgacaaccagcgagtgtatgatgaaaccacagtagaccctaatgatgaagaggtcgcttatgatgaagctacagatgaatttgcttcttacttcaacaaacagacttctcccaagattctcatcacaacatcagatagacctcatgggagaacagtacgactctgtgaacagctctccacagttataccaaactcacatgtttattacagaagaggactggctctgaaaaaaattattccacagtgcatcgcaagagatttcacagacctgattgttattaatgaagatcgtaaaaccccaaatggacttattttgagtcacttgccaaatggcccaactgctcattttaaaatgagcagtgttcgtcttcgtaaagaaattaagagaagaggcaaggaccccacagaacacatacctgaaataattctgaataattttacaacacggctgggtcattcaattggacgtatgtttgcatctctctttcctcataatcctcaatttatcggaaggcaggttgccacattccacaatcaacgggattacatattcttcagatttcacagatacatattcaggagtgaaaagaaagtgggaattcaggaacttggaccacgttttaccttaaaattaaggtctcttcagaaaggaacctttgattctaaatatggagagtatgaatgggtccataagccccgggaaatggatacaagtagaagaaaattccatttataaagtactgagagaatgatattggattttgctgaacaggcctatcttgaactttggtaaattatttttgacagaatactcttttcaaaatggcatttgctgatttcataaacctttcacgtctggacgaattaccaaatgccatgaattgccactgtgtgtttatgtagaaaatacaaataaaagttattttgatggcttaggtttccttaaacttagttctcttgtttttgggtaactgtgaataattaagttggaatcaagattcagattaactttcctatttgcatagaacacatgagaggaataaaatggttggtaaa

SEQ ID NO: 1927 - DNA, 724 bp, Homo sapiens
acggaagcaaaggagccaagaccatggcgaaagccggggataagagcagcagcagcgggaagaaaagtctaaaacggaaagccgctgccgaagaacttcaggaggctgcaggcgctggggatggggcgacggaaaacggggtccaacccccgaaagcggctgcctttccgccaggctttagcatttcggagattaaaaacaaacagcggcgacacttaatgttcacgcggtggaaacagcagcagcggaaggaaaagttggcagctaagaaaaaacttaaaaaagaaagagaggctcttggcgataaggctccaccaaagcctgtacccaagaccattgacaaccagcgagtgtatgatgaaaccacagtagaccctaatgatgaagaggtaatgttagaagtcttaaattagtttgaatgatcacatataattgataaattatatgtttttttgttgatatttaaagtgctggctggccaagttgcataatggactgattcagctaaaatgttggcatattatcttattatttggtgaagactatttcataattgaatttcccaataatgctatagaaaaattctataaaaattctaggtaaacttttacatttgtcatataatccctgaatggtattttggagggttttgtttttgtttttgtttttgattttgttgagacagagtcttgctctgtcgcccatgctggagtgcagtggtgtg

SEQ ID NO: 1928 - DNA, 873 bp, Homo sapiens
acgcgcagcttccggttccgcctgttccggcgcacgtaatcgccgagggcacgtgcatgccccctggttaagagttgcaggtagcggtagcgatggacactctggatcgagtagtaaagcccaaaacgaaaagagccaagagattccttgagaagagagaaccgaaactcaatgaaaatattaaaaatgccatgctgattaaagggggaaatgcaaatgcaacagtgacaaaagtacttaaagatgtgaatgtgttttgttttgaaagctataaattttgttttacagtatgcactgaaaaaaccatacggtgtactatataaaaagaaaaatattacaagaccttttgaggatcagacatcactggaattcttttcaaagaagtcagattgttctttattcatgtttggctcccataataagaagcggccaaataatctagtaataggtcgtatgtatgactaccatgtgctggatatgattgaattaggtattgagaattttgtctctctaaaagacattaagaacagtaaatgtcctgagggaacaaaacccatgctgatatttgctggcgatgatttcgatgtaacagaagattatagaagactaaaaagtcttcttattgatttcttcagaggccccacagtatcaaatatccgcctggctggattagagtatgttctgcacttcactgcactgaatgggaagatttactttcgaagctataagttgctgttgaagaaatctggttgcagaacaccacggattgaattggaagagatgggaccctcattggatctggttctgaggaggacacacctggcatcggatgacctttataaattatctatgaaaatgccaaaagctctcaag

SEQ ID NO: 1929 - DNA, 906 bp, Homo sapiens
aagtgggagccgtgggatgggagggatgtgggattgaagcgttggccgcttttatcctagccagttgaaaaacgtctgacttccgaagtatgagacagatggtatagtggggttaggagcacagccctcggaatccgacagatctgagtgacagtctggcgcgtccacttaaagctttgtgactttggaaagcccaaaacgaaaagagccaagagattccttgagaagagagaaccgaaactcaatgaaaatattaaaaatgccatgctgattaaagggggaaatgcaaatgcaacagtgacaaaagtacttaaagatgtgtatgcactgaaaaaaccatacggtgtactatataaaaagaaaaatattacaagaccttttgaggatcagacatcactggaattcttttcaaagaagtcagattgttctttattcatgtttggctcccataataagaagcggccaaataatctagtaataggtcgtatgtatgactaccatgtgctggatatgattgaattaggtattgagaattttgtctctctaaaagacattaagaacagtaaatgtcctgagggaacaaaacccatgctgatatttgctggcgatgatttcgatgtaacagaagattatagaagactaaaaagtcttcttattgatttcttcagaggccccacagtatcaaatatccgcctggctggattagagtatgttctgcacttcactgcactgaatgggaagatttactttcgaagctataagttgctgttgaagaaatctggttgcagaacaccacggattgaattggaagagatgggaccctcattggatctggttctgaggaggacacacctggcatcggatgacctttataaattatctatgaaaatgccaaaagctctcaag

SEQ ID NO: 1930 - DNA, 1531 bp, Homo sapiens
acgcgcagcttccggttccgcctgttccggcgcacgtaatcgccgagggcacgtgcatgccccctggttaagagttgcaggtagcggtagcgatggacactctggatcgagtagtaaagcccaaaacgaaaagagccaagagattccttgagaagagagaaccgaaactcaatgaaaatattaaaaatgccatgctgattaaagggggaaatgcaaatgcaacagtgacaaaagtacttaaagatgtgtatgcactgaaaaaaccatacggtgtactatataaaaagaaaaatattacaagaccttttgaggatcagacatcactggaattcttttcaaagaagtcagattgttctttattcatgtttggctcccataataagaagcggccaaataatctagtaataggtcgtatgtatgactaccatgtgctggatatgattgaattaggtattgagaattttgtctctctaaaagacattaagaacagtaaatgtcctgagggaacaaaacccatgctgatatttgctggcgatgatttcgatgtaacagaagattatagaagactaaaaagtcttcttattgatttcttcagaggccccacagtatcaaatatccgcctggctggattagagtatgttctgcacttcactgcactgaatgggaagatttactttcgaagctataagttgctgttgaagaaatctggttgcagaacaccacggattgaattggaagagatgggaccctcattggatctggttctgaggaggacacacctggcatcggatgacctttataaattatctatgaaaatgccaaaagctctcaagccaaagaagaagaaaaatatttcccatgatacttttggtacaacttatggaaggattcatatgcagaagcaagacctaagcaaactacaaaccaggaaaatgaaggggttgaagaagcgacctgcagaaaggataacagaagaccacgagaaaaagtcaaaaagaattaaaaaaaattgatggaacttagccagccactactgtttcattgtgttctacttaagagaattatcaagcgtcaatccattcagagtttcttataagatcttattatatatttttataacatgataattttacgatatattattatgaacagtaatatactagtattaagtgtaaagtaagccttttatttgagacattacaccctggtgtgccattttctcttgtgatatcccctgccctccacaaattcttctttctcattgggtggatggatgggtgaggagggatctccataaccattgggatttttttgaatttctggccttagctaaagaaagccacagaaagccggacccgcaggagctgtgtaaacaatctcagtatgaattacctggaaagttaacctcctctcccaacatggatctacattctgatttttattttctacttttattttgcctgaaatcctactcgttgacatttgagattttaagctttgtggctgaaaatatatagatctctgagaggga

SEQ ID NO: 1931 - DNA, 596 bp, Homo sapiens
agagctggaatctctgcacgggccttggaaaacgactgtcttcttctgccaaaatgtcaggaattggaaataaaagagcagctggagaacctggcacctccatgcctcctgagaagaaggcagctgttgaagattcagggaccacagtggaaacaattaagctaggaggtgtctcttcaacggaggaactagacattagaacactgcaaaccaaaaatcgcaagctggcagaaatgttggatcagcggcaggccattgaagatgaacttcgtgagcacattgaaaaactggaacgacgacaggccactgatgatgcctcactattgattgtcaaccgatactggagtcagtttgatgaaaacatccgtatcatccttaaacgttatgatctggagcagggcttgggagacctactcacagaacgaaaagcccttgttgtgcctgaaccagaaccagactctgatagcaatcaggagcgtaaagatgaccgagagagaggggaagggcaagagccagctttctctttccttgctactttggccagcagttccagtgaagagatggagtctcagctgcaggaacgtgtggagtcttcc

SEQ ID NO: 1932 - DNA, 3936 bp, Homo sapiens
ggaagttctgccttgtctccgccgcgggtcaggggtgagagctggaatctctgcacgggccttggaaaacgactgtcttcttctgccaaaatgtcaggaattggaaataaaagagcagctggagaacctggcacctccatgcctcctgagaagaaggcagctgttgaagattcagggaccacagtggaaacaattaagctaggaggtgtctcttcaacggaggaactagacattagaacactgcaaaccaaaaatcgcaagctggcagaaatgttggatcagcggcaggccattgaagatgaacttcgtgagcacattgaaaaactggaacgacgacaggccactgatgatgcctcactattgattgtcaaccgatactggagtcagtttgatgaaaacatccgtatcatccttaaacgttatgatctggagcagggcttgggagacctactcacagaacgaaaagcccttgttgtgcctgaaccagaaccagactctgatagcaatcaggagcgtaaagatgaccgagagagaggggaagggcaagagccagctttctctttccttgctactttggccagcagttccagtgaagagatggagtctcagctgcaggaacgtgtggagtcttcccgccgagccgtgtcccagattgtgactgtttatgataaattgcaagaaaaagtggagctcttatcccggaagctaaacagtggagataatctgatagtggaggaagcagtgcaggagctgaactctttcctcgcacaggagaatatgaggctacaggaattgacagatcttcttcaggaaaagcatcgcaccatgtctcaggagttctccaagttgcagagtaaagtggagacagccgaatcacgagtgtctgtcctggagtccatgattgatgacctgcagtgggatattgacaaaattcgaaagagggaacagcgactcaaccgacacttagcagaagtcctagaacgggtgaattccaaaggttataaggtgtatggagcggggagcagtctgtatggcggcacaatcactatcaatgctcggaagtttgaggaaatgaatgcagagcttgaggagaacaaagagttggctcagaaccgtctctgtgagctggagaaacttcggcaagactttgaggaggtcactacacaaaatgaaaagctgaaggtggaattgcggagtgcagtggagcaagtcgttaaggaaactccagaatatcgctgcatgcagtcacagttctccgtcttgtataatgagagcctacagttgaaagcacacttggatgaggctcggaccctgcttcatggcaccagaggaacccaccagcaccaggttgagcttattgagcgagatgaggttagtcttcataagaagctgaggactgaagtaattcagctagaagatacattggcccaggtccgcaaggagtatgaaatgctgaggatagaatttgagcagacccttgctgccaatgaacaagcaggccctataaacagggagatgcgccacctcatcagtagcctccagaatcacaatcaccagctgaaaggggaggtcctgagatataagcggaaattgagagaagcccagtctgacctgaacaagacacgcctgcgtagtggtagtgccctcctgcagtcccagtctagtactgaggacccgaaggatgagcctgcggagctaaaaccagattctgaggacttatcctcccagtcctcagcttcaaaggcatctcaggaggatgccaatgaaatcaagtctaaacgggatgaagaagaacgagaacgagaaaggagggagaaggagagggaacgagaaagagaacgggagaaggagaaggagagagaacgagagaagcagaagctaaaagagtcagaaaaagagagagattctgctaaggataaagagaaaggcaaacatgatgatggacggaaaaaggaagcagaaattatcaaacaattgaagattgaactcaagaaggcacaggagagccaaaaggagatgaaactattgctggatatgtaccgttctgccccaaaggaacagagagacaaagttcagctgatggcagctgagaagaagtctaaggcagagttggaagatctaaggcaaagactcaaggatctggaagataaagagaagaaagagaacaagaaaatggctgatgaggatgccttgaggaagatccgggcagtggaggagcagatagaatacctacagaagaagctagccatggccaagcaggaagaagaagcactcctctctgaaatggatgtcacaggccaggcctttgaagacatgcaggagcaaaatatccgtttgatgcagcaattgcgggagaaggatgatgcaaatttcaagctcatgtcagagcgtatcaagtccaatcagatccataagttgcttaaagaagagaaggaggagctggcagaccaggtgttgactctgaagactcaggttgatgcccagctacaggtagtaaggaaactggaagagaaggagcatctgttacagagcaacattggcacaggggagaaagagctgggtcttaggacccaagccttagagatgaataaacgcaaggcaatggaggcagcccagcttgcagatgacctcaaagcacaactggagttggctcagaagaagctacatgattttcaggatgagatcgtggagaacagtgttaccaaagaaaaggacatgttcaatttcaaacgagcccaggaggacatctctagacttcgcaggaagctggagaccacaaagaaaccagacaatgtacccaagtgtgatgagattctgatggaagagattaaggattacaaggcacgcttgacctgtccgtgctgtaacatgcgtaaaaaggatgctgttcttactaagtgttttcatgtcttctgctttgagtgtgtgaagacacgctatgacacccgccagcgcaaatgtcccaagtgtaatgctgcttttggtgccaatgattttcatcgcatctacattggttgatctaagtcaagagaagaagaggagctggctagtcaggaacttattcattaaccaccaaacctctacctcttctctccttgactgtcacctgtaggacagtttatcagtcaactacctttcctccagactttacttccaggctctcctcttcagtagctggatgactttagcagaaaggactggtaaatacaagccttgggtttcagaatgaattagaaacaaataactcttactgtcttccctcccagctttgtttattttgtgcttttagacttttcagtgttttctttttccagcccactgtataaacttggattgtccattcctcctgaagaaatcaagttggtatttttgatgtggaaaagggaacaaaagtggaaacatggctacttttggggagtgatattttaaaaaataagttgtctatgggcacaaagttttcttcatttgtgtagcaaacttcttgtgaatgtggattacaaaatggtataattgtgctactctcccctgggtggtttgcagccctaatgaaattatgtctaggatgattcagtctatttcccatttactagcagagtaacttgttaagatcagctggctttcttgttaaagttatttaagttttgaatgctctactacttcaagtctttaaatttcttgagactagaataattttaaataatatgaccctttgtcttctaatgaaataaagattgaagaggttgagtcaggactgagctggtgaagaaatcttgtgggtattctggaaatttgatacggagagaacttggtgagctatgaattactctcagtctcctttttacagggttgttgtgatccctcttttccagaaaattctgtggaatgtttctgtaggactttgttctccacaagcttgaattaaagcaggattcagtt

SEQ ID NO: 1933 - DNA, 784 bp, Homo sapiens
gcttagggcccaacaggactgtgccaggcctcaggagtctccaccctctccagttttggggccgtcagtctcctgggcctgcaattatccacgctgaggctgaggtctttggcttttagcgagttggattgcagccttgttctgcttctgtgtcttctctctccaggcgaggtcctactgaggttgttgccagcgatagtcctctcctggagcttgaattggaagcagagtagtcttgttagtctcggtgatggctgcgttgtttcctgaagtagccaaagtgctttagcatccattccgcctcctttgagcaccctgggaggaaaacgactgtcttcttctgccaaaatgtcaggaattggaaataaaagagcagctggagaacctggcacctccatgcctcctgagaagaaggcagctgttgaagattcagggaccacagtggaaacaattaagctaggaggtgtctcttcaacggaggaactagacattagaacactgcaaaccaaaaatcgcaagctggcagaaatgttggatcagcggcaggccattgaagatgaacttcgtgagcacattgaaaaactggaacgacgacaggccactgatgatgcctcactattgattgtcaaccgatactggagtcagtttgatgaaaacatccgtatcatccttaaacgttatgatctggagcagggcttgggagacctactcacagaacgaaaagcccttgttgtgcctgaaccagaaccagactctgatagcaatcaggagcgtaaagatgacc

SEQ ID NO: 1934 - DNA, 387 bp, Homo sapiens
acgggccttggtgagtaactgctgcgagttctgttcccgcgcggcgccagttcaaagaacttaggaaaacgactgtcttcttctgccaaaatgtcaggaattggaaataaaagagcagctggagaacctggcacctccatgcctcctgagaagaaggcagctgttgaagattcagggaccacagtggaaacaattaagctaggaggtgtctcttcaacggaggaactagacattagaacactgcaaaccaaaaatcgcaagctggcagaaatgttggatcagcggcaggccattgaagatgaacttcgtgagcacattgaaaaactggaacgacgacaggccactgatgatgcctcactattgattgtcaaccgatactggagtcag

SEQ ID NO: 1935 - DNA, 3416 bp, Homo sapiens
aaaaaggaactgggagcgcgccgcggcggttcctgtccttacagttgcgctgcccagggaccgatgttgcgcgaggaaaatgcgggacgcccaggtcggtgctcggcccagacttatgcccgtgttttcacagcccacactcgtgcccgaagccccttaccccgccccgggctgtggtctgtgggctgtgggacgagctgcggcgcgggccatttctgagcagtggaggtttcaagtaatccactaacaaccagttccaaattctgtcatcaaatcctgtgctgctgttcctcgtggtaatagatgcatattatttcttttatttaaaagaaatgaatgtgactagtattgcattaagagctgaaacttggcttttagctgcatggcatgttaaagtacctccgatgtggctggaagcttgtattaactggattcaagaagaaaataataatgttaacttgagtcaggcccaaatgaataaacaagtgtttgagcagtggctccttactgatctgagggatttggagcatcctcttttacccgatggcattttagaaattccaaaaggagaattaaatggattttatgctctgcagattaattccttggttgatgtaagtcagcctgcatactcccagatacagaagttgagaggaaagaatacaacaaatgatctagttacagctgaagcacaagtaaccccaaaaccttgggaagcaaagccttcacgaatgttgatgctgcagctaactgatggaatcgtacaaatacagggaatggaatatcagcctattccaattcttcatagtgatcttcctccaggtacaaaaattttgatttatggaaatatatctttccgtcttggtgttctcttattgaaaccagaaaacgtgaaagtgttaggaggtgaagtagatgctcttttagaagaatatgcccaagaaaaagtacttgcaagattaataggggaacctgatcttgtagtttcagtcataccaaacaattctaacgaaaacattcccagagttacagatgttctagatcctgcattaggtccttctgatgaagaactcttggcaagtcttgatgaaaatgatgagcttacagcaaataatgacacttcctcagaacgatgtttcaccacaggtagttcctcaaataccattcccacaagacagtcaagttttgagccagaatttgttatttctccaagaccaaaagaggaaccatcaaacctatctatacatgtaatggatggagaattagatgacttttcactggaggaggccttgcttttagaagaaactgtccagaaagaacagatggaaactaaggaattgcaaccattgacttttaacagaaatgccgatcgaagtatagagagattttcacataatcctaatactacgaataacttttctttgacttgcaaaaatggaaacaataattggagtgaaaaaaatgtatctgaacaaatgactaatgaagacaaatcatttggttgtccatctgttagagaccaaaacaggagtattttttcagttcattgtaatgtacccttagcccatgattttacaaataaagaaaagaacttagagacagataataaaataaaacaaaccagcagttcagatagccattccttaaataataaaatattaaatagagaggtggtcaactatgtacagaaaaggaattcacaaatttctaatgaaaatgattgtaatttacagagttgttctttaagatcatcagagaatagcattaatctttctattgccatggatttgtattctccaccctttgtctatttgtctgttctaatggccagcaaaccaaaggaagttacaacagtgaaagtgaaagcatttattgtaaccttaactggaaatctctcaagttctggtggtatttggagtataactgcaaaggtgtctgatggtactgcatatctagatgtagactttgtggatgaaatacttactagcttgatagggttctcagtaccagaaatgaaacagtcaaaaaaggatcctcttcaataccaaaagttcctggaagggttgcagaaatgtcaaagagatctaatagatttgtgctgtctaatgactatttcatttaatccttccttgtctaaagcaatggtactggcattacaagatgttaatatggaacaccttgagaatctaaagaagcggttaaataaataattaaactaaaatagtattaggaacaattaaaaacaacaaggaaatatttagaatttgttcacaattttacttatgatactttgtgtaaaaaggaaaaatgaaatttcatagcttatttcagtttaattttaaagtgtttaatcatgtttgttatatgtggagcttttgaaaataagttaatctttttttttttttttttaatgtcagggtattgctctgttgcccaggctagagtgcagtggcatgatcataggttattgcatcaacctcttgagctcaagcgatcctcctgccttagcctcttgagttgctgggactataggcatgtaccaccatgcccagctaatttataattactattattgttttgtagggacagagttttgctatgttgcccagattggtctcaaactcctggcctctcactcctgccgtcatggcctccaaagtttactttttttaaaagtaactgttagatggaggaatatggtgacccactattgttgagaaatttgttttccacttgtcacgtcacataagatgattgctaaaatattgtactggtgttcggtggtgagtcatatttttgaaagttaataattataaataggtaatttccttctaatatgttggtactgtctatggccataccaccctgaacatgcctgagcttgtcataatatgttgagtacccaaaagatttgtttatattgttaatcttagggaaaaaaaattaaaatccagtagatcagaacatcaggctttcagatacaaattgatttactggtttttattttgctgattataatatttggtatatttaaggtaatctagttaactagatgctatttcatagattatattgaatgatttaaaactttattttcaaggatagtttattttaaatggcatattgaaaacatcattattaagatccagtaggtaggacatttattggattaaaatgaagcatttatctatgtctttaggtgtcattgttccctttctgaattagctgtacatataagccttcctttggttttaagtactgatttttttttaaaaaaaagagggactgtttaccattcttccactgtgctgttataaagttgtatttgaaaggtaatgttgtttttattaatcttttgtcttaaaataatttaaagtgctttgaattttaaaacattaaacaaatccttaaataac

SEQ ID NO: 1936 - DNA, 2716 bp, Homo sapiens
attttgtgaagcggcgaaggaggtggtggctgcgttgggctccgggaagccgttcgggctggggctgtcggccgcggggcggaggcactcgcgcggggggtaattcggggtctgggttctggtgccgcgcagctttccccgtctaaaagttggttttaattggttgcccacaggattgacttggcctctacttcttgttaaggaaattcatctcttgttttatcaggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactgggtgaggctttcatcgtttttgccatctctgccaccaatgccatccattcccccaattccagttcctcctccagtacctacattgcctcctgtgcctcctgtgcccccgattcccccagttccttctgtgccacccatgaccccactgccacccatgtcgggcatgccgcccttgaatccgccacctgtggcacctctacctgctggaatgaatggctctggagcacctatgaatttgaacaataatctgaatcctatgtttcttggtccgttgaatcctgttaaccctatccagatgaactctcagagcagtgtgaagccactccccatcaaccctgatgatctgtatgtcagtgtgcatggaatgcccttttctgcaatggaaaatgatgtcagagatttttttcatgggctccgtgttgatgcagtgcatttgttgaaagatcatgtaggtcgaaataatgggaatggattggttaagtttctctcccctcaagatacatttgaagctttgaaacgaaacagaatgctgatgattcaacgctatgtggaagttagccctgccacagaaagacagtgggtagctgctggaggccatatcacttttaagcaaaatatgggaccttctggacaaactcatccccctcctcagacacttcccaggtcaaaatcgcccagtgggcagaaaagatcaaggtcaagatcaccacatgaggctggtttttgtgtttacttgaaagggctaccatttgaagcagaaaacaaacatgtcattgatttttttaaaaagctggatattgtggaagatagtatttatatagcttatggacccaatgggaaagcaactggcgaaggctttgtagagttcagaaatgaggctgactataaggctgctctgtgtcgtcataaacagtacatgggcaatcgctttattcaagttcatccaattactaagaaaggtatgctagaaaagatagatatgattcgaaaaagactgcagaacttcagctatgaccagagggaaatgatactaaatccagagggggatgtcaactctgccaaagtctgtgcccacataacaaatattccattcagcattacaaagatggatgttcttcagttcctagaaggaatcccagtggatgaaaatgctgtacatgttcttgttgataacaatgggcaaggtctaggacaggcattggttcagtttaaaaatgaagatgatgcacgtaagtctgaacgcttacaccgtaaaaaacttaatgggagagaagcttttgttcatgtagttaccctagaagatatgagagagattgagaaaaatccccctgcccaaggaaaaaagggattaaagatgcctgtgccaggtaatcctgcagttccaggaatgcccaatgcgggactgcccggtgtgggactgcccagtgcaggacttcccggtgcaggcctgcccagcacaggactgcctggttcagcaataaccagtgcaggactgcctggtgcgggaatgcccagtgcaggaatacctagtgcaggaggtgaagagcatgccttcctgactgtaggatcaaaggaagccaataatgggcctccatttaactttcctggtaattttggtggatcaaatgcctttgggccaccaatccctcctccaggattaggaggcggggcctttggtgatgctaggcctggtatgccttcagttggaaacagtggtttgcctggtctaggactggatgttccgggttttggaggtggaccaaacaatttaagtgggccatcgggatttggagggggccctcagaattttggaaatggccctggtagcttaggcggtcccccggggtttggaagtggccctcctggtcttggaagtgcccctgggcatttgggtgggccaccagcttttgggcctggccccggccccggccccggccctggcccaatccatattggtggtccccctggctttgcatctagttctggaaaaccaggaccgacagtaattaaagtgcaaaacatgccctttactgtgtctattgatgagattttagatttcttttatggctatcaagtaatcccaggctcagtgtgtttaaaatacaatgaaaaaggtatgcccacaggtgaagccatggtggcctttgagtctcgggatgaagccacagctgctgtcattgacttaaatgacaggcctataggttcaagaaaagtaaaacttgtattagggtagccattcacatcattttttatagggtagatcttcatattgctgtgattaatgcatccagattgttttcctagtatttccaggttagaacctgtggattgtttcaattgcatatagc

SEQ ID NO: 1937 - DNA, 5332 bp, Homo sapiens
ggcgaaggaggtggtggctgcgttgggctccgggaagccgttcgggctggggctgtcggccgcggggcggaggcactcgcgcggggggtaattcggggtctgggttctggtgccgcgcagctttccccggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactgggtgaggctttcatcgtttttgccactgatgaagatgcaaggcttggtatgatgcgcacaggtggtacaattaaagggtcaaaagtaacactattgttgagtagtaagacggaaatgcagaatatgattgaactgagtcgtaggcgttttgaaactgccaacttagatataccaccagcaaatgccagtagatcaggaccaccacctagctcaggaatgagtagcagggtaaacttgcccacaacagtatccaactttaataatccatcacccagtgtagttactgccaccacttctgttcatgaaagcaacaaaaacatacagacattttccacagccagcgtaggaacagctcctccaaatatgggggcttcctttgggagcccaacgtttagctcaactgttccaagcacagcctctccaatgaacacagtcccgccgccaccaattcctccaattccagcgatgccatctctgccaccaatgccatccattcccccaattccagttcctcctccagtacctacattgcctcctgtgcctcctgtgcccccgattcccccagttccttctgtgccacccatgaccccactgccacccatgtcgggcatgccgcccttgaatccgccacctgtggcacctctacctgctggaatgaatggctctggagcacctatgaatttgaacaataatctgaatcctatgtttcttggtccgttgaatcctgttaaccctatccagatgaactctcagagcagtgtgaagccactccccatcaaccctgatgatctgtatgtcagtgtgcatggaatgcccttttctgcaatggaaaatgatgtcagagatttttttcatgggctccgtgttgatgcagtgcatttgttgaaagatcatgtaggtcgaaataatgggaatggattggttaagtttctctcccctcaagatacatttgaagctttgaaacgaaacagaatgctgatgattcaacgctatgtggaagttagccctgccacagaaagacagtgggtagctgctggaggccatatcacttttaagcaaaatatgggaccttctggacaaactcatccccctcctcagacacttcccaggtcaaaatcgcccagtgggcagaaaagatcaaggtcaagatcaccacatgaggctggtttttgtgtttacttgaaagggctaccatttgaagcagaaaacaaacatgtcattgatttttttaaaaagctggatattgtggaagatagtatttatatagcttatggacccaatgggaaagcaactggcgaaggctttgtagagttcagaaatgaggctgactataaggctgctctgtgtcgtcataaacagtacatgggcaatcgctttattcaagttcatccaattactaagaaaggtatgctagaaaagatagatatgattcgaaaaagactgcagaacttcagctatgaccagagggaaatgatactaaatccagagggggatgtcaactctgccaaagtctgtgcccacataacaaatattccattcagcattacaaagatggatgttcttcagttcctagaaggaatcccagtggatgaaaatgctgtacatgttcttgttgataacaatgggcaaggtctaggacaggcattggttcagtttaaaaatgaagatgatgcacgtaagtctgaacgcttacaccgtaaaaaacttaatgggagagaagcttttgttcatgtagttaccctagaagatatgagagagattgagaaaaatccccctgcccaaggaaaaaagggattaaagatgcctgtgccaggtaatcctgcagttccaggaatgcccaatgcgggactgcccggtgtgggactgcccagtgcaggacttcccggtgcaggcctgcccagcacaggactgcctggttcagcaataaccagtgcaggactgcctggtgcgggaatgcccagtgcaggaatacctagtgcaggaggtgaagagcatgccttcctgactgtaggatcaaaggaagccaataatgggcctccatttaactttcctggtaattttggtggatcaaatgcctttgggccaccaatccctcctccaggattaggaggcggggcctttggtgatgctaggcctggtatgccttcagttggaaacagtggtttgcctggtctaggactggatgttccgggttttggaggtggaccaaacaatttaagtgggccatcgggatttggagggggccctcagaattttggaaatggccctggtagcttaggcggtcccccggggtttggaagtggccctcctggtcttggaagtgcccctgggcatttgggtgggccaccagcttttgggcctggccccggccccggccccggccctggcccaatccatattggtggtccccctggctttgcatctagttctggaaaaccaggaccgacagtaattaaagtgcaaaacatgccctttactgtgtctattgatgagattttagatttcttttatggctatcaagtaatcccaggctcagtgtgtttaaaatacaatgaaaaaggtatgcccacaggtgaagccatggtggcctttgagtctcgggatgaagccacagctgctgtcattgacttaaatgacaggcctataggttcaagaaaagtaaaacttgtattagggtagccattcacatcattttttatagggtagatcttcatattgctgtgattaatgcatccagattgttttcctagtatttccaggttagaacctgtggattgtttcaattgcatatagcttggtttccataacatagagcattggttgactgtttacagaagactcactcaccaggataaacattgctgtatgttacagtaaagctatctggagagaacacataaatgattttggcataccattagagaaaccatttgtaaaactcaaatgaccacataaagcttatcaaggagtctagattggttttgttttataccatatgggatgaagaaaatagaaatgtcagtagaactcattgagggtgctcttgccagctgctgaaaatagaagttggctactctcagaatttggtttaaagctggacagatttgctttgttatagggtaaagctttgtctaaagtcctcattttcttttaaaattgaataaaatttctgtatacagattcattgtatgtacctttattgcttcttaagggtccttgctgtatagacagtcctgcttcagaagttgctgctttgtttgtctaattgactcatttgtaaatgagcagaactgttttgttggtttttttccctaaatataaaagtccacacttcgtttgtgctataacctcaaactttgatttctaatgtcacacttaaaactgtgtggaataagacttttgccataaaaataaactatggagtcctttatctaccagagcctttttggtttgaccgccacgatttaggttagtcagtttaaaaattgttcatgttgtttggatggtatcgaaaaccagaaaccacttttaataatgtgtttaagatacttgatttgaagtccttttcatatggactaattgtagtatcaatttcctcctgtcccgattatgtgaaattttggcctttaaacaaagaggggcccattcataagaaagtgttatatctaggtttttaaaactgaagttgaaattatctttgttagcagtagtagtatagaataaaagatccgtatgctggttcgtagattgatacgtgttagtcctgttatttggaggctttttggcatagttgttcgatcaggagcctgtttactaaaagtcttcatacagagtacaagtgcagccgccagaggagaaaattgagattcttgaccctttcatactcttttctttggtattcaggacactaaggcaggaggaccacatgagttctggttggtaagtgtccttgtcatgaaaacacttgccttacaaggctctaattatgatttccctagtcagtgctctgaagatgtgtcacattatattataaacaatacggaaggggagataggtgagatgatatgaaaaacaaattttctcactgtcataaaaggctctaattatggttactttccttgtgatgaaaaacttggccttacagggctctagttatggttactttccctagtcaatgctctgaaaatgtgtcacattataaacaatacagaaggagagatagatgagagatcatgaaaaccaaattttatcttttacatggcccctttgtcttcgtttgaaacatccccaacatttcctacaaatcagcgtagttacaaaggggtcagtcttttaaaataagtatttcctattaaactatatatatatacagtgcctttttggtgttgtgagtcagtggaacactgaaatacagcggttgtgtaatttaagagtggcaacagtttcatttgataagatttgaaaaggctttttatcactacaatcttagaggattgacagtacaggatttttgtttaagagaaggattgtttagactcaagaggtgactatgttgtgggtcttttgataattcatgaatacagatttgctttgaccgatcactagatactgcctcctcaatttcaaaagcaatataacgtttgtatatgctgtttaatttaagttaatgttaagtaatcatttctcattccaaagacaatgcaaaaaacttcagcactgcttgagagttgtatttcagccacagatattttctccattggaaagctattttcattttagaaaaatgggttgtttgaagatgaaagtcttttatcttttttcacaatttattttggttatatgttcgtacattcttattaaatatttcatacactttattgcaactactttgttatttctacatcttagataaatgctgaaaaggaaaacgatttcattgttcatctaattaaataaattaaaagagcggtttgtgtagaaattggagagaactatgttttatatgaatcacaacagtgctcgttgtggactgtaattaaatgctttgccctctggaacttg

SEQ ID NO: 1938 - DNA, 5213 bp, Homo sapiens
attttgtgaagcggcgaaggaggtggtggctgcgttgggctccgggaagccgttcgggctggggctgtcggccgcggggcggaggcactcgcgcggggggtaattcggggtctgggttctggtgccgcgcagctttccccggattgacttggcctctacttcttgttaaggaaattcatctcttgttttatcaggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactgggtgaggctttcatcgtttttgccactgatgaagatgcaaggcttggtatgatgcgcacaggtggtacaattaaagggtcaaaagtaacactattgttgagtagtaagacggaaatgcagaatatgattgaactgagtcgtaggcgttttgaaactgccaacttagatataccaccagcaaatgccagtagatcaggaccaccacctagctcaggaatgagtagcagggtaaacttgcccacaacagtatccaactttaataatccatcacccagtgtagttactgccaccacttctgttcatgaaagcaacaaaaacatacagacattttccacagccagcgtaggaacagctcctccaaatatgggggcttcctttgggagcccaacgtttagctcaactgttccaagcacagcctctccaatgaacacagtcccgccgccaccaattcctccaattccagcgatgccatctctgccaccaatgccatccattcccccaattccagttcctcctccagtacctacattgcctcctgtgcctcctgtgcccccgattcccccagttccttctgtgccacccatgaccccactgccacccatgtcgggcatgccgcccttgaatccgccacctgtggcacctctacctgctggaatgaatggctctggagcacctatgaatttgaacaataatctgaatcctatgtttcttggtccgttgaatcctgttaaccctatccagatgaactctcagagcagtgtgaagccactccccatcaaccctgatgatctgtatgtcagtgtgcatggaatgcccttttctgcaatggaaaatgatgtcagagatttttttcatgggctccgtgttgatgcagtgcatttgttgaaagatcatgtaggtcgaaataatgggaatggattggttaagtttctctcccctcaagatacatttgaagctttgaaacgaaacagaatgctgatgattcaacgctatgtggaagttagccctgccacagaaagacagtgggtagctgctggaggccatatcacttttaagcaaaatatgggaccttctggacaaactcatccccctcctcagacacttcccaggtcaaaatcgcccagtgggcagaaaagatcaaggtcaagatcaccacatgaggctggtttttgtgtttacttgaaagggctaccatttgaagcagaaaacaaacatgtcattgatttttttaaaaagctggatattgtggaagatagtatttatatagcttatggacccaatgggaaagcaactggcgaaggctttgtagagttcagaaatgaggctgactataaggctgctctgtgtcgtcataaacagtacatgggcaatcgctttattcaagttcatccaattactaagaaaggtatgctagaaaagatagatatgattcgaaaaagactgcagaacttcagctatgaccagagggaaatgatactaaatccagagggggatgtcaactctgccaaagtctgtgcccacataacaaatattccattcagcattacaaagatggatgttcttcagttcctagaaggaatcccagtggatgaaaatgctgtacatgttcttgttgataacaatgggcaaggtctaggacaggcattggttcagtttaaaaatgaagatgatgcacgtaagtctgaacgcttacaccgtaaaaaacttaatgggagagaagcttttgttcatgtagttaccctagaagatatgagagagattgagaaaaatccccctgcccaaggaaaaaagggattaaagatgcctgtgccaggtaatcctgcagttccaggaatgcccaatgcgggactgcccggtgtgggactgcccagtgcaggacttcccggtgcaggcctgcccagcacaggactgcctggttcagcaataaccagtgcaggactgcctggtgcgggaatgcccagtgcaggaatacctagtgcaggaggtgaagagcatgccttcctgactgtaggatcaaaggaagccaataatgggcctccatttaactttcctggtaattttggtggatcaaatgcctttgggccaccaatccctcctccaggattaggaggcggggcctttggtgatgctaggcctggtatgccttcagttggaaacagtggtttgcctggtctaggactggatgttccgggttttggaggtggaccaaacaatttaagtgggccatcgggatttggagggggccctcagaattttggaaatggccctggtagcttaggcggtcccccggggtttggaagtggccctcctggtcttggaagtgcccctgggcatttgggtgggccaccagcttttgggcctggccccggccccggccccggccctggcccaatccatattggtggtccccctggctttgcatctagttctggaaaaccaggaccgacagtaattaaagtgcaaaacatgccctttactgtgtctattgatgagattttagatttcttttatggctatcaagtaatcccaggctcagtgtgtttaaaatacaatgaaaaaggtatgcccacaggtgaagccatggtggcctttgagtctcgggatgaagccacagctgctgtcattgacttaaatgacaggcctataggttcaagaaaagtaaaacttgtattagggtagccattcacatcattttttatagggtagatcttcatattgctgtgattaatgcatccagattgttttcctagtatttccaggttagaacctgtggattgtttcaattgcatatagcttggtttccataacatagagcattggttgactgtttacagaagactcactcaccaggataaacattgctgtatgttacagtaaagctatctggagagaacacataaatgattttggcataccattagagaaaccatttgtaaaactcaaatgaccacataaagcttatcaaggagtctagattggttttgttttataccatatgggatgaagaaaatagaaatgtcagtagaactcattgagggtgctcttgccagctgctgaaaatagaagttggctactctcagaatttggtttaaagctggacagatttgctttgttatagggtaaagctttgtctaaagtcctcattttcttttaaaattgaataaaatttctgtatacagattcattgtatgtacctttattgcttcttaagggtccttgctgtatagacagtcctgcttcagaagttgctgctttgtttgtctaattgactcatttgtaaatgagcagaactgttttgttggtttttttccctaaatataaaagtccacacttcgtttgtgctataacctcaaactttgatttctaatgtcacacttaaaactgtgtggaataagacttttgccataaaaataaactatggagtcctttatctaccagagcctttttggtttgaccgccacgatttaggttagtcagtttaaaaattgttcatgttgtttggatggtatcgaaaaccagaaaccacttttaataatgtgtttaagatacttgatttgaagtccttttcatatggactaattgtagtatcaatttcctcctgtcccgattatgtgaaattttggcctttaaacaaagaggggcccattcataagaaagtgttatatctaggtttttaaaactgaagttgaaattatctttgttagcagtagtagtatagaataaaagatccgtatgctggttcgtagattgatacgtgttagtcctgttatttggaggctttttggcatagttgttcgatcaggagcctgtttactaaaagtcttcatacagagtacaagtgcagccgccagaggagaaaattgagattcttgaccctttcatactcttttctttggtattcaggacactaaggcaggaggaccacatgagttctggttggtaagtgtccttgtcatgaaaacacttgccttacaaggctctaattatgatttccctagtcagtgctctgaagatgtgtcacattatattataaacaatacggaaggggagataggtgagatgatatgaaaaacaaattttctcactgtcataaaaggctctaattatggttactttccttgtgatgaaaaacttggccttacagggctctagttatggttactttccctagtcaatgctctgaaaatgtgtcacattataaacaatacagaaggagagatagatgagagatcatgaaaaccaaattttatcttttacatggcccctttgtcttcgtttgaaacatccccaacatttcctacaaatcagcgtagttacaaaggggtcagtcttttaaaataagtatttcctattaaactatatatatatacagtgcctttttggtgttgtgagtcagtggaacactgaaatacagcggttgtgtaatttaagagtggcaacagtttcatttgataagatttgaaaaggctttttatcactacaatcttagaggattgacagtacaggatttttgtttaagagaaggattgtttagactcaagaggtgactatgttgtgggtcttttgataattcatgaatacagatttgctttgaccgatcactagatactgcctcctcaatttcaaaagcaatataacgtttgtatatgctgtttaatttaagttaatgttaagtaatcatttctcattccaaagacaatgcaaaaaacttcagcactgcttgagagttgtatttcagccacagatattttctccattggaaagctattttcattttagaaaaatgggttgtttgaagatgaaagtcttttatcttttttcacaatttattttggttatatgttcgtacattcttattaaatatttcatacacttta

SEQ ID NO: 1939 - DNA, 6662 bp, Homo sapiens
gagcgggccgacggccattttgtgaagcggcgaaggaggtggtggctgcgttgggctccgggaagccgttcgggctggggctgtcggccgcggggcggaggcactcgcgcggggggtaattcggggtctgggttctggtgccgcgcagctttccccgtctaaaagttggttttaattggttgcccacaggattgacttggcctctacttcttgttaaggaaattcatctcttgttttatcaggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactgggtgaggctttcatcgtttttgccactgatgaagatgcaaggcttggtatgatgcgcacaggtggtacaattaaagggtcaaaagtaacactattgttgagtagtaagacggaaatgcagaatatgattgaactgagtcgtaggcgttttgaaactgccaacttagatataccaccagcaaatgccagtagatcaggaccaccacctagctcaggaatgagtagcagggtaaacttgcccacaacagtatccaactttaataatccatcacccagtgtagttactgccaccacttctgttcatgaaagcaacaaaaacatacagacattttccacagccagcgtaggaacagctcctccaaatatgggggcttcctttgggagcccaacgtttagctcaactgttccaagcacagcctctccaatgaacacagtcccgccgccaccaattcctccaattccagcgatgccatctctgccaccaatgccatccattcccccaattccagttcctcctccagtacctacattgcctcctgtgcctcctgtgcccccgattcccccagttccttctgtgccacccatgaccccactgccacccatgtcgggcatgccgcccttgaatccgccacctgtggcacctctacctgctggaatgaatggctctggagcacctatgaatttgaacaataatctgaatcctatgtttcttggtccgttgaatcctgttaaccctatccagatgaactctcagagcagtgtgaagccactccccatcaaccctgatgatctgtatgtcagtgtgcatggaatgcccttttctgcaatggaaaatgatgtcagagatttttttcatgggctccgtgttgatgcagtgcatttgttgaaagatcatgtaggtcgaaataatgggaatggattggttaagtttctctcccctcaagatacatttgaagctttgaaacgaaacagaatgctgatgattcaacgctatgtggaagttagccctgccacagaaagacagtgggtagctgctggaggccatatcacttttaagcaaaatatgggaccttctggacaaactcatccccctcctcagacacttcccaggtcaaaatcgcccagtgggcagaaaagatcaaggtcaagatcaccacatgaggctggtttttgtgtttacttgaaagggctaccatttgaagcagaaaacaaacatgtcattgatttttttaaaaagctggatattgtggaagatagtatttatatagcttatggacccaatgggaaagcaactggcgaaggctttgtagagttcagaaatgaggctgactataaggctgctctgtgtcgtcataaacagtacatgggcaatcgctttattcaagttcatccaattactaagaaaggtatgctagaaaagatagatatgattcgaaaaagactgcagaacttcagctatgaccagagggaaatgatactaaatccagagggggatgtcaactctgccaaagtctgtgcccacataacaaatattccattcagcattacaaagatggatgttcttcagttcctagaaggaatcccagtggatgaaaatgctgtacatgttcttgttgataacaatgggcaaggtctaggacaggcattggttcagtttaaaaatgaagatgatgcacgtaagtctgaacgcttacaccgtaaaaaacttaatgggagagaagcttttgttcatgtagttaccctagaagatatgagagagattgagaaaaatccccctgcccaaggaaaaaagggattaaagatgcctgtgccaggtaatcctgcagttccaggaatgcccaatgcgggactgcccggtgtgggactgcccagtgcaggacttcccggtgcaggcctgcccagcacaggactgcctggttcagcaataaccagtgcaggactgcctggtgcgggaatgcccagtgcaggaatacctagtgcaggaggtgaagagcatgccttcctgactgtaggatcaaaggaagccaataatgggcctccatttaactttcctggtaattttggtggatcaaatgcctttgggccaccaatccctcctccaggattaggaggcggggcctttggtgatgctaggcctggtatgccttcagttggaaacagtggtttgcctggtctaggactggatgttccgggttttggaggtggaccaaacaatttaagtgggccatcgggatttggagggggccctcagaattttggaaatggccctggtagcttaggcggtcccccggggtttggaagtggccctcctggtcttggaagtgcccctgggcatttgggtgggccaccagcttttgggcctggccccggccccggccccggccctggcccaatccatattggtggtccccctggctttgcatctagttctggaaaaccaggaccgacagtaattaaagtgcaaaacatgccctttactgtgtctattgatgagattttagatttcttttatggctatcaagtaatcccaggctcagtgtgtttaaaatacaatgaaaaaggtatgcccacaggtgaagccatggtggcctttgagtctcgggatgaagccacagctgctgtcattgacttaaatgacaggcctataggttcaagaaaagtaaaacttgtattagggtagccattcacatcattttttatagggtagatcttcatattgctgtgattaatgcatccagattgttttcctagtatttccaggttagaacctgtggattgtttcaattgcatatagcttggtttccataacatagagcattggttgactgtttacagaagactcactcaccaggataaacattgctgtatgttacagtaaagctatctggagagaacacataaatgattttggcataccattagagaaaccatttgtaaaactcaaatgaccacataaagcttatcaaggagtctagattggttttgttttataccatatgggatgaagaaaatagaaatgtcagtagaactcattgagggtgctcttgccagctgctgaaaatagaagttggctactctcagaatttggtttaaagctggacagatttgctttgttatagggtaaagctttgtctaaagtcctcattttcttttaaaattgaataaaatttctgtatacagattcattgtatgtacctttattgcttcttaagggtccttgctgtatagacagtcctgcttcagaagttgctgctttgtttgtctaattgactcatttgtaaatgagcagaactgttttgttggtttttttccctaaatataaaagtccacacttcgtttgtgctataacctcaaactttgatttctaatgtcacacttaaaactgtgtggaataagacttttgccataaaaataaactatggagtcctttatctaccagagcctttttggtttgaccgccacgatttaggttagtcagtttaaaaattgttcatgttgtttggatggtatcgaaaaccagaaaccacttttaataatgtgtttaagatacttgatttgaagtccttttcatatggactaattgtagtatcaatttcctcctgtcccgattatgtgaaattttggcctttaaacaaagaggggcccattcataagaaagtgttatatctaggtttttaaaactgaagttgaaattatctttgttagcagtagtagtatagaataaaagatccgtatgctggttcgtagattgatacgtgttagtcctgttatttggaggctttttggcatagttgttcgatcaggagcctgtttactaaaagtcttcatacagagtacaagtgcagccgccagaggagaaaattgagattcttgaccctttcatactcttttctttggtattcaggacactaaggcaggaggaccacatgagttctggttggtaagtgtccttgtcatgaaaacacttgccttacaaggctctaattatgatttccctagtcagtgctctgaagatgtgtcacattatattataaacaatacggaaggggagataggtgagatgatatgaaaaacaaattttctcactgtcataaaaggctctaattatggttactttccttgtgatgaaaaacttggccttacagggctctagttatggttactttccctagtcaatgctctgaaaatgtgtcacattataaacaatacagaaggagagatagatgagagatcatgaaaaccaaattttatcttttacatggcccctttgtcttcgtttgaaacatccccaacatttcctacaaatcagcgtagttacaaaggggtcagtcttttaaaataagtatttcctattaaactatatatatatacagtgcctttttggtgttgtgagtcagtggaacactgaaatacagcggttgtgtaatttaagagtggcaacagtttcatttgataagatttgaaaaggctttttatcactacaatcttagaggattgacagtacaggatttttgtttaagagaaggattgtttagactcaagaggtgactatgttgtgggtcttttgataattcatgaatacagatttgctttgaccgatcactagatactgcctcctcaatttcaaaagcaatataacgtttgtatatgctgtttaatttaagttaatgttaagtaatcatttctcattccaaagacaatgcaaaaaacttcagcactgcttgagagttgtatttcagccacagatattttctccattggaaagctattttcattttagaaaaatgggttgtttgaagatgaaagtcttttatcttttttcacaatttattttggttatatgttcgtacattcttattaaatatttcatacactttattgcaactactttgttatttctacatcttagataaatgctgaaaaggaaaacgatttcattgttcatctaattaaataaattaaaagagcggtttgtgtagaaattggagagaactatgttttatatgaatcacaacagtgctcgttgtggactgtaattaaatgctttgccctctggaacttgatttttgtgtatctgagatttattaacagtgctaactgctaaggatactgtttatcttgttctgggcattggagtttcagtttttaaaaaattcttgaaaatgtattctgtgaaactactcatacctctcttcctgcgaattttctcctaagaactaggtttggggtagaaatgaattgacattattttctcatttgctttgtatggtatgaaggatttgtaaagctttgctcaaagttgtgtgcatttgtaaacactatcatgatattttcaattttatgtgtaaattttattgtctgtttttggtgactctgacattaatggaagagaatattttccattagatttaattttttttcctctcccttctgattttttttttattggtgttcatttttcttttgatttaaaggattagagaaatctacaaatgtatgtcataaataagcaaatttgtaaacttttctgaactttagtgaaacatttagttcacaagcataatttggaggtgtgttctgtgtttacacagtagtttggatgtacaattattattagtggctttttaaaaaatgaaacagtgttaagtgaaatgtagttcctagctttgtactccaagttgtcaaagcatcaacaatgaaaattcgattaggaaactttatttaaaatttcaggtagtaatattcagtgtagttaaggccagtcttaacccactggatgaaaatctaggactgtatggaagtaagcaaacattacatttttaggtggaaatagtcagccttgcataaaaacaaggatgcgtgaaagccttaaattccagctcccttttactggagtctgtggttgtgtacaggtatgggccaagtgtaaaatctcatcaattttaagaacactcgggaaatgagtaaagaaaatgtaaaattgctgctagtcaaatcttttggaaagaatttctggaagtggtcactttaaaaattattttccacccttgcaaaattgccacatttaaattgttttactggcagttctatagtagtccagactttagaaaccaaacacaacaaaatggcttgttgccaatatggccacaacattgccagcaaatactgccttggcatcactcagcagaggtttttgtttataaagatgaagtcttgaatactgttcaataaacttgtcaaaaaataaaacaggctgatgcttttaatgctttaactgca

SEQ ID NO: 1940 - DNA, 1068 bp, Homo sapiens
cggcgaaggaggtggtggctgcgttgggctccgggaagccgttcgggctggggctgtcggccgcggggcggaggcactcgcgcgggggtctaaaagttggttttaattggttgcccacaggattgacttggcctctacttcttgttaaggaaattcatctcttgttttatcaggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactgggtgaggctttcatcgtttttgccactgatgaagatgcaaggcttggtatgatgcgcacaggtggtacaattaaagggtcaaaagtaacactattgttgagtagtaagacggaaatgcagaatatgattgaactgagtcgtaggcgttttgaaactgccaacttagatataccaccagcaaatgccagtagatcaggaccaccacctagctcaggaatgagtagcagggtaaacttgcccacaacagtatccaactttaataatccatcacccagtgtagttactgccaccacttctgttcatgaaagcaacaaaaacatacagacattttccacagccagcgtaggaacagctcctccaaatatgggggcttcctttgggagcccaacgtttagctcaactgttccaagcacagcctctccaatgaacacagtcccgccgccaccaattcctccaattccagcgatgccatctctgccaccaatgccatccattcccccaattccagttcctcctccagtacctacattgcctcctgtgcctcctgtgcccccgattcccccagttccttctgtgccacccatgaccccactgccacccatgtcgggcatgccgcccttgaatccgccacctgtggcacctctacctgctggaatgaatggctctggagcacctatgaatttgaacaataatctgaatcctatgtttcttggtccgttgaatcctgttaaccctatccagatgaactctcag

SEQ ID NO: 1941 - DNA, 583 bp, Homo sapiens
aaccacgccgttcctcccccttctggaacgcggagccgctgagcgggccgacggccattttgtgaagcggcgaaggaggattgacttggcctctacttcttgttaaggaaattcatctcttgttttatcaggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactgggtgaggctttcatcgtttttgccactgatgaagatgcaaggcttggtatgatgcgcacaggtggtacaattaaagggtcaaaagtaacactattgttgagtagtaagacggaaatgcagaatatgattgaactgagtcgtaggcgttttgaaactgccaacttagatataccaccagcaaatgccagtagatcaggaccaccacctagctcaggaatgagtagcagggtaaacttgcccacaacagtatccaactttaataatccatcacccagtgtagttactgccaccacttctgttcatgaaagca

SEQ ID NO: 1942 - DNA, 565 bp, Homo sapiens
ctggaacgcggagccgctgagcgggccgacggccattttgtgaagcggcgaaggagtctaaaagttggttttaattggttgcccacaggattgacttggcctctacttcttgttaaggaaattcatctcttgttttatcaggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactgggtgaggctttcatcgtttttgccactgatgaagatgcaaggcttggtatgatgcgcacaggtggtacaattaaagggtcaaaagtaacactattgttgagtagtaagacggaaatgcagaatatgattgaactgagtcgtaggcgttttgaaactgccaacttagatataccaccagcaaatgccagtagatcaggaccaccacctagctcaggaatgagtagcagggtaaacttgcccacaacagtatccaactttaataatccatcacccagtgtagtt

SEQ ID NO: 1943 - DNA, 2601 bp, Homo sapiens
ggcgcatgcgcagattggggaaggttctggaagacggcagagctgccgccattttgcgggaagaggaggctctgtacctgcagtgctgcttttcttgcctagactctaggaactatccgagctccactccccacaacatactcaaaggaacggagagaaccgggacccccctgcggggacccggaactgatctgacaggatggcatctgatgactttgacatagtgattgaggccatgctggaagctccctataaaaaagaagaggatgagcaacaaaggaaagaagttaaaaaggattatcctagcaataccaccagcagcaccagcaacagtggcaatgagaccagtggaagcagcaccatcggggagacaagcaagaagaagaggagtcggagccataataaaagcagggatagaaagcgcagtcgtagtcgagatcgggatcggtatagacggagaaatagtcggagccgaagtccaggtcggcagtgtcgtccgtagccgtagctgggatcgtcgacatggtagtgagtcgcgaagtcgggaccatcgtcgtgaggatcgtgtgcattacaggagtcctccacttgccactggttataggtatggacacagtaagagtcctcatttcagagagaagagcccagtcagggagccagttgataatctgagtcctgaggagcgtgatgcccgcacagttttctgtatgcagttagctgcccgaattcggcctcgagatctggaggactttttctctgctgtaggcaaggttcgcgatgtacgtatcatctcagatcggaactcacgtcgttctaagggcattgcctacgtggaattctgtgaaatccagtctgtgccactggccattgggctgactgggcagcggttgctgggagtgcctatcattgtacaggcttcacaggcagagaaaaaccgactggcagccatggccaacaacctgcaaaagggcaatggtggaccaatgcgcctctatgtgggttccctgcacttcaatatcactgaagacatgctccggggcatctttgagccctttggtaaaattgataatattgtcctgatgaaggactcagatacaggccgctctaaaggttatggtttcatcacgttctctgattctgagtgtgcccggcgggccctggaacagttgaatgggtttgagcttgctggtcgacctatgagggttggccatgtgactgagcgactggatggtggcacagacatcacttttcctgatggggaccaggagctggatctgggatcagcaggtggacgttttcagctcatggcaaaactggcagaaggcgctggaatccaactgccaagcactgctgctgctgctgctgccgccgccgcccaggctgctgccttgcaactgaatggagcagttcccttgggggccctgaatccagcagctctgactgctctgagtccagccctgaaccttgcctcccagtgtttccagctctccagcctctttaccccccagaccatgtaaatcagtggcacagtatactgcctccttgtgcctctggatcctgccacttcacatctactcttccatggccccatttctccattttgtggaccaagccatcctgagggcatggacattgtctctgaggaaattggggccacccttaagataccaagaaaagctcctgcccatggtcccactggaaatggactctgctgagcaaagccaccagttgaagagaacagaatccacacctgcattgaatacctgtttctccatgtgtatcgtctctgagattaccttcttgccctttccaacaccttagtgattcctcaatttctcccccattgggaaggccatagggcatactgaaggaactgacctctctccttttcctgtacctttaacctttagtctgtcaaggaaaacccttaggacctctgaatcaagaggactgagtttgtgggtgaaccttgaaggtgctctttctgctacaagggccctgggagatagcatggacgtgcattgagaagccagcctcagaccttagcttgaagcagcttgaggccagacctactgtagcctcagcatcttgctaggaggcatggaagtgatctatcctgccaggaggcctcagagtgatctgtcctgccaggaggtgtgagagtgatctgtcctgtgaggcatttaggggctttcaggaatttagtaaaaggtggagtatgcctttccagtatcttccatcttcctttgtatacttgtccttcctcccatttcctccctttggcccgaggtaggaggatggagggaggctgctactctaccacttcctgtgtgcctctactgtggcctcaaccctggcaattatagctactcccatcccttacctgggcatgtgtgagcccttctcactggattttatacccttgtgtctgtgtacataaatatatatacatatatatatacataaaaactttgtacaaaaggcaagcctcctccttgtggcagctgttgcccatttgtgtgtggtctttgttgtgtgtctgacaacttctcattagcccaacttatgatgtttctagggatataaaacattagtaacatc

SEQ ID NO: 1944 - DNA, 2361 bp, Homo sapiens
gcagattggggaaggttctggaagacggcagagctgccgccattttgcgggaagaggaggctctgtacctgcagtgctgcttttcttgcctagactctaggaactatccgagctccactccccacaacatactcaaaggaacggagagaaccgggacccccctgcggggacccggaactgatctgacaggatggcatctgatgactttgacatagtgattgaggccatgctggaagctccctataaaaaagaagaggatgagcaacaaaggaaagaagttaaaaaggattatcctagcaataccaccagcagcaccagcaacagtggcaatgagaccagtggaagcagcaccatcggggagacaagcaatcgtagtcgagatcgggatcggtatagacggagaaatagtcggagccgaagtccaggtcggcagtgtcgtcaccgtagccgtagctgggatcgtcgacatggtagtgagtcgcgaagtcgggaccatcgtcgtgaggatcgtgtgcattacaggagtcctccacttgccactggggagccagttgataatctgagtcctgaggagcgtgatgcccgcacagttttctgtatgcagttagctgcccgaattcggcctcgagatctggaggactttttctctgctgtaggcaaggttcgcgatgtacgtatcatctcagatcggaactcacgtcgttctaagggcattgcctacgtggaattctgtgaaatccagtctgtgccactggccattgggctgactgggcagcggttgctgggagtgcctatcattgtacaggcttcacaggcagagaaaaaccgactggcagccatggccaacaacctgcaaaagggcaatggtggaccaatgcgcctctatgtgggttccctgcacttcaatatcactgaagacatgctccggggcatctttgagccctttggtaaaattgataatattgtcctgatgaaggactcagatacaggccgctctaaaggttatggtttcatcacgttctctgattctgagtgtgcccggcgggccctggaacagttgaatgggtttgagcttgctggtcgacctatgagggttggccatgtgactgagcgactggatggtggcacagacatcacttttcctgatggggaccaggagctggatctgggatcagcaggtggacgttttcagctcatggcaaaactggcagaaggcgctggaatccaactgccaagcactgctgctgctgctgctgccgccgccgcccaggctgctgccttgcaactgaatggagcagttcccttgggggccctgaatccagcagctctgactgctctgagtccagccctgaaccttgcctcccagtgtttccagctctccagcctctttaccccccagaccatgtaaatcagtggcacagtatactgcctccttgtgcctctggatcctgccacttcacatctactcttccatggccccatttctccattttgtggaccaagccatcctgagggcatggacattgtctctgaggaaattggggccacccttaagataccaagaaaagctcctgcccatggtcccactggaaatggactctgctgagcaaagccaccagttgaagagaacagaatccacacctgcattgaatacctgtttctccatgtgtatcgtctctgagattaccttcttgccctttccaacaccttagtgattcctcaatttctcccccattgggaaggccatagggcatactgaaggaactgacctctctccttttcctgtacctttaacctttagtctgtcaaggaaaacccttaggacctctgaatcaagaggactgagtttgtgggtgaaccttgaaggtgctctttctgctacaagggccctgggagatagcatggacgtgcattgagaagccagcctcagaccttagcttgaagcagcttgaggccagacctactgtagcctcagcatcttgctaggaggcatggaagtgatctatcctgccaggaggcctcagagtgatctgtcctgccaggaggtgtgagagtgatctgtcctgtgaggcatttaggggctttcaggaatttagtaaaaggtggagtatgcctttccagtatcttccatcttcctttgtatacttgtccttcctcccatttcctccctttggcccgaggtaggaggatggagggaggctgctactctaccacttcctgtgtgcctctactgtggcctcaaccctggcaattatagctactcccatcccttacctgggcatgtgtgagcccttctcactggattttatacccttgtgtctgtgtacataaatatatatacatatatatatacataaaaac

SEQ ID NO: 1945 - DNA, 2601 bp, Homo sapiens
gcatgcgcagattggggaaggttctggaagacggcagagctgccgccattttgcgggaagaggaggctctgtacctgcagtgctgcttttcttgcctagactctaggaactatccgagctccactccccacaacatactcaaaggaacggagagaaccgggacccccctgcggggacccggaactgatctgacaggatggcatctgatgactttgacatagtgattgaggccatgctggaagctccctataaaaaagaagaggatgagcaacaaaggaaagaagttaaaaaggattatcctagcaataccaccagcagcaccagcaacagtggcaatgagaccagtggaagcagcaccatcggggagacaagcaagaagaagaggagtcggagccataataaaagcagggatagaaagcgcagtcgtagtcgagatcgggatcggtatagacggagaaatagtcggagccgaagtccaggtcggcagtgtcgtcaccgtagccgtagctgggatcgtcgacatggtagtgagtcgcgaagtcgggaccatcgtcgtgaggatcgtgtgcattacaggagtcctccacttgccactggttataggtatggacacagtaagagtcctcatttcagagagaagagcccagtcagggagccagttgataatctgagtcctgaggagcgtgatgcccgcacagttttctgtatgcagttagctgcccgaattcggcctcgagatctggaggactttttctctgctgtaggcaaggttcgcgatgtacgtatcatctcagatcggaactcacgtcgttctaagggcattgcctacgtggaattctgtgaaatccagtctgtgccactggccattgggctgactgggcagcggttgctgggagtgcctatcattgtacaggcttcacaggcagagaaaaaccgactggcagccatggccaacaacctgcaaaagggcaatggtggaccaatgcgcctctatgtgggttccctgcacttcaatatcactgaagacatgctccggggcatctttgagccctttggtaaaattgataatattgtcctgatgaaggactcagatacaggccgctctaaaggttatggtttcatcacgttctctgattctgagtgtgcccggcgggccctggaacagttgaatgggtttgagcttgctggtcgacctatgagggttggccatgtgactgagcgactggatggtggcacagacatcacttttcctgatggggaccaggagctggatctgggatcagcaggtggacgttttcagctcatggcaaaactggcagaaggcgctggaatccaactgccaagcactgctgctgctgctgctgccgccgccgcccaggctgctgccttgcaactgaatggagcagttcccttgggggccctgaatccagcagctctgactgctctgagtccagccctgaaccttgcctcccagtgtttccagctctccagcctctttaccccccagaccatgtaaatcagtggcacagtatactgcctccttgtgcctctggatcctgccacttcacatctactcttccatggccccatttctccattttgtggaccaagccatcctgagggcatggacattgtctctgaggaaattggggccacccttaagataccaagaaaagctcctgcccatggtcccactggaaatggactctgctgagcaaagccaccagttgaagagaacagaatccacacctgcattgaatacctgtttctccatgtgtatcgtctctgagattaccttcttgccctttccaacaccttagtgattcctcaatttctcccccattgggaaggccatagggcatactgaaggaactgacctctctccttttcctgtacctttaacctttagtctgtcaaggaaaacccttaggacctctgaatcaagaggactgagtttgtgggtgaaccttgaaggtgctctttctgctacaagggccctgggagatagcatggacgtgcattgagaagccagcctcagaccttagcttgaagcagcttgaggccagacctactgtagcctcagcatcttgctaggaggcatggaagtgatctatcctgccaggaggcctcagagtgatctgtcctgccaggaggtgtgagagtgatctgtcctgtgaggcatttaggggctttcaggaatttagtaaaaggtggagtatgcctttccagtatcttccatcttcctttgtatacttgtccttcctcccatttcctccctttggcccgaggtaggaggatggagggaggctgctactctaccacttcctgtgtgcctctactgtggcctcaaccctggcaattatagctactcccatcccttacctgggcatgtgtgagcccttctcactggattttatacccttgtgtctgtgtacataaatatatatacatatatatatacataaaaactttgtacaaaaggcaagcctcctccttgtggcagctgttgcccatttgtgtgtggtctttgttgtgtgtctgacaacttctcattagcccaacttatgatgtttctagggatataaaacattagtaacatca

SEQ ID NO: 1946 - DNA, 2430 bp, Homo sapiens
atgcgcagattggggaaggttctggaagacggcagagctgccgccattttgcgggaagaggaggctctgtacctgcagtgctgcttttcttgcctagactctaggaactatccgagctccactccccacaacatactcaaaggaacggagagaaccgggacccccctgcggggacccggaactgatctgacaggatggcatctgatgactttgacatagtgattgaggccatgctggaagctccctataaaaaagaagaggatgagcaacaaaggaaagaagttaaaaaggattatcctagcaataccaccagcagcaccagcaacagtggcaatgagaccagtggaagcagcaccatcggggagacaagcaatcgtagtcgagatcgggatcggtatagacggagaaatagtcggagccgaagtccaggtcggcagtgtcgtcaccgtagccgtagctgggatcgtcgacatggtagtgagtcgcgaagtcgggaccatcgtcgtgaggatcgtgtgcattacaggagtcctccacttgccactggttataggtatggacacagtaagagtcctcatttcagagagaagagcccagtcagggagccagttgataatctgagtcctgaggagcgtgatgcccgcacagttttctgtatgcagttagctgcccgaattcggcctcgagatctggaggactttttctctgctgtaggcaaggttcgcgatgtacgtatcatctcagatcggaactcacgtcgttctaagggcattgcctacgtggaattctgtgaaatccagtctgtgccactggccattgggctgactgggcagcggttgctgggagtgcctatcattgtacaggcttcacaggcagagaaaaaccgactggcagccatggccaacaacctgcaaaagggcaatggtggaccaatgcgcctctatgtgggttccctgcacttcaatatcactgaagacatgctccggggcatctttgagccctttggtaaaattgataatattgtcctgatgaaggactcagatacaggccgctctaaaggttatggtttcatcacgttctctgattctgagtgtgcccggcgggccctggaacagttgaatgggtttgagcttgctggtcgacctatgagggttggccatgtgactgagcgactggatggtggcacagacatcacttttcctgatggggaccaggagctggatctgggatcagcaggtggacgttttcagctcatggcaaaactggcagaaggcgctggaatccaactgccaagcactgctgctgctgctgctgccgccgccgcccaggctgctgccttgcaactgaatggagcagttcccttgggggccctgaatccagcagctctgactgctctgagtccagccctgaaccttgcctcccagtgtttccagctctccagcctctttaccccccagaccatgtaaatcagtggcacagtatactgcctccttgtgcctctggatcctgccacttcacatctactcttccatggccccatttctccattttgtggaccaagccatcctgagggcatggacattgtctctgaggaaattggggccacccttaagataccaagaaaagctcctgcccatggtcccactggaaatggactctgctgagcaaagccaccagttgaagagaacagaatccacacctgcattgaatacctgtttctccatgtgtatcgtctctgagattaccttcttgccctttccaacaccttagtgattcctcaatttctcccccattgggaaggccatagggcatactgaaggaactgacctctctccttttcctgtacctttaacctttagtctgtcaaggaaaacccttaggacctctgaatcaagaggactgagtttgtgggtgaaccttgaaggtgctctttctgctacaagggccctgggagatagcatggacgtgcattgagaagccagcctcagaccttagcttgaagcagcttgaggccagacctactgtagcctcagcatcttgctaggaggcatggaagtgatctatcctgccaggaggcctcagagtgatctgtcctgccaggaggtgtgagagtgatctgtcctgtgaggcatttaggggctttcaggaatttagtaaaaggtggagtatgcctttccagtatcttccatcttcctttgtatacttgtccttcctcccatttcctccctttggcccgaggtaggaggatggagggaggctgctactctaccacttcctgtgtgcctctactgtggcctcaaccctggcaattatagctactcccatcccttacctgggcatgtgtgagcccttctcactggattttatacccttgtgtctgtgtacataaatatatatacatatatatatacataaaaactttgtacaaaa

SEQ ID NO: 1947 - DNA, 268 bp, Homo sapiens
gaaaaaactaccagcctgaaaatgcatagtgtttgctaccttattgcttttagcacatctagaaagacactaaacccaatctgacaggatggcatctgatgactttgacatagtgattgaggccatgctggaagctccctataaaaaagaagaggatgagcaacaaaggaaagaagttaaaaaggattatcctagcaataccaccagcagcaccagcaacagtggcaatgagaccagtggaagcagcaccatcggggagacaagcaag

SEQ ID NO: 1948 - DNA, 581 bp, Homo sapiens
attttgcgggaagaggaggctctgtacctgcagtgctgcttttcttgcctagactctaggaactatccgagctccactccccacaacatactcaaaggaacggagagaaccgggacccccctgcggggacccggaactgatctgacaggatggcatctgatgactttgacatagtgattgaggccatgctggaagctccctataaaaaagaagaggatgagcaacaaaggaaagaagttaaaaaggattatcctagcaataccaccagcagcaccagcaacagtggcaatgagaccagtggaagcagcaccatcggggagacaagcaagaagaagaggagtcggagccataataaaagcagggatagaaagcgcagtcgtagtcgagatcgggatcggtatagacggagaaatagtcggagccgaagtccaggtcggcagtgtcgtcaccgtagccgtagctgggatcgtcgacatggtagtgagtcgcgaagtcgggaccatcgtcgtgaggatcgtgtgcattacaggagtcctccacttgccactggggagccagttgataatctgagtcctgaggag

SEQ ID NO: 1949 - DNA, 588 bp, Homo sapiens
agagctgccgccattttgcgggaagaggaggctctgtacctgcagtgctgcttttcttgcctagactctaggaactatccgagctccactccccacaacatactcaaaggaacggagagaaccgggacccccctgcggggacccggaactgagtcttggtctgtcacccaacctggagtgcaatggtgccatctcggctggctgcaacttccgcctcccgggttcaagcaattctcctgtctcagcctcccaggctggagcacagtggcgcgttctcggctcattgcaacctccacctcctgggttcaagcagttcttatgccacagccttccaagcagctgggactacagatctgacaggatggcatctgatgactttgacatagtgattgaggccatgctggaagctccctataaaaaagaagaggatgagcaacaaaggaaagaagttaaaaaggattatcctagcaataccaccagcagcaccagcaacagtggcaatgagaccagtggaagcagcaccatcggggagacaagcaagaagaagaggagtcggagccataataaaagcagggatagaaagcgcag

SEQ ID NO: 1950 - DNA, 583 bp, Homo sapiens
agagctgccgccattttgcgggaagaggaggctctgtacctgcagtgctgcttttcttgcctagactctaggaactatccgagctccactccccacaacatactcaaaggaacggagagaaccgggacccccctgcggggacccggaactgatggaatcttgctctgtcacccaggctggagcacagtggcgcgttctcggctcattgcaacctccacctcctgggttcaagcagttcttatgccacagccttccaagcagctgggactacagatctgacaggatggcatctgatgactttgacatagtgattgaggccatgctggaagctccctataaaaaagaagaggatgagcaacaaaggaaagaagttaaaaaggattatcctagcaataccaccagcagcaccagcaacagtggcaatgagaccagtggaagcagcaccatcggggagacaagcaatcgtagtcgagatcgggatcggtatagacggagaaatagtcggagccgaagtccaggtcggcagtgtcgtcaccgtagccgtagctgggatcgtcgacatggtagtgagtcgcgaagtcgg

SEQ ID NO: 1951 - DNA, 571 bp, Homo sapiens
attacaggtgtgtgccaccacacccagctaatttttatatttttggtagagggggtttcgccatgttggccaggctggtctcaaactcctgacctcaggtgatctgcctgccttgccctcccagagtgctaggattacaggtgtgagccactgcgcccggactatccttgactgttccaagccacaaagtcgaactagttcagatctatagggtgtaaaaataaacctagagtaagtgacagctggtaaggtttctttgcagttcaagaaacagaactgaaatctgtatatcctgaagtctctttcttggagtgggaaagaaatgtgtggtgctggaaagggaggaaaaatataaaacagattcttacatattaatatcctctccccagatctgacaggatggcatctgatgactttgacatagtgattgaggccatgctggaagctccctataaaaaagaagaggatgagcaacaaaggaaagaagttaaaaaggattatcctagcaataccaccagcagcaccagcaacagtggcaatgagaccagtggaagcagcaccatcggggaga

SEQ ID NO: 1952 - DNA, 569 bp, Homo sapiens
aagacggcagagctgccgccattttgcgggaagaggaggctctgtacctgcagtgctgcttttcttgcctagactctaggaactatccgagctccactccccacaacatactcaaaggaacggagagaaccgggacccccctgcggggacccggaactgatggaatcttgctctgtcacccaggctggagcacagtggcgcgttctcggctcattgcaacctccacctcctgggttcaagcagttcttatgccacagccttccaagcagctgggactacagatctgacaggatggcatctgatgactttgacatagtgattgaggccatgctggaagctccctataaaaaagaagaggatgagcaacaaaggaaagaagttaaaaaggattatcctagcaataccaccagcagcaccagcaacagtggcaatgagaccagtggaagcagcaccatcggggagacaagcaagaagaagaggagtcggagccataataaaagcagggatagaaagcgcagtcgtagtcgagatcgggatcggtatagacggagaaatagtcggagccgaag

SEQ ID NO: 1953 - DNA, 457 bp, Homo sapiens
agagctgccgccattttgcgggaagaggaggctctgtacctgcagtgctgcttttcttgcctagactctaggaactatccgagctccactccccacaacatactcaaaggaacggagagaaccgggacccccctgcggggacccggaactggctggagcacagtggcgcgttctcggctcattgcaacctccacctcctgggttcaagcagttcttatgccacagccttccaagcagctgggactacagatctgacaggatggcatctgatgactttgacatagtgattgaggccatgctggaagctccctataaaaaagaagaggatgagcaacaaaggaaagaagttaaaaaggattatcctagcaataccaccagcagcaccagcaacagtggcaatgagaccagtggaagcagcaccatcggggagacaagcaatcgtagtcgagatcgggat

SEQ ID NO: 1954 - DNA, 582 bp, Homo sapiens
agagctgccgccattttgcgggaagaggaggctctgtacctgcagtgctgcttttcttgcctagactctaggaactatccgagctccactccccacaacatactcaaaggaacggagagaaccgggacccccctgcggggacccggaactgggtcacacattgctgcccaggctggagtacagtggcgtgatcttggctcactgcaacctccaccttttgggttcaagtgattctcctgcctcagcctcctgagtagctgggattacagatctgacaggatggcatctgatgactttgacatagtgattgaggccatgctggaagctccctataaaaaagaagaggatgagcaacaaaggaaagaagttaaaaaggattatcctagcaataccaccagcagcaccagcaacagtggcaatgagaccagtggaagcagcaccatcggggagacaagcaatcgtagtcgagatcgggatcggtatagacggagaaatagtcggagccgaagtccaggtcggcagtgtcgtcaccgtagccgtagctgggatcgtcgacatggtagtgagtcgcgaagtcgggac

SEQ ID NO: 1955 - DNA, 573 bp, Homo sapiens
agagctgccgccattttgcgggaagaggaggctctgtacctgcagtgctgcttttcttgcctagactctaggaactatccgagctccactccccacaacatactcaaaggaacggagagaaccgggacccccctgcggggacccggaactggccgggctcggtggctcatgtctgtaatcccagccctttgggaggaccaggcaggcggatcacctgaggtcaggagttcgagaccagcctgaccaatgtggagaaaccccgtctctgctaaaaatacaacattagccagatctgacaggatggcatctgatgactttgacatagtgattgaggccatgctggaagctccctataaaaaagaagaggatgagcaacaaaggaaagaagttaaaaaggattatcctagcaataccaccagcagcaccagcaacagtggcaatgagaccagtggaagcagcaccatcggggagacaagcaatcgtagtcgagatcgggatcggtatagacggagaaatagtcggagccgaagtccaggtcggcagtgtcgtcaccgtagccgtagctgggatcgt

SEQ ID NO: 1956 - DNA, 1488 bp, Homo sapiens
agctgcagtctgggagtctttggagtaagaatggccttggaagggatgagcaaacggaagagaaagagaagtgtccaggagggagagaatcctgacgacggcgttcgcgggagtccgccggaagactacaggcttggacaggtcgccagtagcttatttcgcggcgaacaccattccagaggtggcaccggtcggctggcgtccctcttcagttctctggagccccagattcaacccgtgtacgtgcctgtgcctaaacaaaccatcaaaaaaacgaaacggaatgaggaggaagaaagtacatcccagattgaaagaccactttcgcaagaacctgccaaaaaagtgaaagcgaagaagaaacacactaacgcagaaaaaaagttggcagacagttctcctttcagattgatgctcagaccttgcttatccatatccagcaatactttatattgtatttaccgtttcacaatttacttttgggaaagcgctctagcgagtgctgatttagaagaagaaattcaccagaaacaagggcagaaaaggaaaaattctcaacctggtgttaaagtagcagatagaaaaatacttgatgacacagaagacacagttgtcagtcaaagaaagaaaattcaaatcaaccaagaagaagagagattaaagaatgagagaactgtgtttgttgggaatttgcctgttacatgtaataagaagaagctgaagtcgttttttaaagagtatggacaaatagaatctgtacgatttcgttctctgattccagcagagggaacgctatccaaaaagttggcagcaataaaacgtaaaattcatcctgatcagaaaaatattaatgcctatgttgtgtttaaggaggagagtgctgccacgcaagcattgaaaagaaatggggcccagattgcagatggatttcgtattagagttgatctcgcatctgagacctcatctagagacaagagatcggtttttgtggggaatctcccttataaagttgaagaatctgccattgagaagcactttctggactgtggaagtatcatggccgtgaggattgtgagagacaaaatgacaggcatcggcaaagggtttggctatgtgctctttgagaatacagattctgttcatcttgctctgaaattaaataattctgaactcatggggagaaaactcagagtcatgcgttctgttaataaagaaaaatttaaacaacaaaattcaaatccacgattgaagaatgtcagtaaacctaagcagggacttaattttacttccaaaactgcagaaggacatcctaaaagcttatttattggagaaaaagctgttctccttaaaacgaagaagaaaggacagaagaaaagtggacgccctaagaaacagagaaaacagaaataacaaccaggaactgctttttcttttcctgctgagtactgctaataaaagtgctattatctgctgatagcatcgtctgct

SEQ ID NO: 1957 - DNA, 2054 bp, Homo sapiens
gcttcaaccactcccagaagacgtccttcactcccaaaatgaggcttttctgaaacggcgaggaccaccaaccgacggcgacaaacctgctccctcacccagcgcctcccttcgccgccgcccggcggccgactgccggaggggagggggcgtggccagagagcggaagtgcccggaacccggaagtgcgagctggcgcgcagctgcagtctgggagtctttggagtaagaatggccttggaagggatgagcaaacggaagagaaagagaagtgtccaggagggagagaatcctgacgacggcgttcgcgggagtccgccggaagactacaggcttggacaggtcgccagtagcttatttcgcggcgaacaccattccagaggtggcaccggtcggctggcgtccctcttcagttctctggagccccagattcaacccgtgtacgtgcctgtgcctaaacaaaccatcaaaaaaacgaaacggaatgaggaggaagaaagtacatcccagattgaaagaccactttcgcaagaacctgccaaaaaagtgaaagcgaagaagaaacacactaacgcagaaaaaaagttggcagacagggaaagcgctctagcgagtgctgatttagaagaagaaattcaccagaaacaagggcagaaaaggaaaaattctcaacctggtgttaaagtagcagatagaaaaatacttgatgacacagaagacacagttgtcagtcaaagaaagaaaattcaaatcaaccaagaagaagagagattaaagaatgagagaactgtgtttgttgggaatttgcctgttacatgtaataagaagaagctgaagtcgttttttaaagagtatggacaaatagaatctgtacgatttcgttctctgattccagcagagggaacgctatccaaaaagttggcagcaataaaacgtaaaattcatcctgatcagaaaaatattaatgcctatgttgtgtttaaggaggagagtgctgccacgcaagcattgaaaagaaatggggcccagattgcagatggatttcgtattagagttgatctcgcatctgagacctcatctagagacaagagatcggtttttgtggggaatctcccttataaagttgaagaatctgccattgagaagcactttctggactgtggaagtatcatggccgtgaggattgtgagagacaaaatgacaggcatcggcaaagggtttggctatgtgctctttgagaatacagattctgttcatcttgctctgaaattaaataattctgaactcatggggagaaaactcagagtcatgcgttctgttaataaagaaaaatttaaacaacaaaattcaaatccacgattgaagaatgtcagtaaacctaagcagggacttaattttacttccaaaactgcagaaggacatcctaaaagcttatttattggagaaaaagctgttctccttaaaacgaagaagaaaggacagaagaaaagtggacgccctaagaaacagagaaaacagaaataacaaccaggaactgctttttcttttcctgctgagtactgctaataaaagtgctattatctgctgatagcatcgtctgctattcatgtgttgagttttatacttctttatggatggtgtatgtgaaatgtggagacttccacattctcagtttattcacattgtgatactacctttgaaggtttttttgtttttgttttgttttttgagatggagtttggctgttgtctcccaggctggagtgcagtggcgtgatcttggctcactgcaacctctgccttctgggttcaagcgcttctcctgcctcagcctcccaagtagctgggattacaggcgcctgccaccacgcctggctaattttttgtatttttagtagagacggggtttcaccatgttggccaggctggtctcgaactcctgacctcaggtgatccacctgccttggcctctcaaagtgctgggattacaggcgtgagtcactgcacccaagcctcctttctcttttgcctattaaacctctgctcttaacctta

SEQ ID NO: 1958 - DNA, 667 bp, Homo sapiens
gcagctgcagtctgggagtctttggagtaagaatggccttggaagggatgagcaaacggaagagaaagagaagtgtccaggagggagagaatcctgacgacggcgttcgcgggagtccgccggaagactacaggcttggacaggtcgccagtagcttatttcgcggcgaacaccattccagaggtggcaccggtcggctggcgtccctcttcagttctctggagccccagattcaacccgtgtacgtgcctgtgcctaaacaaaccatcaaaaaaacgaaacggaatgaggaggaagaaagtacatcccagattgaaagaccactttcgcaagaacctgccaaaaaagtgaaagcgaagaagaaacacactaacgcagaaaaaaagttggcagacagttctcctttcagattgatgctcagaccttgcttatccatatccagcaatactttatattgtatttaccgtttcacaatttacttttgggaaagcgctctagcgagtgctgatttagaagaagaaattcaccagaaacaagggcagaaaaggaaaaattctcaacctggtgttaaagtagcagatagaaaaatacttgatgacacagaagacacagttgtcagtcaaagaaagaaaattcaaatcaaccaagaagaagagagattaaagaa

SEQ ID NO: 1959 - DNA, 4192 bp, Homo sapiens
cgggtggaaggaccgcccttttcttcgtagcctccaagggagctggaacaaaaaacgaaaccaaaacctgcctgctcgctcctctccccatcgcctgcgttccgctggttgtgggctttctgcggccgctgagggcgcgtctcccctccgccatggcatcagttttgaatgtcaaggaatccaaagctcctgaaagaacggttgtagttgctggtcttccagttgacctttttagtgatcaattattggccgtattagtgaagagccacttccaagacattaagaatgagggcggagatgttgaagatgtgatatatccgacaagaaccaagggagttgcatatgtaatattcaaagaaaaaaaagttgcagagaatgtcatcagacaaaagaaacactggctagcaaggaagactagacatgctgaactcacagtctctctcagagtctctcattttggtgacaagatcttcagctctgtaaatgccatccttgatctttctgtttttggaaaagaagttactctagaaactctggtaaaagacctgaaaaaaaaaatcccgagtttaagcttcagtcctttgaaacccaatggaagaatctccgtggaaggatcatttctggctgtcaagaggctcagagaatctttgctagcaagagcatgttctctcttagaaaaagacagaaattttaccagtgaggagagaaagtggaatagacaaaatccccagaggaatctacagagaagtaataactctttggcatcagtcaggaccttagtacctgagactgctagaagtggagaaatgcttgtgcttgacacagatgtttttctttacctgaaacacaagtgtggatcttatgaaagcacactgaaaaaattccacattctgagtcaggagaaagtggatggtgaaatcaccacaatttgtctaaaaagcattcaagttggttctcagccaaacaatgcaaaacatgtaaaagagctcattgaggaatggtcacatgctctttacttaaagcttagaaaagagacatttattttggaaggaaaggaaaatagagagaaaagaatgatcaaaagggcatgtgaacaattaagttcgagataccttgaagtcctgattaacctttataggacacacattgacattataggatcttcttctgacacttacctgtttaaaaaaggggtcatgaaattaatagggcaaaaggttagttaataaaatctcagcaatatagtcataagggctgctttctcttgctgagcagtgaccattgccatgaatgaggctagctttacacaccgtatctcatgaatccttatagtcatccttctttgtcagtgttgactatcctcatgttacagcggaagaaactaggatttggagaagttaaaacacttttctgaagttatccagttgacaaagaatgaggctgtggcttagcccagtctatctgattacacagataatatctaaggaataaaactttgaaaaaaactcaccaaacttttttttttttttttttgagatggagtctcgctctgttgtccaggctggagtgcagtggcgtgatctcggctcactgcaacgtccacctcctgggttcacaccattctcctgcctcaacctctggagtagctgggactacaggtgcccaccaccacgcccggctaatctttttgtatttttttagtagagatggggtttcaccgtgttagtcaggatggtctccatctcctgaccttgtgatccacccgcctcggcctcccaaagtgctgggattacaggcgtgagccactgcgcccagcaaactcaccaaactttgaaggaatcttactttctctgtaactccaaattattagagaataataattattaagaagtagccttaacatatgagaaatttgaaaggtgattattatgccatgggcaatttcttaacatttacagtttgtgtttactccgtgtagaattagaatactggcaaaaatcactggggaaactacttagatggaaagcatatcttatgcaggtaatcattatttgactaaattctattgtttcaaggctgctggccacataggatgtttttactatttttttagcctaagtgcttacataaaatggtgattcttttataattgtgcaagttgataatattaattgagtcattcttgtcacatccaactaaaacagactcaagaagctagggggaaaaagtacttgggacacataatattgctccaagaatgtaattctctgtgagcctggctactgaaactgcttgctgtaacctgagaccagttttgtctatagctgctgagataacttgctgtaactctaggactaattttacctatggccattgcccaccagttggagcttgccagctccccagggctttactaataccaatgaactttctcttaagatcacaagttggccgggcgtggtgactcatacctgtaatcccagcactttgggaggccgaggcgggtggatcacaaggtcaggagattgagaccatcctggctaacatggtaaaaccccatctctactaaaaatacaaaaattagccgggcatggtggtgggcgcctgtagtcccacctactcgggaggctagaggctgaggcaggagaatggcgtgaacccgggaggtggagcttgcagtgagccaagactgcactactgcactccagcctgggtgacagagcgagactccgtctcaaaaaaaaaaaaaaaaaaaaaagaaagaccacaagtaacattcttagttttaaataaaaccctcaaccttctctttgtttgttggacatactaaagatcacctagaattgaaattctttcttctcaaaacattaaatttagttttgtgtctacattttcattttgactttgacatgcatggtgtcagaagtgggatacaaagctgactcacctcatggagaatcattggcctttggagttatggcatgaggtacccatgttggggccctttgaaccccctacacccccaccactttcacaggtaatcctttctccctccagtaagtatctcttggacagaactctcagatatggttcgagttctgttttatttgggatatgattagggagaggtctttccccctcttgtttggtagatctgttgggtagaattattttccccctgttgacctcagctgcgaggtttggaccttgaggcttggatgagggaatttttccctttctttggagaaggcttatcattcttactggtaagcatgtattttattttctgtcctgtcttgtatttatttggcctttgtgtattcagtgcttgcatttacttggcttttgcatagttgacattaaatcagagcacccacgaaatgagctctcaaagttcaaaggcatgccagaatattttctggaactccagctagtaacatattcaaacattacagggatcatttagtctgtttttcttaaaactgaactaaaagatggaggctataaaatcatacactccaaataagatatgcatatttcattgatatcttgaggctaaaaaaaaataaaaacaaaaacaaaacacattcaggatacaaatattgccttgttaaaaaatactgtctcaaaggtggctgaaactttcttttctagacctttcccctccccttcttacagtatcccctctttatccttctctaaacagctattctaacatactacttaaataaaaacacttgaaaaccagcagatataaaacaaagtcattttgaccttcctactgttttttttttaaagcaaagattaaattcccatgtaaaaccttcctccctatacaaaaaagaatagcagcatttttatcttcaatgacaaagaattgagtccaagaaaatactgtataaaccttgttaaaaatcactcttgtcttttggtcctactcacataattcagcacactttcacagttaactattttttgttcaatttagtgcactggtgagtgactcaaactgctttatcccaaatttgatttacagcctttataagattgcctattaaaaaagcttaaagcttatccttagcccattttgtcagaaaaataatttgcatctaatcatttttataaactggtgaatttacgtgttttactatatcatgactaaaattctaaaataaaagttttaatatcttta

SEQ ID NO: 1960 - DNA, 4056 bp, Homo sapiens
agactagacgctgagcgctcccgtgcgcagcgccccacgcagccgggacgcggcgccgctctgcgggtggaaccgccgcgcgctcccggcctcgggagctgagcccgagagaacttcgctgccttcgggtcgccgctcccgctttccactgtggaatgtgcagcttgggatagagagaaaccagggtttggggagcggtcctcctggagactttctctctgcaagtctccaaggttaagcaattctgacccactggaattcccagagcctgggagttaagcctaaaacgctctgttgctttaagcggcgcggtggggagtcgctggacactccttattttggttttacattaaaaagaaggcggacgagaagatgttgtaggtgacttcctagctgtgttaagttgctcctgggctgtgaatggtgttaatttctgaagtgggcggctccaaaaacttaacaaggaaagctcaggtaacggaggccttggaaagagactctgcgtcaggtcacccagcagagatcagcaatccttggctcactgaggaggtttggatttgcctcaaagggcactgcaaaaattgaacagaggaatcccaaggaagctgcctgaatttgcctgtatactctcgttctgcgacttataaaggaccagacaaatcaaattagtggttttggtttccgccagctgtggatgcctttgacattatgaccgcagaggattccaccgcagccatgagcagtgactcggccgccgggtcctccgccaaggtgcccgagggcgtggcgggcgcgcccaacgaggcagcactgctggcgctgatggagcgcacgggctacagcatggtgcaagagaacgggcagcgcaagtacggcggcccaccgcccggctgggagggcccgcacccgcagcgtggctgcgaggtcttcgtgggcaagatcccgcgcgacgtgtacgaggacgagctggtgcccgtgttcgaggccgtgggccgcatctacgagctgcgcctcatgatggactttgacggcaagaaccgcggctacgccttcgtcatgtactgccacaagcacgaggccaagcgcgcagtgcgtgagctcaacaactacgagatccgcccgggccgcctgctcggcgtgtgctgcagcgtggacaactgccgcctcttcatcggcgggatccccaagatgaagaagcgcgaggaaatcctggaggagattgccaaggtcaccgagggcgtgctggacgtgatcgtctacgccagcgcggccgacaagatgaagaaccgcggcttcgccttcgtggagtacgagagccaccgcgcggctgccatggctcgccgcaagctcatgcctggccgcatccagctgtggggccaccagatcgccgtggactgggccgaacctgagatcgacgtggacgaggacgtgatggagaccgtgaagatcctctacgtgcgcaacctcatgatcgagaccaccgaggacaccatcaagaagagcttcggccagttcaaccccggctgcgtggagcgcgtcaagaagatccgcgactacgccttcgtgcacttcaccagccgcgaggatgccgtgcatgccatgaacaacctcaacggcactgagctggagggctcgtgcctggaggtcacgctggccaagcccgtggacaaggagcagtactcgcgctaccagaaggcagccaggggcggcggcgcggctgaggcagcgcagcagcccagctacgtgtactcctgcgacccctacacactggcctactacggctacccctacaacgcgctcattgggcccaacagggactactttgtgaaagcaggcagcataagaggccgagggcgaggtgcagctggcaacagagccccagggcctaggggttcctacctcgggggatattctgctggtcgtggtatatatagccgatatcatgaagggaaaggaaagcagcaagaaaaaggatatgaactggtgccgaatttggaaatccctaccgtcaacccagttgccattaaacctggtacagtagccatccctgccattggggctcagtattccatgtttccagcagctccagcccctaaaatgattgaagatggcaaaatccacacagtggagcacatgatcagccccattgctgtgcagccagacccagccagtgctgctgccgccgcagccgcggccgcagccgccgcagccgctgtcattcccactgtgtcgacgccaccacctttccagggccgcccaataactccagtatacacggtggctccaaacgttcagagaattcctactgccgggatctacggggccagttacgtgccatttgctgctccagctacagccacgatcgccacactacagaagaacgcggcagccgcggccgccatgtatggaggatacgcaggctacatacctcaggccttccctgctgctgccattcaggtccccatccccgacgtctaccagacatactgaggctggtgaccagcacgaagacagaccacacaaacaccactgaaggaacgcttgactatttatgaagaaggaacatgttggattcacacatgcaacctgaaagtgaagaatgttagcagatttatttctgaattattttatatacatgaagttttcactagttttttaagactattttcaacttagcatgcctacgttcatacatttccaaaagacttgcaatggttcgtgccttcattccatcttttaaaaatttgtatgctgtactacatttgtatagaggtttttgttgttgtttttttaaggatatattttcagtatgaaggttattttcttaacttctgcactccagagatttctattttgtagtaccttcaataatatatcaactatatattaaaaaagcacacttgaggagctagggaactattttgaaaaatatatacaatatttaaagatacaaacagtagtgcttaaaaatactacataaagcattattttaaaggttatactggaaagtgcaattttaaaatgagtaaaacctctgtatttctgctggcattaagggttgatggtgttaccatgtatcatcatggcggtactattttttaaaagaaattaaacactggatctctccttaagccaacattgaaaagacttgccgcacttctgagtccaaacactggaaagctctcctttgccaccgttagccggggctcattctccatgtgccttagccttaaacatgcccccactcccacatctctcaccctgtcccctcctccccagattcccaatcccaccgcaatgtttggcaagcctaggactgataagtagctctgatagaggagctggtggcttttatacttcttcctgggtttttgttggggtttgttgtttcgttgttttttgtttttttttttgtttggttggggaagtattgtcttctacgtgtgctattttcagtagcagagtaagcacaaggttttaatcgagttgcataagacacctttgcatagctatttaattgcccaatgtaaaactttaatgccatttctaatgcttttattcatttttgaagtatgagtttgtagggacaaagaatgtatgttatcgtagacaagacccccagagactcttttcagcagaaagttatgcttctagttgccttaccatgtttcttgcaaaactgtccatggtcctcaagggtgttggaaacattatgtttattaaatgggcctctcttcctttgctgtgcacttgatgggtgaactggattggggtgtgcacatccaggaggaggaggagagacctgtagaagtttaaagatagtttgtaaatatcttctaatgcttgtttttagtccttttatgttggagaagttcatggtatgtagtttaatgcaaaatgaaaccattttatttcaatgttattaaaaaggtttgttttattaggaagttaatgtattgttgcagtgttttgtgcctgtttaaaggcttttgtttagcagagtgaatgtaaaatacagtaaaatgttaagattgtcatctactttttaaaaaaaaa

SEQ ID NO: 1961 - DNA, 4934 bp, Homo sapiens
gcagactagacgctgagcgctcccgtgcgcagcgccccacgcagccgggacgcggcgccgctctgcgggtggaaccgccgcgcgctcccggcctcgggagctgagcccgagagaacttcgctgccttcgggtcgccgctcccgctttccactgtggaatgtgcagcttgggatagagagaaaccagggtttggggagcggtcctcctggagactttctctctgcaagtctccaaggttaagcaattctgacccactggaattcccagagcctgggagttaagcctaaaacgctctgttgctttaagcggcgcggtggggagtcgctggacactccttattttggttttacattaaaaagaaggcggacgagaagatgttgtaggtgacttcctagctgtgttaagttgctcctgggctgtgaatggtgttaatttctgaagtgggcggctccaaaaacttaacaaggaaagctcaggtaacggaggccttggaaagagactctgcgtcaggtcacccagcagagatcagcaatccttggctcactgaggaggtttggatttgcctcaaagggcactgcaaaaattgaacagaggaatcccaaggaagctgcctgaatttgcctgtatactctcgttctgcgacttataaaggaccagacaaatcaaattagtggttttggtttccgccagctgtggatgcctttgacattatgaccgcagaggattccaccgcagccatgagcagtgactcggccgccgggtcctccgccaaggtgcccgagggcgtggcgggcgcgcccaacgaggcagcactgctggcgctgatggagcgcacgggctacagcatggtgcaagagaacgggcagcgcaagtacggcggcccaccgcccggctgggagggcccgcacccgcagcgtggctgcgaggtcttcgtgggcaagatcccgcgcgacgtgtacgaggacgagctggtgcccgtgttcgaggccgtgggccgcatctacgagctgcgcctcatgatggactttgacggcaagaaccgcggctacgccttcgtcatgtactgccacaagcacgaggccaagcgcgcagtgcgtgagctcaacaactacgagatccgcccgggccgcctgctcggcgtgtgctgcagcgtggacaactgccgcctcttcatcggcgggatccccaagatgaagaagcgcgaggaaatcctggaggagattgccaaggtcaccgagggcgtgctggacgtgatcgtctacgccagcgcggccgacaagatgaagaaccgcggcttcgccttcgtggagtacgagagccaccgcgcggctgccatggctcgccgcaagctcatgcctggccgcatccagctgtggggccaccagatcgccgtggactgggccgaacctgagatcgacgtggacgaggacgtgatggagaccgtgaagatcctctacgtgcgcaacctcatgatcgagaccaccgaggacaccatcaagaagagcttcggccagttcaaccccggctgcgtggagcgcgtcaagaagatccgcgactacgccttcgtgcacttcaccagccgcgaggatgccgtgcatgccatgaacaacctcaacggcactgagctggagggctcgtgcctggaggtcacgctggccaagcccgtggacaaggagcagtactcgcgctaccagaaggcagccaggggcggcggcgcggctgaggcagcgcagcagcccagctacgtgtactcctgcgacccctacacactggcctactacggctacccctacaacgcgctcattgggcccaacagggactactttgtgaaagtagccatccctgccattggggctcagtattccatgtttccagcagctccagcccctaaaatgattgaagatggcaaaatccacacagtggagcacatgatcagccccattgctgtgcagccagacccagccagtgctgctgccgccgcagccgcggccgcagccgccgcagccgctgtcattcccactgtgtcgacgccaccacctttccagggccgcccaataactccagtatacacggtggctccaaacgttcagagaattcctactgccgggatctacggggccagttacgtgccatttgctgctccagctacagccacgatcgccacactacagaagaacgcggcagccgcggccgccatgtatggaggatacgcaggctacatacctcaggccttccctgctgctgccattcaggtccccatccccgacgtctaccagacatactgaggctggtgaccagcacgaagacagaccacacaaacaccactgaaggaacgcttgactatttatgaagaaggaacatgttggattcacacatgcaacctgaaagtgaagaatgttagcagatttatttctgaattattttatatacatgaagttttcactagttttttaagactattttcaacttagcatgcctacgttcatacatttccaaaagacttgcaatggttcgtgccttcattccatcttttaaaaatttgtatgctgtactacatttgtatagaggtttttgttgttgtttttttaaggatatattttcagtatgaaggttattttcttaacttctgcactccagagatttctattttgtagtaccttcaataatatatcaactatatattaaaaaagcacacttgaggagctagggaactattttgaaaaatatatacaatatttaaagatacaaacagtagtgcttaaaaatactacataaagcattattttaaaggttatactggaaagtgcaattttaaaatgagtaaaacctctgtatttctgctggcattaagggttgatggtgttaccatgtatcatcatggcggtactattttttaaaagaaattaaacactggatctctccttaagccaacattgaaaagacttgccgcacttctgagtccaaacactggaaagctctcctttgccaccgttagccggggctcattctccatgtgccttagccttaaacatgcccccactcccacatctctcaccctgtcccctcctccccagattcccaatcccaccgcaatgtttggcaagcctaggactgataagtagctctgatagaggagctggtggcttttatacttcttcctgggtttttgttggggtttgttgtttcgttgttttttgtttttttttttgtttggttggggaagtattgtcttctacgtgtgctattttcagtagcagagtaagcacaaggttttaatcgagttgcataagacacctttgcatagctatttaattgcccaatgtaaaactttaatgccatttctaatgcttttattcatttttgaagtatgagtttgtagggacaaagaatgtatgttatcgtagacaagacccccagagactcttttcagcagaaagttatgcttctagttgccttaccatgtttcttgcaaaactgtccatggtcctcaagggtgttggaaacattatgtttattaaatgggcctctcttcctttgctgtgcacttgatgggtgaactggattggggtgtgcacatccaggaggaggaggagagacctgtagaagtttaaagatagtttgtaaatatcttctaatgcttgtttttagtccttttatgttggagaagttcatggtatgtagtttaatgcaaaatgaaaccattttatttcaatgttattaaaaaggtttgttttattaggaagttaatgtattgttgcagtgttttgtgcctgtttaaaggcttttgtttagcagagtgaatgtaaaatacagtaaaatgttaagattgtcatctactttttaaaaaaaaatatcaacttggaattgttttttaaaggctcaatcaaggaagtgaggtgtgcaataaggtagcaagtaaaacgcagttgcgtttttatgtcatgttagagatccatacaattttccactcacgggatttttgttgatggctgaattcttgtggattcataagaggatcatgcccttagcaagtacttttgttttgttttaaattaagagattcccaaatgcctttttccccctcatcttgaaatgagatgagtttttatgtgtaagcaatatttatttaactattctataaaattattgagtgcctactgaggcctttaagcaccgctaacattcctttccatcattcttttaaatgacataaaataattgtgcaatgttcctgatgatgtaccccacaagctgcattcaaactcaaatctgtgggaatgagtgactcgacaaaatgtaattcggatcagatcctcatcccctgactgtgtgaaaaaagtactctccttctagtgaaggattgtcacagagtttcactggatgaaactatgacccagtattcttactgtattttacatatgcctgtaaattatttgcaaaaaagaagaagaagaggaagaaagaaaagaaagaaaagaaagaaagaaagaaagaaagaaagaaagaaagaaagaaagaaagaaagaaagaaagaaaaagaaagaaagaataaaaaaaaatgataacatggcaaccaccaaactcccttaaaaacaaacattggtgacatggccaattaagtatcagtgagcctcctatctgggacttatctgttcctattgtttcaaaaccatttcatgtacactactgaggtaagtttataacttgaaatgtgaactttttttttttttagtgttaagaacaaactatataaatgtaaaaaaaaagttttagagttctgttttcaaacattgctagtggtttagttaactttagctgctttatatttgaaaagcttttatttagatcttgctccatttacagtacattcttaggatgtatgtagtaaataaagctttctttaaagcaatcgcaagaccttattttaaattgtg

SEQ ID NO: 1962 - DNA, 4816 bp, Homo sapiens
aaggggaagtgtggaaatagagcctgcttgttcattttcattattgtacattacatgatatcttttcgaccattatattgtgttccctcagtggtgtttgctctgagggtgggacacaagcctgtttagtgtctcgtaaaacatttaccaaaagcactgagccatggtttttgaagggcattccgttgccagagtgtgggaggagagagcaagcagggaaagagagcgccaggtgcttagcaggatttgcctcaaagggcactgcaaaaattgaacagaggaatcccaaggaagctgcctgaatttgcctgtatactctcgttctgcgacttataaaggaccagacaaatcaaattagtggttttggtttccgccagctgtggatgcctttgacattatgaccgcagaggattccaccgcagccatgagcagtgactcggccgccgggtcctccgccaaggtgcccgagggcgtggcgggcgcgcccaacgaggcagcactgctggcgctgatggagcgcacgggctacagcatggtgcaagagaacgggcagcgcaagtacggcggcccaccgcccggctgggagggcccgcacccgcagcgtggctgcgaggtcttcgtgggcaagatcccgcgcgacgtgtacgaggacgagctggtgcccgtgttcgaggccgtgggccgcatctacgagctgcgcctcatgatggactttgacggcaagaaccgcggctacgccttcgtcatgtactgccacaagcacgaggccaagcgcgcagtgcgtgagctcaacaactacgagatccgcccgggccgcctgctcggcgtgtgctgcagcgtggacaactgccgcctcttcatcggcgggatccccaagatgaagaagcgcgaggaaatcctggaggagattgccaaggtcaccgagggcgtgctggacgtgatcgtctacgccagcgcggccgacaagatgaagaaccgcggcttcgccttcgtggagtacgagagccaccgcgcggctgccatggctcgccgcaagctcatgcctggccgcatccagctgtggggccaccagatcgccgtggactgggccgaacctgagatcgacgtggacgaggacgtgatggagaccgtgaagatcctctacgtgcgcaacctcatgatcgagaccaccgaggacaccatcaagaagagcttcggccagttcaaccccggctgcgtggagcgcgtcaagaagatccgcgactacgccttcgtgcacttcaccagccgcgaggatgccgtgcatgccatgaacaacctcaacggcactgagctggagggctcgtgcctggaggtcacgctggccaagcccgtggacaaggagcagtactcgcgctaccagaaggcagccaggggcggcggcgcggctgaggcagcgcagcagcccagctacgtgtactcctgcgacccctacacactggcctactacggctacccctacaacgcgctcattgggcccaacagggactactttgtgaaagcaggcagcataagaggccgagggcgaggtgcagctggcaacagagccccagggcctaggggttcctacctcgggggatattctgctggtcgtggtatatatagccgatatcatgaagggaaaggaaagcagcaagaaaaaggatatgaactggtgccgaatttggaaatccctaccgtcaacccagttgccattaaacctggtacagtagccatccctgccattggggctcagtattccatgtttccagcagctccagcccctaaaatgattgaagatggcaaaatccacacagtggagcacatgatcagccccattgctgtgcagccagacccagccagtgctgctgccgccgcagccgcggccgcagccgccgcagccgctgtcattcccactgtgtcgacgccaccacctttccagggccgcccaataactccagtatacacggtggctccaaacgttcagagaattcctactgccgggatctacggggccagttacgtgccatttgctgctccagctacagccacgatcgccacactacagaagaacgcggcagccgcggccgccatgtatggaggatacgcaggctacatacctcaggccttccctgctgctgccattcaggtccccatccccgacgtctaccagacatactgaggctggtgaccagcacgaagacagaccacacaaacaccactgaaggaacgcttgactatttatgaagaaggaacatgttggattcacacatgcaacctgaaagtgaagaatgttagcagatttatttctgaattattttatatacatgaagttttcactagttttttaagactattttcaacttagcatgcctacgttcatacatttccaaaagacttgcaatggttcgtgccttcattccatcttttaaaaatttgtatgctgtactacatttgtatagaggtttttgttgttgtttttttaaggatatattttcagtatgaaggttattttcttaacttctgcactccagagatttctattttgtagtaccttcaataatatatcaactatatattaaaaaagcacacttgaggagctagggaactattttgaaaaatatatacaatatttaaagatacaaacagtagtgcttaaaaatactacataaagcattattttaaaggttatactggaaagtgcaattttaaaatgagtaaaacctctgtatttctgctggcattaagggttgatggtgttaccatgtatcatcatggcggtactattttttaaaagaaattaaacactggatctctccttaagccaacattgaaaagacttgccgcacttctgagtccaaacactggaaagctctcctttgccaccgttagccggggctcattctccatgtgccttagccttaaacatgcccccactcccacatctctcaccctgtcccctcctccccagattcccaatcccaccgcaatgtttggcaagcctaggactgataagtagctctgatagaggagctggtggcttttatacttcttcctgggtttttgttggggtttgttgtttcgttgttttttgtttttttttttgtttggttggggaagtattgtcttctacgtgtgctattttcagtagcagagtaagcacaaggttttaatcgagttgcataagacacctttgcatagctatttaattgcccaatgtaaaactttaatgccatttctaatgcttttattcatttttgaagtatgagtttgtagggacaaagaatgtatgttatcgtagacaagacccccagagactcttttcagcagaaagttatgcttctagttgccttaccatgtttcttgcaaaactgtccatggtcctcaagggtgttggaaacattatgtttattaaatgggcctctcttcctttgctgtgcacttgatgggtgaactggattggggtgtgcacatccaggaggaggaggagagacctgtagaagtttaaagatagtttgtaaatatcttctaatgcttgtttttagtccttttatgttggagaagttcatggtatgtagtttaatgcaaaatgaaaccattttatttcaatgttattaaaaaggtttgttttattaggaagttaatgtattgttgcagtgttttgtgcctgtttaaaggcttttgtttagcagagtgaatgtaaaatacagtaaaatgttaagattgtcatctactttttaaaaaaaaatatcaacttggaattgttttttaaaggctcaatcaaggaagtgaggtgtgcaataaggtagcaagtaaaacgcagttgcgtttttatgtcatgttagagatccatacaattttccactcacgggatttttgttgatggctgaattcttgtggattcataagaggatcatgcccttagcaagtacttttgttttgttttaaattaagagattcccaaatgcctttttccccctcatcttgaaatgagatgagtttttatgtgtaagcaatatttatttaactattctataaaattattgagtgcctactgaggcctttaagcaccgctaacattcctttccatcattcttttaaatgacataaaataattgtgcaatgttcctgatgatgtaccccacaagctgcattcaaactcaaatctgtgggaatgagtgactcgacaaaatgtaattcggatcagatcctcatcccctgactgtgtgaaaaaagtactctccttctagtgaaggattgtcacagagtttcactggatgaaactatgacccagtattcttactgtattttacatatgcctgtaaattatttgcaaaaaagaagaagaagaggaagaaagaaaagaaagaaaagaaagaaagaaagaaagaaagaaagaaagaaagaaagaaagaaagaaagaaagaaagaaaaagaaagaaagaataaaaaaaaatgataacatggcaaccaccaaactcccttaaaaacaaacattggtgacatggccaattaagtatcagtgagcctcctatctgggacttatctgttcctattgtttcaaaaccatttcatgtacactactgaggtaagtttataacttgaaatgtgaactttttttttttttagtgttaagaacaaactatataaatgtaaaaaaaaagttttagagttctgttttcaaacattgctagtggtttagttaactttagctgctttatatttgaaaagcttttatttagatcttgctccatttacagtacattcttaggatgtatgtagtaaataaagctttctttaaagcaatcgcaagacctta

SEQ ID NO: 1963 - DNA, 4473 bp, Homo sapiens
agtcagacccaggaggagtgaggtcaattgccctttagtcccaggactaaccggaagcttctgcaacaggaggacattgaaaataagatggaacccatccacataaggatttgcctcaaagggcactgcaaaaattgaacagaggaatcccaaggaagctgcctgaatttgcctgtatactctcgttctgcgacttataaaggaccagacaaatcaaattagtggttttggtttccgccagctgtggatgcctttgacattatgaccgcagaggattccaccgcagccatgagcagtgactcggccgccgggtcctccgccaaggtgcccgagggcgtggcgggcgcgcccaacgaggcagcactgctggcgctgatggagcgcacgggctacagcatggtgcaagagaacgggcagcgcaagtacggcggcccaccgcccggctgggagggcccgcacccgcagcgtggctgcgaggtcttcgtgggcaagatcccgcgcgacgtgtacgaggacgagctggtgcccgtgttcgaggccgtgggccgcatctacgagctgcgcctcatgatggactttgacggcaagaaccgcggctacgccttcgtcatgtactgccacaagcacgaggccaagcgcgcagtgcgtgagctcaacaactacgagatccgcccgggccgcctgctcggcgtgtgctgcagcgtggacaactgccgcctcttcatcggcgggatccccaagatgaagaagcgcgaggaaatcctggaggagattgccaaggtcaccgagggcgtgctggacgtgatcgtctacgccagcgcggccgacaagatgaagaaccgcggcttcgccttcgtggagtacgagagccaccgcgcggctgccatggctcgccgcaagctcatgcctggccgcatccagctgtggggccaccagatcgccgtggactgggccgaacctgagatcgacgtggacgaggacgtgatggagaccgtgaagatcctctacgtgcgcaacctcatgatcgagaccaccgaggacaccatcaagaagagcttcggccagttcaaccccggctgcgtggagcgcgtcaagaagatccgcgactacgccttcgtgcacttcaccagccgcgaggatgccgtgcatgccatgaacaacctcaacggcactgagctggagggctcgtgcctggaggtcacgctggccaagcccgtggacaaggagcagtactcgcgctaccagaaggcagccaggggcggcggcgcggctgaggcagcgcagcagcccagctacgtgtactcctgcgacccctacacactggcctactacggctacccctacaacgcgctcattgggcccaacagggactactttgtgaaagtagccatccctgccattggggctcagtattccatgtttccagcagctccagcccctaaaatgattgaagatggcaaaatccacacagtggagcacatgatcagccccattgctgtgcagccagacccagccagtgctgctgccgccgcagccgcggccgcagccgccgcagccgctgtcattcccactgtgtcgacgccaccacctttccagggccgcccaataactccagtatacacggtggctccaaacgttcagagaattcctactgccgggatctacggggccagttacgtgccatttgctgctccagctacagccacgatcgccacactacagaagaacgcggcagccgcggccgccatgtatggaggatacgcaggctacatacctcaggccttccctgctgctgccattcaggtccccatccccgacgtctaccagacatactgaggctggtgaccagcacgaagacagaccacacaaacaccactgaaggaacgcttgactatttatgaagaaggaacatgttggattcacacatgcaacctgaaagtgaagaatgttagcagatttatttctgaattattttatatacatgaagttttcactagttttttaagactattttcaacttagcatgcctacgttcatacatttccaaaagacttgcaatggttcgtgccttcattccatcttttaaaaatttgtatgctgtactacatttgtatagaggtttttgttgttgtttttttaaggatatattttcagtatgaaggttattttcttaacttctgcactccagagatttctattttgtagtaccttcaataatatatcaactatatattaaaaaagcacacttgaggagctagggaactattttgaaaaatatatacaatatttaaagatacaaacagtagtgcttaaaaatactacataaagcattattttaaaggttatactggaaagtgcaattttaaaatgagtaaaacctctgtatttctgctggcattaagggttgatggtgttaccatgtatcatcatggcggtactattttttaaaagaaattaaacactggatctctccttaagccaacattgaaaagacttgccgcacttctgagtccaaacactggaaagctctcctttgccaccgttagccggggctcattctccatgtgccttagccttaaacatgcccccactcccacatctctcaccctgtcccctcctccccagattcccaatcccaccgcaatgtttggcaagcctaggactgataagtagctctgatagaggagctggtggcttttatacttcttcctgggtttttgttggggtttgttgtttcgttgttttttgtttttttttttgtttggttggggaagtattgtcttctacgtgtgctattttcagtagcagagtaagcacaaggttttaatcgagttgcataagacacctttgcatagctatttaattgcccaatgtaaaactttaatgccatttctaatgcttttattcatttttgaagtatgagtttgtagggacaaagaatgtatgttatcgtagacaagacccccagagactcttttcagcagaaagttatgcttctagttgccttaccatgtttcttgcaaaactgtccatggtcctcaagggtgttggaaacattatgtttattaaatgggcctctcttcctttgctgtgcacttgatgggtgaactggattggggtgtgcacatccaggaggaggaggagagacctgtagaagtttaaagatagtttgtaaatatcttctaatgcttgtttttagtccttttatgttggagaagttcatggtatgtagtttaatgcaaaatgaaaccattttatttcaatgttattaaaaaggtttgttttattaggaagttaatgtattgttgcagtgttttgtgcctgtttaaaggcttttgtttagcagagtgaatgtaaaatacagtaaaatgttaagattgtcatctactttttaaaaaaaaatatcaacttggaattgttttttaaaggctcaatcaaggaagtgaggtgtgcaataaggtagcaagtaaaacgcagttgcgtttttatgtcatgttagagatccatacaattttccactcacgggatttttgttgatggctgaattcttgtggattcataagaggatcatgcccttagcaagtacttttgttttgttttaaattaagagattcccaaatgcctttttccccctcatcttgaaatgagatgagtttttatgtgtaagcaatatttatttaactattctataaaattattgagtgcctactgaggcctttaagcaccgctaacattcctttccatcattcttttaaatgacataaaataattgtgcaatgttcctgatgatgtaccccacaagctgcattcaaactcaaatctgtgggaatgagtgactcgacaaaatgtaattcggatcagatcctcatcccctgactgtgtgaaaaaagtactctccttctagtgaaggattgtcacagagtttcactggatgaaactatgacccagtattcttactgtattttacatatgcctgtaaattatttgcaaaaaagaagaagaagaggaagaaagaaaagaaagaaaagaaagaaagaaagaaagaaagaaagaaagaaagaaagaaagaaagaaagaaagaaagaaaaagaaagaaagaataaaaaaaaatgataacatggcaaccaccaaactcccttaaaaacaaacattggtgacatggccaattaagtatcagtgagcctcctatctgggacttatctgttcctattgtttcaaaaccatttcatgtacactactgaggtaagtttataacttgaaatgtgaactttttttttttttagtgttaagaacaaactatataaatgtaaaaaaaaagttttagagttctgttttcaaacattgctagtggtttagttaactttagctgctttatatttgaaaagcttttatttagatcttgctccatttacagtacattcttaggatgtatgtagtaaataaagctttctttaaagcaatcgcaagacctta

SEQ ID NO: 1964 - DNA, 741 bp, Homo sapiens
ataaacaggtaaggcggagggggtggggcgcggattgcggacatctgggtttcttgggaattgggatggggtgggggttcgagccaactccccagagagcaggcaaggtgaagcgagggcttggctgctgtttctaaatgcagtgtttttttgttccctttctagaaaccctccgtaactctaggtcagagcgcactaaaatgagccacttctgaacgagcagcgcccaggccccaggccctgctgcgaaggccccggcaaaggtcagggccccgtccgcgtgacgctcctgcctgcgcgcggccaagccatgctcggccccagctcaggtaacggaggccttggaaagagactctgcgtcaggtcacccagcagagatcagcaatccttggctcactgaggaggtttggatttgcctcaaagggcactgcaaaaattgaacagaggaatcccaaggaagctgcctgaatttgcctgtatactctcgttctgcgacttataaaggaccagacaaatcaaattagtggttttggtttccgccagctgtggatgcctttgacattatgaccgcagaggattccaccgcagccatgagcagtgactcggccgccgggtcctccgccaaggtgcccgagggcgtggcgggcgcgcccaacgaggcagcactgctggcgctgatggagcgcacgggctacagcatggtgcaagagaacgggcagcgcaagtacggcggcccaccgc

SEQ ID NO: 1965 - DNA, 856 bp, Homo sapiens
ccgcgcctacaaacaggcttagcgctccactgaaatgcgggaggctccttaactcttgtataaacagaaaccctccgtaactctaggtcagagcgcactaaaatgagccacttctgaacgagcagcgcccaggccccaggccctgctgcgaaggccccggcaaaggtcagggccccgtccgcgtgacgctcctgcctgcgcgcggccaagccatgctcggccccaggatttgcctcaaagggcactgcaaaaattgaacagaggaatcccaaggaagctgcctgaatttgcctgtatactctcgttctgcgacttataaaggaccagacaaatcaaattagtggttttggtttccgccagctgtggatgcctttgacattatgaccgcagaggattccaccgcagccatgagcagtgactcggccgccgggtcctccgccaaggtgcccgagggcgtggcgggcgcgcccaacgaggcagcactgctggcgctgatggagcgcacgggctacagcatggtgcaagagaacgggcagcgcaagtacggcggcccaccgcccggctgggagggcccgcacccgcagcgtggctgcgaggtcttcgtgggcaagatcccgcgcgacgtgtacgaggacgagctggtgcccgtgttcgaggccgtgggccgcatctacgagctgcgcctcatgatggactttgacggcaagaaccgcggctacgccttcgtcatgtactgccacaagcacgaggccaagcgcgcagtgcgtgagctcaacaactacgagatccgcccgggccgcctgctcggcgtgtgctgcagcgtggacaactgccgcctcttcatcggcgggatccc

SEQ ID NO: 1966 - DNA, 582 bp, Homo sapiens
gcttaagcaaagctttcattacagttagcctgtcgcacccagatcaagattggaaaggatttgcctcaaagggcactgcaaaaattgaacagaggaatcccaaggaagctgcctgaatttgcctgtatactctcgttctgcgacttataaaggaccagacaaatcaaattagtggttttggtttccgccagctgtggatgcctttgacattatgaccgcagaggattccaccgcagccatgagcagtgactcggccgccgggtcctccgccaaggtgcccgagggcgtggcgggcgcgcccaacgaggcagcactgctggcgctgatggagcgcacgggctacagcatggtgcaagagaacgggcagcgcaagtacggcggcccaccgcccggctgggagggcccgcacccgcagcgtggctgcgaggtcttcgtgggcaagatcccgcgcgacgtgtacgaggacgagctggtgcccgtgttcgaggccgtgggccgcatctacgagctgcgcctcatgatggactttgacggcaagaaccgcggctacgccttcgtcatgtactgccacaagcacgaggc

SEQ ID NO: 1967 - DNA, 836 bp, Homo sapiens
gtcacagaattcgattcctgttggcccattccgcgcctacaaacaggcttagcgctccactgaaatgcgggaggctccttaactcttgtataaacagaaaccctccgtaactctaggtcagagcgcactaaaatgagccacttctgaacgagcagcgcccaggccccaggccctgctgcgaaggccccggcaaaggtcagggccccgtccgcgtgacgctcctgcctgcgcgcggccaagccatgctcggccccagctcaggtaacggaggccttggaaagagactctgcgtcaggtcacccagcagagatcagcaatccttggctcactgaggaggtttggatttgcctcaaagggcactgcaaaaattgaacagaggaatcccaaggaagctgcctgaatttgcctgtatactctcgttctgcgacttataaaggaccagacaaatcaaattagtggttttggtttccgccagctgtggatgcctttgacattatgaccgcagaggattccaccgcagccatgagcagtgactcggccgccgggtcctccgccaaggtgcccgagggcgtggcgggcgcgcccaacgaggcagcactgctggcgctgatggagcgcacgggctacagcatggtgcaagagaacgggcagcgcaagtacggcggcccaccgcccggctgggagggcccgcacccgcagcgtggctgcgaggtcttcgtgggcaagatcccgcgcgacgtgtacgaggacgagctggtgcccgtgttcgaggccgtgggccgcatctacgagctgcgcctcatgatggactttgacggcaagaaccgcggctacgc

SEQ ID NO: 1968 - DNA, 657 bp, Homo sapiens
ataaacaggtaaggcggagggggtggggcgcggattgcggacatctgggtttcttgggaattgggatggggtgggggttcgagccaactccccagagagcaggcaaggtgaagcgagggcttggctgctgtttctaaatgcagtgtttttttgttccctttctagaaaccctccgtaactctaggtcagagcgcactaaaatgagccacttctgaacgagcagcgcccaggccccaggccctgctgcgaaggccccggcaaaggtcagggccccgtccgcgtgacgctcctgcctgcgcgcggccaagccatgctcggccccaggatttgcctcaaagggcactgcaaaaattgaacagaggaatcccaaggaagctgcctgaatttgcctgtatactctcgttctgcgacttataaaggaccagacaaatcaaattagtggttttggtttccgccagctgtggatgcctttgacattatgaccgcagaggattccaccgcagccatgagcagtgactcggccgccgggtcctccgccaaggtgcccgagggcgtggcgggcgcgcccaacgaggcagcactgctggcgctgatggagcgcacgggctacagcatggtgcaagagaacgggcagcgcaagtacggcggcccaccgcc

SEQ ID NO: 1969 - DNA, 882 bp, Homo sapiens
gggaaagagagcgccaggtgcttagcaggatttgcctcaaagggcactgcaaaaattgaacagaggaatcccaaggaagctgcctgaatttgcctgtatactctcgttctgcgacttataaaggaccagacaaatcaaattagtggttttgagacagggtctcactatgttgcccagactggtctggaactcctgagctcaagcaagcttctcacctcagcctcccaaagtgctgggattataggcttcagccaccacgcccaaccagccaggtttccgccagctgtggatgcctttgacattatgaccgcagaggattccaccgcagccatgagcagtgactcggccgccgggtcctccgccaaggtgcccgagggcgtggcgggcgcgcccaacgaggcagcactgctggcgctgatggagcgcacgggctacagcatggtgcaagagaacgggcagcgcaagtacggcggcccaccgcccggctgggagggcccgcacccgcagcgtggctgcgaggtcttcgtgggcaagatcccgcgcgacgtgtacgaggacgagctggtgcccgtgttcgaggccgtgggccgcatctacgagctgcgcctcatgatggactttgacggcaagaaccgcggctacgccttcgtcatgtactgccacaagcacgaggccaagcgcgcagtgcgtgagctcaacaactacgagatccgcccgggccgcctgctcggcgtgtgctgcagcgtggacaactgccgcctcttcatcggcgggatccccaagatgaagaagcgcgaggaaatcctggaggagattgccaaggtcaccgagggcgtgctggacgtgatcgtctacgccagcgcggccgacaagatgaagaac

SEQ ID NO: 1970 - DNA, 797 bp, Homo sapiens
tgaaccttcagcaaaggtatctgcgctcctaaaaaacaacaggaatgtggcactggcctttagccaggggaggctcagccagcaggataaaatttcagggcagatttacgggaagttgccggtgttgggagtaaaaatctggtttgctcaggtaacggaggccttggaaagagactctgcgtcaggtcacccagcagagatcagcaatccttggctcactgaggaggtttggatttgcctcaaagggcactgcaaaaattgaacagaggaatcccaaggaagctgcctgaatttgcctgtatactctcgttctgcgacttataaaggaccagacaaatcaaattagtggttttggtttccgccagctgtggatgcctttgacattatgaccgcagaggattccaccgcagccatgagcagtgactcggccgccgggtcctccgccaaggtgcccgagggcgtggcgggcgcgcccaacgaggcagcactgctggcgctgatggagcgcacgggctacagcatggtgcaagagaacgggcagcgcaagtacggcggcccaccgcccggctgggagggcccgcacccgcagcgtggctgcgaggtcttcgtgggcaagatcccgcgcgacgtgtacgaggacgagctggtgcccgtgttcgaggccgtgggccgcatctacgagctgcgcctcatgatggactttgacggcaagaaccgcggctacgccttcgtcatgtactgccacaagcacgaggccaagcgcgcagtgcgtgagctcaacaactacgagatccgcc

SEQ ID NO: 1971 - DNA, 1100 bp, Homo sapiens
taatttctccaacgtggttctggctgggtttctcggagcagcccgaagggggccgagcgtctgactcggacagatgcccccaggtggagcaggtgccacttctgggtgtctgaaaggcatgtgacttttggggcggggagagaagtccgtctggtcaagtcccccaatctctgccatcaaggccgattttctttgaaccttcagcaaagctcaggtaacggaggccttggaaagagactctgcgtcaggtcacccagcagagatcagcaatccttggctcactgaggaggtttggatttgcctcaaagggcactgcaaaaattgaacagaggaatcccaaggaagctgcctgaatttgcctgtatactctcgttctgcgacttataaaggaccagacaaatcaaattagtggttttggtttccgccagctgtggatgcctttgacattatgaccgcagaggattccaccgcagccatgagcagtgactcggccgccgggtcctccgccaaggtgcccgagggcgtggcgggcgcgcccaacgaggcagcactgctggcgctgatggagcgcacgggctacagcatggtgcaagagaacgggcagcgcaagtacggcggcccaccgcccggctgggagggcccgcacccgcagcgtggctgcgaggtcttcgtgggcaagatcccgcgcgacgtgtacgaggacgagctggtgcccgtgttcgaggccgtgggccgcatctacgagctgcgcctcatgatggactttgacggcaagaaccgcggctacgccttcgtcatgtactgccacaagcacgaggccaagcgcgcagtgcgtgagctcaacaactacgagatccgcccgggccgcctgctcggcgtgtgctgcagcgtggacaactgccgcctcttcatcggcgggatccccaagatgaagaagcgcgaggaaatcctggaggagattgccaaggtcaccgagggcgtgctggacgtgatcgtctacgccagcgcggccgacaagatgaagaaccgcggcttcgccttcgtggagtacgagagccaccgcgcggctgccatggctcgccgcaagctcatgcctggcc

SEQ ID NO: 1972 - DNA, 1840 bp, Homo sapiens
ggctcccgcgaggggaaggggagggaagcagcgcgcactcgcgcgtgcgtgagctggcgcgcgagaaagggcccggtcgcgtccaggctcgagcggccgtcgccattttgtaaggttctctctgacgtgggagccgccgtcgctgccgccacccggaggctcttgtcaggatggtgaagctgttcatcggaaaccttccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaagcttcaaccaagttacacgtgggtaacatcagccccacttgtaccaaccaagagcttcgagccaagtttgaggagtatggtccggtcatcgaatgtgacatcgtgaaagattatgccttcgtacacatggagcgggcagaggatgcagtggaggccatcaggggccttgacaacacagagtttcaaggcaaaagaatgcatgtgcagttgtccacaagccggcttcggactgcccctggtatgggagaccagagtggctgctatcggtgtgggaaagaagggcactggtccaaagagtgcccagtagatcgtacgggtcgtgtggcagactttactgagcagtataatgaacaatatggagcagttcgaacaccttacaccatgggctacggggaatccatgtattacaacgatgcatatggagcactcgactactataagcgataccgggtccgctcttatgaggcagtagcagcggcggcagcggcttctgcatacaactacgcagagcagaccatgtcccatctgcctcaagtccaaagcacaactgtgaccagccacctcaactctacttctgttgatccctatgacagacacctattgccaaactctggcgctgctgccacttcagctgctatggctgctgctgcagccaccacttcctcctactatggaagggacaggagcccactgcgtcgtgctgcagccatgctccccacagttggagagggctacggttatgggccagagagtgaattatctcaggcttccgcagctacacggaattctctgtatgacatggcccggtatgaacgggagcagtatgtggaccgagcccggtactcagccttttaaaaactggaggtaggataattgcggactgaaccctcgggctgcggtcatatatgagaacttgctccgcgcggtcccctttgccgggatgtttccattgcttcatgtttcagtaaacaaaaggagtttgtgaccaactatgttttctttcttaattcttctaagttgacttttctttcctcctgaaactagtctctgtagcctttcactctgttccttatattctcagcctctgagcagccctaggtaaggattatgctggcatcccctttttcctgtgcagtggaacccctcttatcttgctttccctaggagttgaatccttctccctgcctacctgcagcatctcctttccctttaaaatgaccatgtagtggcaagcagccttttactcttctgttagctctggactcttaacacttaagttactcttctgaaattgctaggaccattgggggttttgttgttttgtttgttttttatgtccgacctgtgatcgtggtacagcattagctgaaatttacccttgttttactccactcctcccttttttaaaaaaattttttgacaaataaatgtttctaacacttaaa

SEQ ID NO: 1973 - DNA, 2339 bp, Homo sapiens
gtgtgtgtgatgtggggagctcgggggcgggtcgggccgggcctccggcagactgcacggcccggatttgggtttctcattttgcagcgggaggtctgggaagacaacgggaggaggcggggccgggtctccggaaggaggcggggcaggggtcgggtcgagtctttgttggggcgaagaagctggagggtgggccgctgggggcgaggtggttggtccccggtttgggggaaaggggacttttttctttttagagtatcttgaaaggcgctagtgcgcgcaggagaggtacacagatttccctccaaaaccttgttaccaggcgcactgcgattgatgccccttgcctttgcttgggcttttctcttccctcattttaagacatgaagcagctaattctggtatttcattgcgctccacttcacggagatgatagactgggctatgcatgctgaccctcgacctcctgtttgcatgtcacgcatagctcgcacttctcgagaacaaaccgcccttcttctattgaggaagaataatgaatgtctgtacgagggtcttgaaggtgcaagaactttggaggattagacgaaaatgctgcagtgcaccgaaatttcccaccacacccctgacttttgaagtcttgtgtttctctcccaggctcttgtcaggatggtgaagctgttcatcggaaaccttccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaagcttcaaccaagttacacgtgggtaacatcagccccacttgtaccaaccaagagcttcgagccaagtttgaggagtatggtccggtcatcgaatgtgacatcgtgaaagattatgccttcgtacacatggagcgggcagaggatgcagtggaggccatcaggggccttgacaacacagagtttcaaggcaaaagaatgcatgtgcagttgtccacaagccggcttcggactgcccctggtatgggagaccagagtggctgctatcggtgtgggaaagaagggcactggtccaaagagtgcccagtagatcgtacgggtcgtgtggcagactttactgagcagtataatgaacaatatggagcagttcgaacaccttacaccatgggctacggggaatccatgtattacaacgatgcatatggagcactcgactactataagcgataccgggtccgctcttatgaggcagtagcagcggcggcagcggcttctgcatacaactacgcagagcagaccatgtcccatctgcctcaagtccaaagcacaactgtgaccagccacctcaactctacttctgttgatccctatgacagacacctattgccaaactctggcgctgctgccacttcagctgctatggctgctgctgcagccaccacttcctcctactatggaagggacaggagcccactgcgtcgtgctgcagccatgctccccacagttggagagggctacggttatgggccagagagtgaattatctcaggcttccgcagctacacggaattctctgtatgacatggcccggtatgaacgggagcagtatgtggaccgagcccggtactcagccttttaaaaactggaggtaggataattgcggactgaaccctcgggctgcggtcatatatgagaacttgctccgcgcggtcccctttgccgggatgtttccattgcttcatgtttcagtaaacaaaaggagtttgtgaccaactatgttttctttcttaattcttctaagttgacttttctttcctcctgaaactagtctctgtagcctttcactctgttccttatattctcagcctctgagcagccctaggtaaggattatgctggcatcccctttttcctgtgcagtggaacccctcttatcttgctttccctaggagttgaatccttctccctgcctacctgcagcatctcctttccctttaaaatgaccatgtagtggcaagcagccttttactcttctgttagctctggactcttaacacttaagttactcttctgaaattgctaggaccattgggggttttgttgttttgtttgttttttatgtccgacctgtgatcgtggtacagcattagctgaaatttacccttgttttactccactcctcccttttttaaaaaaattttttgacaaataaatgtttctaacacttaaa

SEQ ID NO: 1974 - DNA, 3188 bp, Homo sapiens
aagcgtgaggtactgtgggtaggagacggccgtcggcggaggcgccattttgtgtagccgccgaaccttgttggaggttctggggcgcagaaccgctactgctgcttcggtctctccttgggaaaaaataaaatttgaaccttttggagctgtgtgctaaatcttcagtgggacaatgggttcagacaaaagagtgagtagaacagagcgtagtggaagatacggttccatcatagacagggatgaccgtgatgagcgtgaatcccgaagcaggcggagggactcagattacaaaagatctagtgatgatcggaggggtgatagatatgatgactaccgagactatgacagtccagagagagagcgtgaaagaaggaacagtgaccgatccgaagatggctaccattcagatggtgactatggtgagcacgactataggcatgacatcagtgacgagagggagagcaagaccatcatgctgcgcggccttcccatcaccatcacagagagcgatattcgagaaatgatggagtccttcgaaggccctcagcctgcggatgtgaggctgatgaagaggaaaacaggtgtaagccgtggtttcgccttcgtggagttttatcacttgcaagatgctaccagctggatggaagccaatcagaaaaagttggtgattcaaggaaagcacattgcaatgcattatagcaatcccagacctaagtttgaagattggctttgtaacaagtgctgccttaacaatttcaggaaaagactaaaatgcttccgatgtggagcagacaagtttgactctgaacaggaagtgcctcctggaaccacagagtcggttcagtctgtggattactactgtgatacgatcattcttcggaacatagctccgcacactgtggtggattccatcatgacagcactgtctccttacgcgtctttagctgtcaataacatccgcctcataaaagacaaacagacccagcagaacagaggcttcgcatttgtgcagctgtcctctgcaatggatgcttctcagctgcttcagatattacagagtctccatcctcctttgaaaattgatggcaaaactattggggttgattttgcaaaaagtgccagaaaagacttggtcctctcagatggtaaccgcgtcagcgctttctctgtagctagtacggctattgctgctgctcagtggtcatccacccagtctcaaagtggtgaaggaggcagtgttgactacagttatctgcaaccaggtcaagatggctatgcccaatatgctcagtattcacaggattatcagcagttttatcaacaacaagctggaggattggaatctgatgcatcatctgcatcaggcacagcagtgaccaccacctcagcggctgtagtgtcccagagtcctcagctgtataatcaaacctccaatccacctggctctccgactgaggaagcacagcctagcactagcacaagtacacaggccccagccgcttcccctactggtgtagttcctggtaccaaatatgcagtacctgacacgtccacttaccagtatgatgaatcttcaggatattactatgatccgacaacagggctctattatgaccccaactcgcaatactactataattccttgacccagcagtacctttactgggatggggaaaaagagacctacgtgccagctgcagagtctagctcccaccagcagtcgggcctgcctcctgcaaaagaggggaaagagaagaaggagaaacccaagagcaaaacagcccagcagattgccaaagacatggaacgctgggctaagagtttgaataagcagaaagaaaactttaaaaatagctttcagcctgtcaattccttgagggaagaagaaaggagagaatctgctgcagcagacgctggctttgctctctttgagaagaagggagccttagctgaaaggcagcagctcatcccagaattggtgcgaaatggagatgaggagaatcccctcaaaaggggtctggttgctgcttacagtggtgacagtgacaatgaggaggagctggtggagagacttgagagtgaggaagagaagctagctgactggaagaagatggcctgtctgctctgccggcgccagttcccgaacaaagatgccctagtcaggcaccagcaactctcagaccttcacaagcaaaacatggacatctatcgacgatccaggctgagcgagcaggagctggaagccttggagctaagggagagagagatgaaataccgagaccgagctgcagaaagacgggagaagtacggcattccagaacctccagagcccaagcgcaagaagcagtttgatgccggcactgtgaattacgagcaacccaccaaagatggcattgaccacagtaacattggcaacaagatgctgcaggccatgggctggcgggaaggctctggcttgggacgaaagtgtcaaggcattacggctcccattgaggctcaagttcggctaaagggagctggcctaggagccaaaggcagcgcatatggtttgtcgggcgccgattcctacaaagatgctgtccggaaagccatgtttgcccggttcactgagatggagtgagagagagagagagagagagatgacaaggagcacaagaagtggtccatctcccgaattcgctgttaccgcctgtctctttaagggcatgccttgtgctgttaatagatcttagggtgaaccacttcattctgcagggttctccctcccaccttaaagaagttccccttatgtgggttgcctggtgaatggccttccttcccgccagagggcttgtgaacagaccggagaggacagtggattgtttatactccagtgtacatagtgtaatgtagcgtgtttacatgtgtagcctatgttgtggtccatcagcccctcacattcctaggggtttgagatgctgtaggtggtatgtgacaccaaagccacctctgtcatttgttgtgatgtcttttcttggcaaaagccttgtgtatatttgtatattacacatttgtacagaattttggaagattttcagtctagttgccaaatctggctcctttacaaaagaaataccttgagaaatgggtgtcctgtgtctctttattcttgggtgggtaggtgggtcaagcatgtctgagccagt

SEQ ID NO: 1975 - DNA, 427 bp, Homo sapiens
cttgtctcctagaaaaaataaaatttgaaccttttggagctgtgtgctaaatcttcagtgggacaatgggttcagacaaaagagtgagtagaacagagcgtagtggaagatacggttccatcatagacagggatgaccgtgatgagcgtgaatcccgaagcaggcggagggactcagattacaaaagatctagtgatgatcggaggggtgatagatatgatgactaccgagactatgacagtccagagagagagcgtgaaagaaggaacagtgaccgatccgaagatggctaccattcagatggtgactatggtgagcacgactataggcatgacatcagtgacgagagggagagcaagaccatcatgctgcgcggccttcccatcaccatcacagagagcgatattcgagaaatgatggagtcctt

SEQ ID NO: 1976 - DNA, 582 bp, Homo sapiens
acgttattaatgtagtagatttcagtcagctcagtatcccagcttctacgaggttttacatttttcatcagaagtgtttgaatttcatgttgctccttgtattaatgaagacacttggattaatgttttaacggtcaactatcccacggagttgctttgatacaaaaccaaggagctgattgtagctctgccctttttgctttgtaattctaagaaaaaataaaatttgaaccttttggagctgtgtgctaaatcttcagtgggacaatgggttcagacaaaagagtgagtagaacagagcgtagtggaagatacggttccatcatagacagggatgaccgtgatgagcgtgaatcccgaagcaggcggagggactcagattacaaaagatctagtgatgatcggaggggtgatagatatgatgactaccgagactatgacagtccagagagagagcgtgaaagaaggaacagtgaccgatccgaagatggctaccattcagatggtgactatggtgagcacgactataggcatgacatcagtgacgagagggagagcaagaccatcatgctgcgcggcctt

SEQ ID NO: 1977 - DNA, 569 bp, Homo sapiens
attttgtgtagccgccgaaccttgttggaggttctggggcgcagaaccgctactgctgcttcggtctctccttggggtaagtgcggcggctgtctgtaacgacgaaaaaataaaatttgaaccttttggagctgtgtgctaaatcttcagtgggacaatgggttcagacaaaagagtgagtagaacagagcgtagtggaagatacggttccatcatagacagggatgaccgtgatgagcgtgaatcccgaagcaggcggagggactcagattacaaaagatctagtgatgatcggaggggtgatagatatgatgactaccgagactatgacagtccagagagagagcgtgaaagaaggaacagtgaccgatccgaagatggctaccattcagatggtgactatggtgagcacgactataggcatgacatcagtgacgagagggagagcaagaccatcatgctgcgcggccttcccatcaccatcacagagagcgatattcgagaaatgatggagtccttcgaaggccctcagcctgcggatgtgaggctgatgaagaggaaaacaggtg

SEQ ID NO: 1978 - DNA, 2716 bp, Homo sapiens
actgtgggtaggagacggccgtcggcggaggcgccattttgtgtagccgccgaaccttgttggaggttctggggcgcagaaccgctactgctgcttcggtctctccttgggaaaaaataaaatttgaaccttttggagctgtgtgctaaatcttcagtgggacaatgggttcagacaaaagagtgagtagaacagagcgtagtggaagatacggttccatcatagacagggatgaccgtgatgagcgtgaatcccgaagcaggcggagggactcagattacaaaagatctagtgatgatcggaggggtgatagatatgatgactaccgagactatgacagtccagagagagagcgtgaaagaaggaacagtgaccgatccgaagatggctaccattcagatggtgactatggtgagcacgactataggcatgacatcagtgacgagagggagagcaagaccatcatgctgcgcggccttcccatcaccatcacagagagcgatattcgagaaatgatggagtccttcgaaggccctcagcctgcggatgtgaggctgatgaagaggaaaacaggtgagagcttgcttagttcctgatattattgttctcttccccattcccacctcagtccctaaagaacatcctgattcccccagtcttcaagcacatgaattcagaatgaaaggtttgccatggctaaggaatgtgactctttgaaaaccatgttagcatctgaggaacttttttaaactttgttttagggacttttttttccttaggtaagtaatgatttataaactcctttttttttttgactatagtcggttgcatggttactttaagcgtggaatcaaatggagtggcatttagttcaggcggcttgttccttgccatggcaaagtatcaagaagatccccaagtcaagtcacatttgtaaagctgcttcccaattggctttgtcacgcagtgttgaagcagtgggagagagattcacctgttataaaggaactgactaacacaagtatcccgtctatatctgaatgctgtctctaggtgtaagccgtggtttcgccttcgtggagttttatcacttgcaagatgctaccagctggatggaagccaatcaggttgcttcactcaccaagtctagatattcatgaaaatggaacaagtctgtacaattttaaaaaaaggttgaaggagtggtttgttccaaaggagtgacttttttttaaaaaaaaagctttgtatatattaaaattgatgttactagaataagtacagtaccaaggacttcattatagaatttgttctgcctttaaacatggctacctacctggcagggctttgttaactactgaatacctgtctggtaatcactaaaacatcttaatgtttcccttttttctagtttgttatattcctattatgtccattgagagtaagcttagtatatcaaactctccatttgacagtgaagagaacatagtgaaagtctgtggcggcatttttataagtaattccttatttctgcctgaagaccacaaagcctcctggaggcgtaactgctcagaccggtcttcagggaatatttaaggacttagtggaatttatgaacaataagtctgatgagattagcctgggagtggtgtcctgcagctgtctaatctagttagagtggcattaacattctaatctccttgagaatgccttttatagtctgttcaaagcaagtcattgatggttcttcgaggtagtgttaactgaagtgttcttcagtttgtcaagataatgttcagtgcttggcacttaaataacattttttgcaagaactccaaggcacattattgaatgcctttaaccaagtgcattctgggaagtttgcttgactcattatcttgcttttctgcagcattctgtgatttgagtcatccatgaatccatgaataaaagttacattctttgattggtaatattgccatttataacaagactcactaatgagggtatcactttgactgactgatttgttaaagtttttaagcctctcattttcctaacccagaaatcacagcctgattttattaaaagtagagcttcattcatttcataccatagataccatcctagtaaatccagaacatatacaaggttcatgtgagtctgctttcttgacatgatagcattgtttgatgcagtggatatgtcagaatgactaacctaggagtttaaaactcctaagaaactaaaacctgtaagacatttaaaagtctccacaattttaatgtatacaaagctatgttactgtgtaacacattacagttcaaattcactccagaaataaaaggccagtaggattagggactcactggtagtttggagtctcccagcacacatccctcctagtgggatgatctattcacatatctcccagcttttttatttttgcttctgtatatcacagtgagtggatggcccttcagctttttctctcctggccagacatgcagtcttgcctttagatatcgcagagacaaaattcacagcatgtcttaaatcttccaggatttgcaagaaccaaattgctcaacagtatgtatgtttagaggggttagactcctttttaaaatctggatatctaaccacctacttaaatctgtttgatagtgtcaaaccacccccacccttgatcctcccacccccaagaaaaagaaaa

SEQ ID NO: 1979 - DNA, 2949 bp, Homo sapiens
ggccgtcggcggaggcgccattttgtgtagccgccgaaccttgttggaggttctggggcgcagaaccgctactgctgcttcggtctctccttgggaaaaaataaaatttgaaccttttggagctgtgtgctaaatcttcagtgggacaatgggttcagacaaaagagtgagtagaacagagcgtagtggaagatacggttccatcatagacagggatgaccgtgatgagcgtgaatcccgaagcaggcggagggactcagattacaaaagatctagtgatgatcggaggggtgatagatatgatgactaccgagactatgacagtccagagaatgataaatattcgagaaatgatggagtccttcgaaggccctcagcctgcggatgtgaggctgatgaagaggaaaacaggtgtaagccgtggtttcgccttcgtggagttttatcacttgcaagatgctaccagctggatggaagccaatcagaaaaagttggtgattcaaggaaagcacattgcaatgcattatagcaatcccagacctaagtttgaagattggctttgtaacaagtgctgccttaacaatttcaggaaaagactaaaatgcttccgatgtggagcagacaagtttgactctgaacaggaagtgcctcctggaaccacagagtcggttcagtctgtggattactactgtgatacgatcattcttcggaacatagctccgcacactgtggtggattccatcatgacagcactgtctccttacgcgtctttagctgtcaataacatccgcctcataaaagacaaacagacccagcagaacagaggcttcgcatttgtgcagctgtcctctgcaatggatgcttctcagctgcttcagatattacagagtctccatcctcctttgaaaattgatggcaaaactattggggttgattttgcaaaaagtgccagaaaagacttggtcctctcagatggtaaccgcgtcagcgctttctctgtagctagtacggctattgctgctgctcagtggtcatccacccagtctcaaagtggtgaaggaggcagtgttgactacagttatctgcaaccaggtcaagatggctatgcccaatatgctcagtattcacaggattatcagcagttttatcaacaacaagctggaggattggaatctgatgcatcatctgcatcaggcacagcagtgaccaccacctcagcggctgtagtgtcccagagtcctcagctgtataatcaaacctccaatccacctggctctccgactgaggaagcacagcctagcactagcacaagtacacaggccccagccgcttcccctactggtgtagttcctggtaccaaatatgcagtacctgacacgtccacttaccagtatgatgaatcttcaggatattactatgatccgacaacagggctctattatgaccccaactcgcaatactactataattccttgacccagcagtacctttactgggatggggaaaaagagacctacgtgccagctgcagagtctagctcccaccagcagtcgggcctgcctcctgcaaaagaggggaaagagaagaaggagaaacccaagagcaaaacagcccagcagattgccaaagacatggaacgctgggctaagagtttgaataagcagaaagaaaactttaaaaatagctttcagcctgtcaattccttgagggaagaagaaaggagagaatctgctgcagcagacgctggctttgctctctttgagaagaagggagccttagctgaaaggcagcagctcatcccagaattggtgcgaaatggagatgaggagaatcccctcaaaaggggtctggttgctgcttacagtggtgacagtgacaatgaggaggagctggtggagagacttgagagtgaggaagagaagctagctgactggaagaagatggcctgtctgctctgccggcgccagttcccgaacaaagatgccctagtcaggcaccagcaactctcagaccttcacaagcaaaacatggacatctatcgacgatccaggctgagcgagcaggagctggaagccttggagctaagggagagagagatgaaataccgagaccgagctgcagaaagacgggagaagtacggcattccagaacctccagagcccaagcgcaagaagcagtttgatgccggcactgtgaattacgagcaacccaccaaagatggcattgaccacagtaacattggcaacaagatgctgcaggccatgggctggcgggaaggctctggcttgggacgaaagtgtcaaggcattacggctcccattgaggctcaagttcggctaaagggagctggcctaggagccaaaggcagcgcatatggtttgtcgggcgccgattcctacaaagatgctgtccggaaagccatgtttgcccggttcactgagatggagtgagagagagagagagagagagatgacaaggagcacaagaagtggtccatctcccgaattcgctgttaccgcctgtctctttaagggcatgccttgtgctgttaatagatcttagggtgaaccacttcattctgcagggttctccctcccaccttaaagaagttccccttatgtgggttgcctggtgaatggccttccttcccgccagagggcttgtgaacagaccggagaggacagtggattgtttatactccagtgtacatagtgtaatgtagcgtgtttacatgtgtagcctatgttgtggtccatcagcccctcacattcctaggggtttgagatgctgtaggtggtatgtgacaccaaagccacctctgtcatttgttgtgatgtcttttcttggcaaaagccttgtgtatatttgtatattacacatttgtacagaattttggaagattttcagtctagttgccaaatctggctcctttacaaaagaaataccttg

SEQ ID NO: 1980 - DNA, 2870 bp, Homo sapiens
ggtacaaaatgcagagtgagtagaacagagcgtagtggaagatacggttccatcatagacagggatgaccgtgatgagcgtgaatcccgaagcaggcggagggactcagattacaaaagatctagtgatgatcggaggggtgatagatatgatgactaccgagactatgacagtccagagagagagcgtgaaagaaggaacagtgaccgatccgaagatggctaccattcagatggtgactatggtgagcacgactataggcatgacatcagtgacgagagggagagcaagaccatcatgctgcgcggccttcccatcaccatcacagagagcgatattcgagaaatgatggagtccttcgaaggccctcagcctgcggatgtgaggctgatgaagaggaaaacagaaaaagttggtgattcaaggaaagcacattgcaatgcattatagcaatcccagacctaagtttgaagattggctttgtaacaagtgctgccttaacaatttcaggaaaagactaaaatgcttccgatgtggagcagacaagtttgactctgaacaggaagtgcctcctggaaccacagagtcggttcagtctgtggattactactgtgatacgatcattcttcggaacatagctccgcacactgtggtggattccatcatgacagcactgtctccttacgcgtctttagctgtcaataacatccgcctcataaaagacaaacagacccagcagaacagaggcttcgcatttgtgcagctgtcctctgcaatggatgcttctcagctgcttcagatattacagagtctccatcctcctttgaaaattgatggcaaaactattggggttgattttgcaaaaagtgccagaaaagacttggtcctctcagatggtaaccgcgtcagcgctttctctgtagctagtacggctattgctgctgctcagtggtcatccacccagtctcaaagtggtgaaggaggcagtgttgactacagttatctgcaaccaggtcaagatggctatgcccaatatgctcagtattcacaggattatcagcagttttatcaacaacaagctggaggattggaatctgatgcatcatctgcatcaggcacagcagtgaccaccacctcagcggctgtagtgtcccagagtcctcagctgtataatcaaacctccaatccacctggctctccgactgaggaagcacagcctagcactagcacaagtacacaggccccagccgcttcccctactggtgtagttcctggtaccaaatatgcagtacctgacacgtccacttaccagtatgatgaatcttcaggatattactatgatccgacaacagggctctattatgaccccaactcgcaatactactataattccttgacccagcagtacctttactgggatggggaaaaagagacctacgtgccagctgcagagtctagctcccaccagcagtcgggcctgcctcctgcaaaagaggggaaagagaagaaggagaaacccaagagcaaaacagcccagcagattgccaaagacatggaacgctgggctaagagtttgaataagcagaaagaaaactttaaaaatagctttcagcctgtcaattccttgagggaagaagaaaggagagaatctgctgcagcagacgctggctttgctctctttgagaagaagggagccttagctgaaaggcagcagctcatcccagaattggtgcgaaatggagatgaggagaatcccctcaaaaggggtctggttgctgcttacagtggtgacagtgacaatgaggaggagctggtggagagacttgagagtgaggaagagaagctagctgactggaagaagatggcctgtctgctctgccggcgccagttcccgaacaaagatgccctagtcaggcaccagcaactctcagaccttcacaagcaaaacatggacatctatcgacgatccaggctgagcgagcaggagctggaagccttggagctaagggagagagagatgaaataccgagaccgagctgcagaaagacgggagaagtacggcattccagaacctccagagcccaagcgcaagaagcagtttgatgccggcactgtgaattacgagcaacccaccaaagatggcattgaccacagtaacattggcaacaagatgctgcaggccatgggctggcgggaaggctctggcttgggacgaaagtgtcaaggcattacggctcccattgaggctcaagttcggctaaagggagctggcctaggagccaaaggcagcgcatatggtttgtcgggcgccgattcctacaaagatgctgtccggaaagccatgtttgcccggttcactgagatggagtgagagagagagagagagagagatgacaaggagcacaagaagtggtccatctcccgaattcgctgttaccgcctgtctctttaagggcatgccttgtgctgttaatagatcttagggtgaaccacttcattctgcagggttctccctcccaccttaaagaagttccccttatgtgggttgcctggtgaatggccttccttcccgccagagggcttgtgaacagaccggagaggacagtggattgtttatactccagtgtacatagtgtaatgtagcgtgtttacatgtgtagcctatgttgtggtccatcagcccctcacattcctaggggtttgagatgctgtaggtggtatgtgacaccaaagccacctctgtcatttgttgtgatgtcttttcttggcaaaagccttgtgtatatttgtatattacacatttgtacagaattttggaagattttcagtctagttgccaaatctggctcctttacaaaagaaataccttg

SEQ ID NO: 1981 - DNA, 2944 bp, Homo sapiens
ggtacaaaatgcagagtgagtagaacagagcgtagtggaagatacggttccatcatagacagggatgaccgtgatgagcgtgaatcccgaagcaggcggagggactcagattacaaaagatctagtgatgatcggaggggtgatagatatgatgactaccgagactatgacagtccagagagagagcgtgaaagaaggaacagtgaccgatccgaagatggctaccattcagatggtgactatggtgagcacgactataggcatgacatcagtgacgagagggagagcaagaccatcatgctgcgcggccttcccatcaccatcacagagagcgatattcgagaaatgatggagtccttcgaaggccctcagcctgcggatgtgaggctgatgaagaggaaaacaggtgtaagccgtggtttcgccttcgtggagttttatcacttgcaagatgctaccagctggatggaagccaatcagaaaaagttggtgattcaaggaaagcacattgcaatgcattatagcaatcccagacctaagtttgaagattggctttgtaacaagtgctgccttaacaatttcaggaaaagactaaaatgcttccgatgtggagcagacaagtttgactctgaacaggaagtgcctcctggaaccacagagtcggttcagtctgtggattactactgtgatacgatcattcttcggaacatagctccgcacactgtggtggattccatcatgacagcactgtctccttacgcgtctttagctgtcaataacatccgcctcataaaagacaaacagacccagcagaacagaggcttcgcatttgtgcagctgtcctctgcaatggatgcttctcagctgcttcagatattacagagtctccatcctcctttgaaaattgatggcaaaactattggggttgattttgcaaaaagtgccagaaaagacttggtcctctcagatggtaaccgcgtcagcgctttctctgtagctagtacggctattgctgctgctcagtggtcatccacccagtctcaaagtggtgaaggaggcagtgttgactacagttatctgcaaccaggtcaagatggctatgcccaatatgctcagtattcacaggattatcagcagttttatcaacaacaagctggaggattggaatctgatgcatcatctgcatcaggcacagcagtgaccaccacctcagcggctgtagtgtcccagagtcctcagctgtataatcaaacctccaatccacctggctctccgactgaggaagcacagcctagcactagcacaagtacacaggccccagccgcttcccctactggtgtagttcctggtaccaaatatgcagtacctgacacgtccacttaccagtatgatgaatcttcaggatattactatgatccgacaacagggctctattatgaccccaactcgcaatactactataattccttgacccagcagtacctttactgggatggggaaaaagagacctacgtgccagctgcagagtctagctcccaccagcagtcgggcctgcctcctgcaaaagaggggaaagagaagaaggagaaacccaagagcaaaacagcccagcagattgccaaagacatggaacgctgggctaagagtttgaataagcagaaagaaaactttaaaaatagctttcagcctgtcaattccttgagggaagaagaaaggagagaatctgctgcagcagacgctggctttgctctctttgagaagaagggagccttagctgaaaggcagcagctcatcccagaattggtgcgaaatggagatgaggagaatcccctcaaaaggggtctggttgctgcttacagtggtgacagtgacaatgaggaggagctggtggagagacttgagagtgaggaagagaagctagctgactggaagaagatggcctgtctgctctgccggcgccagttcccgaacaaagatgccctagtcaggcaccagcaactctcagaccttcacaagcaaaacatggacatctatcgacgatccaggctgagcgagcaggagctggaagccttggagctaagggagagagagatgaaataccgagaccgagctgcagaaagacgggagaagtacggcattccagaacctccagagcccaagcgcaagaagcagtttgatgccggcactgtgaattacgagcaacccaccaaagatggcattgaccacagtaacattggcaacaagatgctgcaggccatgggctggcgggaaggctctggcttgggacgaaagtgtcaaggcattacggctcccattgaggctcaagttcggctaaagggagctggcctaggagccaaaggcagcgcatatggtttgtcgggcgccgattcctacaaagatgctgtccggaaagccatgtttgcccggttcactgagatggagtgagagagagagagagagagagatgacaaggagcacaagaagtggtccatctcccgaattcgctgttaccgcctgtctctttaagggcatgccttgtgctgttaatagatcttagggtgaaccacttcattctgcagggttctccctcccaccttaaagaagttccccttatgtgggttgcctggtgaatggccttccttcccgccagagggcttgtgaacagaccggagaggacagtggattgtttatactccagtgtacatagtgtaatgtagcgtgtttacatgtgtagcctatgttgtggtccatcagcccctcacattcctaggggtttgagatgctgtaggtggtatgtgacaccaaagccacctctgtcatttgttgtgatgtcttttcttggcaaaagccttgtgtatatttgtatattacacatttgtacagaattttggaagattttcagtctagttgccaaatctggctcctttacaaaagaaataccttg

SEQ ID NO: 1982 - DNA, 2017 bp, Homo sapiens
aatggtttcagatcaggagaaagagacttggtcctctcagatggtaaccgcgtcagcgctttctctgtagctagtacggctattgctgctgctcagtggtcatccacccagtctcaaagtggtgaaggaggcagtgttgactacagttatctgcaaccaggtcaagatggctatgcccaatatgctcagtattcacaggattatcagcagttttatcaacaacaagctggaggattggaatctgatgcatcatctgcatcaggcacagcagtgaccaccacctcagcggctgtagtgtcccagagtcctcagctgtataatcaaacctccaatccacctggctctccgactgaggaagcacagcctagcactagcacaagtacacaggccccagccgcttcccctactggtgtagttcctggtaccaaatatgcagtacctgacacgtccacttaccagtatgatgaatcttcaggatattactatgatccgacaacagggctctattatgaccccaactcgcaatactactataattccttgacccagcagtacctttactgggatggggaaaaagagacctacgtgccagctgcagagtctagctcccaccagcagtcgggcctgcctcctgcaaaagaggggaaagagaagaaggagaaacccaagagcaaaacagcccagcagattgccaaagacatggaacgctgggctaagagtttgaataagcagaaagaaaactttaaaaatagctttcagcctgtcaattccttgagggaagaagaaaggagagaatctgctgcagcagacgctggctttgctctctttgagaagaagggagccttagctgaaaggcagcagctcatcccagaattggtgcgaaatggagatgaggagaatcccctcaaaaggggtctggttgctgcttacagtggtgacagtgacaatgaggaggagctggtggagagacttgagagtgaggaagagaagctagctgactggaagaagatggcctgtctgctctgccggcgccagttcccgaacaaagatgccctagtcaggcaccagcaactctcagaccttcacaagcaaaacatggacatctatcgacgatccaggctgagcgagcaggagctggaagccttggagctaagggagagagagatgaaataccgagaccgagctgcagaaagacgggagaagtacggcattccagaacctccagagcccaagcgcaagaagcagtttgatgccggcactgtgaattacgagcaacccaccaaagatggcattgaccacagtaacattggcaacaagatgctgcaggccatgggctggcgggaaggctctggcttgggacgaaagtgtcaaggcattacggctcccattgaggctcaagttcggctaaagggagctggcctaggagccaaaggcagcgcatatggtttgtcgggcgccgattcctacaaagatgctgtccggaaagccatgtttgcccggttcactgagatggagtgagagagagagagagagagagatgacaaggagcacaagaagtggtccatctcccgaattcgctgttaccgcctgtctctttaagggcatgccttgtgctgttaatagatcttagggtgaaccacttcattctgcagggttctccctcccaccttaaagaagttccccttatgtgggttgcctggtgaatggccttccttcccgccagagggcttgtgaacagaccggagaggacagtggattgtttatactccagtgtacatagtgtaatgtagcgtgtttacatgtgtagcctatgttgtggtccatcagcccctcacattcctaggggtttgagatgctgtaggtggtatgtgacaccaaagccacctctgtcatttgttgtgatgtcttttcttggcaaaagccttgtgtatatttgtatattacacatttgtacagaattttggaagattttcagtctagttgccaaatctggctcctttacaaaagaaataccttg

SEQ ID NO: 1983 - DNA, 3748 bp, Homo sapiens
acggcgggagtaagagtctgcgggaccggcagctgtacttcatctcccagcgggccgagcgctgaaggcagcggcgcggcgcctttgtggtagcagtggccccgcgcggaggaagttccggtgtccgcggcgctgggtcggtggcggaggctgaggagaaggaggagcgggccgtggaggcttcgccgcctaggtactgctataaccagaatttggtagaaaaaggatttacttgttggggccctcttgataaaaagagatgtggggggattctcgacctgctaacagaactggaccttttcgtgggagccaagaagaaaggtttgctcccgggtggaacagggattatcctcctcctccccttaagagtcatgctcaagagagacactctggcaactttcctggcagagattcacttccctttgatttccaggggcattcggggcctccttttgcaaatgtagaggagcattctttcagctatggagctagagacggaccgcatggtgactatcgaggaggggagggacctggacatgatttcagggggggagatttttcgtcttctgatttccagagcagagattcatcacagttggacttcaggggtagggacatacattctggggattttcgggatagagaaggaccacctatggactataggggtggagatggtacttctatggattatagaggtagggaggcacctcatatgaactacagagacagggatgctcacgctgttgacttcagaggtagggatgctcctccatctgacttcaggggccggggcacttatgatttagattttagaggccgggatggatcccatgcagattttaggggaagggatttatcagatttggattttagggccagagaacagtcccgttctgattttaggaatagagatgtatctgatttggactttagagacaaagacggaacacaagtagactttagaggccgaggttcaggtactactgatctagactttagggacagggatacgccacattcagatttcagaggtagacaccgatctaggactgatcaggattttaggggcagagagatgggatcttgtatggaatttaaagatagggagatgccccctgtggatccaaatattttggattacattcagccctctacacaagatagagaacattctggtatgaatgtgaacaggagagaagaatccacacatgaccatacgatagaaaggcctgcttttggcattcagaagggagaatttgagcattcagaaacaagagaaggagaaacacaaggtgtagcctttgaacatgagtctccagcagactttcagaacagccaaagtccagttcaagaccaagataagtcacagctttctggacgtgaagagcagagttcagatgctggtctgtttaaagaagaaggcggtctggactttcttgggcggcaagacaccgattacagaagcatggagtaccgtgatgtggatcataggctgccaggaagccagatgtttggctatggccagagcaagtcttttccagagggcaaaactgcccgagatgcccaacgggaccttcaggatcaagattataggaccggcccaagtgaggagaaacccagcaggcttattcgattaagtggggtacctgaagatgccacaaaagaagagattcttaatgcttttcggactcctgatggcatgcctgtaaagaacttgcagttgaaggagtataacacaggttacgactatggctatgtctgcgtggagttttcactcttggaagatgccatcggatgcatggaggccaaccagggaactctaatgatccaggacaaagaagttaccctggagtatgtatcaagcctggatttttggtactgcaaacgatgtaaggcaaacattggtgggcaccgatcttcctgttcattctgcaagaacccaagagaagtgacagaggccaagcaagaattaataacctaccctcagcctcagaaaacatccataccagcaccattggaaaaacagcccaaccagcccctaagaccagctgataaggaacctgaacccaggaagagggaagaaggccaagagtcacgcttaggacatcaaaagagagaagcagaaaggtatctgcctccttctcgaagggaagggccaactttccgaagagaccgagagagggagtcatggtctggagagacacgccaggatggagagagcaaaactatcatgctaaagcgtatctatcgttccacaccacctgaggtgatagtggaagtgctggagccctatgtccgccttactactgccaacgtccgtatcatcaagaacagaacaggccctatggggcatacctatggctttattgacctcgactcccatgcggaagctcttcgtgtggtgaagatcttacagaaccttgatccgccatttagcattgatgggaagatggtagctgtaaacctggccactggaaaacgaagaaatgattctggggaccattctgaccacatgcattactatcagggtaaaaaatatttccgagataggaggggaggtggcagaaattcagactggtcttcagatacaaatcgacaaggacaacagtcatcatctgactgctacatatatgattctgctactggctactattatgaccccttggcaggaacttattatgaccccaatacccagcaagaagtctatgtgccccaggatcctggattacctgaggaagaagagatcaaggaaaaaaaacccaccagtcaaggaaagtcaagtagcaagaaggaaatgtctaaaagagatggcaaggagaaaaaagacagaggagtgacgaggtttcaggaaaatgccagtgaagggaaggcccctgcagaagacgtctttaagaagcccctgcctcctactgtgaagaaggaagagagtccccctccacctaaagtggtaaacccactgatcggcctcttgggtgaatatggaggagacagtgactatgaggaggaagaagaggaggaacagacccctcccccacagccccgcacagcacagccccagaagcgagaggagcaaaccaagaaggagaatgaagaagacaaactcactgactggaataaactggcttgtctgctttgcagaaggcagtttcccaataaagaagttctgatcaaacaccagcagctgtcagacctgcacaagcaaaacctggaaatccaccggaagataaaacagtctgagcaggagctagcctatctggaaaggagagaacgagagggaaagtttaaaggaagaggaaatgatcgcagggaaaagctccagtcttttgactctccagaaaggaaacggattaagtactccagggaaactgacagtgatcgtaaacttgttgataaagaagatatcgacactagcagcaaaggaggctgtgtccaacaggctactggctggaggaaagggacaggcctgggatatggccatcctggattggcttcatcagaggaggctgaaggccggatgaggggccccagtgttggagcctcaggaagaaccagcaaaagacagtccaacgagacttaccgagatgctgttcgaagagtcatgtttgctcgatataaagaactcgattaagaaaggagacaagttccatgggatacaacctccctcttgttttgtttgtctctccttttcttttgttactgttcttgctgctagaacttttttaaataaactttttttcaatgtgat

SEQ ID NO: 1984 - DNA, 591 bp, Homo sapiens
ttcatctcccagcgggccgagcgctgaaggcagcggcgcggcgcctttgtggtagcagtggccccgcgcggaggaagttccggtgtccgcggcgctgggtactgctataaccagaatttggtagaaaaaggatttacttgttggggccctcttgataaaaagagatgtggggggattctcgacctgctaacagaactggaccttttcgtgggagccaagaagaaaggtttgctcccgggtggaacagggattatcctcctcctccccttaagagtcatgctcaagagagacactctggcaactttcctggcagagattcacttccctttgatttccaggggcattcggggcctccttttgcaaatgtagaggagcattctttcagctatggagctagagacggaccgcatggtgactatcgaggaggggagggacctggacatgatttcagggggggagatttttcgtcttctgatttccagagcagagattcatcacagttggacttcaggggtagggacatacattctggggattttcgggatagagaaggaccacctatggactataggggtggagatggtacttcta

SEQ ID NO: 1985 - DNA, 2324 bp, Homo sapiens
agcggcgcggcgcctttgtggtagcagtggccccgcgcggaggaagttccggtgtccgcggcgctgggtcggtggcggaggctgaggagaaggaggagcgggccgtggaggcttcgccgcctaggtactgctataaccagaatttggtagaaaaaggatttacttgttggggccctcttgataaaaagagatgtggggggattctcgacctgctaacagaactggaccttttcggatcaagattataggaccggcccaagtgaggagaaacccagcaggcttattcgattaagtggggtacctgaagatgccacaaaagaagagattcttaatgcttttcggactcctgatggcatgcctgtaaagaacttgcagttgaaggagtataacacagggaactctaatgatccaggacaaagaagttaccctggagtatgtatcaagcctggatttttggtactgcaaacgatgtaaggcaaacattggtgggcaccgatcttcctgttcattctgcaagaacccaagagaagtgacagaggccaagcaagaattaataacctaccctcagcctcagaaaacatccataccagcaccattggaaaaacagcccaaccagcccctaagaccagctgataaggaacctgaacccaggaagagggaagaaggccaagagtcacgcttaggacatcaaaagagagaagcagaaaggtatctgcctccttctcgaagggaagggccaactttccgaagagaccgagagagggagtcatggtctggagagacacgccaggatggagagagcaaaactatcatgctaaagcgtatctatcgttccacaccacctgaggtgatagtggaagtgctggagccctatgtccgccttactactgccaacgtccgtatcatcaagaacagaacaggccctatggggcatacctatggctttattgacctcgactcccatgcggaagctcttcgtgtggtgaagatcttacagaaccttgatccgccatttagcattgatgggaagatggtagctgtaaacctggccactggaaaacgaagaaatgattctggggaccattctgaccacatgcattactatcagggtaaaaaatatttccgagataggaggggaggtggcagaaattcagactggtcttcagatacaaatcgacaaggacaacagtcatcatctgactgctacatatatgattctgctactggctactattatgaccccttggcaggaacttattatgaccccaatacccagcaagaagtctatgtgccccaggatcctggattacctgaggaagaagagatcaaggaaaaaaaacccaccagtcaaggaaagtcaagtagcaagaaggaaatgtctaaaagagatggcaaggagaaaaaagacagaggagtgacgaggtttcaggaaaatgccagtgaagggaaggcccctgcagaagacgtctttaagaagcccctgcctcctactgtgaagaaggaagagagtccccctccacctaaagtggtaaacccactgatcggcctcttgggtgaatatggaggagacagtgactatgaggaggaagaagaggaggaacagacccctcccccacagccccgcacagcacagccccagaagcgagaggagcaaaccaagaaggagaatgaagaagacaaactcactgactggaataaactggcttgtctgctttgcagaaggcagtttcccaataaagaagttctgatcaaacaccagcagctgtcagacctgcacaagcaaaacctggaaatccaccggaagataaaacagtctgagcaggagctagcctatctggaaaggagagaacgagagggaaagtttaaaggaagaggaaatgatcgcagggaaaagctccagtcttttgactctccagaaaggaaacggattaagtactccagggaaactgacagtgatcgtaaacttgttgataaagaagatatcgacactagcagcaaaggaggctgtgtccaacaggctactggctggaggaaagggacaggcctgggatatggccatcctggattggcttcatcagaggaggctgaaggccggatgaggggccccagtgttggagcctcaggaagaaccagcaaaagacagtccaacgagacttaccgagatgctgttcgaagagtcatgtttgctcgatataaagaactcgattaagaaaggagacaagttccatgggatacaacctccctcttgttttgtttgtctctccttttcttttgttactgttcttgctgctagaacttttttaaataaactttttttcaatgtg

SEQ ID NO: 1986 - DNA, 1886 bp, Homo sapiens
cggtgtccgcggcgctgggtcggtggcggaggctgaggagaaggaggagcgggccgtggaggcttcgccgcctaggtactgctataaccagaatttggtagaaaaaggatttacttgttggggccctcttgataaaaagagatgtggggggattctcgacctgctaacagaactggaccttttcgtgggagccaagaagaaaggtttgctcccgggtggaacagggattatcctcctcctccccttaagagtcatgctcaagagagacactctggcaactttcctggcagagattcacttccctttgatttccaggggcattcggggcctccttttgcaaatgtagaggagcattctttcagctatggagctagagacggaccgcatggtgactatcgaggaggggagggacctggacatgatttcagggggggagatttttcgtcttctgatttccagagcagagattcatcacagttggacttcaggggtagggacatacattctggggattttcgggatagagaaggaccacctatggactataggggtggagatggtacttctatggattatagaggtagggaggcacctcatatgaactacagagacagggatgctcacgctgttgacttcagaggtagggatgctcctccatctgacttcaggggccggggcacttatgatttagattttagaggccgggatggatcccatgcagattttaggggaagggatttatcagatttggattttagggccagagaacagtcccgttctgattttaggaatagagatgtatctgatttggactttagagacaaagacggaacacaagtagactttagaggccgaggttcaggtactactgatctagactttagggacagggatacgccacattcagatttcagaggtagacaccgatctaggactgatcaggattttaggggcagagagatgggatcttgtatggaatttaaagatagggagatgccccctgtggatccaaatattttggattacattcagccctctacacaagatagagaacattctggtatgaatgtgaacaggagagaagaatccacacatgaccatacgatagaaaggcctgcttttggcattcagaagggagaatttgagcattcagaaacaagagaaggagaaacacaaggtgtagcctttgaacatgagtctccagcagactttcagaacagccaaagtccagttcaagaccaagataagtcacagctttctggacgtgaagagcagagttcagatgctggtctgtttaaagaagaaggcggtctggactttcttgggcggcaagacaccgattacagaagcatggagtaccgtgatgtggatcataggctgccaggaagccagatgtttggctatggccagagcaagtcttttccagagggcaaaactgcccgagatgcccaacgggaccttcaggatcaagattataggaccggcccaagtgaggagaaacccagcaggcttattcgattaagtggggtacctgaagatgccacaaaagaagagattcttaatgcttttcggactcctgatggcatgcctgtaaagaacttgcagttgaaggagtataacacagggaactctaatgatccaggacaaagaagttaccctggagtatgtatcaagcctggatttttggtactgcaaacgatgtaaggcaaacattggtgggcaccgatcttcctgttcattctgcaagaacccaagagaagtgacagaggccaagcaagaattaataacctaccctcagcctcagaaaacatccataccagcaccattggaaaaacagcccaaccagcccctaagaccagctgataaggaacctgaacccaggaaga

SEQ ID NO: 1987 - DNA, 582 bp, Homo sapiens
agtagattaccggtcccgccgcggagcggccagctgtgaggctggggccggcgcgtggttgcggctctgtgctcctactcttcggagctgtaagcgggctgttcttgcggttttcctgtttcagatccaattctgtggcatcactaggaagggagctcttgtgcttagcacgtagcctcgtcctcagacttggacagacacaagggaggctccgctggaccggagggcacaagagctccgagcccggtcgtcggggcggtagaacctggaagcgggagagtggtctggtactgctataaccagaatttggtagaaaaaggatttacttgttggggccctcttgataaaaagagatgtggggggattctcgacctgctaacagaactggaccttttcgtgggagccaagaagaaaggtttgctcccgggtggaacagggattatcctcctcctccccttaagagtcatgctcaagagagacactctggcaactttcctggcagagattcacttccctttgatttccaggggcattcggggcctccttttgcaaatgtagaggagcattctttcagctatggag

SEQ ID NO: 1988 - DNA, 2260 bp, Homo sapiens
gaaggcaagtcccctgcgcgcggggcacggcgggagtaagagtctgcgggaccggcagctgtacttcatctcccagcgggccgagcgctgaaggcagcggcgcggcgcctttgtggtagcagtggccccgcgcggaggaagttccggtgtccgcggcgctgggtcggtggcggaggctgaggagaaggaggagcgggccgtggaggcttcgccgcctaggtactgctataaccagaatttggtagaaaaaggatttacttgttggggccctcttgataaaaagagatgtggggggattctcgacctgctaacagaactggaccttttcgggaactctaatgatccaggacaaagaagttaccctggagtatgtatcaagcctggatttttggtactgcaaacgatgtaaggcaaacattggtgggcaccgatcttcctgttcattctgcaagaacccaagagaagtgacagaggccaagcaagaattaataacctaccctcagcctcagaaaacatccataccagcaccattggaaaaacagcccaaccagcccctaagaccagctgataaggaacctgaacccaggaagagggaagaaggccaagagtcacgcttaggacatcaaaagagagaagcagaaaggtatctgcctccttctcgaagggaagggccaactttccgaagagaccgagagagggagtcatggtctggagagacacgccaggatggagagagcaaaactatcatgctaaagcgtatctatcgttccacaccacctgaggtgatagtggaagtgctggagccctatgtccgccttactactgccaacgtccgtatcatcaagaacagaacaggccctatggggcatacctatggctttattgacctcgactcccatgcggaagctcttcgtgtggtgaagatcttacagaaccttgatccgccatttagcattgatgggaagatggtagctgtaaacctggccactggaaaacgaagaaatgattctggggaccattctgaccacatgcattactatcagggtaaaaaatatttccgagataggaggggaggtggcagaaattcagactggtcttcagatacaaatcgacaaggacaacagtcatcatctgactgctacatatatgattctgctactggctactattatgaccccttggcaggaacttattatgaccccaatacccagcaagaagtctatgtgccccaggatcctggattacctgaggaagaagagatcaaggaaaaaaaacccaccagtcaaggaaagtcaagtagcaagaaggaaatgtctaaaagagatggcaaggagaaaaaagacagaggagtgacgaggtttcaggaaaatgccagtgaagggaaggcccctgcagaagacgtctttaagaagcccctgcctcctactgtgaagaaggaagagagtccccctccacctaaagtggtaaacccactgatcggcctcttgggtgaatatggaggagacagtgactatgaggaggaagaagaggaggaacagacccctcccccacagccccgcacagcacagccccagaagcgagaggagcaaaccaagaaggagaatgaagaagacaaactcactgactggaataaactggcttgtctgctttgcagaaggcagtttcccaataaagaagttctgatcaaacaccagcagctgtcagacctgcacaagcaaaacctggaaatccaccggaagataaaacagtctgagcaggagctagcctatctggaaaggagagaacgagagggaaagtttaaaggaagaggaaatgatcgcagggaaaagctccagtcttttgactctccagaaaggaaacggattaagtactccagggaaactgacagtgatcgtaaacttgttgataaagaagatatcgacactagcagcaaaggaggctgtgtccaacaggctactggctggaggaaagggacaggcctgggatatggccatcctggattggcttcatcagaggaggctgaaggccggatgaggggccccagtgttggagcctcaggaagaaccagcaaaagacagtccaacgagacttaccgagatgctgttcgaagagtcatgtttgctcgatataaagaactcgattaagaaaggagacaagttccatgggatacaacctccctcttgttttgtttgtctctccttttcttttgttactgttcttgctgctagaacttttttaaataaactttttttcaatgtga

SEQ ID NO: 1989 - DNA, 4010 bp, Homo sapiens
agtaagagtctgcgggaccggcagctgtacttcatctcccagcgggccgagcgctgaaggcagcggcgcggcgcctttgtggtagcagtggccccgcgcggaggaagttccggtgtccgcggcgctgggtcggtggcggaggctgaggagaaggaggagcgggccgtggaggcttcgccgcctaggtactgctataaccagaatttggtagaaaaaggatttacttgttggggccctcttgataaaaagagatgtggggggattctcgacctgctaacagaactggaccttttcggactgggtgaaagctttttctgcagcagtcatgttgaaaaccttgtgttgactttcctcgtgttctgaaatgggagcataaaagtttactccgccacttcgtcttaaaatagcaaaactttgctgttttctgcagatctaggaccttgttacagaactctgccaaaaaaaaaatgtttacagaagaatgtgctgtgattagagaagaatatgctggtgtgtagatttcaaactctctggacaatatgaataacactgtctttgtttctacagtgggagccaagaagaaaggtttgctcccgggtggaacagggattatcctcctcctccccttaagagtcatgctcaagagagacactctggcaactttcctggcagagattcacttccctttgatttccaggggcattcggggcctccttttgcaaatgtagaggagcattctttcagctatggagctagagacggaccgcatggtgactatcgaggaggggagggacctggacatgatttcagggggggagatttttcgtcttctgatttccagagcagagattcatcacagttggacttcaggggtagggacatacattctggggattttcgggatagagaaggaccacctatggactataggggtggagatggtacttctatggattatagaggtagggaggcacctcatatgaactacagagacagggatgctcacgctgttgacttcagaggtagggatgctcctccatctgacttcaggggccggggcacttatgatttagattttagaggccgggatggatcccatgcagattttaggggaagggatttatcagatttggattttagggccagagaacagtcccgttctgattttaggaatagagatgtatctgatttggactttagagacaaagacggaacacaagtagactttagaggccgaggttcaggtactactgatctagactttagggacagggatacgccacattcagatttcagaggtagacaccgatctaggactgatcaggattttaggggcagagagatgggatcttgtatggaatttaaagatagggagatgccccctgtggatccaaatattttggattacattcagccctctacacaagatagagaacattctggtatgaatgtgaacaggagagaagaatccacacatgaccatacgatagaaaggcctgcttttggcattcagaagggagaatttgagcattcagaaacaagagaaggagaaacacaaggtgtagcctttgaacatgagtctccagcagactttcagaacagccaaagtccagttcaagaccaagataagtcacagctttctggacgtgaagagcagagttcagatgctggtctgtttaaagaagaaggcggtctggactttcttgggcggcaagacaccgattacagaagcatggagtaccgtgatgtggatcataggctgccaggaagccagatgtttggctatggccagagcaagtcttttccagagggcaaaactgcccgagatgcccaacgggaccttcaggatcaagattataggaccggcccaagtgaggagaaacccagcaggcttattcgattaagtggggtacctgaagatgccacaaaagaagagattcttaatgcttttcggactcctgatggcatgcctgtaaagaacttgcagttgaaggagtataacacaggttacgactatggctatgtctgcgtggagttttcactcttggaagatgccatcggatgcatggaggccaaccagggaactctaatgatccaggacaaagaagttaccctggagtatgtatcaagcctggatttttggtactgcaaacgatgtaaggcaaacattggtgggcaccgatcttcctgttcattctgcaagaacccaagagaagtgacagaggccaagcaagaattaataacctaccctcagcctcagaaaacatccataccagcaccattggaaaaacagcccaaccagcccctaagaccagctgataaggaacctgaacccaggaagagggaagaaggccaagagtcacgcttaggacatcaaaagagagaagcagaaaggtatctgcctccttctcgaagggaagggccaactttccgaagagaccgagagagggagtcatggtctggagagacacgccaggatggagagagcaaaactatcatgctaaagcgtatctatcgttccacaccacctgaggtgatagtggaagtgctggagccctatgtccgccttactactgccaacgtccgtatcatcaagaacagaacaggccctatggggcatacctatggctttattgacctcgactcccatgcggaagctcttcgtgtggtgaagatcttacagaaccttgatccgccatttagcattgatgggaagatggtagctgtaaacctggccactggaaaacgaagaaatgattctggggaccattctgaccacatgcattactatcagggtaaaaaatatttccgagataggaggggaggtggcagaaattcagactggtcttcagatacaaatcgacaaggacaacagtcatcatctgactgctacatatatgattctgctactggctactattatgaccccttggcaggaacttattatgaccccaatacccagcaagaagtctatgtgccccaggatcctggattacctgaggaagaagagatcaaggaaaaaaaacccaccagtcaaggaaagtcaagtagcaagaaggaaatgtctaaaagagatggcaaggagaaaaaagacagaggagtgacgaggtttcaggaaaatgccagtgaagggaaggcccctgcagaagacgtctttaagaagcccctgcctcctactgtgaagaaggaagagagtccccctccacctaaagtggtaaacccactgatcggcctcttgggtgaatatggaggagacagtgactatgaggaggaagaagaggaggaacagacccctcccccacagccccgcacagcacagccccagaagcgagaggagcaaaccaagaaggagaatgaagaagacaaactcactgactggaataaactggcttgtctgctttgcagaaggcagtttcccaataaagaagttctgatcaaacaccagcagctgtcagacctgcacaagcaaaacctggaaatccaccggaagataaaacagtctgagcaggagctagcctatctggaaaggagagaacgagagggaaagtttaaaggaagaggaaatgatcgcagggaaaagctccagtcttttgactctccagaaaggaaacggattaagtactccagggaaactgacagtgatcgtaaacttgttgataaagaagatatcgacactagcagcaaaggaggctgtgtccaacaggctactggctggaggaaagggacaggcctgggatatggccatcctggattggcttcatcagaggaggctgaaggccggatgaggggccccagtgttggagcctcaggaagaaccagcaaaagacagtccaacgagacttaccgagatgctgttcgaagagtcatgtttgctcgatataaagaactcgattaagaaaggagacaagttccatgggatacaacctccctcttgttttgtttgtctctccttttcttttgttactgttcttgctgctagaacttttttaaataaactttttttcaatgtg

SEQ ID NO: 1990 - DNA, 2128 bp, Homo sapiens
agctgtacttcatctcccagcgggccgagcgctgaaggcagcggcgcggcgcctttgtggtagcagtggccccgcgcggaggaagttccggtgtccgcggcgctgggtcggtggcggaggctgaggagaaggaggagcgggccgtggaggcttcgccgcctaggtactgctataaccagaatttggtagaaaaaggatttacttgttggggccctcttgataaaaagagatgtggggggattctcgacctgctaacagaactggaccttttcgtgtaaggcaaacattggtgggcaccgatcttcctgttcattctgcaagaacccaagagaagtgacagaggccaagcaagaattaataacctaccctcagcctcagaaaacatccataccagcaccattggaaaaacagcccaaccagcccctaagaccagctgataaggaacctgaacccaggaagagggaagaaggccaagagtcacgcttaggacatcaaaagagagaagcagaaaggtatctgcctccttctcgaagggaagggccaactttccgaagagaccgagagagggagtcatggtctggagagacacgccaggatggagagagcaaaactatcatgctaaagcgtatctatcgttccacaccacctgaggtgatagtggaagtgctggagccctatgtccgccttactactgccaacgtccgtatcatcaagaacagaacaggccctatggggcatacctatggctttattgacctcgactcccatgcggaagctcttcgtgtggtgaagatcttacagaaccttgatccgccatttagcattgatgggaagatggtagctgtaaacctggccactggaaaacgaagaaatgattctggggaccattctgaccacatgcattactatcagggtaaaaaatatttccgagataggaggggaggtggcagaaattcagactggtcttcagatacaaatcgacaaggacaacagtcatcatctgactgctacatatatgattctgctactggctactattatgaccccttggcaggaacttattatgaccccaatacccagcaagaagtctatgtgccccaggatcctggattacctgaggaagaagagatcaaggaaaaaaaacccaccagtcaaggaaagtcaagtagcaagaaggaaatgtctaaaagagatggcaaggagaaaaaagacagaggagtgacgaggtttcaggaaaatgccagtgaagggaaggcccctgcagaagacgtctttaagaagcccctgcctcctactgtgaagaaggaagagagtccccctccacctaaagtggtaaacccactgatcggcctcttgggtgaatatggaggagacagtgactatgaggaggaagaagaggaggaacagacccctcccccacagccccgcacagcacagccccagaagcgagaggagcaaaccaagaaggagaatgaagaagacaaactcactgactggaataaactggcttgtctgctttgcagaaggcagtttcccaataaagaagttctgatcaaacaccagcagctgtcagacctgcacaagcaaaacctggaaatccaccggaagataaaacagtctgagcaggagctagcctatctggaaaggagagaacgagagggaaagtttaaaggaagaggaaatgatcgcagggaaaagctccagtcttttgactctccagaaaggaaacggattaagtactccagggaaactgacagtgatcgtaaacttgttgataaagaagatatcgacactagcagcaaaggaggctgtgtccaacaggctactggctggaggaaagggacaggcctgggatatggccatcctggattggcttcatcagaggaggctgaaggccggatgaggggccccagtgttggagcctcaggaagaaccagcaaaagacagtccaacgagacttaccgagatgctgttcgaagagtcatgtttgctcgatataaagaactcgattaagaaaggagacaagttccatgggatacaacctccctcttgttttgtttgtctctccttttcttttgttactgttcttgctgctagaacttttttaaataaactttttttcaatgtg

SEQ ID NO: 1991 - DNA, 4799 bp, Homo sapiens
cacccctcatccagtctcttccagcctagagatcctggcctacccctccgccaaagcgcgcactgagtgcaaaccccagagtcaatccctgtcccggctccgccccccgcgtccgaatcccgcccagccgggccctcaagcccagtcgggactcgagcctagggaggcgaggttcccgcaccggataggaacattctgttgttttcctctgccatctagtggcaaaagaaagtaattttcctggttttttgaatggatagccataccttaaaaagcatccagattgcgcagtagtgctagcggcttcgcggttcagtcctcctaactgacagccgccactggtgctgagctgctaggaagcccctgtcggcgagcttgttggagcttgaacccactgtcacccctccgactcaccggcaaaaaaaaaaatggttgaagcagatcgcccaggaaagctcttcattggtgggcttaatacggaaacaaatgagaaagctcttgaaacagtatttggcaaatatggacgaatagtggaagtactcttgataaaagaccgtgaaaccaacaaatcaagaggatttgcttttgtcacctttgaaagcccagcagacgctaaggatgcagccagagacatgaatggaaagtcattagatggaaaagccatcaaggtggaacaagccaccaaaccatcatttgaaagaggtagacatggaccgcccccacctccaagaagtagaggtcctccaagaggttttggagctggaagaggaggaagtggaggaaccaggggacctccttcacgaggaggacacatggatgatggtggatattccatgaattttaacatgagttcttccaggggaccactcccagtaaaaagaggaccaccaccaagaagtgggggtccttctcctaagagatctgcaccttcaggactagttcgcagcagcagtggaatgggaggaagagctcctctatcacgtggaagagatagttatggaggtccacctcgaagggaaccgctcccctctcgtagagatgtttatttgtccccaagagatgatgggtattctactaaagacagctattcaagcagagattacccaagttctcgtgatacaagagattatgcaccaccaccacgagattatacttaccgtgattatggtcattccagttcacgtgatgactatccatcaagaggctatggcgatagagatggatatggtcgtgatcgtgactattcagatcatccaagtggaggttcctacagagattcatatgagagttatggtaactcacgtagtgctccacttacacgagggcccccgccatcttatggtggaagcagtcgctatgatgattatagcagctcacgtgatggatatggtggaagtcgagacagttactcaagcagccgaagtgatctctactcaagttgtgacagggttggcagacaagaaagagggcttcccccttctgtagaaagggggtacccttcttcacgtgattcctacagcagttcaagccgcggagcaccaagaggtgctggccctggaggaagccgatctgatagagggggaggcagaagcagatactagaaacaaacaaaactttggaccaaaatcccagttcaaagaaacaaaaaaaagagtggaaactattctatcataactacccaaggactactaaaaggaaaaattgtgttaccttttttaaattccctgttaagtcccttccgtaatttttatgttcttgtgaggaaaaaagtaaaacatgtttaattttatttgactttatgacattgcttttcaacaagcaaatgttaaatgtgttaagccttgtagtactagtgttgtaactttccaagtaaaggtgtccctaaagaccacttcctatctggtttttcccagtaaatgaggcaagcaattctaagatcttccacaaaacatctagccaactaaaatggagagatgaatcattctgcctatacaaacaagctagctattagagggtggttggagtatgctactcataagatttcagggtgttttctaactgaaatctcactgttctcagtatgcaaaacctgaaatcagatgcctatgtaaggaaagtgctattcacccagtaaacccaaaaaaagcaaatggataatgctggccattttgcctttctgacatttccttgggaatctgcaagaacctcccctttcccctcccacaataagaccatttaagtgtgtgctaaacaactacggaatactaaataaaaagtttggccaaaaccaaccatgaagctgcaaaggtgcttgctcttactctttcaaatttttgcaactctaatgtctcacttttaaaggaacagcttgattgcaaaggagaaaatagataagcaatgaatttatctccaacttcctaaaggcttatgacttctaaaaagtgaatctatcagcattccacatcagatttaaagcatcaaatgcctgtgaaacagcaaagatggttgaagattgtgctcattatgtttgtggagtgctgattgattcacagtagataacgctggcagtaagagaaatcaaatgctaagagttgttgaagcagaaggcggctgattgttggtaagtcagtgcagttgcataagcagtgctgtcagaattggtttggtgcaggcaatagattttgccttcaagggttcctgtggatctcaggaaggcatcagtgttgattaacactcataactagggagtgagtggtagttacttaagtaattgaccaaatggaaaaggggaagtaattaaggaaattggtaagtggaggtagtcaggaggttctcgtggtcctttacacagattttacagctttgggtttcattttgtttagctaaagtcatggggacaactcttcaatttagaacttaagatgaattataaaaatgatggatataagtggtagctctatctggtgaagtgtcttgtcagtaagtgaaacatttttttgtggtggcttatccacaaacagtttagttgtagaataaaacttatgagtgacatctggaaagtaacaaccatgctaagatggcaaacacactggaaacaattgggccacttggctttcttttgctgtattgttttataagcctgctttacctccccgtcttggaaacaagttttagtttattgctttggagactagagccaatagtgtaatgttctcaaaggaaacagacttgagttgttggattagaggaactaactcaacttctaattttttttgttgtaattatggcactgtcatgttttaacatttgcaactagggatagtaagtacaacatttttaactctcatttggcagactactactaatcacagaccacaagggtaatgaccaaatttatgtggttgttacacttccatagttgtcttagccgaatccttccatattcttatgattacttgggttaaagcttctgtgaggaccttttggctcttaagatatcctaaatatttaaaatatttagatatcctaaatataggatatagagtttgtaccaaatatgaatgaatattgttcaaagcaaggagtatgttaaaatgaccagacacctgtttgataaatagtttactgaactagcagacgtgtggaaaaagaatcagatcttgattcttctgggtttatactggttgtaaaacagaatgatattagaaaatgttttccttgtttaagtggtagttgaacatagaacttgggtattatagatcacttttcactttttggaatgttttgtattgaaacttaatacaactttaacatggcaaaaaaaaaaaaaatccaaaatctatgagataattttgttaaagttggcttgcttgggcgggtgcttggtccagagggagaaaagaaggcatgatttcagaatactctggcagctttttaaattcagctttatcaagttacagtaaactgtatctgtttagaattacaactcaatggttattttgacagatgtatatgccatgaagccactgtcaccatcaacatgcagaacacttccatcgcccccaaaagattcctcaagttcctttgcagtccatccctcacgctgctgatttgtctttgtcaccatatattagtttgctttgtggtggtgtttagtattttatataaatgggattgtgtagcatgtacttttttgtttatggtttctttcacacacaatgactttgaaattcaccaggttgcagtgtatcagtagcttattccttttattgctgagtagtgtcccattatgtgaatatgccattatttgtttttctactcacctgttgatggaccttgggattgtttccagtttggggctactgtgaataaaactgttaggaacatttgtgtacaagccactgtgtagacataggttttcctttctcttgggtaaatacctaccagtaaaatggttgggttgcatggcagatttatgtttaataaagtaactgccaaactgtttgttttccaaaggggctatacccttttatattcccaccagggttgtatagagttccaactgccaacactcagttttcagccattctgatgggaatctagtggtatctcattgtggttttattttcatttccccgggtgactaatgctggtaagcatcttttaaggtactttttggccagttgtatattttctgtgaagtggctgtcaaatcttttgcccacttttaattggattgtttgtcttattgagttgtaaaagttctttatatatactgtattaaagtcctttgtaagaca

SEQ ID NO: 1992 - DNA, 5084 bp, Homo sapiens
gtggcccccaccccttccctcctccatttccatccattccgcgatcgcggcggaccccaccgtcatcgcgcgccgtgagtcacactccacagccaatccctggccacatccgggctcgcccccgccccgcccccttgttcccgcaagcccggaactgcccaaatcccgcccctcccctcccaaaaaaacacccctcatccagtctcttccagcctagagatcctggcctacccctccgccaaagcgcgcactgagtgcaaaccccagagtcaatccctgtcccggctccgccccccgcgtccgaatcccgcccagccgggccctcaagcccagtcgggactcgagcctagggaggcgaggttcccgcaccggatagcatgtttttggcccagaggagcctctgctctcttagcggtagagcaaaattcctgaagacaatttcttcttccaaaatcctcggattctctacttctgctgaacattctgttgttttcctctgccatctagtggcaaaagaaagtaattttcctggttttttgaatggatagccataccttaaaaagcatccagattgcgcagtagtgctagcggcttcgcggttcagtcctcctaactgacagccgccactggtgctgagctgctaggaagcccctgtcggcgagcttgttggagcttgaacccactgtcacccctccgactcaccggcaaaaaaaaaaatggttgaagcagatcgcccaggaaagctcttcattggtgggcttaatacggaaacaaatgagaaagctcttgaaacagtatttggcaaatatggacgaatagtggaagtactcttgataaaagaccgtgaaaccaacaaatcaagaggatttgcttttgtcacctttgaaagcccagcagacgctaaggatgcagccagagacatgaatggaaagtcattagatggaaaagccatcaaggtggaacaagccaccaaaccatcatttgaaagaggtagacatggaccgcccccacctccaagaagtagaggtcctccaagaggttttggagctggaagaggaggaagtggaggaaccaggggacctccttcacgaggaggacacatggatgatggtggatattccatgaattttaacatgagttcttccaggggaccactcccagtaaaaagaggaccaccaccaagaagtgggggtccttctcctaagagatctgcaccttcaggactagttcgcagcagcagtggaatgggaggaagagctcctctatcacgtggaagagatagttatggaggtccacctcgaagggaaccgctcccctctcgtagagatgtttatttgtccccaagagatgatgggtattctactaaagacagctattcaagcagagattacccaagttctcgtgatacaagagattatgcaccaccaccacgagattatacttaccgtgattatggtcattccagttcacgtgatgactatccatcaagaggctatggcgatagagatggatatggtcgtgatcgtgactattcagatcatccaagtggaggttcctacagagattcatatgagagttatggtaactcacgtagtgctccacttacacgagggcccccgccatcttatggtggaagcagtcgctatgatgattatagcagctcacgtgatggatatggtggaagtcgagacagttactcaagcagccgaagtgatctctactcaagttgtgacagggttggcagacaagaaagagggcttcccccttctgtagaaagggggtacccttcttcacgtgattcctacagcagttcaagccgcggagcaccaagaggtgctggccctggaggaagccgatctgatagagggggaggcagaagcagatactagaaacaaacaaaactttggaccaaaatcccagttcaaagaaacaaaaaaaagagtggaaactattctatcataactacccaaggactactaaaaggaaaaattgtgttaccttttttaaattccctgttaagtcccttccgtaatttttatgttcttgtgaggaaaaaagtaaaacatgtttaattttatttgactttatgacattgcttttcaacaagcaaatgttaaatgtgttaagccttgtagtactagtgttgtaactttccaagtaaaggtgtccctaaagaccacttcctatctggtttttcccagtaaatgaggcaagcaattctaagatcttccacaaaacatctagccaactaaaatggagagatgaatcattctgcctatacaaacaagctagctattagagggtggttggagtatgctactcataagatttcagggtgttttctaactgaaatctcactgttctcagtatgcaaaacctgaaatcagatgcctatgtaaggaaagtgctattcacccagtaaacccaaaaaaagcaaatggataatgctggccattttgcctttctgacatttccttgggaatctgcaagaacctcccctttcccctcccacaataagaccatttaagtgtgtgctaaacaactacggaatactaaataaaaagtttggccaaaaccaaccatgaagctgcaaaggtgcttgctcttactctttcaaatttttgcaactctaatgtctcacttttaaaggaacagcttgattgcaaaggagaaaatagataagcaatgaatttatctccaacttcctaaaggcttatgacttctaaaaagtgaatctatcagcattccacatcagatttaaagcatcaaatgcctgtgaaacagcaaagatggttgaagattgtgctcattatgtttgtggagtgctgattgattcacagtagataacgctggcagtaagagaaatcaaatgctaagagttgttgaagcagaaggcggctgattgttggtaagtcagtgcagttgcataagcagtgctgtcagaattggtttggtgcaggcaatagattttgccttcaagggttcctgtggatctcaggaaggcatcagtgttgattaacactcataactagggagtgagtggtagttacttaagtaattgaccaaatggaaaaggggaagtaattaaggaaattggtaagtggaggtagtcaggaggttctcgtggtcctttacacagattttacagctttgggtttcattttgtttagctaaagtcatggggacaactcttcaatttagaacttaagatgaattataaaaatgatggatataagtggtagctctatctggtgaagtgtcttgtcagtaagtgaaacatttttttgtggtggcttatccacaaacagtttagttgtagaataaaacttatgagtgacatctggaaagtaacaaccatgctaagatggcaaacacactggaaacaattgggccacttggctttcttttgctgtattgttttataagcctgctttacctccccgtcttggaaacaagttttagtttattgctttggagactagagccaatagtgtaatgttctcaaaggaaacagacttgagttgttggattagaggaactaactcaacttctaattttttttgttgtaattatggcactgtcatgttttaacatttgcaactagggatagtaagtacaacatttttaactctcatttggcagactactactaatcacagaccacaagggtaatgaccaaatttatgtggttgttacacttccatagttgtcttagccgaatccttccatattcttatgattacttgggttaaagcttctgtgaggaccttttggctcttaagatatcctaaatatttaaaatatttagatatcctaaatataggatatagagtttgtaccaaatatgaatgaatattgttcaaagcaaggagtatgttaaaatgaccagacacctgtttgataaatagtttactgaactagcagacgtgtggaaaaagaatcagatcttgattcttctgggtttatactggttgtaaaacagaatgatattagaaaatgttttccttgtttaagtggtagttgaacatagaacttgggtattatagatcacttttcactttttggaatgttttgtattgaaacttaatacaactttaacatggcaaaaaaaaaaaaaatccaaaatctatgagataattttgttaaagttggcttgcttgggcgggtgcttggtccagagggagaaaagaaggcatgatttcagaatactctggcagctttttaaattcagctttatcaagttacagtaaactgtatctgtttagaattacaactcaatggttattttgacagatgtatatgccatgaagccactgtcaccatcaacatgcagaacacttccatcgcccccaaaagattcctcaagttcctttgcagtccatccctcacgctgctgatttgtctttgtcaccatatattagtttgctttgtggtggtgtttagtattttatataaatgggattgtgtagcatgtacttttttgtttatggtttctttcacacacaatgactttgaaattcaccaggttgcagtgtatcagtagcttattccttttattgctgagtagtgtcccattatgtgaatatgccattatttgtttttctactcacctgttgatggaccttgggattgtttccagtttggggctactgtgaataaaactgttaggaacatttgtgtacaagccactgtgtagacataggttttcctttctcttgggtaaatacctaccagtaaaatggttgggttgcatggcagatttatgtttaataaagtaactgccaaactgtttgttttccaaaggggctatacccttttatattcccaccagggttgtatagagttccaactgccaacactcagttttcagccattctgatgggaatctagtggtatctcattgtggttttattttcatttccccgggtgactaatgctggtaagcatcttttaaggtactttttggccagttgtatattttctgtgaagtggctgtcaaatcttttgcccacttttaattggattgtttgtcttattgagttgtaaaagttctttatatatactgtattaaagtcctttgtaag

SEQ ID NO: 1993 - DNA, 1887 bp, Homo sapiens
cagggtagctccagctgtccctcccgcagttggccctgtggtgttccgaagccggttacgtacggcctgagggccaggcgaacctcaggctctttgtcctactaaaaagcgcagcacaatggtagaagcagatcatcctggcaagcttttcattggtggcctcaatagagaaaccaatgagaagatgcttaaagcagtatttgggaaacatggtcccatatcagaagttcttttgataaaggatcgaaccagcaaatccagaggctttgcatttattacttttgagaaccctgcagatgctaagaatgctgcgaaagatatgaatggaacgtctttgcatggaaaagcaataaaagtagaacaagccaagaaaccatcttttcaaagtggtggtaggcggagaccaccagcttcttcgagaaacagaagcccttcaggaagtctgagatctgcaagaggaagcagtggaggaacaagagggtggcttccctcacatgaagggcacctggatgatggtggatacactcctgatctcaagatgagttattctaggggactcattccagttaaaagaggtccatcttcaagaagtggaggtcctcctccgaaaaaatctgctccttctgctgtggcaagaagcaatagttggatgggaagccaaggtcccatgtcacaaagaagagagaattatggagttcctccacgcagagcgacaatatcttcctggagaaatgatcgcatgtcaacaagacatgatggttatgcaactaacgatggaaatcatccaagttgccaagaaacgagggattatgctccaccatctagaggctatgcataccgtgataatggtcattctaatcgggatgaacattcctctagaggatatagaaatcatcgaagttcccgagaaactagggattatgctccaccatctagaggccatgcataccgtgattatggtcattctcgtcgggatgaaagttattctagaggatacagaaatcatcgaagttcccgagaaactagggagtatgctccaccatctagaggccatggataccgtgattatggtcattctcgtcgacatgaaagttattctagaggatatagaaatcatccaagttcccgagaaaccagggattatgctccaccacatagagactatgcataccgtgattatggtcattctagttgggatgaacattcctctagaggatatagttatcatgatggctacggtgaggcccttggtagagatcattctgaacatctaagtggaagttcttatagagatgcacttcagaggtacgggacctctcatggtgcaccacctgcaagagggcctcggatgtcttatggtggaagcacctgccacgcatatagtaatacacgagatagatatggcagaagttgggagagttactcgagctgtggtgattttcattattgtgatcgtgagcatgtttgcagaaaagaccaaaggaatccgccttctctgggtagggtgctccctgatcctcgtgaagcatatggtagctcaagttatgtggcatctatagtagatggtggggagagtcgatctgaaaaaggagactcgagcagatattaaagcaagcattgaaaataatagttattgcataccaatccttgtttgcaaatcaaaaattgaaatgttatttctgcattgttacctgcatattactgaaagaaacatgttggttttgtggagagaggtagatactaacttcctccatgaattttttgaggtattcaaaggaaaaggaattgttttcaaagtaatttcatacttgttgatgctatttgaaaagtgtttagatgtaatatctaccttaaaattttcacaataaaattttacatgtactgcaa

SEQ ID NO: 1994 - DNA, 1810 bp, Homo sapiens
atttccgggcacggcttccggcgtccttccctctcagggtagctccagctgtccctcccgcagttggccctgtggtgttccgaagccggttacgtacggcctgagggccaggcgaacctcaggctctttgtcctactaaaaagcgcagcacaatggtagaagcagatcatcctggcaagcttttcattggtggcctcaatagagaaaccaatgagaagatgcttaaagcagtatttgggaaacatggtcccatatcagaagttcttttgataaaggatcgaaccagcaaatccagaggctttgcatttattacttttgagaaccctgcagatgctaagaatgctgcgaaagatatgaatggaacgtctttgcatggaaaagcaataaaagtagaacaagccaagaaaccatcttttcaaagtggtggtaggcggagaccaccagcttcttcgagaaacagaagcccttcaggaagtctgagatctgcaagaggaagcagtggaggaacaagagggtggcttccctcacatgaagggcacctggatgatggtggatacactcctgatctcaagatgagttattctaggggactcattccagttaaaagaggtccatcttcaagaagtggaggtcctcctccgaaaaaatctgctccttctgctgtggcaagaagcaatagttggatgggaagccaaggtcccatgtcacaaagaagagagaattatggagttcctccacgcagagcgacaatatcttcctggagaaatgatcgcatgtcaacaagacatgatggttatgcaactaacgatggaaatcatccaagttgccaagaaacgagggattatgctccaccatctagaggctatgcataccgtgataatggtcattctaatcgggatgaacattcctctagaggatatagaaatcatcgaagttcccgagaaactagggattatgctccaccatctagaggccatgcataccgtgattatggtcattctcgtcgggatgaaagttattctagaggatacagaaatcatcgaagttcccgagaaactagggagtatgctccaccatctagaggccatggataccgtgattatggtcattctcgtcgacatgaaagttattctagaggatatagttatcatgatggctacggtgaggcccttggtagagatcattctgaacatctaagtggaagttcttatagagatgcacttcagaggtacgggacctctcatggtgcaccacctgcaagagggcctcggatgtcttatggtggaagcacctgccacgcatatagtaatacacgagatagatatggcagaagttgggagagttactcgagctgtggtgattttcattattgtgatcgtgagcatgtttgcagaaaagaccaaaggaatccgccttctctgggtagggtgctccctgatcctcgtgaagcatatggtagctcaagttatgtggcatctatagtagatggtggggagagtcgatctgaaaaaggagactcgagcagatattaaagcaagcattgaaaataatagttattgcataccaatccttgtttgcaaatcaaaaattgaaatgttatttctgcattgttacctgcatattactgaaagaaacatgttggttttgtggagagaggtagatactaacttcctccatgaattttttgaggtattcaaaggaaaaggaattgttttcaaagtaatttcatacttgttgatgctatttgaaaagtgtttagatgtaatatctaccttaaaattttcacaataaaattttacatgtactgcaa

SEQ ID NO: 1995 - DNA, 1886 bp, Homo sapiens
cagggtagctccagctgtccctcccgcagttggccctgtggtgttccgaagccggttacgtacgcctgagggccaggcgaacctcaggctctttgtcctactaaaaagcgcagcacaatggtagaagcagatcatcctggcaagcttttcattggtggcctcaatagagaaaccaatgagaagatgcttaaagcagtatttgggaaacatggtcccatatcagaagttcttttgataaaggatcgaaccagcaaatccagaggctttgcatttattacttttgagaaccctgcagatgctaagaatgctgcgaaagatatgaatggaacgtctttgcatggaaaagcaataaaagtagaacaagccaagaaaccatcttttcaaagtggtggtaggcggagaccaccagcttcttcgagaaacagaagcccttcaggaagtctgagatctgcaagaggaagcagtggaggaacaagagggtggcttccctcacatgaagggcacctggatgatggtggatacactcctgatctcaagatgagttattctaggggactcattccagttaaaagaggtccatcttcaagaagtggaggtcctcctccgaaaaaatctgctccttctgctgtggcaagaagcaatagttggatgggaagccaaggtcccatgtcacaaagaagagagaattatggagttcctccacgcagagcgacaatatcttcctggagaaatgatcgcatgtcaacaagacatgatggttatgcaactaacgatggaaatcatccaagttgccaagaaacgagggattatgctccaccatctagaggctatgcataccgtgataatggtcattctaatcgggatgaacattcctctagaggatatagaaatcatcgaagttcccgagaaactagggattatgctccaccatctagaggccatgcataccgtgattatggtcattctcgtcgggatgaaagttattctagaggatacagaaatcatcgaagttcccgagaaactagggagtatgctccaccatctagaggccatggataccgtgattatggtcattctcgtcgacatgaaagttattctagaggatatagaaatcatccaagttcccgagaaaccagggattatgctccaccacatagagactatgcataccgtgattatggtcattctagttgggatgaacattcctctagaggatatagttatcatgatggctacggtgaggcccttggtagagatcattctgaacatctaagtggaagttcttatagagatgcacttcagagatacgggacctctcatggtgcaccacctgcaagagggcctcggatgtcttatggtggaagcacctgccacgcatatagtaatacacgagatagatatggcagaagttgggagagttactcgagctgtggtgattttcattattgtgatcgtgagcatgtttgcagaaaagaccaaaggaatccgccttctctgggtagggtgctccctgatcctcgtgaagcatatggtagctcaagttatgtggcatctatagtagatggtggggagagtcgatctgaaaaaggagactcgagcagatattaaagcaagcattgaaaataatagttattgcataccaatccttgtttgcaaatcaaaaattgaaatgttatttctgcattgttacctgcatattactgaaagaaacatgttggttttgtggagagaggtagatactaacttcctccatgaattttttgaggtattcaaaggaaaaggaattgttttcaaagtaatttcatacttgttgatgctatttgaaaagtgtttagatgtaatatctaccttaaaattttcacaataaaattttacatgtactgcaa

SEQ ID NO: 1996 - DNA, 1921 bp, Homo sapiens
atttccgggcacggcttccggcgtccttccctctcagggtagctccagctgtccctcccgcagttggccctgtggtgttccgaagccggttacgtacggcctgagggccaggcgaacctcaggctctttgtcctactaaaaagcgcagcacaatggtagaagcagatcatcctggcaagcttttcattggtggcctcaatagagaaaccaatgagaagatgcttaaagcagtatttgggaaacatggtcccatatcagaagttcttttgataaaggatcgaaccagcaaatccagaggctttgcatttattacttttgagaaccctgcagatgctaagaatgctgcgaaagatatgaatggaacgtctttgcatggaaaagcaataaaagtagaacaagccaagaaaccatcttttcaaagtggtggtaggcggagaccaccagcttcttcgagaaacagaagcccttcaggaagtctgagatctgcaagaggaagcagtggaggaacaagagggtggcttccctcacatgaagggcacctggatgatggtggatacactcctgatctcaagatgagttattctaggggactcattccagttaaaagaggtccatcttcaagaagtggaggtcctcctccgaaaaaatctgctccttctgctgtggcaagaagcaatagttggatgggaagccaaggtcccatgtcacaaagaagagagaattatggagttcctccacgcagagcgacaatatcttcctggagaaatgatcgcatgtcaacaagacatgatggttatgcaactaacgatggaaatcatccaagttgccaagaaacgagggattatgctccaccatctagaggctatgcataccgtgataatggtcattctaatcgggatgaacattcctctagaggatatagaaatcatcgaagttcccgagaaactagggattatgctccaccatctagaggccatgcataccgtgattatggtcattctcgtcgggatgaaagttattctagaggatacagaaatcatcgaagttcccgagaaactagggagtatgctccaccatctagaggccatggataccgtgattatggtcattctcgtcgacatgaaagttattctagaggatatagaaatcatccaagttcccgagaaaccagggattatgctccaccacatagagactatgcataccgtgattatggtcattctagttgggatgaacattcctctagaggatatagttatcatgatggctacggtgaggcccttggtagagatcattctgaacatctaagtggaagttcttatagagatgcacttcagagatacgggacctctcatggtgcaccacctgcaagagggcctcggatgtcttatggtggaagcacctgccacgcatatagtaatacacgagatagatatggcagaagttgggagagttactcgagctgtggtgattttcattattgtgatcgtgagcatgtttgcagaaaagaccaaaggaatccgccttctctgggtagggtgctccctgatcctcgtgaagcatatggtagctcaagttatgtggcatctatagtagatggtggggagagtcgatctgaaaaaggagactcgagcagatattaaagcaagcattgaaaataatagttattgcataccaatccttgtttgcaaatcaaaaattgaaatgttatttctgcattgttacctgcatattactgaaagaaacatgttggttttgtggagagaggtagatactaacttcctccatgaattttttgaggtattcaaaggaaaaggaattgttttcaaagtaatttcatacttgttgatgctatttgaaaagtgtttagatgtaatatctaccttaaaattttcacaataaaattttacatgtactgcaa

SEQ ID NO: 1997 - DNA, 1810 bp, Homo sapiens
atttccgggcacggcttccggcgtccttccctctcagggtagctccagctgtccctcccgcagttggccctgtggtgttccgaagccggttacgtacggcctgagggccaggcgaacctcaggctctttgtcctactaaaaagcgcagcacaatggtagaagcagatcatcctggcaagcttttcattggtggcctcaatagagaaaccaatgagaagatgcttaaagcagtatttgggaaacatggtcccatatcagaagttcttttgataaaggatcgaaccagcaaatccagaggctttgcatttattacttttgagaaccctgcagatgctaagaatgctgcgaaagatatgaatggaacgtctttgcatggaaaagcaataaaagtagaacaagccaagaaaccatcttttcaaagtggtggtaggcggagaccaccagcttcttcgagaaacagaagcccttcaggaagtctgagatctgcaagaggaagcagtggaggaacaagagggtggcttccctcacatgaagggcacctggatgatggtggatacactcctgatctcaagatgagttattctaggggactcattccagttaaaagaggtccatcttcaagaagtggaggtcctcctccgaaaaaatctgctccttctgctgtggcaagaagcaatagttggatgggaagccaaggtcccatgtcacaaagaagagagaattatggagttcctccacgcagagcgacaatatcttcctggagaaatgatcgcatgtcaacaagacatgatggttatgcaactaacgatggaaatcatccaagttgccaagaaacgagggattatgctccaccatctagaggctatgcataccgtgataatggtcattctaatcgggatgaacattcctctagaggatatagaaatcatcgaagttcccgagaaactagggattatgctccaccatctagaggccatgcataccgtgattatggtcattctcgtcgggatgaaagttattctagaggatacagaaatcatcgaagttcccgagaaactagggagtatgctccaccatctagaggccatggataccgtgattatggtcattctcgtcgacatgaaagttattctagaggatatagttatcatgatggctacggtgaggcccttggtagagatcattctgaacatctaagtggaagttcttatagagatgcacttcagagatacgggacctctcatggtgcaccacctgcaagagggcctcggatgtcttatggtggaagcacctgccacgcatatagtaatacacgagatagatatggcagaagttgggagagttactcgagctgtggtgattttcattattgtgatcgtgagcatgtttgcagaaaagaccaaaggaatccgccttctctgggtagggtgctccctgatcctcgtgaagcatatggtagctcaagttatgtggcatctatagtagatggtggggagagtcgatctgaaaaaggagactcgagcagatattaaagcaagcattgaaaataatagttattgcataccaatccttgtttgcaaatcaaaaattgaaatgttatttctgcattgttacctgcatattactgaaagaaacatgttggttttgtggagagaggtagatactaacttcctccatgaattttttgaggtattcaaaggaaaaggaattgttttcaaagtaatttcatacttgttgatgctatttgaaaagtgtttagatgtaatatctaccttaaaattttcacaataaaattttacatgtactgcaa

SEQ ID NO: 1998 - DNA, 4273 bp, Homo sapiens
caccaagcgcagccgccgctgccgcactttccacttgtattgatcacctctcagccccgcgcagccggctcgcccgagcggaccgcggccagcgcgccagcccttggcagccccggagcagtcgggctccgggaggaaactccttgggagcgccctgtccggggtgccctctgcgctctgcagtgtctttctttctgcctgggaggaggaggaggaggaggaagaggaggaggaggaggaggaggaggaggaagaggaggaggaggaggaggacgtctggtcccggctgggaggtggagcagcggcagcagcagcagccgccgccgccgccgccgctgccgccgccgccggaaagggagaggcaggagagcccgagacttggaaaccccaaagtgtccgcgaccctgcacggcaggctcccttccagcttcatgggcaaagtgtggaaacagcagatgtaccctcagtacgccacctactattacccccagtatctgcaagccaagcagtctctggtcccagcccaccccatggcccctcccagtcccagcaccaccagcagtaataacaacagtagcagcagtagcaactcaggatgggatcagctcagcaaaacgaacctctatatccgaggactgcctccccacaccaccgaccaggacctggtgaagctctgtcaaccatatgggaaaatagtctccacaaaggcaattttggataagacaacgaacaaatgcaaaggttatggttttgtcgactttgacagccctgcagcagctcaaaaagctgtgtctgccctgaaggccagtggggttcaagctcaaatggcaaagcaacaggaacaagatcctaccaacctctacatttctaatttgccactctccatggatgagcaagaactagaaaatatgctcaaaccatttggacaagttatttctacaaggatactacgtgattccagtggtacaagtcgtggtgttggctttgctaggatggaatcaacagaaaaatgtgaagctgttattggtcattttaatggaaaatttattaagacaccaccaggagtttctgcccccacagaacctttattgtgtaagtttgctgatggaggacagaaaaagagacagaacccaaacaaatacatccctaatggaagaccatggcatagagaaggagaggtgagacttgctggaatgacacttacttacgacccaactacagctgctatacagaacggattttatccttcaccatacagtattgctacaaaccgaatgatcactcaaacttctattacaccctatattgcatctcctgtatctgcctaccaggtgcaaagtccttcgtggatgcaacctcaaccatatattctacagcaccctggtgccgtgttaactccctcaatggagcacaccatgtcactacagcccgcatcaatgatcagccctctggcccagcagatgagtcatctgtcactaggcagcaccggaacatacatgcctgcaacgtcagctatgcaaggagcctacttgccacagtatgcacatatgcagacgacagcggttcctgttgaggaggcaagtggtcaacagcaggtggctgtcgagacgtctaatgaccattctccatatacctttcaacctaataagtaactgtgagatgtacagaaaggtgttcttacatgaagaagggtgtgaaggctgaacaatcatggatttttctgatcaattgtgctttaggaaattattgacagttttgcacaggttcttgaaaacgttatttataatgaaatcaactaaaactatttttgctataagttctataaggtgcataaaacccttaaattcatctagtagctgttcccccgaacaggtttattttagtaaaaaaaaaaaaacaaaaaacaaaaacaaaagatttttatcaaatgttatgatgcaaaaaaagaaaaagaaaaaaaaaaagaaaagaaaacttcaattttctgggtatgcacaaagaccatgaagacttatccaagtgcatgaccggatttttgtggttttgttcattttgtgtttaatttgtgttttttttttccagctgtatgaaatgggctttctgaagtttaaatagtccgacttcacccatggtgttctgtgcttgcagtgcgagtgttgctgtaattcagtgttgccgtcagtgtctcttttcttagctttctgtctttctttcaacgtagtgtgaagtgtcttatccttttctatgaattccaatttgccttaactcttttgatgctgtagctgtttcagtaaaagttagttcaaactaatgatgtagaatgctttgaccaaatgagctggtctattatgccttgtaaaacagcagcatagggcttttaaaaggtagtcaataaaagttgctgaaattttggcttttttaaatatgtagtaggtgtttttaatgatttttcacataatgtgtaaggtagtgaaatgcaagaagggaaaaatgttttgtgtgaaacacattttctgactggggaacttttattagggtaaattgtttgtaaggctgtacgccaacagtttcctctgatagtttgactgatttaggatatctgctgtatgatgcaatgtaaagtcttttttgccttttttcaggaaaaaaaaaaagctaacttgatgtactagatttagtgtaggtagtgttggggttggggatgggggtgggggaggggagtcactgaatgttttgtccttcctttatactaatgatagtgctttagaatgagaattatgcctgaaatctggcaaaccgaaaaatgttgctattgcaacaaagtggcaaaagctaaaagtaaggatttatcttcaaacataagctgagataacgaatagaagcaaaacgattggctactagctctctctctctctctctattaggtaaatttgaaaaataaaaatgacttggcacttttaaaggtaacttcaccaaagaccgaagagccagtaaccagtagctccaacttgtctcagcatcacatcttctgtgctctttatttttgccggaccagtttgcggttaggagaatgtgccttttttgtacctttgcatttaggttttataattttaattgatgtatggacacacacaaacaaaaaagcatgaaggaagatttggatccaagcagtgccacactttacatcatcactacaagtgttcaagtgtaaagaaaaccaattttgaaactatgaaattcctgattcataaatacacagttatttctactttagtacatataagataattcactgttattaaagctcttttattaaggcaattgcatatgttttaaaagcaatggtaaattaagttgtcttccaaaactgtgtacttgtctggtcagctgtgtatgatcagttatctacctcagagtctattttcttttgtgctgggacaggttgctggccctccctgtttccacagaccaaatcctcctagctcaggagctagggctaagcagttatttctttcaagtattttttagttcttaaattttatgcttgtatttgatgatagatgtcagtgacatttcatagtttcaaaagtccttgctgctctgagaagtgtagattctagtgaaaattacatagtcataagagaaatgtgtttttgtttttgtttttgtttcatttttttaaagttgtggtattattggttctatgctccctggaatattactgctttgtgaaagtccagactgaacgcagcaccctctgtgtacctagtacagttataaacctgggtctctcactacttgatatttttgcattagttaagacagaaatttgatagctcggttagaggggaggggaaatctgctgctagaaatgtctgaactaagtgccatactcgtctgggtaagatttgggaaacataacctctgtacataaaaaaaaaaaaatcagttaaacatcacatagtagacagccattaaattataaaaaaattaatttatgaagaaagaccttttgtacagattgaaaaaaaaagattttcatagagatatctatatgatcaagagagttaattttttatttttgttttactagtgccacagacttgccagtggtaacttatttgtccggttcaagataactctgtagttttctttcctaggacttgttgttaaacgccaaaagacatttttgaactgtacatttgatcagattgttagcttttctgttttatttcttttgagaacctttgaataaaaaacatctgaaatttta

SEQ ID NO: 1999 - DNA, 1702 bp, Homo sapiens
ctggtcccggctgggaggtggagcagcggcagcagcagcagccgccgccgccgccgccgctgccgccgccgccggaaagggagaggcaggagagcccgagacttggaaaccccaaagtgtccgcgaccctgcacggcaggctcccttccagcttcatgggcaaagtgtggaaacagcagatgtaccctcagtacgccacctactattacccccagtatctgcaagccaagcagtctctggtcccagcccaccccatggcccctcccagtcccagcaccaccagcagtaataacaacagtagcagcagtagcaactcaggatgggatcagctcagcaaaacgaacctctatatccgaggactgcctccccacaccaccgaccaggacctggtgaagctctgtcaaccatatgggaaaatagtctccacaaaggcaattttggataagacaacgaacaaatgcaaaggttatggttttgtcgactttgacagccctgcagcagctcaaaaagctgtgtctgccctgaaggccagtggggttcaagctcaaatggcaaagcaacaggaacaagatcctaccaacctctacatttctaatttgccactctccatggatgagcaagaactagaaaatatgctcaaaccatttggacaagttatttctacaaggatactacgtgattccagtggtacaagtcgtggtgttggctttgctaggatggaatcaacagaaaaatgtgaagctgttattggtcattttaatggaaaatttattaagacaccaccaggagtttctgcccccacagaacctttattgtgtaagtttgctgatggaggacagaaaaagagacagaacccaaacaaatacatccctaatggaagaccatggcatagagaaggagaggctggaatgacacttacttacgacccaactacagctgctatacagaacggattttatccttcaccatacagtattgctacaaaccgaatgatcactcaaacttctattacaccctatattgcatctcctgtatctgcctaccaggtggcaaaggaaaccagagaaaacaagtatcggggctctgctatcaaggtgcaaagtccttcgtggatgcaacctcaaccatatattctacagcaccctggtgccgtgttaactccctcaatggagcacaccatgtcactacagcccgcatcaatgatcagccctctggcccagcagatgagtcatctgtcactaggcagcaccggaacatacatgcctgcaacgtcagctatgcaaggagcctacttgccacagtatgcacatatgcagacgacagcggttcctgttgaggaggcaagtggtcaacagcaggtggctgtcgagacgtctaatgaccattctccatatacctttcaacctaataagtaactgtgagatgtacagaaaggtgttcttacatgaagaagggtgtgaaggctgaacaatcatggatttttctgatcaattgtgctttaggaaattattgacagttttgcacaggttcttgaaaacgttatttataatgaaatcaactaaaactatttttgctataagttctataaggtgcataaaacccttaaattcatctagtagctgttcccccgaacaggtttattttagtaaaaaaaaaaaaacaaaaaacaaaaacaaaagatttttatcaaatgttatgatgc

SEQ ID NO: 2000 - DNA, 1550 bp, Homo sapiens
ggaaggattacactgttccaggttttagggagaaaggtttaccaaaccggtggccttaaatgattttcgctccttgatattatcatcttgaaggaaagctgcagtctctggtcccagcccaccccatggcccctcccagtcccagcaccaccagcagtaataacaacagtagcagcagtagcaactcaggatgggatcagctcagcaaaacgaacctctatatccgaggactgcctccccacaccaccgaccaggacctggtgaagctctgtcaaccatatgggaaaatagtctccacaaaggcaattttggataagacaacgaacaaatgcaaaggttatggttttgtcgactttgacagccctgcagcagctcaaaaagctgtgtctgccctgaaggccagtggggttcaagctcaaatggcaaagcaacaggaacaagatcctaccaacctctacatttctaatttgccactctccatggatgagcaagaactagaaaatatgctcaaaccatttggacaagttatttctacaaggatactacgtgattccagtggtacaagtcgtggtgttggctttgctaggatggaatcaacagaaaaatgtgaagctgttattggtcattttaatggaaaatttattaagacaccaccaggagtttctgcccccacagaacctttattgtgtaagtttgctgatggaggacagaaaaagagacagaacccaaacaaatacatccctaatggaagaccatggcatagagaaggagaggctggaatgacacttacttacgacccaactacagctgctatacagaacggattttatccttcaccatacagtattgctacaaaccgaatgatcactcaaacttctattacaccctatattgcatctcctgtatctgcctaccaggtgcaaagtccttcgtggatgcaacctcaaccatatattctacagcaccctggtgccgtgttaactccctcaatggagcacaccatgtcactacagcccgcatcaatgatcagccctctggcccagcagatgagtcatctgtcactaggcagcaccggaacatacatgcctgcaacgtcagctatgcaaggagcctacttgccacagtatgcacatatgcagacgacagcggttcctgttgaggaggcaagtggtcaacagcaggtggctgtcgagacgtctaatgaccattctccatatacctttcaacctaataagtaactgtgagatgtacagaaaggtgttcttacatgaagaagggtgtgaaggctgaacaatcatggatttttctgatcaattgtgctttaggaaattattgacagttttgcacaggttcttgaaaacgttatttataatgaaatcaactaaaactatttttgctataagttctataaggtgcataaaacccttaaattcatctagtagctgttcccccgaacaggtttattttagtaaaaaaaaaaaaacaaaaaacaaaaacaaaagatttttatcaaatgttatgatgcaaaaaaagaaaaagaaaaaaaaaaa

SEQ ID NO: 2001 - DNA, 1490 bp, Homo sapiens
atttgccttctcttcacttggggagtatcaatttgccacagcagtctctggtcccagcccaccccatggcccctcccagtcccagcaccaccagcagtaataacaacagtagcagcagtagcaactcaggatgggatcagctcagcaaaacgaacctctatatccgaggactgcctccccacaccaccgaccaggacctggtgaagctctgtcaaccatatgggaaaatagtctccacaaaggcaattttggataagacaacgaacaaatgcaaaggttatggttttgtcgactttgacagccctgcagcagctcaaaaagctgtgtctgccctgaaggccagtggggttcaagctcaaatggcaaagcaacaggaacaagatcctaccaacctctacatttctaatttgccactctccatggatgagcaagaactagaaaatatgctcaaaccatttggacaagttatttctacaaggatactacgtgattccagtggtacaagtcgtggtgttggctttgctaggatggaatcaacagaaaaatgtgaagctgttattggtcattttaatggaaaatttattaagacaccaccaggagtttctgcccccacagaacctttattgtgtaagtttgctgatggaggacagaaaaagagacagaacccaaacaaatacatccctaatggaagaccatggcatagagaaggagaggctggaatgacacttacttacgacccaactacagctgctatacagaacggattttatccttcaccatacagtattgctacaaaccgaatgatcactcaaacttctattacaccctatattgcatctcctgtatctgcctaccaggtgcaaagtccttcgtggatgcaacctcaaccatatattctacagcaccctggtgccgtgttaactccctcaatggagcacaccatgtcactacagcccgcatcaatgatcagccctctggcccagcagatgagtcatctgtcactaggcagcaccggaacatacatgcctgcaacgtcagctatgcaaggagcctacttgccacagtatgcacatatgcagacgacagcggttcctgttgaggaggcaagtggtcaacagcaggtggctgtcgagacgtctaatgaccattctccatatacctttcaacctaataagtaactgtgagatgtacagaaaggtgttcttacatgaagaagggtgtgaaggctgaacaatcatggatttttctgatcaattgtgctttaggaaattattgacagttttgcacaggttcttgaaaacgttatttataatgaaatcaactaaaactatttttgctataagttctataaggtgcataaaacccttaaattcatctagtagctgttcccccgaacaggtttattttagtaaaaaaaaaaaaacaaaaaacaaaaacaaaagatttttatcaaatgttatgatgcaaaaaaagaaaaagaaaaaaaaaaa

SEQ ID NO: 2002 - DNA, 1815 bp, Homo sapiens
ggccgcggtaggtggggacgcggcggcgctgctcctccgctgccgccgggagagtcggcgacgccgccagctccgcgcgcgaactcccgtccatggcacgcagggcggcggctgcccgagctgctcgagtctcgcccgctgccgcgccgtacttttaggcgagtgcggaggtcgaaggcggaggggaagtcagcgcggagctgcagcccccgccggccgccgccgcgcggcgagagggagttcccagagctgccgcggccccgggcccggccggccacctccttgcgccctccccctcgcggcgaggctgccccgcgcccgcgcccgcgcccgcacccgccgccgccgcccgcagcgatgatcttccccagcagcagtggcaaccccgggggcagcagcaactgccggacgccctatcgcaagcagcagtctctggtcccagcccaccccatggcccctcccagtcccagcaccaccagcagtaataacaacagtagcagcagtagcaactcaggatgggatcagctcagcaaaacgaacctctatatccgaggactgcctccccacaccaccgaccaggacctggtgaagctctgtcaaccatatgggaaaatagtctccacaaaggcaattttggataagacaacgaacaaatgcaaaggttatggttttgtcgactttgacagccctgcagcagctcaaaaagctgtgtctgccctgaaggccagtggggttcaagctcaaatggcaaagcaacaggaacaagatcctaccaacctctacatttctaatttgccactctccatggatgagcaagaactagaaaatatgctcaaaccatttggacaagttatttctacaaggatactacgtgattccagtggtacaagtcgtggtgttggctttgctaggatggaatcaacagaaaaatgtgaagctgttattggtcattttaatggaaaatttattaagacaccaccaggagtttctgcccccacagaacctttattgtgtaagtttgctgatggaggacagaaaaagagacagaacccaaacaaatacatccctaatggaagaccatggcatagagaaggagaggctggaatgacacttacttacgacccaactacagctgctatacagaacggattttatccttcaccatacagtattgctacaaaccgaatgatcactcaaacttctattacaccctatattgcatctcctgtatctgcctaccaggtgcaaagtccttcgtggatgcaacctcaaccatatattctacagcaccctggtgccgtgttaactccctcaatggagcacaccatgtcactacagcccgcatcaatgatcagccctctggcccagcagatgagtcatctgtcactaggcagcaccggaacatacatgcctgcaacgtcagctatgcaaggagcctacttgccacagtatgcacatatgcagacgacagcggttcctgttgaggaggcaagtggtcaacagcaggtggctgtcgagacgtctaatgaccattctccatatacctttcaacctaataagtaactgtgagatgtacagaaaggtgttcttacatgaagaagggtgtgaaggctgaacaatcatggatttttctgatcaattgtgctttaggaaattattgacagttttgcacaggttcttgaaaacgttatttataatgaaatcaactaaaactatttttgctataagttctataaggtgcataaaacccttaaattcatctagtagctgttcccccgaacaggtttattttagtaaaaaaaaaaaaacaaaaaa

SEQ ID NO: 2003 - DNA, 583 bp, Homo sapiens
atttgccttctcttcacttggggagtatcaatttgccacagagcaagcaacagcgggtggtcctaggagacttctgtgtggtctagggagaccttgacacagtcgcctaagaatggaccgtgtttacagcctctaagaatggactgtgtttagaatgaggggcagcctgaaaaaggcagtctctggtcccagcccaccccatggcccctcccagtcccagcaccaccagcagtaataacaacagtagcagcagtagcaactcaggatgggatcagctcagcaaaacgaacctctatatccgaggactgcctccccacaccaccgaccaggacctggtgaagctctgtcaaccatatgggaaaatagtctccacaaaggcaattttggataagacaacgaacaaatgcaaaggttatggttttgtcgactttgacagccctgcagcagctcaaaaagctgtgtctgccctgaaggccagtggggttcaagctcaaatggcaaagcaacaggaacaagatcctaccaacctctacatttctaatttgccactctccatggatgagcaagaactagaaaatatgct

SEQ ID NO: 2004 - DNA, 3147 bp, Homo sapiens
ccctcgctcccctcctccctccctccccgtctttcttaccccctccctttctctctctctctctctctcgctcgttccctaacattaaagagaaaatgctgctatccgtgacttccaggcccgggatttcgacttttggctacaatagaaacaacaagaagccatatgtgtcattggctcagcagatggcaccacctagcccaagcaacagtacacctaacagcagtagtggaagcaatggaaatgaccagctgagcaaaaccaacctatacatccgaggattgcaaccaggcactactgaccaagatcttgtcaagctgtgtcagccatatggcaagattgtttccactaaggccatactggacaagaccacaaacaaatgtaaaggctatggctttgtagattttgacagcccttcagcagcacagaaagctgtaacagcactgaaggccagcggtgtacaggcacagatggcaaagcaacaggaacaggaccccacaaatttatacatctcaaacctcccactgtcaatggatgagcaggaactggaggggatgctgaagccctttggccaggttatctccacccgtatccttcgagataccagtgggaccagcagaggtgttggctttgcaaggatggagtccacagagaagtgtgaagccatcatcacccactttaatggaaaatatattaagacaccccctggagtaccagccccatccgatcccttgctttgcaaatttgctgatggcgggccaaagaaacgacagaaccaaggaaaatttgtgcaaaatggacgggcttggccaaggaatgcagacatgggcgtcatggccttgacctatgaccccaccacagctcttcagaatgggttttacccagccccctataacatcacccccaacaggatgcttgctcagtctgcactctccccatacctttcctctcctgtgtcttcgtatcagagagtgactcagacatctcctctacaagtacctaacccatcctggatgcaccaccattcatacctcatgcagccttcaggttcagttctgacaccagggatggaccatcccatttctctccagcctgcctccatgatgggaccccttacccagcaactgggccatctctccctcagcagcacaggcacgtatatgccgacggctgcagctatgcaaggagcttacatctcccagtacacccctgtgccttcttccagtgtttcagtcgaggagagcagcggccaacagaaccaagtggcagtggacgcaccctcagagcatggggtctattctttccagttcaacaagtaacagtgggattcccctccccatctttactgaatagaaatgaattcttggagatactcatgctcccagattccagagggttaaccaggaatggagaccatccgtcggccctgctaaggactaacacttagccatcgtttttcacaggcctgggcctggaaaaagaaatctctacgttcctgccctttactattgctgatggagcctgggggaaccatcactttttttgtgtgctacattcaaggagatcaaaaaaacttttcttcttttgcaaagaaagctttttgtttttaactgcaacgtacttttcccctaccttgaagagacatggtggtcgcagcttctcatctatatgaaaaagttttcgatgtattggaattatttgggaatgcttttaaaacaatttgtaattatttctttacaaaccaaaacagaacagaaaggtgtggtgctggaacatcgatgaaggagccctacttactgagcttagttatggacttttttgatgcatgtgtgtatgtgttttaaaaagtatgcaggctctaaaaatgttattttgtaaagctctcagctcatgcaccccatctcctcttcacccatattatgccttctttctcttgtccagattcttctttttctcttttctaaacagctgagcctgcctactttgcccttttacagcttttaattttatggatttttaaaaatgaaatttcatgtggaatttggggttggggggcaggctgggcaaggaacaaggcagaacactaagtaggccatggaagtggctgttctttcccccaccctgccacaccctgggagaaaaaactagactttggcttcagaaagcacagatgtgacccaggcttactaaagagacaactccacagccctgggaacacacccttgagccaaacttggttgaagactaggtcttccctggcaagttccggaagaatggacttactgacttttatcaactcttctcactgccaaggccaacagcatctgaggtatagctttttgggagtacctgctttcttgcctcctggaggatattttctgtcctgggcttcatggcccctctcttccctgttacacattgctgtgctcagagcctttgcagctgcgacctagttgaatccacataggctccttccacacggtggaagatctgctgcttcactcacagaccaggagttctcaatcagaggtggttttgtccctcaggcctttggcaacatctagagacagttttgattgccacgcctggaggtgggatgtgtgtgctactggcatctagtggctgctaaacatcctacactgcataggatagtccccactacccccagccaagaattatctgactccaggggtcaatattgccaagactgggaaacactgatatagacagtgttgtccctgcctcctgggttagggtaaattttcaccccaaccctggacaaacagtgccttttgacactcatgcaactgttggggaaggactggactgggatccttgaattctccccagactttgacttttgataactctgcatatagcaagagtgattcttgaaagagctgtggctccatgctgaatgcacacatgtactcagagggattcaggtgggcattgttctggtgtgtgctgtgcaatggtgggaaaggacaaagctctctaaactgtccagagcaacctgccctgccccggtgtgcttggaccctttgcccagggaaccaggacatcagaaataatgttccttctgtggaaggacaacggggagctagggtagcaaagagcaataaattccaactctttatgaggtca

SEQ ID NO: 2005 - DNA, 1789 bp, Homo sapiens
ggctgcagactcctcgtgctcgtgtcaccgtgtccttcccaggagacagagaaggaggagagcccggaaccagggccggagcggcgggcggagccgagctgcggggagccgctccgggtgcccccacccccgcgcgcctcagtggtgccggccgagggcagggctcgcggttgcggggctcgcgccgctgtcagtgcggcggggcgcgcgagcggcgccagctcggggcagcggaacccagagaagctgagggggcggtagcggcggcgacggcgacgacgacgactcccgcgcgtgtgcccagcctcttcccgccgcagccgcccttttcctccctcccttacgtccccgagtgcggcagtaccgcctccttcccagccgcgcggcttcctccagacctctcggcgcgggtgagccctattcccagaggcaggtggtgctgaccctgtaacccaaaggaggaaacagctggctaagctcatcattgttactggtgggcaccatgtccttgaagcttcaggcaagcaatgtaaccaacaagaatgaccccaagtccatcaactctcgagtcttcattggaaacctcaacacagctctggtgaagaaatcagatgtggagaccatcttctctaagtatggccgtgtggccggctgttctgtgcacaagggctatgcctttgttcagtactccaatgagcgccatgcccgggcagctgtgctgggagagaatgggcgggtgctggccgggcagaccctggacatcaacatggctggagagcctaagcctgacagacccaaggggctaaagagagcagcatctgccatatacagtggctacatctttgactatgattactaccgggacgacttctacgacaggctcttcgactaccggggccgtctgtcgcccgtgccagtgcccagggcggtccctgtgaagcgaccccgggtcacagtccctttggtccggcgtgtcaaaactaacgtacctgtcaagctctttgcccgctccacagctgtcaccaccagctcagccaagatcaagttaaagagcagtgagctgcaggccatcaagacggagctgacacagatcaagtccaatatcgatgccctgctgagccgcttggagcagatcgctgcggagcaaaaggccaatccagatggcaagaagaagggtgatggaggtggcgccggcggcggcggcggtggtggtggcagcggtggcggtggcagtggtggtggcggtggcggtggcagcagccggccaccagccccccaagagaacacaacttctgaggcaggcctgccccagggggaagcacggacccgagacgacggcgatgaggaagggctcctgacacacagcgaggaagagctggaacacagccaggacacagacgcggatgatggggccttgcagtaagcagcctgacaggagcaatggccaccagcaggtgaagggcatcgctgccccaggcctcaagccgggcacccaaccctggatgccaccccccagcgggtaccagaggaaagctggcagcaggcgcctcctcccccaacgcatcccagccagtgccatgtcctctgcaggtggagttactggcctactccttccccatgagccctccctgtctgcactgcccaggccagagggtagagcacaggggtttccccatactacctcccctccccaggacactcccaggcttgggttttttctataggtttggcggggggccacagggaggggaccctgacaataaagagattggatcccaacctgttctga

SEQ ID NO: 2006 - DNA, 1817 bp, Homo sapiens
tctggacctttccaaagccaggctgagagggtggggagagcccatgcgcctgggaagccgggctgtttctgggcggggctgcagactcctcgtgctcgtgtcaccgtgtccttcccaggagacagagaaggaggagagcccggaaccagggccggagcggcgggcggagccgagctgcggggagccgctccgggtgcccccacccccgcgcgcctcagtggtgccggccgagggcagggctcgcggttgcggggctcgcgccgctgtcagtgcggcggggcgcgcgagcggcgccagctcggggcagcggaacccagagaagctgagggggcggtagcggcggcgacggcgacgacgacgactcccgcgcgtgtgcccagcctcttcccgccgcagccgcccttttcctccctcccttacgtccccgagtgcggcagtaccgcctccttcccagccgcgcggcttcctccagacctctcggcgcgggtgagccctattcccagaggcaggtggtgctgaccctgtaacccaaaggaggaaacagctggctaagctcatcattgttactggtgggcaccatgtccttgaagcttcaggcaagcaatgtaaccaacaagaatgaccccaagtccatcaactctcgagtcttcattggaaacctcaacacagctctggtgaagaaatcagatgtggagaccatcttctctaagtatggccgtgtggccggctgttctgtgcacaagggctatgcctttgttcagtactccaatgagcgccatgcccgggcagctgtgctgggagagaatgggcgggtgctggccgggcagaccctggacatcaacatggctggagagcctaagcctgacagacccaaggggctaaagagagcagcatctgccatatacaggctcttcgactaccggggccgtctgtcgcccgtgccagtgcccagggcggtccctgtgaagcgaccccgggtcacagtccctttggtccggcgtgtcaaaactaacgtacctgtcaagctctttgcccgctccacagctgtcaccaccagctcagccaagatcaagttaaagagcagtgagctgcaggccatcaagacggagctgacacagatcaagtccaatatcgatgccctgctgagccgcttggagcagatcgctgcggagcaaaaggccaatccagatggcaagaagaagggtgatggaggtggcgccggcggcggcggcggtggtggtggcagcggtggcggtggcagtggtggtggcggtggcggtggcagcagccggccaccagccccccaagagaacacaacttctgaggcaggcctgccccagggggaagcacggacccgagacgacggcgatgaggaagggctcctgacacacagcgaggaagagctggaacacagccaggacacagacgcggatgatggggccttgcagtaagcagcctgacaggagcaatggccaccagcaggtgaagggcatcgctgccccaggcctcaagccgggcacccaaccctggatgccaccccccagcgggtaccagaggaaagctggcagcaggcgcctcctcccccaacgcatcccagccagtgccatgtcctctgcaggtggagttactggcctactccttccccatgagccctccctgtctgcactgcccaggccagagggtagagcacaggggtttccccatactacctcccctccccaggacactcccaggcttgggttttttctataggtttggcggggggccacagggaggggaccctgacaataaagagattggatcccaacctgttctga

SEQ ID NO: 2007 - DNA, 766 bp, Homo sapiens
gcggcgggcggagccgagctgcggggagccgctccgggtgcccccacccccgcgcgcctcagtggtgccggccgagggcagggctcgcggttgcggggctcgcgccgctgtcagtgcggcggggcgcgcgagcggcgccagctcggggcagcggaacccagagaagctgagggggcggtagcggcggcgacggcgacgacgacgactcccgcgcgtgtgcccagcctcttcccgccgcagccgcccttttcctccctcccttacgtccccgagtgcggcagtaccgcctccttcccagccgcgcggcttcctccagacctctcggcgcgggtgagccctattcccagaggcaggtggtgctgaccctgtaacccaaaggaggaaacagctggctaagctcatcattgttactgtcttcatttccctatttgtaaagttggagtgcctccctgtcccctcacgtctcatgtgtgtactcctaccatgcaggtgggcaccatgtccttgaagcttcaggcaagcaatgtaaccaacaagaatgaccccaagtccatcaactctcgagtcttcattggaaacctcaacacagctctggtgaagaaatcagatgtggagaccatcttctctaagtatggccgtgtggccggctgttctgtgcacaagggctatgcctttgttcagtactccaatgagcgccatgcccgggcagctgtgctgggagagaatgggcgggtgctggccgggcagaccctggacatcaacatgg

SEQ ID NO: 2008 - DNA, 871 bp, Homo sapiens
gcaactttcattccctctgaaataaaacagtgcttaggccagtacctagtctgtttccaactgtgcggtgagccctattcccagaggcaggtggtgctgaccctgtaacccaaaggaggaaacagctggctaagctcatcattgttactggtgggcaccatgtccttgaagcttcaggcaagcaatgtaaccaacaagaatgaccccaagtccatcaactctcgagtcttcattggaaacctcaacacagctctggtgaagaaatcagatgtggagaccatcttctctaagtatggccgtgtggccggctgttctgtgcacaagggctatgcctttgttcagtactccaatgagcgccatgcccgggcagctgtgctgggagagaatgggcgggtgctggccgggcagaccctggacatcaacatggctggagagcctaagcctgacagacccaaggggctaaagagagcagcatctgccatatacaggctcttcgactaccggggccgtctgtcgcccgtgccagtgcccagggcggtccctgtgaagcgaccccgggtcacagtccctttggtccggcgtgtcaaaactaacgtacctgtcaagctctttgcccgctccacagctgtcaccaccagctcagccaagatcaagttaaagagcagtgagctgcaggccatcaagacggagctgacacagatcaagtccaatatcgatgccctgctgagccgcttggagcagatcgctgcggagcaaaaggccaatccagatggcaagaagaagggtgatggaggtggcgccggcggcggcggcggtggtggtggcagcggtggcggtggcagtggtggtggcggtggcggtggcagcagcc

SEQ ID NO: 2009 - DNA, 1204 bp, Homo sapiens
ggagagcccatgcgcctgggaagccgggctgtttctgggcggggctgcagactcctcgtgctcgtgtcaccgtgtccttcccaggagacagagaaggaggagagcccggaaccagggccggagcggcgggcggagccgagctgcggggagccgctccgggtgcccccacccccgcgcgcctcagtggtgccggccgagggcagggctcgcggttgcggggctcgcgccgctgtcagtgcggcggggcgcgcgagcggcgccagctcggggcagcggaacccagagaagctgagggggcggtagcggcggcgacggcgacgacgacgactcccgcgcgtgtgcccagcctcttcccgccgcagccgcccttttcctccctcccttacgtccccgagtgcggcagtaccgcctccttcccagccgcgcggcttcctccagacctctcggcgcgggtgagccctattcccagaggcaggtggtgctgaccctgtaacccaaaggaggaaacagctggctaagctcatcattgttactggttcccagagagggggcttcttgaaaagcaagtagagcagaagactggtgagcacggtgtttcccagcatctccacagtgccagcacagaggaggacactcaagaaatgtttgttaagtgggcaccatgtccttgaagcttcaggcaagcaatgtaaccaacaagaatgaccccaagtccatcaactctcgagtcttcattggaaacctcaacacagctctggtgaagaaatcagatgtggagaccatcttctctaagtatggccgtgtggccggctgttctgtgcacaagggctatgcctttgttcagtactccaatgagcgccatgcccgggcagctgtgctgggagagaatgggcgggtgctggccgggcagaccctggacatcaacatggctggagagcctaagcctgacagacccaaggggctaaagagagcagcatctgccatatacagtggctacatctttgactatgattactaccgggacgacttctacgacaggctcttcgactaccggggccgtctgtcgcccgtgccagtgcccagggcggtccctgtgaagcgaccccgggtcacagtccctttggtccggcgtgtcaaaactaacgtacctgtcaagctctttgcccgctccacagctgtcaccaccagctcagccaagatcaag

SEQ ID NO: 2010 - DNA, 758 bp, Homo sapiens
agtgggcagcctcagacctcagaaggacagcacctgcttggtccaaagggtatgagattcaggactgtttgtctaagctgtctgtggtcaaaagtacattctggactgaagagatggtgatgtaactgggctgtgtgtgtattgaaaaatccctctttgctctttcctcatttcagaatgacatccttaactccaggctgcaggtactctgtacgtgtgtcacctcagatggcgaaccggattgtggattctgcaaggagcatcctcaacaagttcatacctgatatctatatttacacagatcacatgaaaggagtcaactctgggaagtctccgggctttgggttgtcactggttgctgagaccaccagtggcaccttcctcagtgctgaactggcctccaacccccagggccagggagcagcagtacttccagaggaccttggcaggaactgtgcccggctgctgctggaggaaatctacaggggtggatgcgtagactcgaccaaccaaagcctggcgctactactcatgacccttggacagcaggatgtttccaaagtcctgctaggccctctctctccctacacgatagaatttttgcggcatttgaagagctttttccagattatgtttaaaattgaaaccaagccatgtggtgaagaactcaagggtggggataaagtgctgatgacctgtgttggcattggtttctccaaccttagcaagaccctcaagtgataaccatcacaagataa

SEQ ID NO: 2011 - DNA, 801 bp, Homo sapiens
cgtggactgtcttttcagaggcctcgaatagcttgaacaaatgacatccttaactccaggctgcaggtactctgtacgtgtgtcacctcagatggcgaaccggattgtggattctgcaaggagcatcctcaacaagttcatacctgatatctatatttacacagatcacatgaaaggagtcaactctgggaagtctccgggctttgggttgtcactggttgctgagaccaccagtggcaccttcctcagtgctgaactggcctccaacccccagggccagggagcagcagtacttccagaggaccttggcaggaactgtgcccggctgctgctggaggaaatctacaggggtggatgcgtagactcgaccaaccaaagcctggcgctactactcatgacccttggacagcaggatgtttccaaagtcctgctaggccctctctctccctacacgatagaatttttgcggcatttgaagagctttttccagattatgtttaaaattgaaaccaagccatgtggtgaagaactcaagggtggggataaagtgctgatgacctgtgttggcattggtttctccaaccttagcaagaccctcaagtgataaccatcacaagataaggccccaatgcctacagacaaagcagaagctgccacggacaccaatgggaccaagtccaaatggattaatccaggacagaatagccacttgcttaattttctgtgaagaaatatcaatatacaaataaaagacatccctgtagcatatggtttccagctgtttctccagtggcattgcca

SEQ ID NO: 2012 - DNA, 804 bp, Homo sapiens
cagcccgagccgccgccgtcggtgtcgccgccaccaccaccatcggagtcacgagtcccgcgtctgtccgaagtcgccgctctcgggctgctcacgtctcttcggagagcgcgcacatggcgactcaggcgcactccctcagctacgcagggtgcaacttcttgcgccaacgtctggtcctgtctaccctgagcgggcgccccgtcaaaatccgaaagattcgggccagagacgacaacccgggcctccgagattttgaagccagcttcataaggctattggacaaaataacgaatggttctcgaattgaaataaaccaaacaggaacaaccttatattatcagcctggcctcctgtatggtggatctgtggaacatgactgtagcgtccttcgtggcattgggtattacctggagagtcttctttgcttggctccatttatgaagcacccgttaaaaatagttctacgaggagtgaccaatgatcaggttgacccttcagtgagtattgagaacaaaccgtggtgtggtttttgttttgtctcttgtcacaacccaacttgtgagaaaaaagttccttataaggcacagttttattacaaatgtatattgcttttgttatttactttgagatttagaggttaatcactccaggaggcagatgaaccaaaacttaggatcatcaaattcaggactattgttaacagttaccaaggtgccttttgttgttacctaagaaccttcaaaacagatgctctccgtctcatcatagttgacatgaactatagttctgctggctgtatat

SEQ ID NO: 2013 - DNA, 2134 bp, Homo sapiens
gaggcggggaggtggccactggctccgccccgctcccctctgacccggtgtctagtctctccgtcttcctgttccaaaccacgtggacgcgtctgggctgctggaggcagcccgagccgccgccgtcggtgtcgccgccaccaccaccatcggagtcacgagtcccgcgtctgtccgaagtcgccgctctcgggctgctcacgtctcttcggagagcgcgcacatggcgactcaggcgcactccctcagctacgcagggtgcaacttcttgcgccaacgtctggtcctgtctaccctgagcgggcgccccgtcaaaatccgaaagattcgggccagagacgacaacccgggcctccgagattttgaagccagcttcataaggctattggacaaaataacgaatggttctcgaattgaaataaaccaaacaggaacaaccttatattatcagcctggcctcctgtatggtggatctgtggaacatgactgtagcgtccttcgtggcattgggtattacctggagagtcttctttgcttggctccatttatgaagcacccgttaaaaatagttctacgaggagtgaccaatgatcaggttgacccttcagttgatgttcttaaggcaacagcactccctttgttgaaacaatttgggattgatggtgaatcatttgaactgaagattgtgcgacggggaatgcctcccggaggaggaggcgaagtggttttctcatgtcctgtgaggaaggtcttgaagcccattcaactcacagatccaggaaaaatcaaacgtattagaggaatggcgtactctgtacgtgtgtcacctcagatggcgaaccggattgtggattctgcaaggagcatcctcaacaagttcatacctgatatctatatttacacagatcacatgaaaggagtcaactctgggaagtctccgggctttgggttgtcactggttgctgagaccaccagtggcaccttcctcagtgctgaactggcctccaacccccagggccagggagcagcagtacttccagaggaccttggcaggaactgtgcccggctgctgctggaggaaatctacaggggtggatgcgtagactcgaccaaccaaagcctggcgctactactcatgacccttggacagcaggatgtttccaaagtcctgctaggccctctctctccctacacgatagaatttttgcggcatttgaagagctttttccagattatgtttaaaattgaaaccaagccatgtggtgaagaactcaagggtggggataaagtgctgatgacctgtgttggcattggtttctccaaccttagcaagaccctcaagtgataaccatcacaagataaggccccaatgcctacagacaaagcagaagctgccacggacaccaatgggaccaagtccaaatggattaatccaggacagaatagccacttgcttaattttctgtgaagaaatatcaatatacaaataaaagacatccctgtagcatatggtttccagctgtttctccagtggcattgccattgcccaggaggggcccagtcaccatgagagctcccttgccttacctggaggaagaatgtgccttcaggccacagtcgtgctgctagaacagtctcgtagctgcagttcagctgtgcttcctcagcctactatcataggcttcctcagccctctgtcatatggctgttttgcaaacctgtggagtctgttactgttctttctgcaaggactcacctccttgagccttggtttttgttgtagggattaaatgagataatatgagtggcagctcttcatgagtcctgcagtgctaagcaaatgtcagaaattggtgtattagactatttatctttgatcttctgaatggattgctgtcatggacacggacacggatcttcatctggttcattgtatttatatgtgagggatggatggctgcggggctccaagtaagttattgggatgtttttatattccaggtgtgctgtacattcttattttattttcacaatagctctgtgatgtaagtgctatctccatgagaaaattcataaagggtgttttgttcctttgaaatgtataatgtaaagacattaaatctcctcatttaag

SEQ ID NO: 2014 - DNA, 497 bp, Homo sapiens
gaggtaaagcccttgcccttatagagtgtgtggtctcattgaagagcaagaacaaaatgtgcatatgtgaagagagatgtatgaatgacatccttaactccaggctgcaggtactctgtacgtgtgtcacctcagatggcgaaccggattgtggattctgcaaggagcatcctcaacaagttcatacctgatatctatatttacacagatcacatgaaaggagtcaactctgggaagtctccgggctttgggttgtcactggttgctgagaccaccagtggcaccttcctcagtgctgaactggcctccaacccccagggccagggagcagcagtacttccagaggaccttggcaggaactgtgcccggctgctgctggaggaaatctacaggggtggatgcgtagactcgaccaaccaaagcctggcgctactactcatgacccttggacagcaggatgtttccaaagtcctgctaggccctctctctccctacac

SEQ ID NO: 2015 - DNA, 956 bp, Homo sapiens
ccgagccgccgccgtcggtgtcgccgccaccaccaccatcggagtcacgagtcccgcgtctgtccgaagtcgccgctctcgggctgctcacgtctcttcggagagcgcgcacatggcgactcaggcgcactccctcagctacgcagggtgcaacttcttgcgccaacgtctggtcctgtctaccctgagcgggcgccccgtcaaaatccgaaagattcgggccagagacgacaacccgggcctccgagattttgaagccagcttcataaggctattggacaaaataacgaatggttctcgaattgaaataaaccaaacaggttgatgttcttaaggcaacagcactccctttgttgaaacaatttgggattgatggtgaatcatttgaactgaagattgtgcgacggggaatgcctcccggaggaggaggcgaagtggttttctcatgtcctgtgaggaaggtcttgaagcccattcaactcacagatccaggaaaaatcaaacgtattagaggaatggcgtactctgtacgtgtgtcacctcagatggcgaaccggattgtggattctgcaaggagcatcctcaacaagttcatacctgatatctatatttacacagatcacatgaaaggagtcaactctgggaagtctccgggctttgggttgtcactggttgctgagaccaccagtggcaccttcctcagtgctgaactggcctccaacccccagggccagggagcagcagtacttccagaggaccttggcaggaactgtgcccggctgctgctggaggaaatctacaggggtggatgcgtagactcgaccaaccaaagcctggcgctactactcatgacccttggacagcaggatgtttccaaagtcctgctaggccctctctctccctacacgatagaatttttgcggcatttgaagagctttttccagattatgtttaaa

SEQ ID NO: 2016 - DNA, 820 bp, Homo sapiens
ggattacagaggtaaagcccttgcccttatagagtgtgtggtctcattgaagagcaagaacaaaatgtgcatatgtgaagagagatgtatgcagaatgacatccttaactccaggctgcaggtactctgtacgtgtgtcacctcagatggcgaaccggattgtggattctgcaaggagcatcctcaacaagttcatacctgatatctatatttacacagatcacatgaaaggagtcaactctgggaagtctccgggctttgggttgtcactggttgctgagaccaccagtggcaccttcctcagtgctgaactggcctccaacccccagggccagggagcagcagtacttccagaggaccttggcaggaactgtgcccggctgctgctggaggaaatctacaggggtggatgcgtagactcgaccaaccaaagcctggcgctactactcatgacccttggacagcaggatgtttccaaagtcctgctaggccctctctctccctacacgatagaatttttgcggcatttgaagagctttttccagattatgtttaaaattgaaaccaagccatgtggtgaagaactcaagggtggggataaagtgctgatgacctgtgttggcattggtttctccaaccttagcaagaccctcaagtgataaccatcacaagataaggccccaatgcctacagacaaagcagaagctgccacggacaccaatgggaccaagtccaaatggattaatccaggacagaatagccacttgcttaattttctgtgaagaaatatcaatatacaaataaaagacatccctgtagc

SEQ ID NO: 2017 - DNA, 1880 bp, Homo sapiens
ggtttccagaatccttagcgcgaggcggaaaaaatatttctcccagcttgtgttgatgccgcgattttgactgagacttcttcccacgatttctgtttttgcttctccaaggaaaatggcagctcccgagcagccgcttgcgatatcaaggggatgcacgagctcctcctcgctttccccgcctcggggcgaccgaacccttctggtcaggcacctgccggctgagcttactgctgaggagaaagaggacttgctgaagtacttcggggctcagtctgtgcgggtcctgtcagataaggggcgactgaaacatacagcttttgccacattccctaatgaaaaagcagctataaaggcattgacaagactccatcaactgaaacttttaggtcatactttagtcgttgaatttgcaaaagagcaagatcgagttcactccccatgtcccacttcaggctctgaaaaaaaaaaaaggtctgatgaccctgtcgaagatgataaagaaaaaaaagaacttggttatttaacagtagaaaatggaattgcaccaaaccatgggctgacttttcctttaaattcatgcctcaagtatatgtacccaccaccttccagcacaatcctagcaaacattgtaaatgccttggcaagcgtgcctaagttctatgtacaggtccttcatcttatgaataaaatgaatttgcccacaccttttggaccaattactgcgcgacctcccatgtatgaagactatatgccattgcatgcacctcttccacccacatctcctcagccacctgaggaacctcctttgccagacgaggatgaggaattatctagtgaagaatcagaatatgaaagcactgatgatgaggaccgacagagaatgaacaaattaatggaactagcaaatcttcagcccaaaagacctaaaacaataaagcagcgccatgtgagaaaaaagagaaaaataaaggatatgttgaatacacctttgtgtccttcacacagcagtttacatccagtgctgttaccttcagatgtatttgaccaaccacaacctgtaggtaacaaaagaattgaattccatatatctaccgacatgccagctgcatttaagaaagatttagaaaaggaacaaaattgtgaggaaaaaaatcatgatttacctgctactgaagttgatgcatccaatataggatttggaaaaatcttccccaaacctaatttggacatcacagaggagattaaagaagactctgatgaaatgccttcagaatgtatttctagaagggaattggaaaagggcagaatttctagagaagaaatggaaacactttcagttttcagaagttatgaaccgggtgaaccaaactgtagaatttatgtaaagaatttagctaaacatgttcaagaaaaggaccttaaatatatttttggaagatatgttgacttttcatcagaaacacagcggatcatgtttgatatacgtttgatgaaagaaggtcgtatgaaaggacaagctttcattggacttcctaatgaaaaagcagcagcaaaagccttaaaggaagctaatggatatgtgctttttggaaaacccatggtggttcagtttgctcgatctgctagaccaaaacaagatcctaaggaaggaaaaagaaagtgttaaaaattaataaaggtttttttgaatcccgtgtccttcaagtgctttctaactttgagaggaagaaattgaccacctggactatggaactgtgcgtaacagctttgaaagtgtatttaaaaattaaatctatatgcctttaaatcagtgaattggaaacatattacatgtattttaatgattttcctcaaatataataaattgtttcctttcc

SEQ ID NO: 2018 - DNA, 507 bp, Homo sapiens
ctagaagggaattggaaaagggcagaatttctagagaagaaatggaaacactttcagttttcagaagttatgaaccgggtgaaccaaactgtagaatttatgtaaagaatttagctaaacatgttcaagaaaaggaccttaaatatatttttggaagatatgttgacttttcatcagaaacacagcggatcatgtttgatatacgtttgatgaaagaaggtcgtatgaaaggacaagctttcattggacttcctaatgaaaaagcagcagcaaaagccttaaaggaagctaatggatatgtgctttttggaaaacccatggtggttcagtttgctcgatctgctagaccaaaacaagatcctaaggaaggaaaaagaaagtgttaaaaattaataaaggtttttttgaatcccgtgtccttcaagtgctttctaactttgagaggaagaaattgaccacctggactatggaactgtgcgtaacagctttgaaagtgtatttaaaaat

SEQ ID NO: 2019 - DNA, 686 bp, Homo sapiens
gcgcagtcgtgagtcctcttgtccttgagcgtcaaccttctttccctgaagtggctggggttcctgtttccttctttgattgacaacttgtgttaaccctcgcacatctctgggccaatttttgcttgaaaatggcagctcccgagcagccgcttgcgatatcaaggggatgcacgagctcctcctcgctttccccgcctcggggcgaccgaacccttctggtcaggcacctgccggctgagcttactgctgaggagaaagaggacttgctgaagtacttcggggctcagtctgtgcgggtcctgtcagataaggggcgactgaaacatacagcttttgccacattccctaatgaaaaagcagctataaaggcattgacaagactccatcaactgaaacttttaggtcatactttagtcgttgaatttgcaaaagagcaagatcgagttcactccccatgtcccacttcaggctctgaaaaaaaaaaaaggtctgatgaccctgtcgaagatgataaagaaaaaaaagaacttggttatttaacagtagaaaatggaattgcaccaaaccatgggctgacttttcctttaaattcatgcctcaagtatatgtacccaccaccttccagcacaatcctagcaaacattgtaaatgccttggcaagcgtgcctaagttctatgtacag

SEQ ID NO: 2020 - DNA, 3641 bp, Homo sapiens
gcagtcgtgagtcctcttgtccttgagcgtcaaccttctttccctgaagtggctggggttcctgtttccttctttgattgacaacttgtgttaaccctcgcacatctctgggccaatttttgcttgtaagtctttccggagacccctggaatttaaatcattagcaccgcgcccttccccgaagagtcttcgaagggttgccgcttttcggtggcgcagttctcgcgagaaggaaaatggcagctcccgagcagccgcttgcgatatcaaggggatgcacgagctcctcctcgctttccccgcctcggggcgaccgaacccttctggtcaggcacctgccggctgagcttactgctgaggagaaagaggacttgctgaagtacttcggggctcagtctgtgcgggtcctgtcagataaggggcgactgaaacatacagcttttgccacattccctaatgaaaaagcagctataaaggcattgacaagactccatcaactgaaacttttaggtcatactttagtcgttgaatttgcaaaagagcaagatcgagttcactccccatgtcccacttcaggctctgaaaaaaaaaaaaggtctgatgaccctgtcgaagatgataaagaaaaaaaagaacttggttatttaacagtagaaaatggaattgcaccaaaccatgggctgacttttcctttaaattcatgcctcaagtatatgtacccaccaccttccagcacaatcctagcaaacattgtaaatgccttggcaagcgtgcctaagttctatgtacaggtccttcatcttatgaataaaatgaatttgcccacaccttttggaccaattactgcgcgacctcccatgtatgaagactatatgccattgcatgcacctcttccacccacatctcctcagccacctgaggaacctcctttgccagacgaggatgaggaattatctagtgaagaatcagaatatgaaagcactgatgatgaggaccgacagagaatgaacaaattaatggaactagcaaatcttcagcccaaaagacctaaaacaataaagcagcgccatgtgagaaaaaagagaaaaataaaggatatgttgaatacacctttgtgtccttcacacagcagtttacatccagtgctgttaccttcagatgtatttgaccaaccacaacctgtaggtaacaaaagaattgaattccatatatctaccgacatgccagctgcatttaagaaagatttagaaaaggaacaaaattgtgaggaaaaaaatcatgatttacctgctactgaagttgatgcatccaatataggatttggaaaaatcttccccaaacctaatttggacatcacagaggagattaaagaagactctgatgaaatgccttcagaatgtatttctagaagggaattggaaaagggcagaatttctagagaagaaatggaaacactttcagttttcagaagttatgaaccgggtgaaccaaactgtagaatttatgtaaagaatttagctaaacatgttcaagaaaaggaccttaaatatatttttggaagatatgttgacttttcatcagaaacacagcggatcatgtttgatatacgtttgatgaaagaaggtcgtatgaaaggacaagctttcattggacttcctaatgaaaaagcagcagcaaaagccttaaaggaagctaatggatatgtgctttttggaaaacccatggtggttcagtttgctcgatctgctagaccaaaacaagatcctaaggaaggaaaaagaaagtgttaaaaattaataaagaagcattcctgcgtaaatactgctgtaatactgtcatgcaaagtgtatcctttcttgtcgtatcctttttggggcagtgtttttttgtttttttcctagaaatgtttgtccttcccccacctgttgatccaggttaaggaatacttttttacactttattcaaatgaaatatttctaaaattatttgtatagactgaacagatcttttatgtgtttttagatttgttgttgaattttctgtgctgtcctttatataattttttgagggaaagttagtgaatcaggtcaacttacttagagaatgtgttcatttactttaacccagaatacagtcttgtttcttctatttgtatgtttcctaaacctaattcaataacatatgctttctgttgtgtaatatatctggtttaggtatttataatgtgtttaaaatttgggcaaaggaaatgtttttcttttaaaaagtacttacattgaaaattaagatgtctggattactatgtaaattctagagagtagcagacctctcatctgaagtcttagtgaatctcttttgacatagatagcaatagaagtatctttcttctttcccctttctttttctaaacaagagaagaaaagcgtaatagaggggagaacacataatgcccactaagggtagtgcattaaggaaaaacagtcttggcaggtatataggaatagtggtttccagactggttgatgaccgtaatcaccaagaacagtggttctcagtcttggctgcacattgcagtgatctggaacttaaatactaattttaaaagggtgcagtggctcatacctgtaatcccagcactttgcaagtccgagatgggagaatcacttgagcccaggagtttgagaccagcctgggcaatgtagggagaccctgtccctacaaaaaatacaaaaattagccaagtgtggtggcttgcacctctggtctcagctacttgggatgctaaggcaggaggattacttgagccccagaggttgaggttgcagtgaaccatgatcacaccactgcattctagcctgggtgacagagtgagaccctctccctcctaaaaaaatccttaagaaatatattgatgcttggttcctttggtcagaattttgatttaaggtgttgggagtgtagcacagatgttggaataaacctctcaaactgattttaatatacaaacaaggtcgagaaccaccaaggaagagtttttatgcataaagattcctgtactctaccctagaactaatacatctgaatctctgggaatggagtataacaatcagatttgaaaaggtttctttagtaattttaaggactgaccagtttagacactgctttgttagagtaaaatgattaggtacctagtatcaacctagccatccaaccttatattaataactaggaaaataaagggttggagcctctgtgtttctttgttgaaaaatctgctactattattagatctgtgaaaacaattgaaaattcggttattatcaccttaaaagtacaaaacctatagattttgaaaatgtaattatttttctgtaggcatagttaaaaagattttgtaaatgttataaatcagtttctttataagcggtttatttagataaattttgttatactgacatgattcactaattttctaaatataaatggttcagctcttagttatttttaaactaatgacctgtgttatacttcctatttttaatgggcttttatgatgttttaggtttttttgaatcccgtgtccttcaagtgctttctaactttgagaggaagaaattgaccacctggactatggaactgtg

SEQ ID NO: 2021 - DNA, 6621 bp, Homo sapiens
gctttacaatagaagctcggttggagaggcctgcggagaaaagctgggaacggccgcttccggcatgttcatctctggacgaagaacggccgacaagtggagggcggaggagagactccaatgcccagcgggcagtgcgcgggcggcgcttgcgcgatgcgcggacgggggggcggtcgggccatttaaatgtgtgtttgtgggtgaaatggctgcgcaggtcggagcggtgcgcgtagtacgggcggtggcggcgcaggaggagccggacaaagaggggaaggagaaacctcatgctggggtctccccgcggggagttaaacggcagcgccgatctagcagtggggggtctcaggagaagcgggggcggccgagccaggagccccctctcgctccccctcaccggcggcgtcgcagccgccaacatcctgggccgctgccgccaacgaatgcagccccaactgtcccaggccctgttgagcctcttctcctgccgcctccgccgccaccttcgctggcacccgccgggcccgctgtcgctgcccctctcccggccccaagcacctcggccctcttcaccttctcgcctctgacggtgagcgcggccgggcccaagcataagggccacaaggagcggcacaagcaccatcaccaccgcggccccgatggtgatcccagctcctgcggaaccgatctcaagcacaaggacaagcaggaaaacggcgagaggactggaggggtgcctctgatcaaagcccccaagagagaaacaccagatgaaaatggtaaaacccagagagccgatgattttgtcttgaagaaaataaagaagaaaaagaaaaagaaacaccgagaagacatgcgaggaagacgccttaaaatgtacaataaggaagtacaaaccgtctgtgctggcctgacccgcatcagtaaagaaattctcacccaaggacaaataaatagcacttcaggacttaataaggagtccttcaggtatctgaaagatgaacagctgtgccgattaaatttgggtatgcaagaatatcgggtaccccagggagtacaaacaccttttatgactcaccaggaacattctattcgtagaaatttcttaaaaacaggtactaaatttagcaactttattcatgaggaacaccagtccaatggtggtgctcttgtccttcatgcttacatggatgaactctcatttttgtctccaatggagatggagagattttctgaggagtttcttgctttgacattcagtgaaaatgagaaaaatgctgcttactatgctttagcaatagtgcatggagcggctgcttatctcccagacttcttggactactttgcttttaatttccccaacactccagtgaaaatggaaattctgggcaagaaagatattgaaacaaccaccatttcaaattttcacactcaggtcaacaggacatactgctgtggcacctaccgagcaggtcctatgcggcagataagtctcgttggagcagtagatgaagaagttggtgattatttcccagagttccttgatatgttagaagaatcaccatttctgaaaatgactttgccctggggtacactttctagcctccgactccagtgtaggtcccagagtgatgatgggcctataatgtgggtaaggccaggagaacagatgatccctacagcagatatgccaaagtcacccttcaaaagacgacgatcaatgaatgaaataaaaaatctccagtacctacctcggaccagtgaaccccgcgaagttctctttgaagataggactagagctcatgctgatcatgtcggtcaggggtttgactggcagagtacggctgctgttggagttttgaaagctgtacaatttggtgaatggagtgaccaacctcgcataaccaaagatgtgatttgttttcatgctgaggattttactgatgttgtacaaagacttcagttagatcttcatgaacctccagtttcccagtgcgtacagtgggtagatgaagctaaactaaaccaaatgaggcgggaaggcattcgttatgctagaattcagctttgcgacaatgatatctacttcatccctagaaatgtcattcatcagttcaaaacagtttcggcggtgtgcagcttagcctggcatataaggcttaaacagtaccaccctgttgtggaagccactcaaaacacagaaagcaattctaacatggactgtggtttaactggaaagcgagaattagaagttgactcccaatgtgtgaggataaaaactgaatctgaagaagcatgcacagagattcagctgttaacaactgcttcatcatctttcccacctgcatcagaacttaatctacagcaagatcagaagactcagcctattccagttttaaaagtggaaagtagactggactctgaccagcaacacaatctgcaagaacattcaaccacttctgtgtgatatgtacatattcaaacacattttttaacttttttaaattttgatgtgaagttatagttttataactggcttaagttaagttttattggagaaatcttgcctataattctataaagagaaatgacattccacaaatgtcaagcatatcttttttacacagattatgcaaagttaagagttgtatcttatcccgttagtacagtatgtaatagtgggtctgctgctactttctgttttaaggtgtgaggtaacaattcaatctcttcttcaaatcaaaatgagaattctctggaataacagattcttgtttggtaaattattcacttcccttaattttatcttgccttgtctcttgccatatttgctgtttttatggataaataagatttatggtttagtacttgtgtctttatggcacaggttcaatttctacagtgaaaatggcataggttgcaggaaagaatttctgcatctggtacatgggcaagtaagttatttagttctaaccacaaataacaagtagtttccaaggaaatttcagtggctctctggtttcttaacaaaagagaaagcacagcactttctgatccaaactgtcttttttttgtatctgttatttaaagcccagtggatatttcaattaaaaaaaaaatctaaagatgaatagtccttggtcattcattatccatggctcattaatctcttctagaatatatgctaactgttgaagatattttgggtaaaagagataatgttgacatgatactctattgttctgcttcctggcatcctcacattttgtggggataattttgcttcctaaactgatcacaactattaaacttagagaataataatagtctttctgatgaggctgccatattttgagcatcaatcttatgataaactattcttgtcacttggcatcaacctcttcatgataaatatctactactgagacacttcaattcacagttttaactggtgaatacctgggtttatttactattactctgtgttgctattttctaagaaagaatacagcactagacttcatcctagagtttcaggtaggctaatgcttagtgcctgagtatttaaattttcttttcaaacaggcacagttcacattgctagtatggtcctaactttctgttattttagaatgttaacatgattcacattatactttctcttagttaataatacagtaggccttttgtttattaatggaagagtactccccacacctaagaccagattcttatatctccctggttacagtgcaatttggagattttttttttttcctggatggtaagatttgaaatatttacattaacataggcaaaaaaaaaaaaaaatacaagatgctgctttattatgtctgtcaccatgaaaacttagctgcatcttttgaaatatcaaatatgaattttctctaaaatattctgaaataggttaaatcttatataaatattactttgtgcaatattgttgtgtagttaaatgcatattagcaaagtatagaggtcactgtgtaaaccgatagaaaagtaaccatcagcaaatactgcagtgattagttagaatctgtattattccttatatatatgtatatgtatgtattctctgttacaaaggatgaagacaaatagggatacatttcaatgtaaaccatttatgaattggaagtgatgttggctttagttatctttgtaaataaggtaattagaatggtatgaaaggtaatgtgattattgcaggggtgtttttaaatcttgggtataaattctagggtaaattccagtttatccagactagtttttaacgggacctgcctttgagggtgttttttgttattttgttggggaggggtttaatcacaaagtgtgtgggtttgggttatttcttgtttttatttttctgtccagaagagctttaccaggctgtgcaaagtaaaattcttctcaggcaacatttgcttttaaaaataatcatgaagagaaggctgttaaagcaaaaattttttttttttaattttttcttgtcttccaagatccgatttccccatctcccacttgccatccagcagatgccatctgtcatccaagctggtcattgctaataaacaaggagactgtctcctgacagccagcactgtgtattatcactcaggaaccagcggatctgcaaagacctacaatcaaaagcaaatccccattttccttttataaaacattctaccctcacctccaatataaacacattaaaagagtacaataaaaatgtttaaaatcatgtactaataaattcattgtatgttagaattgcaatagaatgaagagaaacatttagctagtaacgtgatctgaaaactgaatgtcctatgtgagtattagattttaatagcatgctttaaagactgatgagtataaaagcagaagttttgcgttttttactgctttcaaagctgtatcctagtttagtgatacaaatgattgcaatttttctaaatcattaaattatttggtttggtggagtgaggcatggagcaatctggcgtcttctgatttgttaaagtagtgatggcagtgaagttgtaactgaaatttaagctgatcttcctttttggtatattatccgttgtgccagctcttgagattacttgcacaatgtggctataagttttaatattttgtggagcagagggatggtttttaaatgtgcttatggaaaggacccaataaatgaatattcctaacttagtaaagtagaataatttcatggtattcattaaaaagcataaaagtcttcctcttgccccagaagtaattctctataccaagatatgctaggagtaggatgatgattcaaagtggtaacccaaattcataaagcaataataataaaaacctatatagtatgttctctcctccaaagttttaactctaaaaattggttcctaggtttaattgtacctttaatttgcttattcagtacttagaatttgtttaactggtacttttattattttttagtgaaagacttttgaaaagtgccctttccccttaagagacagttggaataccagttgactaatattacaagctcttgtagggggaaaaaggagcttattaaagttgtttactaaactttaggaaaagatgtcttgcatcagtcttactaggcataaaagtcacacttaatgactggaaaaaacttgcttattgcctttccctatataaatattaattgtctagaatgaaagctaatataggaacaagactcccaaatccatgaaaacgcttagtgaatatattcttaatcattaataaattagcccattatattttcatctgtatttgccataaaaaatttatttgcatttatgcctttaggataattttgtatctttctaatctgttttatcattgctacaggtttttaaaaaagaacctttcactagctagcacatgccagaggttcacatctgttttgtttttcaaacaggtcgtagctgtatttattggccatgcaagtagaggaaatgcacagtacaaatgtttttctttagcacgtaagggacctatccttgtcttgaaagtttgttgctttaaaagcaagtatctctccataaatattatggccttccattttcttcatacattttttaggatccacttgtgcatgtagttgagaccactgtctcttaaaatatagcacttttcaattctctctaaagaaatacttatgtactactatcacatgttgtaaattttcatgtaatagtgttttctgtgagtaaactccattttgattggcagctaagactttttttcctgtggcttttatttatctaagaggtctttgcatatagatgaaatgtatatttgcctggcggactatttgcgttgtgtggccttagtttgtttattgacattaacgagtgttttaaaaaggtttttaatgaatagtcttaaatctaaatttgtgtgaataatccttttaacacagtgcttttttgtagctgtctaagtgtgttaaattgttaagctatttctttgtaaaataggacaatggaatgcatagtttttttttttcctgtaaagtatttttttaataaaaaaagtctgatttgtccttta

SEQ ID NO: 2022 - DNA, 3091 bp, Homo sapiens
ggagagtaaatacaacaggagcgcaaaatggcggaaccgccgagccccgtgcactgtgtcgctgccgcggcccccaccgccaccgtctcggagaaagaaccgtttggcaagctgcaactctcctcccgggaccctccgggttctctgtccgccaagaaggtccggactgaggagaagaaggcaccgcggagagtgaacggagaagggggcagcggcgggaacagcaggcagctgcagccgccggcagcaccttcgcctcagagctatggcagccccgcgtcttggagctttgcccctctgtctgctgctccctccccgtcctcttctcggagcagtttctctttctccgctggcacggccgttccctcctcagcctccgcttccttgtctcagccggtgccgcgcaaactgctggtccctcctacgctgctgcacgctcagcctcaccatctcctcctgcccgccgccgccgccgctgcctcggctaacgccaagtcgcgcagacctaaggagaagcgggagaaggagaggaggaggcacggtctcggtggggcccgagaggccggcggggcctcccgggaggagaacggggaggtgaagccgctgccccgagataaaatcaaagacaaaattaaagagagagacaaagaaaaagaaagagaaaaaaagaaacataaagtaatgaatgagatcaagaaagagaatggagaagtaaagattttgctgaaaagtgggaaggagaaaccaaaaacaaatatagaagacttacaaattaaaaaggtaaagaagaaaaagaaaaagaaacacaaagagaatgaaaaacggaagcgtccgaaaatgtatagcaaatctattcagaccatctgctcaggattgctaactgatgttgaagatcaagcagccaaaggcatcctaaatgataacataaaagattacgttgggaagaatttggataccaagaactatgattccaaaattccagagaacagtgagtttccatttgtctcattaaaggagccacgagttcagaataacctcaaaaggttggacactttggaatttaaacaactcattcatatagagcaccagcctaatggaggtgcatcggttatccatgcctacagtaacgaactctcccacctgtctcctatggagatggagaggtttgcagaagagtttgtgggtctagtgttcagtgaaaatgaaaactctgcagctttctacgtgatgggtattgttcatggggcagctacttatttacctgactttttagactatttttcatttaattttcccaattcaccagtgaaaatggagatattgggaaagaaagatatagagacaacgactatgtccaattttcatgctcaggtaaaaagaacgtattctcatggtacttacagagctggcccaatgagacaaataagcttggtgggagcagttgatgaagaagtaggagattatttccctgagttccttgacatgttggaagagtcaccatttttaaaatgtacactgccatgggggacgctatctagtctaaaattacagagtcgaaaagatagtgatgatggtcccatcatgtgggttcgtccaggagaacaaatgatccctgtggctgatatgccaaagtcacctttcaaaaggaaaagaactaccaatgaaataaaaaatcttcagtacctacctcgaacaagtgagccccgtgagatgctctttgaagacaggacaagagctcatgcagatcatataggacaaggttttgaacgacagactacagctgctgttggagtgctgaaggctgtgcactgtggagagtggcctgatcaaccccgtataaccaaagatgtaatttgttttcatgctgaagatttcttagaagtagttcaacgaatgcagttagatttacatgaacctccactgtcccagtgtgtccaatgggttgatgatgcaaaactgaatcaactgaggagggaaggcattcgctatgccaggattcagctatatgataatgacatttattttattccaaggaatgttgttcatcagttcaagacagtttcagctgtatgcagtttagcatggcatattcggctcaaattatatcactcagaggaggacacttctcagaatacagctactcatgaaacaggcacatcatcagattccacatcatctgttcttggacctcacactgacaacatgatttgtgctgtaagcaaagcctccttggattctgttttttcagataaacttcattctaaatatgaattacagcagattaaacatgaacctattgcatctgtaagaatcaaggaagaacctgtgaatgttaatattcctgaaaagactacagcactgaataatatggatggcaagaatgttaaagcaaaattggatcatgttcaatttgcagaatttaagattgacatggattctaaatttgaaaatagcaacaaagatttaaaggaagaattgtgccctggaaatctaagtctagttgatacaaggcaacacagttcagcacattcaaatcaagataaaaaagacgatgacattttgtgctaaatttgcatataccatctaaaatccttttttaaaaaaatttaatgtaataaagattcatgaattctgaaagcaagccaaggacttgctcctatgtctgttacaaaacatagtttatgtagctttgtaacattcctcagtgcctgtccataactgtgaagtattaagcacttagggccagatgcactgtaaacattgcaggtttaaacataaaggagtctttaaaaaaaaatcatttacgttggaattttaggttttagaatagagctgacattaacatatatatatatatataaatatatatatatattttgtaatatgagccagaattctttttcaacaatttaaagcttttccatagagcttatttatatccttttttttcattttaaatgtgtcagcactgtagtgtaaatagcttttaaatatctttttagtgtgatttatactgaaatgtgagccacttaataaaggttcatatgttcatattaataaatatgttttctgttgagtctgtaaagacaaa

SEQ ID NO: 2023 - DNA, 2667 bp, Homo sapiens
cgtgcgccggcctggaggggctgggaggcgtccggttttcagcagaggattttgcagttcccaaggggacaggaaatggagcctgtaatttcggttgcagagagggggatggccgacactcttattttctgtatcgtttcttcctcccagttagtgcgctgcaggatttgtgaaaatccatcttgaggactctcctagataaaatcaaagacaaaattaaagagagagacaaagaaaaagaaagagaaaaaaagaaacataaagtaatgaatgagatcaagaaagagaatggagaagtaaagattttgctgaaaagtgggaaggagaaaccaaaaacaaatatagaagacttacaaattaaaaaggtaaagaagaaaaagaaaaagaaacacaaagagaatgaaaaacggaagcgtccgaaaatgtatagcaaatctattcagaccatctgctcaggattgctaactgatgttgaagatcaagcagccaaaggcatcctaaatgataacataaaagattacgttgggaagaatttggataccaagaactatgattccaaaattccagagaacagtgagtttccatttgtctcattaaaggagccacgagttcagaataacctcaaaaggttggacactttggaatttaaacaactcattcatatagagcaccagcctaatggaggtgcatcggttatccatgcctacagtaacgaactctcccacctgtctcctatggagatggagaggtttgcagaagagtttgtgggtctagtgttcagtgaaaatgaaaactctgcagctttctacgtgatgggtattgttcatggggcagctacttatttacctgactttttagactatttttcatttaattttcccaattcaccagtgaaaatggagatattgggaaagaaagatatagagacaacgactatgtccaattttcatgctcaggtaaaaagaacgtattctcatggtacttacagagctggcccaatgagacaaataagcttggtgggagcagttgatgaagaagtaggagattatttccctgagttccttgacatgttggaagagtcaccatttttaaaatgtacactgccatgggggacgctatctagtctaaaattacagagtcgaaaagatagtgatgatggtcccatcatgtgggttcgtccaggagaacaaatgatccctgtggctgatatgccaaagtcacctttcaaaaggaaaagaactaccaatgaaataaaaaatcttcagtacctacctcgaacaagtgagccccgtgagatgctctttgaagacaggacaagagctcatgcagatcatataggacaaggttttgaacgacagactacagctgctgttggagtgctgaaggctgtgcactgtggagagtggcctgatcaaccccgtataaccaaagatgtaatttgttttcatgctgaagatttcttagaagtagttcaacgaatgcagttagatttacatgaacctccactgtcccagtgtgtccaatgggttgatgatgcaaaactgaatcaactgaggagggaaggcattcgctatgccaggattcagctatatgataatgacatttattttattccaaggaatgttgttcatcagttcaagacagtttcagctgtatgcagtttagcatggcatattcggctcaaattatatcactcagaggaggacacttctcagaatacagctactcatgaaacaggcacatcatcagattccacatcatctgttcttggacctcacactgacaacatgatttgtgctgtaagcaaagcctccttggattctgttttttcagataaacttcattctaaatatgaattacagcagattaaacatgaacctattgcatctgtaagaatcaaggaagaacctgtgaatgttaatattcctgaaaagactacagcactgaataatatggatggcaagaatgttaaagcaaaattggatcatgttcaatttgcagaatttaagattgacatggattctaaatttgaaaatagcaacaaagatttaaaggaagaattgtgccctggaaatctaagtctagttgatacaaggcaacacagttcagcacattcaaatcaagataaaaaagacgatgacattttgtgctaaatttgcatataccatctaaaatccttttttaaaaaaatttaatgtaataaagattcatgaattctgaaagcaagccaaggacttgctcctatgtctgttacaaaacatagtttatgtagctttgtaacattcctcagtgcctgtccataactgtgaagtattaagcacttagggccagatgcactgtaaacattgcaggtttaaacataaaggagtctttaaaaaaaaatcatttacgttggaattttaggttttagaatagagctgacattaacatatatatatatatataaatatatatatatattttgtaatatgagccagaattctttttcaacaatttaaagcttttccatagagcttatttatatccttttttttcattttaaatgtgtcagcactgtagtgtaaatagcttttaaatatctttttagtgtgatttatactgaaatgtgagccacttaataaaggttcatatgttcatattaataaatatgttttctgttgagtctgt

SEQ ID NO: 2024 - DNA, 3217 bp, Homo sapiens
aaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaagaatttcattccaaactgcaagaagctactaacttcccactgagaccttttgtcatcccatttttgaaggccaacttgcccctgctgcagcgtgagctcctccactgcgcaagactggccaaacagaaccctgcccagtacctcgcccagcatgaacagctgcttctggatgccagcaccacctcacctgttgactcctcagagctgcttctcgatgtgaacgaaaacgggaagaggcgaactccagacagaaccaaagaaaatggctttgacagagagcctttgcactcagaacatccaagcaagcgaccatgcactattagcccaggccagcggtacagtccaaataacggcttatcctaccagcccaatggcctgcctcaccctaccccacctccacctcagcattaccgtttggatgatatggccattgcccaccactacagggactcctatcgacaccccagccacagggacctcagggacagaaacagacctatggggttgcatggcacacgtcaagaagaaatgattgatcacagactaacagacagagaatgggcagaagagtggaaacatcttgaccatctgttaaactgcataatggacatggtagaaaaaacaaggcgatctctcaccgtactaaggcggtgtcaagaagcagaccgggaagaattgaattactggatccggcggtacagtgacgccgaggacttaaaaaaaggtggcggcagtagcagcagccactctaggcagcagagtcccgtcaacccagacccagttgcactagacgcgcatcgggaattccttcacaggcctgcgtctggatacgtgccagaggagatctggaagaaagctgaggaggccgtcaatgaggtgaagcgccaggcgatgacggagctgcagaaggccgtgtctgaggcggagcggaaagcccacgacatgatcacaacagagagggccaagatggagcgcacggtcgccgaggccaaacggcaggcggcggaggacgcactggcagttatcaatcagcaggaggattcaagcgagagttgctggaattgtggccgtaaagcgagtgaaacctgcagtggctgtaacacagcccgatactgtggctcattttgccagcacaaagactgggagaagcaccatcacatctgtggacagaccctgcaggcccagcagcagggagacacacctgcagtcagctcctctgtcacgcccaacagcggggctgggagcccgatggacacaccaccagcagccactccgaggtcaaccaccccgggaaccccttccaccatagagacaacccctcgctagacgtgaactcagaactgtcggaggaaagacaacacaaccaacgcgaaaccaattcctcatcctcagatgctcaaagttgttttttttgtttgtttgtttattagatgaattatcctatttcagtacttcagcaagagagaacctaactgtatcttgaggtggtagtaaaacacagagggccagtaacgggtcgtaatgacttattgtggataacaaagatatcttttctttagagaactgaaaagagagcagagaatataacatgaaatgatagatttgacctcctccctgttattttcaagtagctgggattttaaactagatgacctcattaaccgatgctttaccaaacagcaaaccaagagattgctaattgctgttgaaagcaaaaatgctaatattaaaagtcacaatgttctttatatacaataatggaaaaaaaaaaaagaggaaaaccctcaagggcatgagcattggatacagcagtagacattttaacaagaagatgaatggcgtccgtgggttgctaactgaactttgaagacccgctacaaaacgcgcagatgtgcagcagattggaaggagacacagatgttcggtttttttcctgtttctgaaaagaaataataatatccaggtcaacagaatgaaaaatgaaagatgatttgcaatgggatgtatgaatacagcagcaagaaaaaaaaatgccataatacaaaaggctccatatatatatatatatatatatatatacacacacacacacgcacatatacacacacacacacacacacacacacacacacacacacacacacacacacacacaagtaagagactcagcctgcagttaattagcattctggcagttttgacatcagccagctgccctaaataacccttcaacgtttcttcacttttgcaaggttccacagagtaagacattgggtctattccagctcattcattttatattgaaaaaaataattttaaaaatggtggcttcagctccagcccctttccaaaatttttcaaccccaccctgtttggatttttaattaaaaactagtagttctcttggtgttaaaacacttctgtcctgtgaggtttcccaatggtgtttttcttgtaaatgtgttggacaaatgtgaagatgcattgtagtttaaccatatgcccacatttagtctctttattcctagttggtgagaaacctgtatctttctatgctgcttttatatctgtatgtattagtgatatttctctagtagttaaaaaaaaaaaaaggaaaaaaagactctttttggttgtcctcaag

SEQ ID NO: 2025 - DNA, 2370 bp, Homo sapiens
caggagaagtgaagatgtaacatgttatctgtcgctcctcttagctggcggagagaatttacatttaaagattagcagagtgagaaagagaaatctgccttttgttgtgtggggtgaggaggaggcatctacccctggccttgacgctatctcccatcacctctgctatccagacaggactcaccgagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaagaatttcattccaaactgcaagaagctactaacttcccactgagaccttttgtcatcccatttttgaaggccaacttgcccctgctgcagcgtgagctcctccactgcgcaagactggccaaacagaaccctgcccagtacctcgcccagcatgaacagctgcttctggatgccagcaccacctcacctgttgactcctcagagctgcttctcgatgtgaacgaaaacgggaagaggcgaactccagacagaaccaaagaaaatggctttgacagagagcctttgcactcagaacatccaagcaagcgaccatgcactattagcccaggccagcggtacagtccaaataacggcttatcctaccagcccaatggcctgcctcaccctaccccacctccacctcagcattaccgtttggatgatatggccattgcccaccactacagggactcctatcgacaccccagccacagggacctcagggacagaaacagacctatggggttgcatggcacacgtcaagaagaaatgattgatcacagactaacagacagagaatgggcagaagagtggaaacatcttgaccatctgttaaactgcataatggacatggtagaaaaaacaaggcgatctctcaccgtactaaggcggtgtcaagaagcagaccgggaagaattgaattactggatccggcggtacagtgacgccgaggacttaaaaaaaggtggcggcagtagcagcagccactctaggcagcagagtcccgtcaacccagacccagttgcactagacgcgcatcgggaattccttcacaggcctgcgtctggatacgtgccagaggagatctggaagaaagctgaggaggccgtcaatgaggtgaagcgccaggcgatgacggagctgcagaaggccgtgtctgaggcggagcggaaagcccacgacatgatcacaacagagagggccaagatggagcgcacggtcgccgaggccaaacggcaggcggcggaggacgcactggcagttatcaatcagcaggaggattcaagcgagagttgctggaattgtggccgtaaagcgagtgaaacctgcagtggctgtaacacagcccgatactgtggctcattttgccagcacaaagactgggagaagcaccatcacatctgtggacagaccctgcaggcccagcagcagggagacacacctgcagtcagctcctctgtcacgcccaacagcggggctgggagcccgatggacacaccaccagcagccactccgaggtcaaccaccccgggaaccccttccaccatagagacaacccctcgctagacgtgaactcagaactgtcggaggaaagacaacacaaccaacgcgaaaccaattcctcatcctcagatgctcaaagttgttttttttgtttgtttgtttattagatgaattatcctatttcagtacttcagcaagagagaacctaactgtatcttgaggtggtagtaaaacacagagggccagtaacgggtcgtaatgacttattgtggataacaaagatatcttttctttagagaactgaaaagagagcagagaatataacatgaaatgatagatttgacctcctccctgttattttcaagtagctgggattttaaactagatgacctcattaaccgatgctttaccaaacagcaaaccaagagattgctaattgctgttgaaagcaaaaatgctaatattaaaagtcacaatgttctttatatacaataatggaaaaaaaaaaaagaggaaaa

SEQ ID NO: 2026 - DNA, 3463 bp, Homo sapiens
tgaataaattattcggcatttagcttatcattctgaatttcactttttgctttttggtgctctgaaacttgcagagagaggtggagtgctaaggggagggtaggggttgtgatactttgcacacacatccctgtcattgttctgcctaaagagacagggctgggttcaaggccacatgtgctcctgtcatcctccacatttctgctccaagtgcaatccggagtgtcagctctccatctgtctctgcctggcaggcgcacgcgcccagcaccctgcctccggcgatgccgccccagcccctctgatggccctcctctctgctgccactcattccagaacaggaggcatgagcccggaacgcgcttgcttttaggagacagccactttctgtgtggtacgctggattcaaggatgcctgatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaagaatttcattccaaactgcaagaagctactaacttcccactgagaccttttgtcatcccatttttgaaggccaacttgcccctgctgcagcgtgagctcctccactgcgcaagactggccaaacagaaccctgcccagtacctcgcccagcatgaacagctgcttctggatgccagcaccacctcacctgttgactcctcagagctgcttctcgatgtgaacgaaaacgggaagaggcgaactccagacagaaccaaagaaaatggctttgacagagagcctttgcactcagaacatccaagcaagcgaccatgcactattagcccaggccagcggtacagtccaaataacggcttatcctaccagcccaatggcctgcctcaccctaccccacctccacctcagcattaccgtttggatgatatggccattgcccaccactacagggactcctatcgacaccccagccacagggacctcagggacagaaacagacctatggggttgcatggcacacgtcaagaagaaatgattgatcacagactaacagacagagaatgggcagaagagtggaaacatcttgaccatctgttaaactgcataatggacatggtagaaaaaacaaggcgatctctcaccgtactaaggcggtgtcaagaagcagaccgggaagaattgaattactggatccggcggtacagtgacgccgaggacttaaaaaaaggtggcggcagtagcagcagccactctaggcagcagagtcccgtcaacccagacccagttgcactagacgcgcatcgggaattccttcacaggcctgcgtctggatacgtgccagaggagatctggaagaaagctgaggaggccgtcaatgaggtgaagcgccaggcgatgacggagctgcagaaggccgtgtctgaggcggagcggaaagcccacgacatgatcacaacagagagggccaagatggagcgcacggtcgccgaggccaaacggcaggcggcggaggacgcactggcagttatcaatcagcaggaggattcaagcgagagttgctggaattgtggccgtaaagcgagtgaaacctgcagtggctgtaacacagcccgatactgtggctcattttgccagcacaaagactgggagaagcaccatcacatctgtggacagaccctgcaggcccagcagcagggagacacacctgcagtcagctcctctgtcacgcccaacagcggggctgggagcccgatggacacaccaccagcagccactccgaggtcaaccaccccgggaaccccttccaccatagagacaacccctcgctagacgtgaactcagaactgtcggaggaaagacaacacaaccaacgcgaaaccaattcctcatcctcagatgctcaaagttgttttttttgtttgtttgtttattagatgaattatcctatttcagtacttcagcaagagagaacctaactgtatcttgaggtggtagtaaaacacagagggccagtaacgggtcgtaatgacttattgtggataacaaagatatcttttctttagagaactgaaaagagagcagagaatataacatgaaatgatagatttgacctcctccctgttattttcaagtagctgggattttaaactagatgacctcattaaccgatgctttaccaaacagcaaaccaagagattgctaattgctgttgaaagcaaaaatgctaatattaaaagtcacaatgttctttatatacaataatggaaaaaaaaaaaagaggaaaaccctcaagggcatgagcattggatacagcagtagacattttaacaagaagatgaatggcgtccgtgggttgctaactgaactttgaagacccgctacaaaacgcgcagatgtgcagcagattggaaggagacacagatgttcggtttttttcctgtttctgaaaagaaataataatatccaggtcaacagaatgaaaaatgaaagatgatttgcaatgggatgtatgaatacagcagcaagaaaaaaaaatgccataatacaaaaggctccatatatatatatatatatatatatatacacacacacacacgcacatatacacacacacacacacacacacacacacacacacacacacacacacacacacacaagtaagagactcagcctgcagttaattagcattctggcagttttgacatcagccagctgccctaaataacccttcaacgtttcttcacttttgcaaggttccacagagtaagacattgggtctattccagctcattcattttatattgaaaaaaataattttaaaaatggtggcttcagctccagcccctttccaaaatttttcaaccccaccctgtttggatttttaattaaaaactagtagttctcttggtgttaaaacacttctgtcctgtgaggtttcccaatggtgtttttcttgtaaatgtgttggacaaatgtgaagatgcattgtagtttaaccatatgcccacatttagtctctttattcctagttggtgagaaacctgtatctttctatgctgcttttatatctgtatgtattagtgatatttctctagtagttaaaaaaaaaaaaaggaaaaaaagactctttttggttgtcctcaag

SEQ ID NO: 2027 - DNA, 2450 bp, Homo sapiens
tataacactaccaaggtagcatctgcctaagccagaaataacaataggatataatataacctagttacaaatgaggtcctgccatctgtgctataccttcttaagtggggtttggatgataaaatcctgatttaaacgtcagtagataagtgtattttattgatagaagatgttgaatttcttctgttcacttgcttttaaaaaagataaaccccacttgaaaaactgaggtgcttaaggagtaaaataatatgttcctggtggcatcctccagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaagaatttcattccaaactgcaagaagctactaacttcccactgagaccttttgtcatcccatttttgaaggccaacttgcccctgctgcagcgtgagctcctccactgcgcaagactggccaaacagaaccctgcccagtacctcgcccagcatgaacagctgcttctggatgccagcaccacctcacctgttgactcctcagagctgcttctcgatgtgaacgaaaacgggaagaggcgaactccagacagaaccaaagaaaatggctttgacagagagcctttgcactcagaacatccaagcaagcgaccatgcactattagcccaggccagcggtacagtccaaataacggcttatcctaccagcccaatggcctgcctcaccctaccccacctccacctcagcattaccgtttggatgatatggccattgcccaccactacagggactcctatcgacaccccagccacagggacctcagggacagaaacagacctatggggttgcatggcacacgtcaagaagaaatgattgatcacagactaacagacagagaatgggcagaagagtggaaacatcttgaccatctgttaaactgcataatggacatggtagaaaaaacaaggcgatctctcaccgtactaaggcggtgtcaagaagcagaccgggaagaattgaattactggatccggcggtacagtgacgccgaggacttaaaaaaaggtggcggcagtagcagcagccactctaggcagcagagtcccgtcaacccagacccagttgcactagacgcgcatcgggaattccttcacaggcctgcgtctggatacgtgccagaggagatctggaagaaagctgaggaggccgtcaatgaggtgaagcgccaggcgatgacggagctgcagaaggccgtgtctgaggcggagcggaaagcccacgacatgatcacaacagagagggccaagatggagcgcacggtcgccgaggccaaacggcaggcggcggaggacgcactggcagttatcaatcagcaggaggattcaagcgagagttgctggaattgtggccgtaaagcgagtgaaacctgcagtggctgtaacacagcccgatactgtggctcattttgccagcacaaagactgggagaagcaccatcacatctgtggacagaccctgcaggcccagcagcagggagacacacctgcagtcagctcctctgtcacgcccaacagcggggctgggagcccgatggacacaccaccagcagccactccgaggtcaaccaccccgggaaccccttccaccatagagacaacccctcgctagacgtgaactcagaactgtcggaggaaagacaacacaaccaacgcgaaaccaattcctcatcctcagatgctcaaagttgttttttttgtttgtttgtttattagatgaattatcctatttcagtacttcagcaagagagaacctaactgtatcttgaggtggtagtaaaacacagagggccagtaacgggtcgtaatgacttattgtggataacaaagatatcttttctttagagaactgaaaagagagcagagaatataacatgaaatgatagatttgacctcctccctgttattttcaagtagctgggattttaaactagatgacctcattaaccgatgctttaccaaacagcaaaccaagagattgctaattgctgttgaaagcaaaaatgctaatattaaaagtcacaatgttctttatatacaataatggaaaaaaaaaaaaga

SEQ ID NO: 2028 - DNA, 1970 bp, Homo sapiens
actcacacacaatgtgccatcctgacaaggcttttacttctgataagctccaatgtgtgtttaatgaatacaaagccgcggtctgggtgccgcctcggccgcggccgctctcccgcgctcctttgccagaagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaagaatttcattccaaactgcaagaagctactaacttcccactgagaccttttgtcatcccatttttgaaggccaacttgcccctgctgcagcgtgagctcctccactgcgcaagactggccaaacagaaccctgcccagtacctcgcccagcatgaacagctgcttctggatgccagcaccacctcacctgttgactcctcagagctgcttctcgatgtgaacgaaaacgggaagaggcgaactccagacagaaccaaagaaaatggctttgacagagagcctttgcactcagaacatccaagcaagcgaccatgcactattagcccaggccagcggtacagtccaaataacggcttatcctaccagcccaatggcctgcctcaccctaccccacctccacctcagcattaccgtttggatgatatggccattgcccaccactacagggactcctatcgacaccccagccacagggacctcagggacagaaacagacctatggggttgcatggcacacgtcaagaagaaatgattgatcacagactaacagacagagaatgggcagaagagtggaaacatcttgaccatctgttaaactgcataatggacatggtagaaaaaacaaggcgatctctcaccgtactaaggcggtgtcaagaagcagaccgggaagaattgaattactggatccggcggtacagtgacgccgaggacttaaaaaaaggtggcggcagtagcagcagccactctaggcagcagagtcccgtcaacccagacccagttgcactagacgcgcatcgggaattccttcacaggcctgcgtctggatacgtgccagaggagatctggaagaaagctgaggaggccgtcaatgaggtgaagcgccaggcgatgacggagctgcagaaggccgtgtctgaggcggagcggaaagcccacgacatgatcacaacagagagggccaagatggagcgcacggtcgccgaggccaaacggcaggcggcggaggacgcactggcagttatcaatcagcaggaggattcaagcgagagttgctggaattgtggccgtaaagcgagtgaaacctgcagtggctgtaacacagcccgatactgtggctcattttgccagcacaaagactgggagaagcaccatcacatctgtggacagaccctgcaggcccagcagcagggagacacacctgcagtcagctcctctgtcacgcccaacagcggggctgggagcccgatggacacaccaccagcagccactccgaggtcaaccaccccgggaaccccttccaccatagagacaacccctcgctagacgtgaactcagaactgtcggaggaaagacaacacaaccaacgcgaaaccaattcctcatcctcagatgctcaaagttgttttttttgtttgtttgtttattagatgaatt

SEQ ID NO: 2029 - DNA, 548 bp, Homo sapiens
attttctgagttcccattatatagtgtcctatgtgtgttgctcttttccagtcagactcattagtagtctggtgtggagctagtagctcagagattgcttttatgaggcggttttggaatcttcatctgcccatgaaaatagaatagtccacttttaaaaaaagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaact

SEQ ID NO: 2030 - DNA, 782 bp, Homo sapiens
ttctgtcttctctctctctctcccacttttcctccctctcccgctccgtctcacacgcaccctctgtttattttcctgcctccatctgggccctgctgatattgtaatcaccctgatgcacgttggcttctctcctctccctcctgcgctcacacactcactcacacacaatgtgccatcctgacaaggcttttacttctgataagctccaatgtgtgtttaatgaatacaaagccgcggtctgggtgccgcctcggccgcggccgctctcccgcgctcctttgccagaagaaaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagt

SEQ ID NO: 2031 - DNA, 574 bp, Homo sapiens
gattcagaagtcgataagaccaggagaagtgaagatgtaacatgttatctgtcgctcctcttagctggcggagagaatttacatttaaagattagcagagtgagaaagagaaatctgccttttgttgtgtggggtgaggaggaggcatctacccctggccttgacgctatctcccatcacctctgctatccagacaggactcaccgaggcgcacgcgcccagcaccctgcctccggcgatgccgccccagcccctctgatggccctcctctctgctgccactcattccagaacaggaggcatgagcccggaacgcgcttgcttttaggagacagccactttctgtgtggtacgctggattcaaggatgcctgatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggctt

SEQ ID NO: 2032 - DNA, 553 bp, Homo sapiens
ctctctccctctctccctttccaaatgattcagaagtcgataagaccaggagaagtgaagatgtaacatgttatctgtcgctcctcttagctggcggagagaatttacatttaaagattagcagagtgagaaagagaaatctgccttttgttgtgtggggtgaggaggaggcatctacccctggccttgacgctatctcccatcacctctgctatccagacaggactcaccgagtatcaaatgataagaactgagcacactggatgaaataatacttgcactgggagcactaagaaaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaaggcgcacgcgcccagcaccctgcctccggcgatgccgccccagcccctctgatggccctcctctctgctgccactcattccagaaca

SEQ ID NO: 2033 - DNA, 556 bp, Homo sapiens
aatgaatacaaagccgcggtctgggtgccgcctcggccgcggccgctctcccgcgctcctttgccagaagaaaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaagaacaggaggcatgagcccggaacgcgcttgcttttaggagacagccactttctgtgtggtacgctggattcaaggatgcctgatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcct

SEQ ID NO: 2034 - DNA, 591 bp, Homo sapiens
gagggcgggcgagggagacgcagacgccgcctgtgacagtggcaattccctgcgccccacatcacatttgtctgccacagcagcaacaacagaaaagcggagggagggagggaggcgggaggaggggagcagagctccgcaagtcttgggctctgcgtggaggttgcgtttggctggcgtccccgaccccgggctttttgcacggcagctctctctgcgcagcgccgggcggccgtagtcgctccgcggcgcgactccgcggtctcgtggcgagcgcgcgtgggcgagtggccgcggacactctggcctcgcgagggaagccgcgccgcgtcctcgccccgtcgccccgcgggccggccgagacgacgggaagttttatttgcagctcggagcctgtggcggatggtgggactctccggccctgtgcagtatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattct

SEQ ID NO: 2035 - DNA, 2453 bp, Homo sapiens
acttttcctccctctcccgctccgtctcacacgcaccctctgtttattttcctgcctccatctgggccctgctgatattgtaatcaccctgatgcacgttggcttctctcctctccctcctgcgctcacacactcactcacacacaatgtgccatcctgacaaggcttttacttctgataagctccaatgtgtgtttaatgaatacaaagccgcggtctgggtgccgcctcggccgcggccgctctcccgcgctcctttgccagaagctggcggagagaatttacatttaaagattagcagagtgagaaagagaaatctgccttttgttgtgtggggtgaggaggaggcatctacccctggccttgacgctatctcccatcacctctgctatccagacaggactcaccgagtatcaaatgataagaactgagcacactggatgaaataatacttgcactgggagcactaagaaaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaagaacaggaggcatgagcccggaacgcgcttgcttttaggagacagccactttctgtgtggtacgctggattcaaggatgcctgatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaagaatttcattccaaactgcaagaagctactaacttcccactgagaccttttgtcatcccatttttgaaggccaacttgcccctgctgcagcgtgagctcctccactgcgcaagactggccaaacagaaccctgcccagtacctcgcccagcatgaacagctgcttctggatgccagcaccacctcacctgttgactcctcagagctgcttctcgatgtgaacgaaaacgggaagaggcgaactccagacagaaccaaagaaaatggctttgacagagagcctttgcactcagaacatccaagcaagcgaccatgcactattagcccaggccagcggtacagtccaaataacggcttatcctaccagcccaatggcctgcctcaccctaccccacctccacctcagcattaccgtttggatgatatggccattgcccaccactacagggactcctatcgacaccccagccacagggacctcagggacagaaacagacctatggggttgcatggcacacgtcaagaagaaatgattgatcacagactaacagacagagaatgggcagaagagtggaaacatcttgaccatctgttaaactgcataatggacatggtagaaaaaacaaggcgatctctcaccgtactaaggcggtgtcaagaagcagaccgggaagaattgaattactggatccggcggtacagtgacgccgaggacttaaaaaaaggtggcggcagtagcagcagccactctaggcagcagagtcccgtcaacccagacccagttgcactagacgcgcatcgggaattccttcacaggcctgcgtctggatacgtgccagaggagatctggaagaaagctgaggaggccgtcaatgaggtgaagcgccaggcgatgacggagctgcagaaggccgtgtctgaggcggagcggaaagcccacgacatgatcacaacagagagggccaagatggagcgcacggtcgccgaggccaaacggcaggcggcggaggacgcactggcagttatcaatcagcaggaggattcaagcgagagttgctggaattgtggccgtaaagcgagtgaaacctgcagtggctgtaacacagcccgatactgtggctcattttgccagcacaaagactgggagaagcaccatcacatctgtggacagaccctgcaggcccagcagcagggagacacacctgcagtcagctcctctgtcacgcccaacagcggggctgggagcccgatggacacaccaccagcagccactccgaggtcaaccaccccgggaaccccttccaccatagagacaacccctcgctag

SEQ ID NO: 2036 - DNA, 548 bp, Homo sapiens
acttctgataagctccaatgtgtgtttaatgaatacaaagccgcggtctgggtgccgcctcggccgcggccgctctcccgcgctcctttgccagaagctggcggagagaatttacatttaaagattagcagagtgagaaagagaaatctgccttttgttgtgtggggtgaggaggaggcatctacccctggccttgacgctatctcccatcacctctgctatccagacaggactcaccgagtatcaaatgataagaactgagcacactggatgaaataatacttgcactgggagcactaagaaaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaagatcgtactgagaagcactccacaatgccagactcacctgtggatgtgaagacgcaatctaggctgactcctcca

SEQ ID NO: 2037 - DNA, 976 bp, Homo sapiens
agaagtcgataagaccaggagaagtgaagatgtaacatgttatctgtcgctcctcttagctggcggagagaatttacatttaaagattagcagagtgagaaagagaaatctgccttttgttgtgtggggtgaggaggaggcatctacccctggccttgacgctatctcccatcacctctgctatccagacaggactcaccgagaaaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaagaatttcattccaaactgcaagaagctactaacttcccactgagaccttttgtcatcccatttttgaaggccaacttgcccctgctgcagcgtgagctcctccactgcgcaagactggccaaacagaaccctgcccagtacctcgcccagcatgaacagctgcttctggatgccagcaccacctcacctgttgactcct

SEQ ID NO: 2038 - DNA, 544 bp, Homo sapiens
actcactcacacacaatgtgccatcctgacaaggcttttacttctgataagctccaatgtgtgtttaatgaatacaaagccgcggtctgggtgccgcctcggccgcggccgctctcccgcgctcctttgccagaagaaaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaaggcgcacgcgcccagcaccctgcctccggcgatgccgccccagcccctctgatggccctcctctctgctgccactcattccagaacaggaggcatgagcccggaacgcgcttgcttttaggagacagccactttctgtgtggtacgctggattcaaggatgcctgatcgtactgagaagcactccacaatgccagactcacctgtggatgtgaagacgcaatctaggctgactcct

SEQ ID NO: 2039 - DNA, 1044 bp, Homo sapiens
ccctcctgcctgtccctttctgtcttctctctctctctcccacttttcctccctctcccgctccgtctcacacgcaccctctgtttattttcctgcctccatctgggccctgctgatattgtaatcaccctgatgcacgttggcttctctcctctccctcctgcgctcacacactcactcacacacaatgtgccatcctgacaaggcttttacttctgataagctccaatgtgtgtttaatgaatacaaagccgcggtctgggtgccgcctcggccgcggccgctctcccgcgctcctttgccagaagctggcggagagaatttacatttaaagattagcagagtgagaaagagaaatctgccttttgttgtgtggggtgaggaggaggcatctacccctggccttgacgctatctcccatcacctctgctatccagacaggactcaccgagaaaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaagaatttcattccaaactg

SEQ ID NO: 2040 - DNA, 491 bp, Homo sapiens
aagtcgataagaccaggagaagtgaagatgtaacatgttatctgtcgctcctcttagctggcggagagaatttacatttaaagattagcagagtgagaaagagaaatctgccttttgttgtgtggggtgaggaggaggcatctacccctggccttgacgctatctcccatcacctctgctatccagacaggactcaccgagtatcaaatgataagaactgagcacactggatgaaataatacttgcactgggagcactaagaaaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaagatcgtactgagaagcactccacaatgccagactcacctgtggatgtgaagacgcaat

SEQ ID NO: 2041 - DNA, 574 bp, Homo sapiens
gattcagaagtcgataagaccaggagaagtgaagatgtaacatgttatctgtcgctcctcttagctggcggagagaatttacatttaaagattagcagagtgagaaagagaaatctgccttttgttgtgtggggtgaggaggaggcatctacccctggccttgacgctatctcccatcacctctgctatccagacaggactcaccgagataaaccccacttgaaaaactgaggtgcttaaggagtaaaataatatgttcctggtggcatcctccagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggtt

SEQ ID NO: 2042 - DNA, 573 bp, Homo sapiens
actcacacacaatgtgccatcctgacaaggcttttacttctgataagctccaatgtgtgtttaatgaatacaaagccgcggtctgggtgccgcctcggccgcggccgctctcccgcgctcctttgccagaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgcca

SEQ ID NO: 2043 - DNA, 2103 bp, Homo sapiens
ttttcctccctctcccgctccgtctcacacgcaccctctgtttattttcctgcctccatctgggccctgctgatattgtaatcaccctgatgcacgttggcttctctcctctccctcctgcgctcacacactcactcacacacaatgtgccatcctgacaaggcttttacttctgataagctccaatgtgtgtttaatgaatacaaagccgcggtctgggtgccgcctcggccgcggccgctctcccgcgctcctttgccagaagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaagaatttcattccaaactgcaagaagctactaacttcccactgagaccttttgtcatcccatttttgaaggccaacttgcccctgctgcagcgtgagctcctccactgcgcaagactggccaaacagaaccctgcccagtacctcgcccagcatgaacagctgcttctggatgccagcaccacctcacctgttgactcctcagagctgcttctcgatgtgaacgaaaacgggaagaggcgaactccagacagaaccaaagaaaatggctttgacagagagcctttgcactcagaacatccaagcaagcgaccatgcactattagcccaggccagcggtacagtccaaataacggcttatcctaccagcccaatggcctgcctcaccctaccccacctccacctcagcattaccgtttggatgatatggccattgcccaccactacagggactcctatcgacaccccagccacagggacctcagggacagaaacagacctatggggttgcatggcacacgtcaagaagaaatgattgatcacagactaacagacagagaatgggcagaagagtggaaacatcttgaccatctgttaaactgcataatggacatggtagaaaaaacaaggcgatctctcaccgtactaaggcggtgtcaagaagcagaccgggaagaattgaattactggatccggcggtacagtgacgccgaggacttaaaaaaaggtggcggcagtagcagcagccactctaggcagcagagtcccgtcaacccagacccagttgcactagacgcgcatcgggaattccttcacaggcctgcgtctggatacgtgccagaggagatctggaagaaagctgaggaggccgtcaatgaggtgaagcgccaggcgatgacggagctgcagaaggccgtgtctgaggcggagcggaaagcccacgacatgatcacaacagagagggccaagatggagcgcacggtcgccgaggccaaacggcaggcggcggaggacgcactggcagttatcaatcagcaggaggattcaagcgagagttgctggaattgtggccgtaaagcgagtgaaacctgcagtggctgtaacacagcccgatactgtggctcattttgccagcacaaagactgggagaagcaccatcacatctgtggacagaccctgcaggcccagcagcagggagacacacctgcagtcagctcctctgtcacgcccaacagcggggctgggagcccgatggacacaccaccagcagccactccgaggtcaaccaccccgggaaccccttccaccatagagacaacccctcgctagacgtgaactcagaactgtcggaggaaagacaacacaaccaacgcgaaaccaattcctcatcctcagatgctcaaagttgttttttttgtttgtttgtttattagatgaatt

SEQ ID NO: 2044 - DNA, 564 bp, Homo sapiens
ttctctcctctccctcctgcgctcacacactcactcacacacaatgtgccatcctgacaaggcttttacttctgataagctccaatgtgtgtttaatgaatacaaagccgcggtctgggtgccgcctcggccgcggccgctctcccgcgctcctttgccagaagtatcaaatgataagaactgagcacactggatgaaataatacttgcactgggagcactaagaaaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctaca

SEQ ID NO: 2045 - DNA, 585 bp, Homo sapiens
aacataagtgggaagctatttattcccttgttgctgaggttggttgagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaagaatttcattccaaactgcaagaagctactaacttcccactgagaccttttgtcatcccatttttgaaggccaacttgcccctgctgcagcgtgagctcctccactgcgcaagactggccaaacagaaccctgccc

SEQ ID NO: 2046 - DNA, 730 bp, Homo sapiens
tgattcagaagtcgataagaccaggagaagtgaagatgtaacatgttatctgtcgctcctcttagctggcggagagaatttacatttaaagattagcagagtgagaaagagaaatctgccttttgttgtgtggggtgaggaggaggcatctacccctggccttgacgctatctcccatcacctctgctatccagacaggactcaccgaggcgcacgcgcccagcaccctgcctccggcgatgccgccccagcccctctgatggccctcctctctgctgccactcattccagaacaggaggcatgagcccggaacgcgcttgcttttaggagacagccactttctgtgtggtacgctggattcaaggatgcctgataaaccccacttgaaaaactgaggtgcttaaggagtaaaataatatgttcctggtggcatcctccagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagct

SEQ ID NO: 2047 - DNA, 596 bp, Homo sapiens
ctccctctctccctttccaaatgattcagaagtcgataagaccaggagaagtgaagatgtaacatgttatctgtcgctcctcttagctggcggagagaatttacatttaaagattagcagagtgagaaagagaaatctgccttttgttgtgtggggtgaggaggaggcatctacccctggccttgacgctatctcccatcacctctgctatccagacaggactcaccgagaaaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacc

SEQ ID NO: 2048 - DNA, 572 bp, Homo sapiens
gagaagaaaatagccagctttagataaagcactataacaaaggcttctagttttatatatcatggtgtccattaaagcttaatagggaagagtccattgaacctggctgggcgcacgcgcccagcaccctgcctccggcgatgccgccccagcccctctgatggccctcctctctgctgccactcattccagaacaggaggcatgagcccggaacgcgcttgcttttaggagacagccactttctgtgtggtacgctggattcaaggatgcctgatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggtt

SEQ ID NO: 2049 - DNA, 690 bp, Homo sapiens
agtctgaaaaattggcacctgcaggatttgcatgtgaaaaaaacggagtcagttgcattttgccggagtctattacttatcaaatgataagaactgagcacactggatgaaataatacttgcactgggagcactaagaaaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtg

SEQ ID NO: 2050 - DNA, 553 bp, Homo sapiens
tatgcaggcaacatagcccttcatagcaaagcagtctgaaaaattggcacctgcaggatttgcatgtgaaaaaaacggagtcagttgcattttgccggagtctattactaaaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgc

SEQ ID NO: 2051 - DNA, 7537 bp, Homo sapiens
atcacatttgtctgccacagcagcaacaacagaaaagcggagggagggagggaggcgggaggaggggagcagagctccgcaagtcttgggctctgcgtggaggttgcgtttggctggcgtccccgaccccgggctttttgcacggcagctctctctgcgcagcgccgggcggccgtagtcgctccgcggcgcgactccgcggtctcgtggcgagcgcgcgtgggcgagtggccgcggacactctggcctcgcgagggaagccgcgccgcgtcctcgccccgtcgccccgcgggccggccgagacgacgggaagttttatttgcagctcggagcctgtggcggatggtgggactctccggccctgtgcagtaaaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaagatcgtactgagaagcactccacaatgccagactcacctgtggatgtgaagacgcaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaagaatttcattccaaactgcaagaagctactaacttcccactgagaccttttgtcatcccatttttgaaggccaacttgcccctgctgcagcgtgagctcctccactgcgcaagactggccaaacagaaccctgcccagtacctcgcccagcatgaacagctgcttctggatgccagcaccacctcacctgttgactcctcagagctgcttctcgatgtgaacgaaaacgggaagaggcgaactccagacagaaccaaagaaaatggctttgacagagagcctttgcactcagaacatccaagcaagcgaccatgcactattagcccaggccagcggtacagtccaaataacggcttatcctaccagcccaatggcctgcctcaccctaccccacctccacctcagcattaccgtttggatgatatggccattgcccaccactacagggactcctatcgacaccccagccacagggacctcagggacagaaacagacctatggggttgcatggcacacgtcaagaagaaatgattgatcacagactaacagacagagaatgggcagaagagtggaaacatcttgaccatctgttaaactgcataatggacatggtagaaaaaacaaggcgatctctcaccgtactaaggcggtgtcaagaagcagaccgggaagaattgaattactggatccggcggtacagtgacgccgaggacttaaaaaaaggtggcggcagtagcagcagccactctaggcagcagagtcccgtcaacccagacccagttgcactagacgcgcatcgggaattccttcacaggcctgcgtctggatacgtgccagaggagatctggaagaaagctgaggaggccgtcaatgaggtgaagcgccaggcgatgacggagctgcagaaggccgtgtctgaggcggagcggaaagcccacgacatgatcacaacagagagggccaagatggagcgcacggtcgccgaggccaaacggcaggcggcggaggacgcactggcagttatcaatcagcaggaggattcaagcgagagttgctggaattgtggccgtaaagcgagtgaaacctgcagtggctgtaacacagcccgatactgtggctcattttgccagcacaaagactgggagaagcaccatcacatctgtggacagaccctgcaggcccagcagcagggagacacacctgcagtcagctcctctgtcacgcccaacagcggggctgggagcccgatggacacaccaccagcagccactccgaggtcaaccaccccgggaaccccttccaccatagagacaacccctcgctagacgtgaactcagaactgtcggaggaaagacaacacaaccaacgcgaaaccaattcctcatcctcagatgctcaaagttgttttttttgtttgtttgtttattagatgaattatcctatttcagtacttcagcaagagagaacctaactgtatcttgaggtggtagtaaaacacagagggccagtaacgggtcgtaatgacttattgtggataacaaagatatcttttctttagagaactgaaaagagagcagagaatataacatgaaatgatagatttgacctcctccctgttattttcaagtagctgggattttaaactagatgacctcattaaccgatgctttaccaaacagcaaaccaagagattgctaattgctgttgaaagcaaaaatgctaatattaaaagtcacaatgttctttatatacaataatggaaaaaaaaaaaagaggaaaaccctcaagggcatgagcattggatacagcagtagacattttaacaagaagatgaatggcgtccgtgggttgctaactgaactttgaagacccgctacaaaacgcgcagatgtgcagcagattggaaggagacacagatgttcggtttttttcctgtttctgaaaagaaataataatatccaggtcaacagaatgaaaaatgaaagatgatttgcaatgggatgtatgaatacagcagcaagaaaaaaaaatgccataatacaaaaggctccatatatatatatatatatatatatatacacacacacacacgcacatatacacacacacacacacacacacacacacacacacacacacacacacacacacacaagtaagagactcagcctgcagttaattagcattctggcagttttgacatcagccagctgccctaaataacccttcaacgtttcttcacttttgcaaggttccacagagtaagacattgggtctattccagctcattcattttatattgaaaaaaataattttaaaaatggtggcttcagctccagcccctttccaaaatttttcaaccccaccctgtttggatttttaattaaaaactagtagttctcttggtgttaaaacacttctgtcctgtgaggtttcccaatggtgtttttcttgtaaatgtgttggacaaatgtgaagatgcattgtagtttaaccatatgcccacatttagtctctttattcctagttggtgagaaacctgtatctttctatgctgcttttatatctgtatgtattagtgatatttctctagtagttaaaaaaaaaaaaaggaaaaaaagactctttttggttgtcctcaagaaaagaaaagaagaaaagctatctttcggagctgctatttcactctcttataggatttttttttttcctgaaaaccagcatgcttcacggaatgctaacatattggtgtttttgtaagagggatgtacataaatgtattttgcactgtcacaatgactccctaggcatgctttttgtttttttttttttttttttgagcaaattctttttaaatatgctagagccatttcatcaagtttagctgtagcatagagtagtcgtggaatttttcttttttttttttttaaatcattattagggacttttttaaaaaaataaaataacaagatatcctactttaaaaaaaaaggacagtgcatgcatattgctgtaaggtcgtttaagtatttctaattttacaaaagtaaaaatcattagagctccaaatgctgaggtgtagattgacagctttaacactgctgaatgccaggttatacagtattcttacaaaaagggaagtcagccaaagactgatctgatggaccaaaatcggaattttgaaaagcaccagtactactttccaaatgatcagcaggttaaacatgttcagcaaggtatagtatgaatccattaacccttcgttgtccagggtccagaccagaactacttgttagttttgaaaacagtagcccaggatgtggttgtgtgctttaggaaagtcagcagtgctgcaggctgtgtagacaaccaaagtttacaaggctgggaagacacttctccaaatacatatacaccaggcatttctttaaaatcaaaaacaatccattagctttggggcggggggtggggggagggttaaatgtaggccttggaaacagttttaagtggcttttaagtatctgcatagaggcaatcctaaggtttgctttaagtctcttaaatctaacatttttaaaagcatttcttccctgtattttcatatacaagttggttttaattttgtttgggtggtgttattttttttaaatgactttttagtttagaaagttctgatgagcaaataaatacatctatctacatgttggaagtccatctgccagcacacctgcttaaagtgaaatgaaagcacataaccaggctctgaatgggttatattttatcatggtgctcccagaatcctttgacctcactctgctttctagtctgcttgtgacactggacagtcctttcttacagagctattatatgttctaggctacgaagggttaaataatcccaaaaatgaggtatgtcatacccacacgtctttatctctagaagctgtgatgtatgtgaaacagcactgttattcttaacactagtgtgtaaaataaggattagtacagtacgtctcattactttttaattcagggcaccctgagtgaaaacaaatacaaaaaaaaatccctaactctgagctctatctctgattcctcttcctccttcccctcttcctcctcttcctctcctcctgttttgctacattctcctcagtggcaaaaagtttcactctacctctgacagcatgtatattgcaccagtagctaacaaaaactggtctagtcaaaccaaatgggcacaaaagaaccaggataccaaaagttaagctcatacagctgcaaaccatatcacttcttggtaacaatgcagacctcataaacctaaagaagagaaagaaaagaaaacttttgttactttccttttttgcttgtcacttatatacaggctatgtgagaatataatttgtaggtataacacattaagaaaaagttatcttcattggatagaattgaatggtggtcgctgataggaatagggcgtcctctagctcttatctctgtctcttactcttttctctttctctttttctctgtcatgagactgtgtgtgacagggccacctgtcttttttttttcttaaattttttttttttttatgtgtaggtgcatgtcttggggatttaaaaatttcaaggctggtttacttatgcaaagcatgcctacgtctggaatacttagggaaagaaagcgactccatgttgtccgaattcctcaagggacagaaaaaaaattggagactgttgaaatgcagatttgaagtaatttttttaaaatattattttgggttctgcgacattgtgaaaaattaaagttgttgtgcaatacttaattcagacatgtaccacaagttaatggtagactaacactggggggtggggtctaggcatcatgcttttgtcagcatactcttgagcttttaagtctactatgtctgaactgtggtttcttgtttatccttttttccttagttggactgtaatgtatggtctgtcaacctgtgaatctttaaagtatgattcaggtattgttgtattctttactgtgtaataaaaaagttgaaaaaaatctggatcctctgtctccctcgtccccggtgtgccatggttgcccaccagtgaccccagcctgaggagtccatcctccatggtgctgaatcaaatctgtagagtttattcagctacaaagcgtggctctgtaacaggagttggcttatccatgcgtgttgagtagggaatgatgtcagaactttgcaaaagtcgagctcattcataaggggatgtttctcaggcaggaggagtaggaagagtgggaggagaattactaccttccataggaaaggagagcttggcttgcctagattagctgctgcatagatagcagaggcccttttggctgtgttttgataaaattagaaatgagtacctaaatctggatcactctgctcagagaggttcgtgccaacctcatgaggctctgactcttgtcaggttgcttggctgccttgtgcatacccgaatggcagatcagctgacatgacatggaactgctctatctgccttgtcccctctcctctaattaaaagtcgctaccattgtcactcttggttatgtagttaatatccactgtggctatctccaacttgctgggacatccagttatctcctctgacacatattttttcattctctagttacaaagtttgttagagtttgaaaaacaaacccttctcccctaccctgtgaatgctgttagtttttatgtgtagttttcaaaacacagattatcttatatactgtgttgtagcagaaattcctgtttcctctgaatgttctgactttatagaccaaaataatcgttgcaaaaaatcaaggatggcacagcaggtgcatgagcccgtgtctggagaaaggttatgaaggtgaatgctggttacatgggagggtgacttggagccctctagtttccttcttgtgccagctgggttcctgtttcaaggccaggcttctctaacttgtcttcctgggaaatgtagcttttccaagaatttggtagtgcacaccaggaaaaactaggtatcagaacagatttttttttaaatagtggaaacaccctcactcccacactttggacagttagggttggatatttaatttcatagttactctttttttccacagaagaaaggccagcctgacccaagttgcctatttttaatgtgttactgcatcttattttctcttcaaagtgaaaaaggccagaaactagcagatagaaatggaacccgttgacttagttcccttataagaagttcttgcaaacacctctgtgacgttttcattcaagtggatatgttggacaaataggaaacagttttagtttacgcgaacagtatgagacttccaggtggtggacgccatttttttagaagtgttgatgatgtatttgataacattataaaagtatgtgtctcccgtgaaagaacattgagctatttccctggaatggatggggaagaaatgagcaaaggagtgctgttctgtatgggtgtctatacccttattccaaggtgaataaataaagttgtgtttgcc

SEQ ID NO: 2052 - DNA, 4147 bp, Homo sapiens
gcggccgccgaggcctgggtggaagttggcgctgctgccgccgccctgcagcccactcgctgcctcggcagcgcgctgctcttctaagatggctgccgctaccggtgcggtggcagcctcggccgcctcgggtcaggcggaaggtaaaaagatcaccgatctgcgggtcatcgatctgaagtccgagctgaagcggcggaacttagacatcaccggagtcaagaccgtgctcatctcccgactcaagcaggctattgaagaggaaggaggcgatccagataatattgaattaactgtttcaactgatactccaaacaagaaaccaactaaaggcaaaggtaaaaaacatgaagcagatgagttgagtggagatgcttctgtggaagatgatgcttttatcaaggactgtgaattggagaatcaagaggcacatgagcaagatggaaatgatgaactaaaggactctgaagaatttggtgaaaatgaagaagaaaatgtgcattccaaggagttactctctgcagaagaaaacaagagagctcatgaattaatagaggcagaaggaatagaagatatagaaaaagaggacatcgaaagtcaggaaattgaagctcaagaaggtgaagatgatacctttctaacagcccaagatggtgaggaagaagaaaatgagaaagatatagcaggttctggtgatggtacacaagaagtatctaaacctcttccttcagaagggagcctagctgaggctgatcacacagctcatgaagagatggaagctcatacgactgtgaaagaagctgaggatgacaacatctcggtcacaatccaggctgaagatgccatcactctggattttgatggtgatgacctcctagaaacaggtaaaaatgtgaaaattacagattctgaagcaagtaagccaaaagatgggcaggacgccattgcacagagcccggagaaggaaagcaaggattatgagatgaatgcgaaccataaagatggtaagaaggaagactgcgtgaagggtgaccctgtcgagaaggaagccagagaaagttctaagaaagcagaatctggagacaaagaaaaggatactttgaagaaagggccctcgtctactggggcctctggtcaagcaaagagctcttcaaaggaatctaaagacagcaagacatcatctaaagatgacaaaggaagtacaagtagtactagtggtagcagtggaagctcaactaaaaatatctgggttagtggactttcatctaataccaaagctgctgatttgaagaacctctttggcaaatatggaaaggttctgagtgcaaaagtagttacaaatgctcgaagtcctggggcaaaatgctatggcattgtaactatgtcttcaagcacagaggtgtccaggtgtattgcacatcttcatcgcactgagctgcatggacagctgatttctgttgaaaaagtaaaaggtgatccctctaagaaagaaatgaagaaagaaaatgatgaaaagagtagttcaagaagttctggagataaaaaaaatacgagtgatagaagtagcaagacacaagcctctgtcaaaaaagaagagaaaagatcgtctgagaaatctgaaaaaaaagaaagcaaggatactaagaaaatagaaggtaaagatgagaagaatgataatggagcaagtggccaaacatcagaatcgattaaaaaaagtgaagaaaagaagcgaataagttccaagagtccaggacatatggtaatactagaccaaactaaaggagatcattgtagaccatcaagaagaggaagatatgagaaaattcatggaagaagtaaggaaaaggagagagctagtctagataaaaaaagagataaagactacagaaggaaagagatcttgccttttgaaaagatgaaggaacaaaggttgagagaacatttagttcgttttgaaaggctgcgacgagcaatggaacttcgaagacgaagagagattgcagagagagagcgtcgagagcgagaacgcattagaataattcgtgaacgggaagaacgggaacgcttacagagagagagagagcgcctagaaattgaaaggcaaaaactagagagagagagaatggaacgcgaacgcttggaaagggaacgcattcgtattgaacaggaacgtcgtaaggaagctgaacggattgctcgagaaagagaggaactcagaaggcaacaacagcagcttcgttatgaacaagaaaaaaggaattccttgaaacgcccacgtgatgtagatcataggcgagatgatccttactggagcgagaataaaaagttgtctctagatacagatgcacgatttggccatggatccgactactctcgccaacagaacagatttaatgactttgatcaccgagagaggggcaggtttcctgagagttcagcagtacagtcttcatcttttgaaaggcgggatcgctttgttggtcaaagtgaggggaaaaaagcacgacctactgcacgaagggaagatccaagcttcgaaagatatcccaaaaatttcagtgactccagaagaaatgagcctccaccaccaagaaatgaacttagagaatcagacaggcgagaagtacgaggggagcgagacgaaaggagaacggtgattattcatgacaggcctgatatcactcatcctagacatcctcgagaggcagggcccaatccttccagacccaccagctggaaaagtgaaggaagcatgtccactgacaaacgggaaacaagagttgaaaggccagaacgatctgggagagaagtatcagggcacagtgtgagaggcgctccccctgggaatcgtagcagcgcttcggggtacgggagcagagagggagacagaggagtcatcacagaccgaggaggtggatcacagcactatcctgaggagcgacatgtggttgaacgccatggacgggacacaagcggaccaaggaaagagtggcatggtccaccctctcaagggcctagctatcatgatacgaggcgaatgggtgacggccgggcaggagcaggcatgataacccaacattcaagtaacgcatccccaattaatagaattgtacaaatcagtggcaattccatgccaagaggaagtggctccggatttaagccatttaagggtggacctccgcgacgattctgaaaatgagctctctgccaaggttttaagataatttattgaaatctcctgtaaactttacttgactacttatgaagaggacctctgacttgcttgagagttctgtcagacttttctttttaaaaatttaacatgattgcttttctcaattttggagaagatgtttaaatagttctgttgtaacttttaatagttttgtgtatcattcaactttttttcttgcagcaccgaggcacatttgaaaagatggaattgaagtcgttttgtttaacgctgtgtgaatataaagagtagtttgcagctgtgtggtagtggtttaatttgcagccttagctctgtggtgtctggctctagagttacttctttttaccaagcattttcagcctccattttgaaggctgtctacacttaagaagtcttagctgtctaatttttagagaataagattgttcattgcatttctgagtattatgtaacctatttttgcagaaggtactgttacattaagtgcatctgtgtatcctggtttaaaaaaatgtaatcttttttgaaataaaccttcatattctgtatagttgctaaagtgttgagaacctttttaattgtaaaatgagaaccgattttcagtttagtgtagcagcacacttgttcaggtttgcatggtatgaaaccaaatagattcatgaaaccttggccatgaggtttgtttcacaaggttcttagaccgagttgtgcaggtaagtgcacttttaggtaatctgcactgtttgtttgatggataaattccatctctgggaattgtgtgggtattaatgtttccatgttcccaactatgttgagaagtggaaaaaaacccaggttctagatgggtgaatcagttgggttttgtaaatacttgtatgtggggaagacattgttgtctttttgtgaaaataaaaatccacacctggaagtgta

SEQ ID NO: 2053 - DNA, 3021 bp, Homo sapiens
actcgctgcctcggcagcgcgctgctcttctaagatggctgccgctaccggtgcggtggcagcctcggccgcctcgggtcaggcggaaggtaaaaagatcaccgatctgcgggtcatcgatctgaagtccgagctgaagcggcggaacttagacatcaccggagtcaagaccgtgctcatctcccgactcaagcaggtaaaaaacatgaagcagatgagttgagtggagatgcttctgtggaagatgatgcttttatcaaggactgtgaattggagaatcaagaggcacatgagcaagatggaaatgatgaactaaaggactctgaagaatttggtgaaaatgaagaagaaaatgtgcattccaaggagttactctctgcagaagaaaacaagagagctcatgaattaatagaggcagaaggaatagaagatatagaaaaagaggacatcgaaagtcaggaaattgaagctcaagaaggtgaagatgatacctttctaacagcccaagatggtgaggaagaagaaaatgagaaagctcttcaaaggaatctaaagacagcaagacatcatctaaagatgacaaaggaagtacaagtagtactagtggtagcagtggaagctcaactaaaaatatctgggttagtggactttcatctaataccaaagctgctgatttgaagaacctctttggcaaatatggaaaggttctgagtgcaaaagtagttacaaatgctcgaagtcctggggcaaaatgctatggcattgtaactatgtcttcaagcacagaggtgtccaggtgtattgcacatcttcatcgcactgagctgcatggacagctgatttctgttgaaaaagtaaaaggtgatccctctaagaaagaaatgaagaaagaaaatgatgaaaagagtagttcaagaagttctggagataaaaaaaatacgagtgatagaagtagcaagacacaagcctctgtcaaaaaagaagagaaaagatcgtctgagaaatctgaaaaaaaagaaagcaaggatactaagaaaatagaaggtaaagatgagaagaatgataatggagcaagtggccaaacatcagaatcgattaaaaaaagtgaagaaaagaagcgaataagttccaagagtccaggacatatggtaatactagaccaaactaaaggagatcattgtagaccatcaagaagaggaagatatgagaaaattcatggaagaagtaaggaaaaggagagagctagtctagataaaaaaagagataaagactacagaaggaaagagatcttgccttttgaaaagatgaaggaacaaaggttgagagaacatttagttcgttttgaaaggctgcgacgagcaatggaacttcgaagacgaagagagattgcagagagagagcgtcgagagcgagaacgcattagaataattcgtgaacgggaagaacgggaacgcttacagagagagagagagcgcctagaaattgaaaggcaaaaactagagagagagagaatggaacgcgaacgcttggaaagggaacgcattcgtattgaacaggaacgtcgtaaggaagctgaacggattgctcgagaaagagaggaactcagaaggcaacaacagcagcttcgttatgaacaagaaaaaaggaattccttgaaacgcccacgtgatgtagatcataggcgagatgatccttactggagcgagaataaaaagttgtctctagatacagatgcacgatttggccatggatccgactactctcgccaacagaacagatttaatgactttgatcaccgagagaggggcaggtttcctgagagttcagcagtacagtcttcatcttttgaaaggcgggatcgctttgttggtcaaagtgaggggaaaaaagcacgacctactgcacgaagggaagatccaagcttcgaaagatatcccaaaaatttcagtgactccagaagaaatgagcctccaccaccaagaaatgaacttagagaatcagacaggcgagaagtacgaggggagcgagacgaaaggagaacggtgattattcatgacaggcctgatatcactcatcctagacatcctcgagaggcagggcccaatccttccagacccaccagctggaaaagtgaaggaagcatgtccactgacaaacgggaaacaagagttgaaaggccagaacgatctgggagagaagtatcagggcacagtgtgagaggcgctccccctgggaatcgtagcagcgcttcggggtacgggagcagagagggagacagaggagtcatcacagaccgaggaggtggatcacagcactatcctgaggagcgacatgtggttgaacgccatggacgggacacaagcggaccaaggaaagagtggcatggtccaccctctcaagggcctagctatcatgatacgaggcgaatgggtgacggccgggcaggagcaggcatgataacccaacattcaagtaacgcatccccaattaatagaattgtacaaatcagtggcaattccatgccaagaggaagtggctccggatttaagccatttaagggtggacctccgcgacgattctgaaaatgagctctctgccaaggttttaagataatttattgaaatctcctgtaaactttacttgactacttatgaagaggacctctgacttgcttgagagttctgtcagacttttctttttaaaaatttaacatgattgcttttctcaattttggagaagatgtttaaatagttctgttgtaacttttaatagttttgtgtatcattcaactttttttcttgcagcaccgaggcacatttgaaaagatggaattgaagtcgttttgtttaacgctgtgtgaatataaagagtagtttgcagctgtgtggtagtggtttaatttgcagccttagctctgtggtgtctggctctagagttacttctttttaccaagcattttcagcctccattttgaaggctgtctacacttaagaagtcttagctgtctaatttttagagaat

SEQ ID NO: 2054 - DNA, 674 bp, Homo sapiens
ggagtcatcacagaccgaggaggtggatcacagcactatcctgaggagcgacatgtggttgaacgccatggacgggacacaagcggaccaaggaaagagtggcatggtccaccctctcaagggcctagctatcatgatacgaggcgaatgggtgacggccgggcaggagcaggcatgataacccaacattcaagtaacgcatccccaattaatagaattgtacaaatcagtggcaattccatgccaagaggaagtggctccggatttaagccatttaagggtggacctccgcgacgattctgaaaatgagctctctgccaagcaccgaggcacatttgaaaagatggaattgaagtcgttttgtttaacgctgtgtgaatataaagagtagtttgcagctgtgtggtagtggtttaatttgcagccttagctctgtggtgtctggctctagagttacttctttttaccaagcattttcagcctccattttgaaggctgtctacacttaagaagtcttagctgtctaatttttagagaataagattgttcattgcatttctgagtattatgtaacctatttttgcagaaggtactgttacattaagtgcatctgtgtatcctggtttaaaaaaatgtaatcttttttgaaataaaccttcatattctgtatagtt

SEQ ID NO: 2055 - DNA, 1486 bp, Homo sapiens
acttccgctgtcccgcgaagggcggggggagcgaactgttgtggtgcggagcgttcggcgggcggcggccgggcggcccaggggctgccgcgggactcggggcgcagccgagtggctgcaggggtggagtgggccggacgagccgcggggcccgggtgccgcgggttcgaggccgggccccgcgcgaggaggccgcgccaccccgggggagctgcccggcagcgagtttgccccgctgccgaaagaaggcgggagccggcaggggccttcgaaaccccctggcaacccaggcccggagtccttggggagcggctgtttcctgggacgccctcccggacacccccgctgcagggttacggttctgggcccccggcagaaggctcctccgggtgacccccggcggggccctgcgagccgcgggagccgaccccggggcctcgagccgggaggaagggggcttccggaggcggagggccgggggccgagggagccgggcctctcggacgcggggcagggcagcgcccgggctggagacggactctgggaccctcggctgcgggggtctcagcgacctgccccgcggcaagcgcggccgcggagtggcctaccggggaccctcccccagagggaccggcccggggcggggagatgaacggcttcagcacggaggaggacagccgcgaagggccccccgccgccccagctgccgccgccccgggctacggccagagctgctgcctcatcgaggacggcgagcgctgcgtccggcccgcgggcaacgcctccttcagcaagagggtccagaagagcatctcgcagaagaaactcaagctggacatcgacaagagcgtaaggcacctatatatctgtgattttcacaaaaatttcatccagagtgtccgaaataaaaggaagaggaagacaagtgacgatggcggagattctcccgagcacgacactgacattcctgaggttgatctgttccagctgcaggtgaacaccctacgacgttataaacgacactacaagttgcagaccagaccaggcttcaataaggcccagttagcagaaactgtgagtcgacacttcaggaacatacctgtgaatgaaaaagagacccttgcctacttcatctacatggtgaagagtaacaagagtagactggaccagaaatcggagggtggcaagcagcttgagtgaggatgaagcacatcttaaaggaatgaagtgtaatgcttgatgcacaggtgatatctactacatttaagcccataaagactgttaaatattattgtaaataaaaaagtttgaatgatgaatactgtaaatctttttggtcaggaggattatattctcatgattcagcatgtgtatagaaagactttcttttacgataactctggactaaaaaaatcaggatcattaaaagaattaaaaactatgtatttcagcattcaacaaagcattaaatcaattctactggaaa

SEQ ID NO: 2056 - DNA, 777 bp, Homo sapiens
gcggccgcggagtggcctaccggggaccctcccccagagggaccggcccggggcggggagatgaacggcttcagcacggaggaggacagccgcgaagggccccccgccgccccagctgccgccgccccgggctacggccagagctgctgcctcatcgaggacggcgagcgctgcgtccggcccgcgggcaacgcctccttcagcaagagggtccagaagagcatctcgcagaagaaactcaagctggacatcgacaagagcctgcaggtgaacaccctacgacgttataaacgacactacaagttgcagaccagaccaggcttcaataaggcccagttagcagaaactgtgagtcgacacttcaggaacatacctgtgaatgaaaaagagacccttgcctacttcatctacatggtgaagagtaacaagagtagactggaccagaaatcggagggtggcaagcagcttgagtgaggatgaagcacatcttaaaggaatgaagtgtaatgcttgatgcacaggtgatatctactacatttaagcccataaagactgttaaatattattgtaaataaaaaagtttgaatgatgaatactgtaaatctttttggtcaggaggattatattctcatgattcagcatgtgtatagaaagactttcttttacgataactctggactaaaaaaatcaggatcattaaaagaattaaaaactatgtatttcagcattcaacaaagcattaaatcaattctactggaaatgtgggataagaaatat

SEQ ID NO: 2057 - DNA, 792 bp, Homo sapiens
gcggccgcggagtggcctaccggggaccctcccccagagggaccggcccggggcggggagatgaacggcttcagcacggaggaggacagccgcgaagggccccccgccgccccagctgccgccgccccgggctacggccagagctgctgcctcatcgaggacggcgagcgctgcgtccggcccgcgggcaacgcctccttcagcaagagggtccagaagagcatctcgcagaagaaactcaagctggacatcgacaagagcgttgatctgttccagctgcaggtgaacaccctacgacgttataaacgacactacaagttgcagaccagaccaggcttcaataaggcccagttagcagaaactgtgagtcgacacttcaggaacatacctgtgaatgaaaaagagacccttgcctacttcatctacatggtgaagagtaacaagagtagactggaccagaaatcggagggtggcaagcagcttgagtgaggatgaagcacatcttaaaggaatgaagtgtaatgcttgatgcacaggtgatatctactacatttaagcccataaagactgttaaatattattgtaaataaaaaagtttgaatgatgaatactgtaaatctttttggtcaggaggattatattctcatgattcagcatgtgtatagaaagactttcttttacgataactctggactaaaaaaatcaggatcattaaaagaattaaaaactatgtatttcagcattcaacaaagcattaaatcaattctactggaaatgtgggataagaaatat

SEQ ID NO: 2058 - DNA, 902 bp, Homo sapiens
cacgcgcagctcgccctcccgcaccgcgagggcagcagccgcctcatgcgactcgagaacgctagagggcgccgcttccgggagcccgcaagcggcttccgggtgctcgcgcgccgacctggacgcagagaagccagagactttcgcttccggctgccgcaggcgcttcgctggtgcagacgcagtgctgagcacacagctaccggacaaagagtgacgcccggagctggagttatggcggctacggagccgatcttggcggccactgggagtcccgcggcggtgccaccggagaaactggaaggagccggttcgagctcagcccctgagcgtaactgtgtgggctcctcgctgccagaggcctcaccgcctgcccctgagccttccagtcccaacgccgcggtccctgaagccatccctacgccccgagctgcggcctccgcggccctggagctgcctctcgggcccgcacccgtgagcgtagcgcctcaggccgaagctgaagcgcgctccacaccaggccccgccggctctagactcggtcccgagacgttccgccagcgtttccggcagttccgctaccaggatgcggcgggtccccgggaggctttccggcagctgcgggagctgtcccgccagtggctgcggcctgacatccgcaccaaggagcagatcgtggagatgctggtgcaagagcagctgctcgccatcctgcccgaggcggctcgggcccggcggatccgccgccgcacggatgtgcgcatcactggctgagcggtggagctgcgggcggccagggccgggcgctctgtgcggactggggccatgatcgggcccgggggcctgagcctgggaccccaccccgtgttaatgaaaaatgagttttggcagcgcctgtggtc

SEQ ID NO: 2059 - DNA, 1727 bp, Homo sapiens
gtgacttgctcctccttgtcttccaccacgattgtgaggcctccctagccacgtggagctctcaaaggtggagacaacccaaatgtccttcaatggatggttaaatataccatggtacatctataccatagattactactcagcaataaaaaggacaaactattgatacaagcaaccacttgggtgaatctccagggaattgtgccaagtggaaagagccaagcccaaatgattatacactatatgattccagaacccacagagccgcatttcccttggtttcggaggacacgcgaaaaataacaacagcaaagggttctcgagcatctccttcgcgccagacggtgtgttgtactttgtcatcgtcgcagtaaggccggtgctatcgccctcctagtttgaccaagcgagaggactttctccagatgggcccctcccgagagaatggtcgccgtcccgctctcctgttcgggtcaccaccggccgggcgccactcgaacgagccccggccagccgtcaccctaatcattcccgaaggaggggccatcagagctacagctcatcagggtcaatcagaaggggcgcccgcacgcaaaggtcacctgcaaaccgaagcggcgcacggataaggtccgggacttgaagtctatctccaaacattcaggctcctcctccgactcctcctcgaactggcgctcagaggcgccaccattcggaaggagcccaggccacgcgcagctcgccctcccgcaccgcgagggcagcagccgcctcatgcgactcgagaacgctagagggcgccgcttccgggagcccgcaagcggcttccgggtgctcgcgcgccgacctggacgcagagaagccagagactttcgcttccggctgccgcaggcgcttcgctggtgcaggtaagctccgcacactctcggccggtcccgagtccgactccctcaagggtgacgcgagctctgccctttaaccggaaacgtctccctgctcaccccacccccgcgcagacgcagtgctgagcacacagctaccggacaaagagtgacgcccggagctggagttatggcggctacggagccgatcttggcggccactgggagtcccgcggcggtgccaccggagaaactggaaggagccggttcgagctcagcccctgagcgtaactgtgtgggctcctcgctgccagaggcctcaccgcctgcccctgagccttccagtcccaacgccgcggtccctgaagccatccctacgccccgagctgcggcctccgcggccctggagctgcctctcgggcccgcacccgtgagcgtagcgcctcaggccgaagctgaagcgcgctccacaccaggccccgccggctctagactcggtcccgagacgttccgccagcgtttccggcagttccgctaccaggatgcggcgggtccccgggaggctttccggcagctgcgggagctgtcccgccagtggctgcggcctgacatccgcaccaaggagcagatcgtggagatgctggtgcaagagcagctgctcgccatcctgcccgaggcggctcgggcccggcggatccgccgccgcacggatgtgcgcatcactggctgagcggtggagctgcgggcggccagggccgggcgctctgtgcggactggggccatgatcgggcccgggggcctgagcctgggaccccaccccgtgttaatgaaaaatgagttttggca

SEQ ID NO: 2060 - DNA, 4877 bp, Homo sapiens
gagcgtggctcaccgggcccggccggaacctacgggcacagctgcgggtgtgtctgcggaacctccacctgagctgtagagtgtttccctcgacccactagtctgggttccacagggtctgagctcctcagaggtgggagctgcggccgagggaagggtgcatgtgcgcggcgacaatcgggcctcttccccaggcagcttgtgagcccctctccctctccgccctcgcccaggctgctccgatcttcgtttccttgcctaggctcatacacccaggctttatttagggccaaagtatccgtcataacctcggttttctgtctcgcaagtatcttgccgctcaatttgtgaccctgaagctttagtgagtcgctctgtgctcactatttctggtcttttcagaggatggcttcactttcaatggaattgcccgagtaactgccctgtgttgtcacgtaaacaagtccttttaaactgagtctgtagttgtcctgtgttgagtgttttcttatatcaaaaactttcctgaccaagaacaaaaaaggagctcaagtaaaatcacccatttgcctagaccccaactggagagaacctttgcctgagctgtctaagctcgggatggaagcagtctctagggtcttcccagccttggctggccaggctccagaagaacaaggggagattatcaaagtaaaggttaaagaagaagaccacacttgggatcaggaatcagccctacgtaggaatttgtcttataccagggaactctctcgtcagcgcttcaggcagttctgctatcaggagacacctgggcccagggaggctctgagtcaactgcgggaactttgccgtcagtggctgaacccagagatacataccaaggagcagatcctggaattgttggtgctggagcagttcctgaccatcctgcctgaggagctccagtcttgggtgcgggagcataatcctgagagtggagaagaggtggtgactttgctggaagatttggagagggagcttgatgaacctagacagcaggtctcacagggcacatatgggcaggaagtttctatggaagaaatgatccctctggattctgcaaaggagtctttaggcacccagcttcagtctatggaagatagaatggaatgtgaatctccagagccacacccacttcaagataatgggtcatttttgtggttttccatgatgtctcaaagcatgggtggtgataacctcagtagcttagatactaatgaagcagaaattgaaccagaaaacatgagagaaaagttcttcagaagcttagcaaggttactggaaaacaaaagtaataatactaagatattttctaaagcaaagtactgtcagttgataaaggaagtgaaagaagctaaagctaaggcgaaaaaggaatcagttgactaccgtcgcttggctagatttgatgttatccttgtacaaggaaatgagaagctaattgaggctgtaaatggggaaacagataaaatacggtattacttacacagtgaggacttatttgacattctgcataatacacatctcagcattggacatggtggacgtactcgcatggagaaagagttacaagcgaaatacaagaacatcacaaaagaagttataatgctgtatctgaccctctgtaaaccatgccaacagaaaaattcaaaactcaagaaggttctaacatcaaaatcaattaaggaagttagttcaagatgccaagtagatcttatagacatgcagttgaatcctgatggggagtacagatttattttgcattatcaagatctctgtacaaagttaacttttttgcggtcattaaagtctaaaaggcctacggaagttgcacatgctcttttagatatatttacaattattggagcacccagtgtcctacaatctgacaatgggagggaattttcaagccaggttgtcagtgaactcagtaatatttggccagaattgaaaattgtccatgggaagtctcagacctgccaaagccagagttctgcagaacaaactgaggatatccgaaagaggattttctcctggatgcaaactaacaactcatcacactggactgaatttttgtggttcattcagatgtcccaaaatcagccctatcacagaagcatgcaacagactccatgtgaaagtgcatttagctctgaagctaaactgggcttgtcccattctcagctaactgaagaacttgttgccagcttgcatacagaaaatgaattagatcaggctgacaaagagttagaaaatactttaagagcccagtatgaagaaaacattgagactggaacagacagtagtgatattgaagagaatctttctgtcactcctaaggtggctgaaaaaagccctcctgagagcagactaagatttttatcctgtgtagtttgtgaaaaagaatgcacaggtgttaatagttgtatatcatgtgatggaaatatccatgcaatttgtggagtgccctctcaacatgggactgagggctgtggtcggcaaataacttgtagcctttgctatgaaaccagcacaatgaagaggaaacatgatgagattcaaagaagtttgcctgttaaaccttccaaaatgctaaagccatcagggacaccattttcaccagacaaagtaggagactggatggcgaaacaagcttcactggacttttttgtcaagaaaagacatgccttttctgaacacagtagtagtaataaaagaaatgttaacaatagaagttatcctgaagaagggaaaaccaaaagagttcatgctagtttcactcggaaatatgatccttcatatattgagtttggttttgtagctgtaattgatggtgaagtactaaaaccacagtgtattatttgtggagatgtactggctaatgaagcaatgaaaccatcaaaacttaagcgacatttatattcaaaacataaagaaataagttcacaaccaaaagaattctttgaaagaaagagtagtgaattgaaaagccaaccaaagcaggtgttcaacgtttctcatataaacattagtgctttgcgggcttcatataaagtagcacttccggttgccaagtctaaaacaccatacacaattgctgagacactagtgaaagactgcatcaaagaagtttgcttggaaatgttgggtgaatctgcagcaaagaaggtagctcaggtaccactttccaatgacaccatagctcgacgtattcaggaactggctaatgatatggaagatcaactcatagaacaaataaaactagcaaagtatttttcattgcaacttgatgaatgcagagatattgctaacatgataattcttttagtctatgtgaggtttgaacatgatgatgatataaaggaagagttctttttttcagcctctttgcctacaaacacaactagctcagaactgtatgaagctgtaaagaattatattgttaacaaatgtggtttggaatttaaattttgtgtaggagtatgttctgatggtgcagcttcaatgacaggaaaacattctgaagtggtaacccagattaaggaacttgcgccagaatgtaaaacaacacattgcttcattcatcgagaaagtcttgccatgaaaaaaatatcagctgaactaaatagtgtacttaatgatatagtaaaaattgtgaattatataaaatctaattcattgaattcaagattattctctttattatgtgataatatggaagctgatcataagcaactgttactgcatgctgagatacggtggttatcacggggaaaagttctgtcaagaatgtttgaaatacgaaatgaactcttagtgtttctgcaaggcaagaaacccatgtggtcccaactttttaaagatgtgaattggacagccagacttgcttatttgtctgatatcttcagtatttttaatgatcttaatgcttctatgcaagggaagaatgcaacttatttttcaatggcagataaagttgaaggacaaaaacagaagttagaagcttggaaaaacagaatttctacagattgttatgacatgtttcataatttaacaacaattatcaatgaagtaggtaatgatcttgatattgcacatctgcgaaaagttatcagtgaacatcttacaaatttgttagaatgttttgaattttattttccatcaaaagaagatccacgcataggaaatttgtggatccaaaatccatttctttcatcaaaagataacttaaatttaactgtaactctacaggataagttgttgaagctggctaccgacgaaggattgaaaatcagttttgaaaatacagcatcacttccttcattttggataaaagctaaaaatgactatcctgagcttgctgagattgctttaaaattgctgcttcttttcccctcaacatacctctgtgagaccggattctctactttaagtgttattaaaacaaaacatagaaacagtttaaatatacattatcccctgagggtagcattgtcatcaatccaacctagattagacaaattaacaagcaagaagcaagctcacttatcacattaaaagctttaaatattgatatgtaaggtattggttcaaagtatgcatataagcattgagtgtgaggaatttgctatttcactttaaactttctgtctagttacagttatggaagtatgagaagttatgagtgaaacagcaattttctatataaattgcctatatgtatattttcaattaagaatgtgtacagtttttataattctatttttcctcatatttgtcgtatttattaaaatataattttaaatctgttgattctaatattaaaacatttgatctta

SEQ ID NO: 2061 - DNA, 4910 bp, Homo sapiens
gcttcggaagcgctggagcttgagaggtcagagagggtccttgcccccagcctgggactccggagttgcgtttctacccgtgcttcagggtctagcccagccgaatccgcgtcgggctgtaactcgagtgccagtttcagctgtgagttcaacatggaggcaaatcagtgccccctggttgtggaaccatcttacccagacctggtcatcaatgtaggagaagtgactcttggagaagaaaacagaaaaaagctgcagaaaattcagagagaccaagagaaggagagagttatgcgggctgcatgtgctttattaaactcaggaggaggagtgattcgaatggccaagaaggttgagcatcccgtggagatgggactggatttagaacagtctttgagagagcttattcagtcttcagatctgcaggctttctttgagaccaagcaacaaggaaggtgtttttacatttttgttaaatcttggagcagtggccctttccctgaagatcgctctgtcaagccccgcctttgcagcctcagttcttcattataccgtagatctgagacctctgtgcgttccatggactcaagagaggcattctgtttcctgaagaccaaaaggaagccaaaaatcttggaagaaggaccttttcacaaaattcacaagggtgtataccaagagctccctaactcggatcctgctgacccaaactcggatcctgctgacctaattttccaaaaagactatcttgaatatggtgaaatcctgccttttcctgagtctcagttagtagagtttaaacagttctctacaaaacacttccaagaatatgtaaaaaggacaattccagaatacgtccctgcatttgcaaacactggaggaggctatctttttattggagtggatgataagagtagggaagtcctgggatgtgcaaaagaaaatgttgaccctgactctttgagaaggaaaatagaacaagccatatacaaactaccttgtgttcatttttgccaaccccaacgcccgataaccttcacactcaaaattgtgaatgtgttaaaaaggggagagctctatggctatgcttgcatgatcagagtaaatcccttctgctgtgcagtgttctcagaagctcccaattcatggatagtggaggacaagtacgtctgcagcctgacaaccgagaaatgggtaggcatgatgacagacacagatccagatcttctacagttgtctgaagattttgaatgtcagctgagtctatctagtgggcctccccttagcagaccagtgtactccaagaaaggcctggaacataaaaaggaactccagcaacttttattttcagtcccaccaggatatttgcgatatactccagagtcactctggagggacctgatctcagagcacagaggactagaggagttaataaataagcaaatgcaacctttctttcggggaattttgatcttctctagaagttgggctgtggacctgaacttgcaggagaagccaggagtcatctgtgatgctctgctgatagcacagaacagcacccccattctctacaccattctcagggagcaagatgcagagggccaggactactgcactcgcaccgcctttactttgaagcagaagctagtgaacatggggggctacaccgggaaggtgtgtgtcagggccaaggtcctctgcctgagtcctgagagcagcgcagaggccttggaggctgcagtgtctccgatggattaccctgcgtcctatagccttgcaggcacccagcacatggaagccctgctgcagtccctcgtgattgtcttactcggcttcaggtctctcttgagtgaccagctcggctgtgaggttttaaatctgctcacagcccagcagtatgagatattctccagaagcctccgcaagaacagagagttgtttgtccacggcttacctggctcagggaagaccatcatggccatgaagatcatggagaagatcaggaatgtgtttcactgtgaggcacacagaattctctacgtttgtgaaaaccagcctctgaggaactttatcagtgatagaaatatctgccgagcagagacccggaaaactttcctaagagaaaactttgaacacattcaacacatcgtcattgacgaagctcagaatttccgtactgaagatggggactggtatgggaaggcaaaaagcatcactcggagagcaaagggtggcccaggaattctctggatctttctggattactttcagaccagccacttggattgcagtggcctccctcctctctcagaccaatatccaagagaagagctcaccagaatagttcgcaatgcagatccaatagccaagtacttacaaaaagaaatgcaagtaattagaagtaatccttcatttaacatccccactgggtgcctcgaggtatttcctgaagccgaatggtcccagggtgttcagggaaccttacgaattaagaaatacttgactgtggagcaaataatgacctgtgtggcagacacgtgcaggcgcttctttgataggggctattctccaaaggatgttgctgtgcttgtcagcaccgcaaaagaagtggagcactataagtatgagctcttgaaagcaatgaggaagaaaagggtggtgcagctcagtgatgcatgtgatatgttgggtgatcacattgtgttggacagtgttcggcgattctcaggcctggaaaggagcatagtgtttgggatccatccaaggacagctgacccagctatcttacccaatgttctgatctgtctggcttccagggcaaaacaacacctgtatatttttccgtggggtggccattaggaagaactccaaatcaaaatgctatgtaaatgtctatgggtgacagtctgctgatggtagaaacctttctttttagttcacaagtcagagatttggacggagctgacacaaagagtttggagctcccccatttctggctctcctttcaggggttccttccccaaccctttcagcagcggtggctgccccccattctgacccctgactcttccagccagaaagatggtggttttctaaaggaactttagctgtcctgcacaatgccgatctgtgtcttgcattttgggtaaaagccataaaaataagaaactcagcctgtggcctttctttcttccaaggctgggcttctttttttaagtgacttcatgcagtttgttgcttttaaaaatttgtccagaatcgttttctgcagaagcatggtctgttaggagcttactggccgtagcagaagcaattgtttcctgaattcttgacatttatctttgctgtattcatttagggcttgggagagtccgaagataattcagtcactgtcagattaataattttgtcaggacaaagaataccgttatgattatttaatcctttaaaattgtggtctccagagcttgttctcagaatggcccagaccaagccttaattgtgatagtgaatattaatggtcactttaaggagaaattataggccaagatgaaatgaacataaacctgtttgccctggctttcagtggaagatgatattagagaccaaaatctggttctgaaggtgtgtatcagccctaaggtgaaccagacttgggaaagattgtctttaaaaatcaatgagtttatgttttaacttctcagcttagttctatgcattgctctataacacacctagttaagttttatgttattcttgaactgtgattttttttctatttactttcatggtttggtgggccattgttatggactgaatgtttgtgtcccacccttcacccccaaattcccgtgttgaagccccaacctgcactgtggagctggggctgctaaggaagtaattaaggttacatgaagtcatggtggggctctgatctgctaaggttggtgtccttatagggagagaccccagagagcttgttccctccctccctgtgcatgcaaacaagagggcatgggagcacacagagagatggcagccacctacaagccaagaggagaagcctcacaatcaaactctcgctgctggcgagagtcttggactctgtcttggacttccagcctccagactgtgagaaacaaatttctgttgtttcagcttctcagtctctggtgttttgttattgcagcctgagaacacagctgtacgattatttgtcaaacagaaaacactgatacttaacaatgctaatgcaattatttatttgcttttcagtctctacaaaacgttctaaaacactaatctaaatattaacagtaaaatatttgcataactaatggaaactaagaaatcatatgaccaatatttcacttattggtaatcttactctactgatttccccccagactgtgatttttgaacttccttgcctttctcctgtctttctgtgtttattcatggaattccagttatctgggcttgaaattgcaggctctcctaacttaagcaaaatctgacagatcagcaaaatgagataaatgtttcttttttctttctgactgcattaaatcagatacaactcagcattaaaaagctatctttgtaaatgttgttactaataaattagtcttataagatccctggactttggagttgttgcaatgtctttgagagtaattctttaaaagtctaatttcgactggttgtatctctttatgatttattgccccactaacaatatttgaaacaatataatattttaaaatgtataaataattatgaatttttgtttagaacaaagaggattactgatatttgtttccctatgaatggcaaaaggtttagcttactactgcatttctgttttaaataaaaagttgagagtttgtgtctcattaaactgaaaaaaa

SEQ ID NO: 2062 - DNA, 5030 bp, Homo sapiens
aaacgctaagggggcttcggaagcgctggagcttgagaggtttctgtatacatagccttcaggactgcttttggtggaaagagatagcaggtggtgctaattcactgtgttggtgggaactctggctacactgaaagattcttactttgacccccaggctggagtgcagtggcacgatcttggttcaccacaatctcgtctcgaaggctcaggtgattctctcacctcagccgcctgagtagctgggaccacagtttcagctgtgagttcaacatggaggcaaatcagtgccccctggttgtggaaccatcttacccagacctggtcatcaatgtaggagaagtgactcttggagaagaaaacagaaaaaagctgcagaaaattcagagagaccaagagaaggagagagttatgcgggctgcatgtgctttattaaactcaggaggaggagtgattcgaatggccaagaaggttgagcatcccgtggagatgggactggatttagaacagtctttgagagagcttattcagtcttcagatctgcaggctttctttgagaccaagcaacaaggaaggtgtttttacatttttgttaaatcttggagcagtggccctttccctgaagatcgctctgtcaagccccgcctttgcagcctcagttcttcattataccgtagatctgagacctctgtgcgttccatggactcaagagaggcattctgtttcctgaagaccaaaaggaagccaaaaatcttggaagaaggaccttttcacaaaattcacaagggtgtataccaagagctccctaactcggatcctgctgacccaaactcggatcctgctgacctaattttccaaaaagactatcttgaatatggtgaaatcctgccttttcctgagtctcagttagtagagtttaaacagttctctacaaaacacttccaagaatatgtaaaaaggacaattccagaatacgtccctgcatttgcaaacactggaggaggctatctttttattggagtggatgataagagtagggaagtcctgggatgtgcaaaagaaaatgttgaccctgactctttgagaaggaaaatagaacaagccatatacaaactaccttgtgttcatttttgccaaccccaacgcccgataaccttcacactcaaaattgtgaatgtgttaaaaaggggagagctctatggctatgcttgcatgatcagagtaaatcccttctgctgtgcagtgttctcagaagctcccaattcatggatagtggaggacaagtacgtctgcagcctgacaaccgagaaatgggtaggcatgatgacagacacagatccagatcttctacagttgtctgaagattttgaatgtcagctgagtctatctagtgggcctccccttagcagaccagtgtactccaagaaaggcctggaacataaaaaggaactccagcaacttttattttcagtcccaccaggatatttgcgatatactccagagtcactctggagggacctgatctcagagcacagaggactagaggagttaataaataagcaaatgcaacctttctttcggggaattttgatcttctctagaagttgggctgtggacctgaacttgcaggagaagccaggagtcatctgtgatgctctgctgatagcacagaacagcacccccattctctacaccattctcagggagcaagatgcagagggccaggactactgcactcgcaccgcctttactttgaagcagaagctagtgaacatggggggctacaccgggaaggtgtgtgtcagggccaaggtcctctgcctgagtcctgagagcagcgcagaggccttggaggctgcagtgtctccgatggattaccctgcgtcctatagccttgcaggcacccagcacatggaagccctgctgcagtccctcgtgattgtcttactcggcttcaggtctctcttgagtgaccagctcggctgtgaggttttaaatctgctcacagcccagcagtatgagatattctccagaagcctccgcaagaacagagagttgtttgtccacggcttacctggctcagggaagaccatcatggccatgaagatcatggagaagatcaggaatgtgtttcactgtgaggcacacagaattctctacgtttgtgaaaaccagcctctgaggaactttatcagtgatagaaatatctgccgagcagagacccggaaaactttcctaagagaaaactttgaacacattcaacacatcgtcattgacgaagctcagaatttccgtactgaagatggggactggtatgggaaggcaaaaagcatcactcggagagcaaagggtggcccaggaattctctggatctttctggattactttcagaccagccacttggattgcagtggcctccctcctctctcagaccaatatccaagagaagagctcaccagaatagttcgcaatgcagatccaatagccaagtacttacaaaaagaaatgcaagtaattagaagtaatccttcatttaacatccccactgggtgcctcgaggtatttcctgaagccgaatggtcccagggtgttcagggaaccttacgaattaagaaatacttgactgtggagcaaataatgacctgtgtggcagacacgtgcaggcgcttctttgataggggctattctccaaaggatgttgctgtgcttgtcagcaccgcaaaagaagtggagcactataagtatgagctcttgaaagcaatgaggaagaaaagggtggtgcagctcagtgatgcatgtgatatgttgggtgatcacattgtgttggacagtgttcggcgattctcaggcctggaaaggagcatagtgtttgggatccatccaaggacagctgacccagctatcttacccaatgttctgatctgtctggcttccagggcaaaacaacacctgtatatttttccgtggggtggccattaggaagaactccaaatcaaaatgctatgtaaatgtctatgggtgacagtctgctgatggtagaaacctttctttttagttcacaagtcagagatttggacggagctgacacaaagagtttggagctcccccatttctggctctcctttcaggggttccttccccaaccctttcagcagcggtggctgccccccattctgacccctgactcttccagccagaaagatggtggttttctaaaggaactttagctgtcctgcacaatgccgatctgtgtcttgcattttgggtaaaagccataaaaataagaaactcagcctgtggcctttctttcttccaaggctgggcttctttttttaagtgacttcatgcagtttgttgcttttaaaaatttgtccagaatcgttttctgcagaagcatggtctgttaggagcttactggccgtagcagaagcaattgtttcctgaattcttgacatttatctttgctgtattcatttagggcttgggagagtccgaagataattcagtcactgtcagattaataattttgtcaggacaaagaataccgttatgattatttaatcctttaaaattgtggtctccagagcttgttctcagaatggcccagaccaagccttaattgtgatagtgaatattaatggtcactttaaggagaaattataggccaagatgaaatgaacataaacctgtttgccctggctttcagtggaagatgatattagagaccaaaatctggttctgaaggtgtgtatcagccctaaggtgaaccagacttgggaaagattgtctttaaaaatcaatgagtttatgttttaacttctcagcttagttctatgcattgctctataacacacctagttaagttttatgttattcttgaactgtgattttttttctatttactttcatggtttggtgggccattgttatggactgaatgtttgtgtcccacccttcacccccaaattcccgtgttgaagccccaacctgcactgtggagctggggctgctaaggaagtaattaaggttacatgaagtcatggtggggctctgatctgctaaggttggtgtccttatagggagagaccccagagagcttgttccctccctccctgtgcatgcaaacaagagggcatgggagcacacagagagatggcagccacctacaagccaagaggagaagcctcacaatcaaactctcgctgctggcgagagtcttggactctgtcttggacttccagcctccagactgtgagaaacaaatttctgttgtttcagcttctcagtctctggtgttttgttattgcagcctgagaacacagctgtacgattatttgtcaaacagaaaacactgatacttaacaatgctaatgcaattatttatttgcttttcagtctctacaaaacgttctaaaacactaatctaaatattaacagtaaaatatttgcataactaatggaaactaagaaatcatatgaccaatatttcacttattggtaatcttactctactgatttccccccagactgtgatttttgaacttccttgcctttctcctgtctttctgtgtttattcatggaattccagttatctgggcttgaaattgcaggctctcctaacttaagcaaaatctgacagatcagcaaaatgagataaatgtttcttttttctttctgactgcattaaatcagatacaactcagcattaaaaagctatctttgtaaatgttgttactaataaattagtcttataagatccctggactttggagttgttgcaatgtctttgagagtaattctttaaaagtctaatttcgactggttgtatctctttatgatttattgccccactaacaatatttgaaacaatataatattttaaaatgtataaataattatgaatttttgtttagaacaaagaggattactgatatttgtttccctatgaatggcaaaaggtttagcttactactgcatttctgttttaaataaaaagttgagagtttgtgtctcattaaactgaaaaaaa

SEQ ID NO: 2063 - DNA, 714 bp, Homo sapiens
aaacgctaagggggcttcggaagcgctggagcttgagaggtcagagagggtccttgcccccagcctgggactccggagttgcgtttctacccgtgcttcagggtctagcccagccgaatccgcgtcgggctgtaactcgagtgccaggtttctgtatacatagccttcaggactgcttttggtggaaagagatagcaggtggtgctaattcactgtgttggtgggaactctggctacactgaaaggtttgaaaaagttatcctgtaaactgactagaatcaggtgcttttgtttctgaagtgcttttattcttactttgacccccaggctggagtgcagtggcacgatcttggttcaccacaatctcgtctcgaaggctcaggtgattctctcacctcagccgcctgagtagctgggaccacagtttcagctgtgagttcaacatggaggcaaatcagtgccccctggttgtggaaccatcttacccagacctggtcatcaatgtaggagaagtgactcttggagaagaaaacagaaaaaagctgcagaaaattcagagagaccaagagaaggagagagttatgcgggctgcatgtgctttattaaactcaggaggaggagtgattcgaatggccaagaaggttgagcatcccgtggagatgggactggatttagaacagtctttgagagagcttattcagtcttcagatctgc

SEQ ID NO: 2064 - DNA, 606 bp, Homo sapiens
aaacgctaagggggcttcggaagcgctggagcttgagaggtcagagagggtccttgcccccagcctgggactccggagttgcgtttctacccgtgcttcagggtctagcccagccgaatccgcgtcgggctgtaactcgagtgccaggtttctgtatacatagccttcaggactgcttttggtggaaagagatagcagattcttactttgacccccaggctggagtgcagtggcacgatcttggttcaccacaatctcgtctcgaaggctcaggtgattctctcacctcagccgcctgagtagctgggaccacagtttcagctgtgagttcaacatggaggcaaatcagtgccccctggttgtggaaccatcttacccagacctggtcatcaatgtaggagaagtgactcttggagaagaaaacagaaaaaagctgcagaaaattcagagagaccaagagaaggagagagttatgcgggctgcatgtgctttattaaactcaggaggaggagtgattcgaatggccaagaaggttgagcatcccgtggagatgggactggatttagaacagtctttgagagagcttattcagtcttcagatctgca

SEQ ID NO: 2065 - DNA, 656 bp, Homo sapiens
gggaaacgctaagggggcttcggaagcgctggagcttgagaggtcagagagggtccttgcccccagcctgggactccggagttgcgtttctacccgtgcttcagggtctagcccagccgaatccgcgtcgggctgtaactcgagtgccaggtttctgtatacatagccttcaggactgcttttggtggaaagagatagcaggtggtgctaattcactgtgttggtgggaactctggctacactgaaagattcttactttgacccccaggctggagtgcagtggcacgatcttggttcaccacaatctcgtctcgaaggctcaggtgattctctcacctcagccgcctgagtagctgggaccacagtttcagctgtgagttcaacatggaggcaaatcagtgccccctggttgtggaaccatcttacccagacctggtcatcaatgtaggagaagtgactcttggagaagaaaacagaaaaaagctgcagaaaattcagagagaccaagagaaggagagagttatgcgggctgcatgtgctttattaaactcaggaggaggagtgattcgaatggccaagaaggttgagcatcccgtggagatgggactggatttagaacagtctttgagagagcttattcagtcttcagatctgca

SEQ ID NO: 2066 - DNA, 606 bp, Homo sapiens
atgtccttcgccacgctgcgcccggcgccgccgggccgctacctgtaccccgaggtgagcccgctgtcggaggacgaggaccgcggcagcgacagctcgggctccgacgagaaaccctgtcgcgtgcacgcggcgcgctgcggcctccagggcgcccggcggagggcggggggccggcgggccgggggcggggggccagggggccggccaggccgtgagccccggcagcggcacacggcgaacgcgcgcgagcgagaccgcaccaacagcgtgaacacggccttcacggcgctgcgcacgctgatccccaccgagcccgccgaccgcaagctctccaagattgagacgctgcgcctggcctccagctacatctcgcacctgggcaacgtgctgctggcgggcgaggcctgcggcgacggacagccctgccactccgggcccgccttcttccacgcggcgcgcgccggcagccccccgccgccgcccccgccgcctcccgcccgcgacggcgagaacacccagcccaaacagatctgcaccttctgcctcagcaaccagagaaagttgagcaaggaccgcgacagaaagacagcgattcgcagttag

SEQ ID NO: 2067 - DNA, 3365 bp, Homo sapiens
cgcggagcgccgccgccgcctccgccggagcgcgggtggaggggggcggggagagctgccggccgccccgctccgccgaacccagcaggaaggagggcgcgagcgggcgagcgcgggcagcacgggaggaaaaagcttccgcgcgggggagcgaaaagacggaaagaaagaaagaaaacgagcgcgagagggggaaaagcgagcgatcgagcgagcgcgcgcgcgaaaactccgggcagcactttcatttggacccgtggatacccattgaacagatgcttgaaacctgcaagtaatcttcagatcctagcagaaccataggcctttcctttgttttgggaggatatagcctgcctatatgctgtggaaatgaacggggagcagcagcttgatgcagatgccggctctggtatggaagaggtagaattaagctgggaagattatctagaagaaacagggtccacagcagttccctatgggtcttttaaacatgtggacacacgtttgcaaaatggatttgctcctgggatgaagctggaggtggctgtgagaacagatcctgagacctactgggttgccaccgttatcactacctgtgagcagttgctccttctccgctatgatggctatggggaggatcggagagcagatttctggtgtgacatcaggaaggctgatctctaccccattgggtggtgtgagcagaataagaagacccttgaagccccagaaggcatcagagataaagtatctgactgggatgagtttctgcggcagaccctgataggagcatgtagtcctcctgttccgctgctagagggcctccgtaatgggaggaatcctttagatctcattgctccaggatccagactagaatgtcaagctttccaggactctttaagcacttggattgttactgtagtagaaaacattggaggaaggctgaagctacgttatgaaggacttgaaagttctgacaattatgaacattggttgtattacttggatccatttcttcatcacgttggttgggctgctcaacagggatatgagcttcagcccccttcagccattagacatctaaaaaatgaagctgagtggcaagagattttggccaaagtgaaagaggaagaggaagagccattaccatcttacttatttaaggacaaacaagttattggcattcatacattctctgtaaacatgaaattggaagctgtagacccctggtctccttttgggatctctcctgctacagttgttaaggtttttgatgagaagtactttctggtggaaatggatgacttgcgtcctgagaaccacgcacggcgatcctttgtgtgccacgccgacagtcctggcatcttccctgtgcagtggagtctgaagaatggcctacacatcagcccccctccaggctacccaagccaggactttgactgggctgactacctcaaacagtgtggtgctgaagctgctccccagaggtgcttccctccgttaatttctgaacatgaatttaaggagaacatgaagctcgaggcggtgaaccccattctccctgaagaagtgtgtgttgctaccatcactgcagtgagaggctcctacctgtggctccagctggagggttctaagaagcctatacctgaatgtattgtgagtgtggaatccatggatatatttcctttgggctggtgtgaaaccaacggccaccccctcagcactcctcgccgagcacgagtatataaacagaggaaaattgcagtggttcagccagaaaaacaagtaccatcctcgaggactgtccacgagggcctgaggaatcaggagctgaactccacagagtcagttatgattaatggaaaatattgctgtccaaagatatacttcaaccaccgttgcttctcagggccatatcttaacaaaggaagaattgctgagctgcctcaatgtgtaggacctgggaactgtgttctggtccttagagaggtcctcactttacttatcaatgcagcctacaaacccagccgtgtccttcgggagctccagctggacaaagactctgtgtggcacggatgtggggaagtcctaaaagccaaatataaaggaaagagttatcgggctactgttgagatagtgaaaacagcagatcgggtgactgaattctgccggcaaacctgtatcaaactggaatgctgtcctaacctcttcggtccacggatggttctggataagtgttctgagaactgttctgtacttacaaagaccaaatacacacactattacggaaagaagaaaaataaaagaattgggaggccacctggtgggcatagtaacttagcttgtgccctgaaaaaagccagtaagaggagaaagaggcggaaaaatgtttttgttcataagaagaaacgctcctctgcatctgttgataataccccagcgggctctccccagggaagtgggggtgaagatgaggatgacccagatgaaggggatgatgattccctaagtgaaggcagtacatccgagcagcaggatgagctacaggaagaatcagaaatgtcagaaaaaaagtcatgctcctcttctcccacccaaagtgagatatccacatcgctgcctccagatagacaaaggagaaaaagggagcttcgcaccttttcattttctgacgatgaaaataaacctccttcaccaaaggaaattgatgggcaggccctgttgctccttacccttcccactgttcaagaatgcatggacttaaaattgggccctgccatcaaactttgccatcacatagagaggatcaagtttgctttttatgagcagtttgccaactgagaaggacaaccaaagtgagctggatctttgaagcacaaatgcagcaaatccttcaccctgctttataagtggagctggaatagtcctggggctctggggcctgcaggtatcagcttgctctctttgcactttcggggaaggaggactcacagtgaggaagcaaaaactgtgcacagaagtggatcacctgctggtggaaatgtggacatctcttgttcagcagatggcagtttttaaaaaataaaggttgtgaggaaaagacttatataagaagaaaagcatttccagtggtgtggcctgaaaacaaagaataacctaggctgctggaaagcacccttttggttgttttcattctgttccctcccattgtagattgaactttgttctctgctttctttttcttggaaagagaggacttagctttaagtcagcactgatttgggactgttcctaaggcatatcagtgcttcattgtcattgtgtttttaaactttttaaaattaaaacagttcattttggggatg

SEQ ID NO: 2068 - DNA, 3613 bp, Homo sapiens
cgcggagcgccgccgccgcctccgccggagcgcgggtggaggggggcggggagagctgccggccgccccgctccgccgaacccagcaggaaggagggcgcgagcgggcgagcgcgggcagcacgggaggaaaaagcttccgcgcgggggagcgaaaagacggaaagaaagaaagaaaacgagcgcgagagggggaaaagcgagcgatcgagcgagcgcgcgcgcgaaaactccgggcaggaaggtggacttttaaatattctccactgaagcaaatgctgcaacaatttgcatttccttcaccaatgtcgtcttgtgccttttcttgttcctactgtaaaggagatgggttagatgttcactttcatttggacccgtggatacccattgaacagatgcttgaaacctgcaagtaatcttcagatcctagcagaaccataggcctttcctttgttttgggaggatatagcctgcctatatgctgtggaaatgaacggggagcagcagcttgatgcagatgccggctctggtatggaagaggtagaattaagctgggaagattatctagaagaaacagggtccacagcagttccctatgggtcttttaaacatgtggacacacgtttgcaaaatggatttgctcctgggatgaagctggaggtggctgtgagaacagatcctgagacctactgggttgccaccgttatcactacctgtgagcagttgctccttctccgctatgatggctatggggaggatcggagagcagatttctggtgtgacatcaggaaggctgatctctaccccattgggtggtgtgagcagaataagaagacccttgaagccccagaaggcatcagagataaagtatctgactgggatgagtttctgcggcagaccctgataggagcatgtagtcctcctgttccgctgctagagggcctccgtaatgggaggaatcctttagatctcattgctccaggatccagactagaatgtcaagctttccaggactctttaagcacttggattgttactgtagtagaaaacattggaggaaggctgaagctacgttatgaaggacttgaaagttctgacaattatgaacattggttgtattacttggatccatttcttcatcacgttggttgggctgctcaacagggatatgagcttcagcccccttcagccattagacatctaaaaaatgaagctgagtggcaagagattttggccaaagtgaaagaggaagaggaagagccattaccatcttacttatttaaggacaaacaagttattggcattcatacattctctgtaaacatgaaattggaagctgtagacccctggtctccttttgggatctctcctgctacagttgttaaggtttttgatgagaagtactttctggtggaaatggatgacttgcgtcctgagaaccacgcacggcgatcctttgtgtgccacgccgacagtcctggcatcttccctgtgcagtggagtctgaagaatggcctacacatcagcccccctccaggctacccaagccaggactttgactgggctgactacctcaaacagtgtggtgctgaagctgctccccagaggtgcttccctccgttaatttctgaacatgaatttaaggagaacatgaagctcgaggcggtgaaccccattctccctgaagaagtgtgtgttgctaccatcactgcagtgagaggctcctacctgtggctccagctggagggttctaagaagcctatacctgaatgtattgtgagtgtggaatccatggatatatttcctttgggctggtgtgaaaccaacggccaccccctcagcactcctcgccgagcacgagtatataaacagaggaaaattgcagtggttcagccagaaaaacaagtaccatcctcgaggactgtccacgagggcctgaggaatcaggagctgaactccacagagtcagttatgattaatggaaaatattgctgtccaaagatatacttcaaccaccgttgcttctcagggccatatcttaacaaaggaagaattgctgagctgcctcaatgtgtaggacctgggaactgtgttctggtccttagagaggtcctcactttacttatcaatgcagcctacaaacccagccgtgtccttcgggagctccagctggacaaagactctgtgtggcacggatgtggggaagtcctaaaagccaaatataaaggaaagagttatcgggctactgttgagatagtgaaaacagcagatcgggtgactgaattctgccggcaaacctgtatcaaactggaatgctgtcctaacctcttcggtccacggatggttctggataagtgttctgagaactgttctgtacttacaaagaccaaatacacacactattacggaaagaagaaaaataaaagaattgggaggccacctggtgggcatagtaacttagcttgtgccctgaaaaaagccagtaagaggagaaagaggcggaaaaatgtttttgttcataagaagaaacgctcctctgcatctgttgataataccccagcgggctctccccagggaagtgggggtgaagatgaggatgacccagatgaaggggatgatgattccctaagtgaaggcagtacatccgagcagcaggatgagctacaggaagaatcagaaatgtcagaaaaaaagtcatgctcctcttctcccacccaaagtgagatatccacatcgctgcctccagatagacaaaggagaaaaagggagcttcgcaccttttcattttctgacgatgaaaataaacctccttcaccaaaggaaataaggatcgaagttgctgaaaggcttcacctggacagtaaccccttgaagtggagtgtggcagacgttgtgcggttcatcagatccactgactgtgctccattagcaagaatattcctagaccaggaaattgatgggcaggccctgttgctccttacccttcccactgttcaagaatgcatggacttaaaattgggccctgccatcaaactttgccatcacatagagaggatcaagtttgctttttatgagcagtttgccaactgagaaggacaaccaaagtgagctggatctttgaagcacaaatgcagcaaatccttcaccctgctttataagtggagctggaatagtcctggggctctggggcctgcaggtatcagcttgctctctttgcactttcggggaaggaggactcacagtgaggaagcaaaaactgtgcacagaagtggatcacctgctggtggaaatgtggacatctcttgttcagcagatggcagtttttaaaaaataaaggttgtgaggaaaagacttatataagaagaaaagcatttccagtggtgtggcctgaaaacaaagaataacctaggctgctggaaagcacccttttggttgttttcattctgttccctcccattgtagattgaactttgttctctgctttctttttcttggaaagagaggacttagctttaagtcagcactgatttgggactgttcctaaggcatatcagtgcttcattgtcattgtgtttttaaactttttaaaattaaaacagttcattttggggatg

SEQ ID NO: 2069 - DNA, 3694 bp, Homo sapiens
ggcccgggcggtcgctgcgcggtggcggagcgtctagtggccgccgcaaccggtggctccgggccgccgttgtgaagtgagcgggcctctcccgcgccgcggcccgccgggcaccgccgctggaccccgcgccgacccggcagcgccccgacctgccgctcgggaggtccgcgaccgtttcgatttctgttcctaaagtccgattttggacgctgaaaaggaggctgtggaggggcgagcggcgtcctgggaagcaaggcctgctctgtgcggagcagaaacgccttgtgcgaacagaaataaattcccgcggaaaggatgaaggtggacttttaaatattctccactgaagcaaatgctgcaacaatttgcatttccttcaccaatgtcgtcttgtgccttttcttgttcctactgtaaaggagatgggttagatgttcactttcatttggacccgtggatacccattgaacagatgcttgaaacctgcaagtaatcttcagatcctagcagaaccataggcctttcctttgttttgggaggatatagcctgcctatatgctgtggaaatgaacggggagcagcagcttgatgcagatgccggctctggtatggaagaggtagaattaagctgggaagattatctagaagaaacagggtccacagcagttccctatgggtcttttaaacatgtggacacacgtttgcaaaatggatttgctcctgggatgaagctggaggtggctgtgagaacagatcctgagacctactgggttgccaccgttatcactacctgtgagcagttgctccttctccgctatgatggctatggggaggatcggagagcagatttctggtgtgacatcaggaaggctgatctctaccccattgggtggtgtgagcagaataagaagacccttgaagccccagaaggcatcagagataaagtatctgactgggatgagtttctgcggcagaccctgataggagcatgtagtcctcctgttccgctgctagagggcctccgtaatgggaggaatcctttagatctcattgctccaggatccagactagaatgtcaagctttccaggactctttaagcacttggattgttactgtagtagaaaacattggaggaaggctgaagctacgttatgaaggacttgaaagttctgacaattatgaacattggttgtattacttggatccatttcttcatcacgttggttgggctgctcaacagggatatgagcttcagcccccttcagccattagacatctaaaaaatgaagctgagtggcaagagattttggccaaagtgaaagaggaagaggaagagccattaccatcttacttatttaaggacaaacaagttattggcattcatacattctctgtaaacatgaaattggaagctgtagacccctggtctccttttgggatctctcctgctacagttgttaaggtttttgatgagaagtactttctggtggaaatggatgacttgcgtcctgagaaccacgcacggcgatcctttgtgtgccacgccgacagtcctggcatcttccctgtgcagtggagtctgaagaatggcctacacatcagcccccctccaggctacccaagccaggactttgactgggctgactacctcaaacagtgtggtgctgaagctgctccccagaggtgcttccctccgttaatttctgaacatgaatttaaggagaacatgaagctcgaggcggtgaaccccattctccctgaagaagtgtgtgttgctaccatcactgcagtgagaggctcctacctgtggctccagctggagggttctaagaagcctatacctgaatgtattgtgagtgtggaatccatggatatatttcctttgggctggtgtgaaaccaacggccaccccctcagcactcctcgccgagcacgagtatataaacagaggaaaattgcagtggttcagccagaaaaacaagtaccatcctcgaggactgtccacgagggcctgaggaatcaggagctgaactccacagagtcagttatgattaatggaaaatattgctgtccaaagatatacttcaaccaccgttgcttctcagggccatatcttaacaaaggaagaattgctgagctgcctcaatgtgtaggacctgggaactgtgttctggtccttagagaggtcctcactttacttatcaatgcagcctacaaacccagccgtgtccttcgggagctccagctggacaaagactctgtgtggcacggatgtggggaagtcctaaaagccaaatataaaggaaagagttatcgggctactgttgagatagtgaaaacagcagatcgggtgactgaattctgccggcaaacctgtatcaaactggaatgctgtcctaacctcttcggtccacggatggttctggataagtgttctgagaactgttctgtacttacaaagaccaaatacacacactattacggaaagaagaaaaataaaagaattgggaggccacctggtgggcatagtaacttagcttgtgccctgaaaaaagccagtaagaggagaaagaggcggaaaaatgtttttgttcataagaagaaacgctcctctgcatctgttgataataccccagcgggctctccccagggaagtgggggtgaagatgaggatgacccagatgaaggggatgatgattccctaagtgaaggcagtacatccgagcagcaggatgagctacaggaagaatcagaaatgtcagaaaaaaagtcatgctcctcttctcccacccaaagtgagatatccacatcgctgcctccagatagacaaaggagaaaaagggagcttcgcaccttttcattttctgacgatgaaaataaacctccttcaccaaaggaaataaggatcgaagttgctgaaaggcttcacctggacagtaaccccttgaagtggagtgtggcagacgttgtgcggttcatcagatccactgactgtgctccattagcaagaatattcctagaccaggaaattgatgggcaggccctgttgctccttacccttcccactgttcaagaatgcatggacttaaaattgggccctgccatcaaactttgccatcacatagagaggatcaagtttgctttttatgagcagtttgccaactgagaaggacaaccaaagtgagctggatctttgaagcacaaatgcagcaaatccttcaccctgctttataagtggagctggaatagtcctggggctctggggcctgcaggtatcagcttgctctctttgcactttcggggaaggaggactcacagtgaggaagcaaaaactgtgcacagaagtggatcacctgctggtggaaatgtggacatctcttgttcagcagatggcagtttttaaaaaataaaggttgtgaggaaaagacttatataagaagaaaagcatttccagtggtgtggcctgaaaacaaagaataacctaggctgctggaaagcacccttttggttgttttcattctgttccctcccattgtagattgaactttgttctctgctttctttttcttggaaagagaggacttagctttaagtcagcactgatttgggactgttcctaaggcatatcagtgcttcattgtcattgtgtttttaaactttttaaaattaaaacagttcattttggggatg

SEQ ID NO: 2070 - DNA, 4443 bp, Homo sapiens
ggaatgagtcggagcgcggagcgccgccgccgcctccgccggagcgcgggtggaggggggcggggagagctgccggccgccccgctccgccgaacccagcaggaaggagggcgcgagcgggcgagcgcgggcagcacgggaggaaaaagcttccgcgcgggggagcgaaaagacggaaagaaagaaagaaaacgagcgcgagagggggaaaagcgagcgatcgagcgagcgcgcgcgcgaaaactccgggcagcactttcatttggacccgtggatacccattgaacagatgcttgaaacctgcaagtaatcttcagatcctagcagaaccataggcctttcctttgttttgggaggatatagcctgcctatatgctgtggaaatgaacggggagcagcagcttgatgcagatgccggctctggtatggaagaggtagaattaagctgggaagattatctagaagaaacagggtccacagcagttccctatgggtcttttaaacatgtggacacacgtttgcaaaatggatttgctcctgggatgaagctggaggtggctgtgagaacagatcctgagacctactgggttgccaccgttatcactacctgtgagcagttgctccttctccgctatgatggctatggggaggatcggagagcagatttctggtgtgacatcaggaaggctgatctctaccccattgggtggtgtgagcagaataagaagacccttgaagccccagaaggcatcagagataaagtatctgactgggatgagtttctgcggcagaccctgataggagcatgtagtcctcctgttccgctgctagagggcctccgtaatgggaggaatcctttagatctcattgctccaggatccagactagaatgtcaagctttccaggactctttaagcacttggattgttactgtagtagaaaacattggaggaaggctgaagctacgttatgaaggacttgaaagttctgacaattatgaacattggttgtattacttggatccatttcttcatcacgttggttgggctgctcaacagggatatgagcttcagcccccttcagccattagacatctaaaaaatgaagctgagtggcaagagattttggccaaagtgaaagaggaagaggaagagccattaccatcttacttatttaaggacaaacaagttattggcattcatacattctctgtaaacatgaaattggaagctgtagacccctggtctccttttgggatctctcctgctacagttgttaaggtttttgatgagaagtactttctggtggaaatggatgacttgcgtcctgagaaccacgcacggcgatcctttgtgtgccacgccgacagtcctggcatcttccctgtgcagtggagtctgaagaatggcctacacatcagcccccctccaggctacccaagccaggactttgactgggctgactacctcaaacagtgtggtgctgaagctgctccccagaggtgcttccctccgttaatttctgaacatgaatttaaggagaacatgaagctcgaggcggtgaaccccattctccctgaagaagtgtgtgttgctaccatcactgcagtgagaggctcctacctgtggctccagctggagggttctaagaagcctatacctgaatgtattgtgagtgtggaatccatggatatatttcctttgggctggtgtgaaaccaacggccaccccctcagcactcctcgccgagcacgagtatataaacagaggaaaattgcagtggttcagccagaaaaacaagtaccatcctcgaggactgtccacgagggcctgaggaatcaggagctgaactccacagagtcagttatgattaatggaaaatattgctgtccaaagatatacttcaaccaccgttgcttctcagggccatatcttaacaaaggaagaattgctgagctgcctcaatgtgtaggacctgggaactgtgttctggtccttagagaggtcctcactttacttatcaatgcagcctacaaacccagccgtgtccttcgggagctccagctggacaaagactctgtgtggcacggatgtggggaagtcctaaaagccaaatataaaggaaagagttatcgggctactgttgagatagtgaaaacagcagatcgggtgactgaattctgccggcaaacctgtatcaaactggaatgctgtcctaacctcttcggtccacggatggttctggataagtgttctgagaactgttctgtacttacaaagaccaaatacacacactattacggaaagaagaaaaataaaagaattgggaggccacctggtgggcatagtaacttagcttgtgccctgaaaaaagccagtaagaggagaaagaggcggaaaaatgtttttgttcataagaagaaacgctcctctgcatctgttgataataccccagcgggctctccccagggaagtgggggtgaagatgaggatgacccagatgaaggggatgatgattccctaagtgaaggcagtacatccgagcagcaggatgagctacaggaagaatcagaaatgtcagaaaaaaagtcatgctcctcttctcccacccaaagtgagatatccacatcgctgcctccagatagacaaaggagaaaaagggagcttcgcaccttttcattttctgacgatgaaaataaacctccttcaccaaaggaaataaggatcgaagttgctgaaaggcttcacctggacagtaaccccttgaagtggagtgtggcagacgttgtgcggttcatcagatccactgactgtgctccattagcaagaatattcctagaccaggaaattgatgggcaggccctgttgctccttacccttcccactgttcaagaatgcatggacttaaaattgggccctgccatcaaactttgccatcacatagagaggatcaagtttgctttttatgagcagtttgccaactgagaaggacaaccaaagtgagctggatctttgaagcacaaatgcagcaaatccttcaccctgctttataagtggagctggaatagtcctggggctctggggcctgcaggtatcagcttgctctctttgcactttcggggaaggaggactcacagtgaggaagcaaaaactgtgcacagaagtggatcacctgctggtggaaatgtggacatctcttgttcagcagatggcagtttttaaaaaataaaggttgtgaggaaaagacttatataagaagaaaagcatttccagtggtgtggcctgaaaacaaagaataacctaggctgctggaaagcacccttttggttgttttcattctgttccctcccattgtagattgaactttgttctctgctttctttttcttggaaagagaggacttagctttaagtcagcactgatttgggactgttcctaaggcatatcagtgcttcattgtcattgtgtttttaaactttttaaaattaaaacagttcattttggggatgattatgtggctctagggttttgaatgtatagtcacactttgatcattttaaaatcgattcttaggagttcctttgtttactacctctgttgataattgagcttacagccatgtatgaggttttttgtatgatgccatttttaagctacataaacactaaaattatgacagaatttggagggggggaaactgtttgctttcttaaaaacattatatggggcacttacaccagttccttaactgacctgatctgagaactctactgttactgttctccatcttgacccagccgaggctgcctgtgttaagtaacatcaccaagactgttagtatttctgtttaattgccctcttcctattcattctcagagggacttcagtgacttttattttgtgtttacttttctctagagttgtttgtctacctctgtttcatttctaaggtctttactttgggtgaaaatcagtaagtgttccatggacccacagcgaagcccatttgtccttctttccaggtgtctccagtgtagaagcacagcacagaaaacatgttttggagggtaacgcagagcatggagtttctgttagcagtgtcctcagtggcaggataaatactgagatgtggttaaggattctggaaacctctttgcctagccacacttagacttttttcagctaatcctttaaattgaatataatctttagtccgaggattcccatttaaacaactcagtattcttttaagtgtgtcttttagcccagctcaagttaacatgaaactccaggtgaattttcacttactattccattgctagctattatagaataatagcgtttgctgcactattctagtcatgaggagtgaggaaaaacatacataggttgtctcccttaaatggtttgctttgctgaattttttttatcctaatcacctgca

SEQ ID NO: 2071 - DNA, 850 bp, Homo sapiens
cggagcgccgccgccgcctccgccggagcgcgggtggaggggggcggggagagctgccggccgccccgctccgccgaacccagcaggaaggagggcgcgagcgggcgagcgcgggcagcacgggaggaaaaagcttccgcgcgggggagcgaaaagacggaaagaaagaaagaaaacgagcgcgagagggggaaaagcgagcgatcgagcgagcgcgcgcgcgaaaactccgggcaggaaggtggacttttaaatattctccactgaagcaaatgctgcaacaatttgcatttccttcaccaatgtcgtcttgtgccttttcttgttcctactgtaaaggagatgggttagatgttcactttcatttggacccgtggatacccattgaacagatgcttgaaacctgcaagtaatcttcagatcctagcagaaccataggcctttcctttgttttgggaggatatagcctgcctatatgctgtggaaatgaacggggagcagcagcttgatgcagatgccggctctggtatggaagaggtagaattaagctgggaagattatctagaagaaacagggtccacagcagttccctatgggtcttttaaacatgtggacacacgtttgcaaaatggatttgctcctgggatgaagctggaggtggctgtgagaacagatcctgagacctactgggttgccaccgttatcactacctgtgagcagttgctccttctccgctatgatggctatggggaggatcggagagcagatttctggtgtgacatcaggaaggctgatctctaccccattgggtggtgtgagcagaataagaagacccttgaagccccagaag

SEQ ID NO: 2072 - DNA, 617 bp, Homo sapiens
cgatccccgacgaggggcaggcaaacgggcgcagtgcccgcggcggcggcacgcgcgcatctgggatccggccgcttctccgctcatgccatcttgtccgagccagtcacgtgcgggcgacagcggcgcgcttcgccgggccggtactccaggtccgacccgcgaacccctctgggatccccgccgctctgtctacaacccgagcactttcatttggacccgtggatacccattgaacagatgcttgaaacctgcaagtaatcttcagatcctagcagaaccataggcctttcctttgttttgggaggatatagcctgcctatatgctgtggaaatgaacggggagcagcagcttgatgcagatgccggctctggtatggaagaggtagaattaagctgggaagattatctagaagaaacagggtccacagcagttccctatgggtcttttaaacatgtggacacacgtttgcaaaatggatttgctcctgggatgaagctggaggtggctgtgagaacagatcctgagacctactgggttgccaccgttatcactacctgtgagcagttgctccttctccgctatgatggctatggggaggatcggagagcagatt

SEQ ID NO: 2073 - DNA, 699 bp, Homo sapiens
aaacgggcgcagtgcccgcggcggcggcacgcgcgcatctgggatccggccgcttctccgctcatgccatcttgtccgagccagtcacgtgcgggcgacagcggcgcgcttcgccgggccggtactccaggtccgacccgcgaacccctctgggatccccgccgctctgtctacaacccgagaaacgaagtctcactgtgttgtccaggctggtctcaagctcctgggctcaagcaatacttccacctcagcctcccaaaatgctgggattacagatggagtcttgctctgtcgcccaggctggagtgcagtgatgcgatctcggctcactgcaacctccacctcccctggttcaagtgattctcctgcctcagcctcccaagtagctgggactacaagcccgtgccaccatgcccagcactttcatttggacccgtggatacccattgaacagatgcttgaaacctgcaagtaatcttcagatcctagcagaaccataggcctttcctttgttttgggaggatatagcctgcctatatgctgtggaaatgaacggggagcagcagcttgatgcagatgccggctctggtatggaagaggtagaattaagctgggaagattatctagaagaaacagggtccacagcagttccctatgggtcttttaaacatgtggacacacgtttgcaaaatggatttg

SEQ ID NO: 2074 - DNA, 7922 bp, Homo sapiens
cgccttgtgtgtgctggatcctgcgcgggtagatccccgagtaattttttctgcaggatgaattaagagaagagacacttgctcatcaggcatggagagcactttgtcagcttccaatatgcaagacccttcatcttcacccttggaaaagtgtctcggctcagctaatggaaatggagaccttgattctgaagaaggctcaagcttggaggaaactggctttaactggggagaatatttggaagagacaggagcaagtgctgctccccacacatcattcaaacacgttgaaatcagcattcagagcaacttccagccaggaatgaaattggaagtggctaataagaacaacccggacacgtactgggtggccacgatcattaccacgtgcgggcagctgctgcttctgcgctactgcggttacggggaggaccgcagggccgacttctggtgtgacgtagtcatcgcggatttgcaccccgtggggtggtgcacacagaacaacaaggtgttgatgccgccggacgcaatcaaagagaagtacacagactggacagaatttctcatacgtgacttgactggttcgaggacagcacccgccaacctcctggaaggtcctctgcgagggaaaggccctatagacctcattacagttggttccttaatagaacttcaggattcccagaacccttttcagtactggatagttagtgtgattgaaaatgttggaggaagattacgccttcgctatgtgggattggaggacactgaatcctatgaccagtggttgttttacttggattacagacttcgaccagttggttggtgtcaagagaataaatacagaatggacccaccttcagaaatctatcctttgaagatggcctctgaatggaaatgtactctggaaaaatcccttattgatgctgccaaatttcctcttccaatggaagtgtttaaggatcacgcagatttgcgaagccatttcttcacagttgggatgaagcttgagacagtgaatatgtgcgagcccttttacatctctcctgcgtcggtgactaaggtttttaacaatcacttttttcaagtgactattgatgacctaagacctgaaccaagtaaactgtcaatgctgtgccatgcagattctttggggattttgccagtacagtggtgccttaaaaatggagtcagcctcactcctcccaaaggttactctggccaggacttcgactgggcagattatcacaagcagcatggggcgcaggaagcccctcccttctgcttccgaaatacatcattcagtcgaggtttcacaaagaacatgaaacttgaagctgtgaaccccaggaatccaggagaactgtgtgtggcctccgttgtgagtgtgaaggggcggctaatgtggcttcacctggaagggctgcagactcctgttccagaggtcattgttgatgtggaatccatggacatcttcccagtgggctggtgtgaagccaattcttatcctttgactgcaccacacaaaacagtctcacaaaagaagagaaagattgcagtcgtgcaaccagagaaacaattgccgcccacagtgcctgttaagaaaatacctcatgacctttgtttattccctcacctggacaccacaggaaccgtcaacgggaaatactgctgtcctcagctcttcatcaaccacaggtgtttctcaggcccttacctgaacaaaggaaggattgcagagctacctcagtcggtgggaccgggcaaatgcgtgctggttcttaaagaggttcttagcatgataatcaacgcagcctacaagcctggaagggtattaagagaattacagctggtagaagatccccactggaatttccaggaagagacgctgaaggccaaatacagaggcaaaacatacagggctgtggtcaaaatcgtacggacatctgaccaagtcgcaaatttctgccgccgagtctgtgccaagctagagtgctgtccaaatttgtttagtcctgtgctgatatctgaaaactgcccagagaactgctccattcataccaaaaccaaatacacctattactatggaaagagaaagaagatctccaagccccccatcggggaaagcaaccccgacagcggacaccccaaacccgccaggcggaggaagcgacggaaatccattttcgtgcagaagaaacggaggtcttctgccgtggacttcaccgcgggctcgggggaggaaagtgaagaggaggacgctgacgccatggacgatgacaccgccagtgaggagaccggctccgagctccgggatgaccagacggacacctcgtcggcggaggtgccctcggcccggccccggagggccgtcaccctgcggagcggctcagagcccgtgcgccggccacccccagagaggacacgaaggggccgcggggcgccggctgcctcctcagcagaggaaggggagaagtgcccgccgaccaagcccgaggggacagaggacacgaaacaggaggaggaggagagactggttctggagagcaacccgttggagtggacggtcaccgacgtggtgaggttcattaagctgacagactgtgcccccttggccaagatatttcaggagcaggatattgacggccaagcactcctgcttctgacccttccgacggtgcaggagtgcatggagctgaagctggggcctgccatcaagttatgccaccagatcgagagagtcaaagtggctttctacgcccagtacgccaactgagtctgccctcgggaggtggcccattattgctgggatgcggtgttggtaaaggtttccaggactgaaactttgattttccgggatatgttaaatggtacagccactaagtatcaccagaaaaccagaagcccaggatcttctgcctccgccagcctgtgagctgtttccatgttttcaaagcacagcagcagtcgcttctggggagtgccagttaaagtcatgcatcagaccctgccagacgtgggcctgcttcttggctcacccacgttttgcctttctcctgccccaaatcaggcagctcccttggagcagggtttcctcagatgaggactgcattctttgaaaacaaagaatgtcgccaaggaagaaacctcacgccatgctgtagtgtttcctgtaatcacacgagcacatttatatatgcagtttcccatggataggcgtgtgaccctggttgagtggcacttgcggtttcatcttggtggcaactcctttgcaatgcagctggcagcgacatccttataaaaacatgtgctaaagctctgtcctctgttagaggtgccttttaggaatacggggagtgaaggaaggccggcaggcatctccatgcaactagatggtttgtttgtttgtttgtttgtttgttgttcattttgttgtgttttttgagacagggtcttgctctgtcgcccaggttgtaatgcagtggcgcaatctcagctcactgcaacctctctctcccgggttcaagtgattctcctgcctcagcctcccaagtagctgggattacaggcacccaccaccatgcctggctaatttttgtatttttggtagagacagggtttcaccatgttggtcaggctagtcttgaactcccaacctcaagtgatctgcccgcctcggcctcccaacgtgctgggattacaggtgtgagccactacgccccggcccaactggatggtttttgattgaagcctagaacatctgtagagacaaactctacccagtcttttctagaccctcaactatctccagtgttgttgtttaatcgtagccggatcagggagtgagtcttttaggcaaatgttggattatatatcaaaggaaaagcttagtttcagagaggaggaagggaaagagatgtgagggaagcatttcatcaaccagctacgtcccccttagaaggatcactgcagcaggtcaccgagcaggagtccctctgagcgtcccttctgtctcgttctgccctagctggcagcatatgaaccaggcatgatgcagcaggagcagtgaatctggagtcagccacttggcaccctggtttcgctgagaacaaactctgagatcttgggtgacttctcatcactctggacctccattcctgtgaagtgacaggtgtggaccctgagggtgcggtggtgagcacactgtctcctgctggcattcaccccactcatgctggaaaggaagatccagatcgtacaaaaattagaaaaagaaagaataagaagggtctggtcccagttctgactcggccattcttacagctctttctggctttgagtttgcttgtggaatttcctgggcagttgtgttaaatccgccaggtcacgtgcagacaaagctgtggctgcgagagttggctggcctcttggaccagaagccatctccatatcctcatgagcgattccatatctccactcagaccctgtggactacagtgttccgctgtggtggctgccaagatgccttcttaaacttatgcaaggaaaccaaaccctcccacagttcccaagcagacactggaagcagaggcttctcacccttcctgctttttcaccacaatcaccttgagctcgtcccttggactagagtctccacagttccagtaaaattctgcggtgggctgatgagctgcttgcatttctgtgacatttccagatatgattctcagtgggattttggaaactttgattgctcaagctcacccttcttaacattctgtaatggttacagatgagaatggaaaacacatattttatggatgaggcgttttggtctcccctgcagtcgatttctagaatcaagttttagagttcggctgatgcatctgcctggggacctcagatgggaggagtgtgtcagttgtaccccgacagaaatgtctctgggatctgtggctggcttgccccgggcatctctcctttaagctcaagttttgaactctctgcggttttccacccctgccttctcagccacatgcttttggccttaaacgctcagtcttgtggagttcaactctgtcaaacgattggaaagggcatccatttccagatctttggcattttccccgcgctgactctttgatgatccttcactgtggccttttcaagctcagctgttcctgttgtatttgagacgagggtgagggaatgtggtggccacaaaagaacagggacttgcagcacaaatgtcacttctgtctcccttttcagtggtagcacggaggaggaggtgctgcgttggagggaggggatcctccaggagctctctggagcccatctaggaagctagagtgtgtggcccgccaggagctcaggaaggatacagccactgtcgcaggggaaagtgtttgcttcccgtggagccaagcgcccaagactctccgtatccttcaccctgacagtttaacttcagcgtttctctgtgcagttgcggtcaccatgggtgagcactgtctgtgcacgtgccagggaggagatggctgggaccactgcacaggagggcgcagcctggcgtcgccatgaaagttgtctctgtgccatctctccggtccttgaggagagcccagaaagattttaggacccaggaggtgcttttcctccagctgttgccagtgtccttctgagcctggattctccggggatttccgtcgtggtggatggacttcacatcagcagcagttctggtacagaattgtaatgtgttttcatttctctgtaggattcacctctcaccagcgtctgtcttaaaggtagggccaatttcatggagcatttttctgtgtgtgtccttgttgcttttgccagaaaaagtggatttgacatgcgtgccccgatgccaccatagcccctaggccaacaatgtcatggtctaaacaccaaaaagtgatgccccgcattccttccctggatggtaccgtttcttctccgtctctctttgatgattctttgggaccaaagtcctctccttagtgcgcctacttcctgtgggcatcatgccacttggaacttattggaactggcccgggagactctgcagtctgcgccgtttgaaaaccctgagaaagagatgccacctcaacttgaatcatgacagcccatcgctcagtctcaccctaaactcatggagcttgtttcagctcctcacttcttgactgtatttgtactatgttgaaaaaatatcctgtccacaaagacataagcctaacaacctagaaaaacaacagggtactactggcattacagaacttctttgcctttcaaaacaaaagcaaaacacagtgaacttcaccacggagctgcacagcgtggggaactcatccatcactttcaaaattagagtcatttgatccaagttggagtcagacacagtatttgagctgcacggcttctgggttctcccaccttatttgatcatattcgaaagattatttcctgtgtttgctttgatttgttcctcagtacattaaaatgatccacaccttgaacactgccctctctagaaggttgattttgatcagccttttgaagatgggtgtcgtttccctaacttatctcacagaattttgagtgttgtatttggcaagttctgagatttgccttctgtcttatgccaaacacccctttctaagagctgtccccgcttagttttagaagtactaggggttttcatacttattttatagaacacccatttatatttatttctgtatatagaactaaaaaaaacagtagtgttaaaaatctttgttgtggtttgagcatctttgctgcttttggattgagatggcgaatcaaggcttcacttcctctctcttctgtctttagaaagctgtgatcgtgcgtgcaattatttgaaaggcaacatagtcaattaagaaacctgtagttgttaaggaagaaattgttggcaagatatccatactgcccatatctcgttggtgcaataattaaatagcaaaggaaatctgtattggcaactattataattcaataattcttttgtttactgcccttttctgttcaagaattttctggaaattactccctttcacatggttgaactcttaagttgaccagttctcatagctctatcactagaatggtttgcagataccccaaacatactatgataaaatcaaattgtgctacttttgacccatgtaatttacctaaaagttgtaattgctgacagagtactgccttgaattttggtttaaaacctctctagtttcaatgacaagtaacaactcaaataattccatattgtttgaggaagaggccataatccttctgaattgttggcactaagtaatgggatttggcccagtaagtatgacggtcgtgtcgcctaaccaacgcagagcagtgctttttgtgtggctgaagcgatgtgctgacgaaaaaaggaaaattctaggacaatcgttggctaaaaatcaccttaggatgaaaaatttgaggcaaatttttttaaatgacagaaaaagataatcatctcacttgcttgaaacaggagccagcatgatctctggaagcatcaactatccctcgtcgtgattgttgaaagctctttcactgttttgcattctagtttgaatagtttgtattgaaattggattcctatcttgtgtatgtttttggtgcgtaaaagggaaaaattggtgtcattacttttgaaatttgcaggacgaagggcatgcttttggtttgctgtaagattgtattctgtatatatgttttcatgtaaataaatgaaaatctatatcagagttatattttaatttttattctaaatgaaaaaaaccctttttacttcaaaaaaattgtaagccacattgttaataaagtaaaaataaattcta

SEQ ID NO: 2075 - DNA, 693 bp, Homo sapiens
aacgcgagctcgggtaattttttctgcaggatgaattaagagaagagacacttgctcatcaggcatggagagcactttgtcagcttccaatatgcaagacccttcatcttcacccttggaaaagtgtctcggctcagctaatggaaatggagaccttgattctgaagaaggctcaagcttggaggaaactggctttaactggggagaatatttggaagagacaggagcaagtgctgctccccacacatcattcaaacacgttgaaatcagcattcagagcaacttccagccaggaatgaaattggaagtggctaataagaacaacccggacacgtactgggtggccacgatcattaccacgtgcgggcagctgctgcttctgcgctactgcggttacggggaggaccgcagggccgacttctggtgtgacgtagtcatcgcggatttgcaccccgtggggtggtgcacacagaacaacaaggtgttgatgccgccggacgtagagagtgatgtcaagccatcagcttctgttcaacatatttcttagaaaaggatgtctcaaaacttcttcgagaccgtcacgaaatgaaacaactccccgatcccacacgaacctctcccaccaccctcaaacataaaccaacccaaaccctttgaaaagctccaaagaaaataaaatgtttttagaacttc

SEQ ID NO: 2076 - DNA, 2402 bp, Homo sapiens
aaagcgcaagtttgtgcacacggtcgactgagccattggaaacccagctcacgaaccgcagccagggaaacgggagtttgcccagttgtccttgcggaggggtgtgcggaaacgcccgcgatgggaactttctgcagatcatgtaattttttctgcaggatgaattaagagaagagacacttgctcatcaggcatggagagcactttgtcagcttccaatatgcaagacccttcatcttcacccttggaaaagtgtctcggctcagctaatggaaatggagaccttgattctgaagaaggctcaagcttggaggaaactggctttaactggggagaatatttggaagagacaggagcaagtgctgctccccacacatcattcaaacacgttgaaatcagcattcagagcaacttccagccaggaatgaaattggaagtggctaataagaacaacccggacacgtactgggtggccacgatcattaccacgtgcgggcagctgctgcttctgcgctactgcggttacggggaggaccgcagggccgacttctggtgtgacgtagtcatcgcggatttgcaccccgtggggtggtgcacacagaacaacaaggtgttgatgccgccggacgcaatcaaagagaagtacacagactggacagaatttctcatacgtgacttgactggttcgaggacagcacccgccaacctcctggaaggtgtatgtattgttgttatacatctaatgtatctctgaagcaccccagttacgtgagctcagacctgacagcacctttgcatatatccttcagcagatgcgtgctttctgcagacactgccatccaaatagcctcccttcctcttttgtcctgaattacttaggtgactgatttgaatggcattgatgaaacttcccctgtgatgcaatcagcaaatggaaaatttgctctatgtgaatccaatttttaaatcacaatatgctaggatgtcttcctactgtcctatatctttaagcctctttcctatgtgagtgaatataaatcaaatcctgtagaatcactgttttgaacaggtgacaagatcatgtatgtgctaatatagtctcttggagtacattgataagtcgttccattaaatgttctattttgacgcataaccccaagatttgaacatacacacgttaaccaataattgaattaacttctcttgtaaaaacaagaggagaaatggcagatcgtatttcagtgtagccaaggaaattttaatgtattgaagaaaacatagtttaatctgaaatcttgatggtttatttgaaaataattttatgttgaaacatcttagtatgtatatgtagtatttgtatttgtataatggaacaggaagagaaaggcactgtgtcataagtaattattgaattacctagtctgtttttcttaagaatgcccctaaaaaggggaaaacttaatgaataacaagtaataaggtgtggattttgacagtatcatattctcttaaccttaaactttccctcttttcataaatgatattgacattttagaacgtcatagtctaatatagttaacgggttttgttttgtgaagattttgcctgatgtatttgttatatatcattagagatactattttaattgttcattaacaaatcaaaatgatgatagttcatcctttcaaaaggacaaattgtctcactatgttaattttctaaaacatatttgcctacaaagctggctgaacaaacacccttttcatatgctatcataggctaagaaggtttcttagaaggggcagtaattatacattctgtaaaccaattaccagcttaagtgtagaaataattttacatagtagtctaatttagctgatcattactgtgtgttagacatgtcattgacacacactcatgccttcgtcacataatcaaagtatgagagcattttggtcattagagtagcggccagtagagtaagatgaatgtctgggaaaccgtcatggtgtaaattgaatgctctgtattagaattatctgtctgttggaaaagtagaccgtttgctaccacgttttctaggtccaggcaaatttgggtagaactcttcttaaaagcatactgattgttaacaaaagcaattttatctgggaagggtgatttgtttggtgagaacttagcacaaactgttattttctattgacttgtgatttttttgttgttggatacggaatggggtacatggatgtgtgggagggaggaaagggaaggggtggggcatgggctgggcaaggatggggtggagggaacgccagactgttcgccagtaccttggatgatggtgtgaaaaaatattatcttctgctgtcatctgtttccatgagaaccttaaaataaagttt

SEQ ID NO: 2077 - DNA, 678 bp, Homo sapiens
ataaagcgcaagtttgtgcacacggtcgactgagccattggaaacccagctcacgaaccgcagccagggaaacgggagtttgcccagttgtccttgcggaggggtgtgcggaaacgcccgcgatgggaactttctgcagatcatgtaattttttctgcaggatgaattaagagaagagacacttgctcatcaggcatggagagcactttgtcagcttccaatatgcaagacccttcatcttcacccttggaaaagtgtctcggctcagctaatggaaatggagaccttgattctgaagaaggctcaagcttggaggaaactggctttaactggggagaatatttggaagagacaggagcaagtgctgctccccacacatcattcaaacacgttgaaatcagcattcagagcaacttccagccaggaatgaaattggaagtggctaataagaacaacccggacacgtactgggtggccacgatcattaccacgtgcgggcagctgctgcttctgcgctactgcggttacggggaggaccgcagggccgacttctggtgtgacgtagtcatcgcggatttgcaccccgtggggtggtgcacacagaacaacaaggtgttgatgccgccggacgtagagagtgatgtcaagccatcagcttctgttcaacatatttcttag

SEQ ID NO: 2078 - DNA, 4363 bp, Homo sapiens
ataaagcgcaagtttgtgcacacggtcgactgagccattggaaacccagctcacgaaccgcagccagggaaacgggagtttgcccagttgtccttgcggaggggtgtgcggaaacgcccgcgatgggaactttctgcagatcatgtaattttttctgcaggatgaattaagagaagagacacttgctcatcaggcatggagagcactttgtcagcttccaatatgcaagacccttcatcttcacccttggaaaagtgtctcggctcagctaatggaaatggagaccttgattctgaagaaggctcaagcttggaggaaactggctttaactggggagaatatttggaagagacaggagcaagtgctgctccccacacatcattcaaacacgttgaaatcagcattcagagcaacttccagccaggaatgaaattggaagtggctaataagaacaacccggacacgtactgggtggccacgatcattaccacgtgcgggcagctgctgcttctgcgctactgcggttacggggaggaccgcagggccgacttctggtgtgacgtagtcatcgcggatttgcaccccgtggggtggtgcacacagaacaacaaggtgttgatgccgccggacgcaatcaaagagaagtacacagactggacagaatttctcatacgtgacttgactggttcgaggacagcacccgccaacctcctggaaggtcctctgcgagggaaaggccctatagacctcattacagttggttccttaatagaacttcaggattcccagaacccttttcagtactggatagttagtgtgattgaaaatgttggaggaagattacgccttcgctatgtgggattggaggacactgaatcctatgaccagtggttgttttacttggattacagacttcgaccagttggttggtgtcaagagaataaatacagaatggacccaccttcagaaatctatcctttgaagatggcctctgaatggaaatgtactctggaaaaatcccttattgatgctgccaaatttcctcttccaatggaagtgtttaaggatcacgcagatttgcgaagccatttcttcacagttgggatgaagcttgagacagtgaatatgtgcgagcccttttacatctctcctgcgtcggtgactaaggtttttaacaatcacttttttcaagtgactattgatgacctaagacctgaaccaagtaaactgtcaatgctgtgccatgcagattctttggggattttgccagtacagtggtgccttaaaaatggagtcagcctcactcctcccaaaggttactctggccaggacttcgactgggcagattatcacaagcagcatggggcgcaggaagcccctcccttctgcttccgaaatacatcattcagtcgaggtttcacaaagaacatgaaacttgaagctgtgaaccccaggaatccaggagaactgtgtgtggcctccgttgtgagtgtgaaggggcggctaatgtggcttcacctggaagggctgcagactcctgttccagaggtcattgttgatgtggaatccatggacatcttcccagtgggctggtgtgaagccaattcttatcctttgactgcaccacacaaaacagtctcacaaaagaagagaaagattgcagtcgtgcaaccagagaaacaattgccgcccacagtgcctgttaagaaaatacctcatgacctttgtttattccctcacctggacaccacaggaaccgtcaacgggaaatactgctgtcctcagctcttcatcaaccacaggtgtttctcaggcccttacctgaacaaaggaaggattgcagagctacctcagtcggtgggaccgggcaaatgcgtgctggttcttaaagaggttcttagcatgataatcaacgcagcctacaagcctggaagggtattaagagaattacagctggtagaagatccccactggaatttccaggaagagacgctgaaggccaaatacagaggcaaaacatacagggctgtggtcaaaatcgtacggacatctgaccaagtcgcaaatttctgccgccgagtctgtgccaagctagagtgctgtccaaatttgtttagtcctgtgctgatatctgaaaactgcccagagaactgctccattcataccaaaaccaaatacacctattactatggaaagagaaagaagatctccaagccccccatcggggaaagcaaccccgacagcggacaccccaaacccgccaggcggaggaagcgacggaaatccattttcgtgcagaagaaacggaggtcttctgccgtggacttcaccgcgggctcgggggaggaaagtgaagaggaggacgctgacgccatggacgatgacaccgccagtgaggagaccggctccgagctccgggatgaccagacggacacctcgtcggcggaggtgccctcggcccggccccggagggccgtcaccctgcggagcggctcagagcccgtgcgccggccacccccagagaggacacgaaggggccgcggggcgccggctgcctcctcagcagaggaaggggagaagtgcccgccgaccaagcccgaggggacagaggacacgaaacaggaggaggaggagagactggttctggagagcaacccgttggagtggacggtcaccgacgtggtgaggttcattaagctgacagactgtgcccccttggccaagatatttcaggagcaggatattgacggccaagcactcctgcttctgacccttccgacggtgcaggagtgcatggagctgaagctggggcctgccatcaagttatgccaccagatcgagagagtcaaagtggctttctacgcccagtacgccaactgagtctgccctcgggaggtggcccattattgctgggatgcggtgttggtaaaggtttccaggactgaaactttgattttccgggatatgttaaatggtacagccactaagtatcaccagaaaaccagaagcccaggatcttctgcctccgccagcctgtgagctgtttccatgttttcaaagcacagcagcagtcgcttctggggagtgccagttaaagtcatgcatcagaccctgccagacgtgggcctgcttcttggctcacccacgttttgcctttctcctgccccaaatcaggcagctcccttggagcagggtttcctcagatgaggactgcattctttgaaaacaaagaatgtcgccaaggaagaaacctcacgccatgctgtagtgtttcctgtaatcacacgagcacatttatatatgcagtttcccatggataggcgtgtgaccctggttgagtggcacttgcggtttcatcttggtggcaactcctttgcaatgcagctggcagcgacatccttataaaaacatgtgctaaagctctgtcctctgttagaggtgccttttaggaatacggggagtgaaggaaggccggcaggcatctccatgcaactagatggtttgtttgtttgtttgtttgtttgttgttcattttgttgtgttttttgagacagggtcttgctctgtcgcccaggttgtaatgcagtggcgcaatctcagctcactgcaacctctctctcccgggttcaagtgattctcctgcctcagcctcccaagtagctgggattacaggcacccaccaccatgcctggctaatttttgtatttttggtagagacagggtttcaccatgttggtcaggctagtcttgaactcccaacctcaagtgatctgcccgcctcggcctcccaacgtgctgggattacaggtgtgagccactacgccccggcccaactggatggtttttgattgaagcctagaacatctgtagagacaaactctacccagtcttttctagaccctcaactatctccagtgttgttgtttaatcgtagccggatcagggagtgagtcttttaggcaaatgttggattatatatcaaaggaaaagcttagtttcagagaggaggaagggaaagagatgtgagggaagcatttcatcaaccagctacgtcccccttagaaggatcactgcagcaggtcaccgagcaggagtccctctgagcgtcccttctgtctcgttctgccctagctggcagcatatgaaccaggcatgatgcagcaggagcagtgaatctggagtcagccacttggcaccctggtttcgctgagaacaaactctgagatcttgggtgacttctcatcactctggacctccattcctgtgaagtgacaggtgtggaccctgagggtgcggtggtgagcacactgtctcctgctggcattcaccccactcatgctggaaaggaagatccagatcgtac

SEQ ID NO: 2079 - DNA, 3579 bp, Homo sapiens
gtctttcttctctctctgtttctctcttgtgtctttttgtccttatcttggtctctctgcttctatttctacctctctcagcgtgtgcgtctctctttccctgtatgtctctgtctttctccgagtctctcttcttctccccgcccccctcactcccctttctccgtccctctctgtctctgcgcctttctcgccctcactttctcccctcctgcctgctccgggcctgcccccaccgccgccggttcaggggaacgtgtgcggagcgattgtcctgggggacatttgatggattagagcgccgagcggttccattgctaggggaccacctgatctccagcctgcgtcccatataaagccggcagccggagtgctgagcgcagctcccgcgatcccctgtctgcgcgccgccgccgccaagcccgagcccgagccggggccgccgccaccggtgccggctccgagcggcctcccgcgctccagcccgctgggagctgtccagtgctgaaaacccgcgcggacacagccgatcgcgcccggccggccgcctccccgcaccgagccccgcgccggccgcgccatgccgcgctccttcctggtaaagaagatcaaaggggacggcttccagtgcagcggggtgccggcccccacctaccaccccttggagacagcctacgtgctgcctggcgcccgggggcctcccggggacaacgggtacgccccgcaccgcctgcccccgagcagctacgatgcggaccagaagccgggcctggagctggccccggccgagcccgcgtacccgccggcggcgccggaggagtacagcgaccccgaaagcccgcagtcgagcctgtcggcgcgctacttccgaggggaggcggcagtgaccgacagctactccatggacgccttcttcatctcggacgggcgctcgcggcggcggcggggcgggggcggcggggacgcggggggctcgggagacgcggggggcgccggggggcgcgcggggcgcgcgggggcgcaggcgggcggcgggcaccggcacgcgtgcgccgagtgcggcaagacctacgccacgtcgtcgaacctgagccgccacaagcagacgcaccgcagcctggacagccagctggcgcgcaaatgcccgacgtgcggcaaggcctacgtgtccatgcccgcgctcgccatgcacctgctcacgcacaacctgcgccacaagtgcggcgtctgcggcaaggccttctcgcggccctggctgctgcagggtcacatgcgctcgcacaccggcgaaaagccgttcggctgcgcgcactgcggcaaggccttcgccgaccgctccaacctgcgcgcgcacatgcagacgcactcggccttcaagcactaccgctgccgccagtgcgacaagagcttcgcgctcaagtcctacctccacaagcactgcgaggcggcctgcgccaaggcggccgagccacccccgccgacccccgccggcccggccagctgagccttccgcctcgccctcgcgcccggaactcgctctccacgcgccccgggccccctacctgcgcccgcagcgccctcgcccagccccggctgcgtttccctgcccatgaccctctcgtggggacccccggcccggcccggaacttttctccccaacccccaaacccacgactcacttccacaccgtcttccccagcgtcccccgacccacttcatcctttccggccatccctcggaccttgacccccctgtccgcgccttcaaggctcccaactcaggcaccaggtccgcacctctcccgcgccccagagccggaaatttctccctcccagaccccgcgctgctcttctaacttctagatcttttctctcgcttctcagctgaatctctctgaccattcctctactggagcccccaatgaaagccgcaaacctatacccttgacgcccatacctgcctcagtttccccatccacacctggacgcaggccctgccgccctgagaccacagtccaaccccagaccatccctctggcctctgctgaatctcccagagtgtgtccatctggggatctaatcttcacccttcttgaagtctccgatctgtccctgatcccatccatgctcaggccttaggtctggccattcacacacacacacacccccacaccccactcccacacacagttcctactgtcttcagtccatggggatctcatcacccactcccagccccagctccagctgccctcacctctctagcagctctcacccctctgagtctacctaacctggagggggcttgaggggcacttcagggccctgccccctaatgtaacccctctctcaccccggcacaacctgggcttccacagtctggagctgccctacccccagattctctgagcactttcccccatccccagggccacagatccccttccttacttgttggggggaggtctggagcacctcgccaatgcccttcccccatccggctgggtccttccagttatttatttgtgtatttatttatttatctatttattattctatttaatctcttggcctcacccagggaccgtctggcttccccagctggactgggaggtcaggaagccaggcaaggagagggacagcacaggccacagagggctgcccccaccacacacacccccgcgtctcgggagaaacccaccctcttcagagcctgcactcgctaaggaaggggactcgagaatgggggggcagcttgctgaccctcaactgggggggtgagggagcatcaggaggtccaggcgtggggcaggtccccaccttcctgaaccttcccctgccactccaggcggcccggagagaggagcctcttcgatttgtttcctgtttattcttcttcccgagggaccccaggttccagggaccgactgagccccggacccgctggggcctctggcctgctccccgggaggggcgctctctcccggccatgtctatgcaactctcccggacagaggggccgggctgccagccacccgcccgttggccgccactacctcctccgctgcgcttttgcatgcccgggcgaggaccgaagcacacacctccacgcgcacgggccctggccccctccgctttaagcacacgcctctgccccattgctctgcagccagcttgggggcaggagtcctggactctcagatcctcctctcccctcctcttagccacaaaagaggggggagactggaggcacccctgcagcaggggcacttccctagggctccagaggggtgaatgggcctttgctcagctccaggcccagcgggaagggaggctgcagggatggtgggagggagaggggtagcagaagcaattatggaggcgttgaccctgtaaatagcaacttctgacagcaataattttccatgcatgctaagccttttggccatattttgtatgagcgcttggcgctcctcctccgtcctatcccaactcacccccaaacccccatcccttccccacctccagcagtattacttgtaacgcaattcagggatattaaagggactttggccactca

SEQ ID NO: 2080 - DNA, 3017 bp, Homo sapiens
gcgctatttccggtcatacccggaaacacgagtccaagctgcagctggcagggattgcggggtgccggccgtctgagtttttttaaaactgctcgccgcgaagtctgtctgcagccaaaatgtccaacagaaacaacaacaagcttcccagcaacctgccgcagttacagaatctaatcaagcgagacccgccggcctacatcgaggagtttctacagcagtataatcactacaaatccaatgtggagattttcaaattgcaaccaaataaacccagcaaagaactagcagagctggtgatgtttatggcacagattagtcactgctacccagagtacctaagtaattttcctcaagaggtgaaagatcttctctcctgcaatcataccgtattggatccagatctgcgaatgacattttgcaaagctttgatcttgctgagaaataagaatctcatcaatccatcaagcctgctagaactcttctttgaactttttcgttgccatgataaacttctgcgaaagactttatacacacatattgtgactgatatcaagaatataaatgcaaaacacaagaacaataaagtgaatgtagtattgcaaaatttcatgtacaccatgttaagagatagcaatgcaaccgcagccaagatgtctttagatgtaatgattgaactctacagaaggaacatctggaatgatgcaaaaactgtcaatgttatcacaactgcatgtttctctaaggtcaccaagatattagttgccgctttgacattctttcttgggaaagatgaagatgaaaaacaggacagtgactccgaatctgaggatgatggaccaacagcaagagacctgctagtacaatatgctacagggaagaaaagttccaaaaacaagaaaaagttggaaaaggcaatgaaagtgctcaagaaacaaaaaaagaagaaaaaaccagaggtgtttaacttttcagccattcacttgattcatgatccccaagattttgcggaaaaactactaaagcagcttgagtgctgtaaggagaggtttgaagtgaagatgatgctcatgaaccttatctccagattggtgggaattcatgagcttttcctcttcaatttctatccctttttgcaaaggtttctgcagccccaccaaagagaagtaaccaagatccttctgtttgctgcacaagcatctcatcacctagtacccccagagattattcaatcattgcttatgactgtggcaaacaattttgttaccgacaagaactctggagaagtcatgacagtaggaatcaatgctataaaggagataacagctcgatgtcctctggccatgactgaagaacttctccaagacctggctcagtataaaacacacaaggataagaatgtaatgatgtctgctagaactttgattcacctcttccgaacactgaatcctcagatgctgcagaagaaattccggggtaagcctacagaggcctccatagaagcaagagtacaagaatatggagaattagatgctaaagattacattccaggagcagaagttctggaagttgagaaagaagagaatgctgaaaatgatgaagatggatgggaaagtaccagtctcagtgaggaggaggatgctgatggtgaatggattgatgtgcaacactcttccgatgaagaacagcaagaaatctccaagaagctgaacagcatgcccatggaggagcggaaggccaaagctgcagccatcagcactagccgagttttaactcaggaagacttccagaaaatccgcatggcccaaatgagaaaagaacttgatgctgcccccgggaaatcccagaagaggaaatacattgaaatagacagtgatgaagagcccaggggtgaattactttctcttcgggacattgaacgccttcataaaaagccaaagtctgacaaagagacaagactagcaactgcaatggctggaaagacagaccgaaaagaatttgtgaggaagaaaaccaaaacaaatccattttccagttcgacaaataaagagaagaaaaaacagaagaactttatgatgatgcggtatagccagaatgtccggtcaaaaaataagcgttccttccgagaaaaacagttggcactacgagatgcacttttgaaaaagagaaaaagaatgaagtaacttcctggcaagttttccattcctagaagaatgctaagtttgtgtccttgctctgaaaattggtaaatcaagcatgtttgtttacattaaaaagtccagacacactgtattgtgaaaactgctgaacatgtggcagcaattttgtgtttttattttggagacggctaatggtaggaatgttaatgtaaatagtggtggtaatgtaaaatcatttcatttatcattcatgcaaaaaaaagtatgtattgagtgcctattcattgtcactgtagatgcaaaacgaatgagctgtaaccccttcactcaaggcattgacagcttagctgtgagggtggacacacatatgtgtatttacagtgcagtgtaaatagttctgtagtagaggttaactccatatttctgtgaggtcactgaggccttatggactaactctgtgaggataggagttatatattcttataagacaaaacaaaacaggacaatgttacaagagtaagaggttcttacttgtacataggctttcctgctgaaaacaggcccctgctgtacagattttgggtacataatttagctcttttagtcaatccaagagatttaagtgacccccccccccccgtgttttttttgtttttgtttttgttttgaatgccatgtaaaggctttttggttaagacctcacttttaaaactgccttaagtataaatagtacctttggaatatatttagttcatcatttgagctgccttcatactggtttcctcagccttccttcagcctgtaatattttcagcccactgtttaccttgtctcaataaaaggtttctaatgccaaat

SEQ ID NO: 2081 - DNA, 3599 bp, Homo sapiens
ccgtgcgtccaggctggcgccgcgctgcgccccctctgcgccggcctctgcggctgcgcgctggcggggctgaggccgaggggtgggggtcgcgccgggggccggcggagctcctgtggtggtagcagcggtagcgggagacggagcgagtccagcggccgcgggcagacccggagggaacggaggaagcggtcatgtctcgctacacgaggccccccaacacctccctgttcatcaggaacgtcgcggacgccaccaggcctgaggacttgcgccgtgagtttggtcgatatggccctatagtagacgtttacattccacttgacttctacactcgccgcccaagaggatttgcttatgttcaatttgaagatgttcgagatgctgaagatgctctttataacctcaatagaaagtgggtatgtggccgtcagattgaaatacagtttgcacaaggtgatcgcaaaacaccaggccaaatgaaatcaaaagaacgtcatccttgttctccaagtgatcacaggagatcaagaagccccagccaaagaagaactcgaagtagaagttcttcatggggaagaaataggaggcggtcagacagccttaaagagtctcgacacaggcgattttcttatagccagtctaaatctcgttccaaatcattaccaaggcggtctacctcagcaaggcagtcaagaactccaagaaggaattttggctctagaggacggtcaaggtccaagtccttacaaaagaggtccaagtcaataggaaaatcacagtcaagttcacctcaaaagcagactagctcaggaacaaaatcaagatcacatggaagacattctgactcaatagcaagatccccgtgtaaatctcccaaagggtataccaattctgaaactaaagtacaaacagcaaagcattctcattttcggtcacattccagatctcgaagttatcgtcataaaaacagttggtgaacagcaacagaaagagcaccacgccgtctttaatataagttattaaactctcattatgttaaataaaaattctttaaggcatacagaaaatgcgagttgatattagttactttgggcatatggaagaaataaaatctctagctttggattaataaaaatttggtctccatttaaagggcccacactacaaattatgatttgtctaatgtcaccattttatggaccattttttatttacattgtggcagaagggtacttttcaagggaaatgagtaaactggaactaatttttaaaattctacttgcatagtattagtactattaataataccttttacacaaatatttttgactttaaagcactttcatgtaaaaagtaactatgactgtataattgcatagagcagacttaagctgtttgacacctatgtctcttttgtgtcttctgtttaaacttgggccaattcctggtggatattagttcatattacaaaattctgatgttccaaaaagtagaatatatatagagatcaaacattcaaaagatacattctctcctaagctcaaaggttatatttttattgggtagaacagtataggtaagttgacatgaaattgcatcctgcaccatgaccacattagtaatatcagaacttttgagaaatactggattttgaatggtttgagactaattctttaaaaattaggctgagcaacactcacaatccaaaaatattcatattaagacttacacatttgaagaatggtacattttgtataaaatcatatttgataccattatttccacatacctacttttcatctgttgcttaattttttctttttagagttcttgctcaactttatatggaacaagtcttattatttttgaaagagtgtttagtaccttgtattaagaaacttggccaagcgtggtggttcactcctgtaatcccagcactttgggaggtcgaggcgggcagattgcttgaggccaggagattgagaccagcctgggcaacatggtgaaatcctgtctctaaaatttaaaaaaaagaagaagaagaaactcgagactacatcttcaaaaaacaactttgcagtatttgaattttacattatactgcccttcatttctgacagccaaataactttattgatatttattgcttttgtagttgttataactaataatttctttgaaaatgtgttgtagtttatgtttttcaaagggttttggtagtgtttgtgatagaatggttttgcatatgattattataggggatatatttatagagctctacttgtatactttgtgacttacattatgaaaacttcaaagttctcaatccatacagttagtatttgtatccagagtgtttaagaaaaaaatctgtcttatatttttagtatataggagccagtgttgcttctatttgttttgaatacaaattccagttttctttgcatattagatcccatatgtaagaaacaaccttaaacaataatttgtatgctggtaatatttggacaagtgccataaattaatgtatattgtactttctgaatagattttctctaatcatagcaaaatttatttcaaaactacaactctttgaattattccgctataataaaatttagttataaaattatgtggcactactgaaaatctaaaggataatctgaagaatgagtaagacagatattgatagaaatttttagtattttcagaatgtttgggttcatacacataagtgaaatcattttaaaaactaggggctgggcacagtggctcacaccagtaatcctagcactttgggaggccaaggcaggaggattgcttgagcccaggagtttgagaccagcctgggcaacatagcaagacccctttatctataaaaataataataactaggtaccattgtgaaaaataataactagggattgattatagtatctttactctgtattcacaaatctctgtattcctgaacatatttaatcctttgatttacctctgactaggtttgtcattgtaatccctgggctgcttaggaggataccatttggtttgatgaaaaagctggaatgataatagctcaaactcttttgagcatttagtacatgcttggcactgttctatatgtcttaagttattcactcttgtatttaaccatcaacactcttatgaggtaaatatcccgcaattacttttgcgccaacctagtaccactacagacaaggaaacagatgcagagaggctaagttacaagggcacacagccataaactttggatctgtggagtgactgggcttcagagtcctcttcctgactgctgttcctatgtcttttgcaaagagaagtctttgacaggtatatgctttattaaaatcatgtttagaaagaaatgagagaatagaattagaaaaaggaatgactgtaggcttcgatgaaaatgacttttgtgactaggtgaaaattgtttggctgggtatcctggaaaattgtcttctgggaatatctatattccagggttcacttttgtcatagaattgtttcttggcccatttaagagagatactttgtttattaataaatcaaacgttttaatttta

SEQ ID NO: 2082 - DNA, 3368 bp, Homo sapiens
gcggggcgcggggcgggcccgagctaccggtagtctgcctgccgcagtccgagcgccgcgctggggagagcgggtgtttgaaggctccgcggaccggcactaggagccgggggcgggtccgtgaccctccggctgctcggagtgaacaggcggccaggaaagaagcgggcctgaacaccatgatccctttggagaagccaggcagcggcggctcctccccaggcgccacctcaggctcgggccgggcaggccggggtctgagcgggccgtgccggccgccgccgccgccccaggcccgcgggctgctgacagagatacgcgccgtggtgcgcaccgagcccttccaggacggctacagcctgtgcccgggccgggagctgggcagggggaaatttgcagtggtgagaaaatgtataaagaaagattctgggaaagaatttgctgcaaagttcatgagaaaaagaagaaaaggccaagattgtcggatggaaataattcatgagattgctgtacttgaactagcacaagacaatccttgggtcattaatttacatgaagtttatgagactgcatcagaaatgatcttagttctggaatatgctgctgggggtgaaatctttgaccagtgtgttgcagacagagaagaagcctttaaagaaaaagatgttcaaagacttatgcgacagattttagaaggtgttcactttttacacactcgtgatgtagttcatcttgatttgaagcctcagaatattctgttgacaagtgaatctccattgggtgacattaagattgttgattttggcctttcaagaatattgaagaacagtgaagagctccgagaaattatgggtacccctgaatatgtggctcctgaaattcttagttatgatcctataagcatggcaacagatatgtggagcattggagtgttaacatatgtcatgcttacaggaatatcacctttcttaggcaatgataaacaagaaacattcttaaacatctcacagatgaatttaagttattctgaggaagaatttgatgttttgtctgagtcggctgttgatttcatcaggacacttttagttaagaaacctgaagatcgagccactgctgaagaatgtctaaagcacccctggttgacacagagcagtattcaagagccttctttcaggatggaaaaggcactagaagaagcaaatgccctccaagaaggtcattctgtgcctgaaattaattcggataccgacaaatcagaaaccaaggaatccattgtaaccgaagagttaattgtagttacttcatatactctaggacaatgcagacagtctgaaaaagagaaaatggagcaaaaggccatttccaaacgatttaaatttgaggaacctttgctacaagaaattccaggagaatttatctactgagcaatatttccctttagaacttcaagatttctacattgaaaatgttaatattatttatggacctctggccaaatggtacatgtactggaagtggataaccagtatcacttacacaaacaaaaataactttgtcaaatttgtggagttaggtggaagccagattttaaaagttgccaaccaggagatttaacaggtacagttacccgtttcaatgttatttttaagaagggagatgttggcacctttgaattctacatcctgtttctccagaatgagaatttgtgtacaaagatatttgtattcactttctttaaaaaatccaagtaaaagtgccaaaactacacttctgtaaatctcttgcattattcatatgtgtatctatatctgcataatgtttgttaatgtctactaaaattgctactttttcactttggatttgtttttggcaaaattttagtctaaacagacatctaaattttcgagacttagaataacattcactaaagtttgataatgtcttttttaaatattttcttactgctttatagtgacttgatttggtttctgttgtgtttttgcctaaatactagtaacatatcagtgaaaaaccctaattttttttctcttcaatgtcactagtaagagaggtggtaatttttcacctctgaaattattctgggtttaggtgtcagctcttgagctgcttccctcatcacaccacactcacatgcatctgttctctctcacactctatacccctgccacttcctggcacctccccccatgcttgtcatttaattttggccacttgtaggtatcagtgtgatctgatcaacactctggttaccttggtcagtgaaaagatgctactatattgcttttgtcccaaagtgagtaaaatcccctagagcagagagagagagagagagagagagtgtcttcatgccaaccacagcctgtttctgctgagtttcttatcagccctcaagctatgctaggaaaagttataaaatgccaaaatatttataaacatttactttgtccataaaaaatttacattggatactctgtaagtaggaggtactttgtcccaaaaagatgtataagaatgtactaatagttttatttgattaggattgaacagttcagttgtatctatgccccacagtgaccagtaaagtccaattaaaatatggaaatgtaaaagtgtatgccgaataccttaaagtaactaattatccttacacacaaaaggctcagtgcattaaatatttgcctatcacctgtgtgctgtgtaccgtggccatgcctcgctctgcactatgaacaactcagacctgtcccttcacggtctgattagggtgtcacacaaagctctctccctaacatggtttctcaactgtcaaaatcatgaaaatgacagcacctaaccactattttaaagtatgtacagtaaatacccaaatgtgtgtaaatgtcatagacatatacaaagtcagtaatctcacccagtcctgctgtgtgaacctgtcaaagcacctgggagtgccctttacaccattaggtgaaattcatcaggcacttcagacaaccaggttgcactgttttctcactaaattggctttatttatacagtttcctggaacctagcattcctaaacaagctccaaaatgcagaagaagaaattgtgccacagtgatagagtttttaatgaatatccatggccacagttttgagtctcaggtaagtcttggaagaagttaaacacagtattaggcaaatatttatctctctgaaaaaatagggaggaggtgaccaggaaaaaataaccactattgaatgacacgtttgtacttgatggatctgtcatcaagttttaaaatcagaatcatttgggctttttaaaaaccattttatactcgtaataaatatatttaatataa

SEQ ID NO: 2083 - DNA, 1710 bp, Homo sapiens
aaacaggtgatgtcataatgcacagtcctgtggccacggccatggccgggtggggagctgggctccagtgagcacagagctccttgccagtaggcgatgcaagttatctctggggcccggaggacacgagtgaggaccgggcaccaatcaggttctcgctctgcgccggcctttgttctcactcgggagcaggttgcgggcgtctagcatcgggaacccgcattcgactcggacgcgcattgctagccccttcgggagacctggctcccctacccgtctgtcccgccacactcggtcagcctgcgctttccccagtcaagtctgccttctctccgcagaacgtggacgctaaaaccctgacttaccattttaagctttagaagaggataaaagaatcagagtgtctcaacccttgacaagaggaccaagtgcctttattccagagaaggaagttgtccaagcaaacacagtggatgaacgtactaactttcttgtggaagaatactctacatccggtcgtctggacaacatcacacaggtcatgagtttacacactcagtacctggagtctttcttgcggagccagttttacatgttgcgcatggatggtccccttcctctaccatacaggcactatattgcaataatgaaacttgtcaaaactggagaaaataattggtctctgcctgaactggtacatgctgtggtcctcctggcacattatcatgctttggcaagctttgtttttggtagtggtatcaatccagagagagatccagaaatctccaatggattcaggctaatatcagtcaacaatttctgcgtttgtgatcttgctaatgacaacaacatagagaatgcatctctttcaggcagcaactttgggattgtggattctctaagtgagctagaggccttaatggaaaggatgaaaagacttcaagaagaaagggaagatgaagaggcgtctcaagaagaaatgagcactcgttttgaaaaggagaagaaagaaagtctttttgtggtctctggagatacttttcattcatttcctcattcagattttgaggatgacatgattataacatctgatgtctctcgatatattgaagaccctggttttgggtatgaagactttgccagacgaggagaagagcatttgccaacattccgagctcaggactatacctgggaaaatcatgggttctccctggtgaacagactttattctgacattggacatcttcttgatgaaaagtttcggatggtctacaatctcacatataacactatggccacccatgaggatgttgacacaaccatgctgcgcagagctttatttaactatgttcactgtatgtttggaatcaggtatgatgactatgattatggagaagttaatcaattacttgaaagaagcctgaaggtttacattaagacagtgacctgctatcctgagagaactacaaaacgcatgtatgatagttactggcggcagttcaaacactcagaaaaagttcatgtcaatctacttttaatggaagcacgaatgcaagctgaacttctttatgctcttcgtgccataactcggcatttgacctgaagtatcacccaaggaaaatgtcatacatgtgtaaagacctttcacataagataaacattgaagctatttgtgatatagcatcaaaaattattcagttctctagtgtc

SEQ ID NO: 2084 - DNA, 1176 bp, Homo sapiens
agccgccgccgtctccgccgtcgctggggcagctgccgcggtggtcgcctctggcagtgccgctagctttcaggcagtcgcctctcctcccgacatcccgccttgaggaggctgaggcggaatcgcggctggcggcggggggacggaccggccctgcagtggccgcagtgacagcccggacccggccctccgcccgctctcgcctcggcgcccgcagccacgatgaaccggggcggcggcagcccgtcggccgccgccaactacctgctctgtaccaactgccggaaagtgctgcggaaggataaaagaatcagagtgtctcaacccttgacaagaggaccaagtgcctttattccagagaaggaagttgtccaagcaaacacagtggatgaacgtactaactttcttgtggaagaatactctacatccggtcgtctggacaacatcacacaggtcatgagtttacacactcagtacctggagtctttcttgcggagccagttttacatgttgcgcatggatggtccccttcctctaccatacaggcactatattgcaataatggctgcagctagacatcagtgttcttacttaataaacatgcatgtggatgaatttttaaagactggaggtattgctgagtggttgaatggtttggaatatgtgccacaaagactgaaaaatcttaatgaaattaataagctgctagcacatcgaccttggctgatcacaaaagagcacattcagaaacttgtcaaaactggagaaaataattggtctctgcctgaactggtacatgctgtggtcctcctggcacattatcatgctttggcaagctttgtttttggtagtggtatcaatccagagagagatccagaaatctccaatggattcaggctaatatcagtcaacaatttctgcgtttgtgatcttgctaatgacaacaacatagagaatgcatctctttcaggcagcaactttgggattgtggattctctaagtgagctagaggccttaatggaaaggatgaaaagacttcaagaagaaagggaagatgaagaggcgtctcaagaagaaatgagcactcgttttgaaaaggagaagaaagaaagtctttttgtggtctctggagatacttttcattcatttcctcattcaggtcttttgaaatattaa

SEQ ID NO: 2085 - DNA, 1408 bp, Homo sapiens
cgcggtggtcgcctctggcagtgccgctagctttcaggcagtcgcctctcctcccgacatcccgccttgaggaggctgaggcggaatcgcggctggcggcggggggacggaccggccctgcagtggccgcagtgacagcccggacccggccctccgcccgctctcgcctcggcgcccgcagccacgatgaaccggggcggcggcagcccgtcggccgccgccaactacctgctctgtaccaactgccggaaagtgctgcggaaggataaaagaatcagagtgtctcaacccttgacaagaggaccaagtgcctttattccagagaaggaagttgtccaagcaaacacagtggatgaacgtactaactttcttgtggaagaatactctacatccggtcgtctggacaacatcacacaggtcatgagtttacacactcagtacctggagtctttcttgcggagccagttttacatgttgcgcatggatggtccccttcctctaccatacaggcactatattgcaataatggctgcagctagacatcagtgttcttacttaataaacatgcatgtggatgaatttttaaagactggaggtattgctgagtggttgaatggtttggaatatgtgccacaaagactgaaaaatcttaatgaaattaataagctgctagcacatcgaccttggctgatcacaaaagagcacattcagaaacttgtcaaaactggagaaaataattggtctctgcctgaactggtacatgctgtggtcctcctggcacattatcatgctttggcaagctttgtttttggtagtggtatcaatccagagagagatccagaaatctccaatggattcaggctaatatcagtcaacaatttctgcgtttgtgatcttgctaatgacaacaacatagagaatgcatctctttcaggcagcaactttgggattgtggattctctaagtgagctagaggccttaatggaaaggatgaaaagacttcaagaagaaagggaagatgaagaggcgtctcaagaagaaatgagcactcgttttgaaaaggagaagaaagaaagtctttttgtggtctctggagatacttttcattcatttcctcattcaggtgcttttttgcacttttttgccttttagttgttcttagaaccctgacagggcaacttcagtgttttccatgtggatatgtaaaaatgattctgctaccatctttctcttatttagttctcctcttctatcttaccctcatgctattgctttccctcaggctggttcatccttgaatgtatttcagattgagttgagagaaactttcagctttgtagttcatactctatcctggataaaatgttatttaaagcagatcagttacttataaagttagatagacata

SEQ ID NO: 2086 - DNA, 9531 bp, Homo sapiens
gaggcgctgcggcggcggtggtggcggtggcagcggtggcggctgctcgtcctagcctggcgggggcgggggtctggaagatgggggcgggtggaacaacgggccggtgaggagcagccgccgccgtctccgccgtcgctggggcagctgccgcggtggtcgcctctggcagtgccgctagctttcaggcagtcgcctctcctcccgacatcccgccttgaggaggctgaggcggaatcgcggctggcggcggggggacggaccggccctgcagtggccgcagtgacagcccggacccggccctccgcccgctctcgcctcggcgcccgcagccacgatgaaccggggcggcggcagcccgtcggccgccgccaactacctgctctgtaccaactgccggaaagtgctgcggaaggataaaagaatcagagtgtctcaacccttgacaagaggaccaagtgcctttattccagagaaggaagttgtccaagcaaacacagtggatgaacgtactaactttcttgtggaagaatactctacatccggtcgtctggacaacatcacacaggtcatgagtttacacactcagtacctggagtctttcttgcggagccagttttacatgttgcgcatggatggtccccttcctctaccatacaggcactatattgcaataatggctgcagctagacatcagtgttcttacttaataaacatgcatgtggatgaatttttaaagactggaggtattgctgagtggttgaatggtttggaatatgtgccacaaagactgaaaaatcttaatgaaattaataagctgctagcacatcgaccttggctgatcacaaaagagcacattcagaaacttgtcaaaactggagaaaataattggtctctgcctgaactggtacatgctgtggtcctcctggcacattatcatgctttggcaagctttgtttttggtagtggtatcaatccagagagagatccagaaatctccaatggattcaggctaatatcagtcaacaatttctgcgtttgtgatcttgctaatgacaacaacatagagaatgcatctctttcaggcagcaactttgggattgtggattctctaagtgagctagaggccttaatggaaaggatgaaaagacttcaagaagaaagggaagatgaagaggcgtctcaagaagaaatgagcactcgttttgaaaaggagaagaaagaaagtctttttgtggtctctggagatacttttcattcatttcctcattcagattttgaggatgacatgattataacatctgatgtctctcgatatattgaagaccctggttttgggtatgaagactttgccagacgaggagaagagcatttgccaacattccgagctcaggactatacctgggaaaatcatgggttctccctggtgaacagactttattctgacattggacatcttcttgatgaaaagtttcggatggtctacaatctcacatataacactatggccacccatgaggatgttgacacaaccatgctgcgcagagctttatttaactatgttcactgtatgtttggaatcaggtatgatgactatgattatggagaagttaatcaattacttgaaagaagcctgaaggtttacattaagacagtgacctgctatcctgagagaactacaaaacgcatgtatgatagttactggcggcagttcaaacactcagaaaaagttcatgtcaatctacttttaatggaagcacgaatgcaagctgaacttctttatgctcttcgtgccataactcggcatttgacctgaagtatcacccaaggaaaatgtcatacatgtgtaaagacctttcacataagataaacattgaagctatttgtgatatagcatcaaaaattattcagttctctagtgtcaaagtttagccgtttgtttttttttttttgttttttgcggctgtaatgtgcaatgatgtgttttattttccttgatgcttaacattactaacaattgcaaaaataatactgaggagcactactttgcattgtttgtagttggagttttggatactgatcataaatcatgaatctggcgtattaatgcttaacttcagcgcctttgggttgtgtgtatgtgtattttttctccccccaccccgcccttttttttttaagaataaggacaagtgcttacaatctgctcaagcaattgtttttcagatattggaattcagcaaagagtgacctctctggccattctaaaactttaatgttgtgtcctaaatctggtggaggaaaagcatgcgctgttgaaccaagctgctcactggacacatatttgtgtccccaggagattatttgtcaggcactgttttttatttgtttgtttgttcatttattgttgttttactgctattggcgataacatgaaatgtgatacagctattgcccataatttaatgtgaaattaatcatgatgaattctatagcatgctactgaaatgccaaattcagctattttctttctcttctaaaatggaagtttcagttttccatatcagatgtatataagtggaattataacacaatcctatcactgacagtaatcctcagtcaccttaaataatcagtgctcacagtgctgcttacagttcatttagttggcacatataaacctgtacccacacaagactgaccaaaaattttctttgcacatttttcctttctcatagtttttttctatatttcgttaagcaaaggaaggttaatatgcctatttttcctgttaggcttttagaaattattttccatgacttttgttcttataataggttagacagtttatttttcaaaggtaaaaattgtgtttctatgcattaatgtgattgaactacaaaaacagagtgcaatatgttcaaaaaatactcaactaaactttccccctgtcatatcactgcaaaagtgtccttttaaacagagccataaagaaatttttttcaaatttctttattgcacaggcttttttcagttttacctttctgggattgaacaatgttcctttcataatgccaaagcattcccttccccagaaaaatctccttggacaactggtttaaaaacgttattaagtcataggggaggaataagcggccaaaaagtcacatttttgcattggtttacgttgcttgattagactatcttcagagagcacattatgtgtttatagctttaatttgtattatgtcaatgaaccagtgaagtgcctaaagagatgcttacaactatccagtaggacacaactgcactgctttttaaacactttttggttagttaagggtgacttgaattgtacacatacatgctaatttttgaaaacttatccatttttcatagtaaataatatagataaaattttctgttagagttcccgcaaatatttcattttagacttacttgtgatataagatttaacttttcttttgtgaaagaatcgtgaactagtgtttcatgaaatcattttcctcttccatttatcatcctcctctggtacaatatattgggttgctttcttttagattttgttccagataggaaaacaaatatgactgtatacttattaacataaggtagttctgcatttttggattccaggatcctgtttgaaatcttccatgtgaggaaaaaattactaatatttttaaagacagggtggtttatttaaagagattattcagagaacttgtgccatatctcgtctgttttattgcatatgccatatgttaacttttattcaatattacattatgtagatatgtaatacaaagaaaatatttaggagaatggcaaaacacaaatggcaacataaatgtccatttgacttacctaacttcacaactttcaagttgaggatgtcatttattcttgaatttgtttttttactagatgctttcaattaatagccctatatttttgtgcaggcgaactgtataacaggataaaaaatgatttgtatgtattgaaaaggaggagaaattctcacagaacaccatatgagctttagaccaaaaggggaaacaaggtttaagtaactaaaatggccacttagtttgtgtttatttttttccctggaaatgtaagtagttggagtttaggctatggaaatattagtgcctttaatagatctctttccttgcaaagtttctttttagctcagcattgatctatcttatcaataggaaaataagttgacttggaactataaacaaaaacaacaccatatatttatgaacctcagtgaaccagcctagaaaaattgacttctgcaggtgctaaagcacctactaatacgcagcatgcacagcatttcaggttgtgaataccattttacaacgagtttgctgttaactctctttatccaatgcaaacttgaaattctgatgcggttttccagggtggtattttttcagagtattgaatttactatttagtaatttatagtatagctttttatattaaaatgtgatatttttaaaagagatatctggttcaattggtataatgacgtgattatgcaatatgctgatctacaccttgcgctcacattgtgccaaacttaaatgtgcaagtgtacgtgagaaaagcacatgtgaatgtgaattctttaattctttgcttattatgttaaaattagtcttcatagtccactgatgtgtatgcttgaataatgtctatttactttggaatttcaagatttccagcttcaatggtaatttataatttctcagatcaccttaagaaatattgagatactctcccacctgaaaataatctgttctttaacccacctgactatgggagtagccaggcaggtgcctcactggcttcttcagacgaggcttcctcaggtggatatatgactattaggggaaaagaggcttttgagacagcttattacctccttcccctttttgaactaagtacattgtctcagtcccagtatgaatttgtcccatttggggtatttttaaaataaaagatggctaacatggaatctggggcatagccttggcctttaattatggttgtaagcccaaataatggcagagaaacacagggctgtttttacaacagaaaactcaatataagttttatataagaatcctataaaatttgaaccagagctcctatttagttgttataatgtctcctaaagatcttaaatgcttctaaaagctaattattattccagagcaactttttccttttcccccttataaagtttttttttaaatccaaaatcttagatttctgtgccacagcaaaataaaatgatcaacaattaaagatctgtacttaaaatagtacaccatttttagtggagggagggtgcatgcctatatgatggtaagattcttttgaactctaaggacaattcctcatggaaaaaataaatttcagtgcatattataaaaatgatttgcactgtgttagcaaaataaggtgttttaggttgtattttaaagacaattctaaatcatttctctggaaagcaagaccttaaattcttctctttaatagaactgcttttatgcaaagagatggtcttaacatggactaaacagtacataacaataatgtttgttatgtaaatagtatatcacatttgcttagtagcacaattcaacagcaggctgaaagtcgtggctcctctgctcagattgagttttaagttacctaatttatgtaatcagaatctattctaggtggccgtcaacgtaaactgtgtttccctattatatccctctggagactgagaatcaaattaaatagtctttcttcaaagcagtactgtaacatgaatgtatttatctcagtcaacagaacttatatgcccactgtatgtggagcttatttcaatgctaatttggcttagttagcagacctagaatctgcccaggtgagacctagaacaaaaatagctggggtgaaatggataagagaggtagaggtatatgtcaaggcagagccctatgaggaaggaagagttttcaaagaatatgaggaacatagtgctgagagtgtggctgccttcagcaccgtacacctaatctagagaaaatatttcccatgtgggaggtcctgtctgcattcagtccacccttttctgcctgcttcttcctccaagtgcctcaacctctacatgctcactctcctccccttccctcagcccatcttggtctaagcagctttcacaatccaaaccaaacatcaccagccacccgctgataagtcaccagcatttactttcctgagttactttttctccattcattgagactatggattcatcccaactccttctaaatccctcaaccatccagctatattttggctaacctttgccctagacactctaccagatgttaatgcagtatcaagtgtaaattgtgtcaccctattctgttctacccttttccctgctgccgaaatatcttgctctcctctacctcatccccaaagagcctataaattcagagtatccaaccttttcatggattcactcactgttgttcagtaatacaacttccatattttaaataaatcataaaagatttttgccttctatcaaagtaggaaactttatatttatacatgatacagaaattgaactatttctatcgttcagaatttagcatataacaggattttaaagtgattgaattgccatcctaacttggatttgtattaggttatgaatgaatactgttgttagtccaagctatttgaatgtaaagttaaaattctccagcaatccagaatgacttgtaacccttcagtggaatgggaaatttctggtatgcaaatagggtggtgttccagacatttgttttattggtggtgtttgggccttgaaacacatttctaatagaatgacatatggcaaagggtatttagatggtcctatgggatcacagaagcccatatgatttaaaatatagataaaataacacaaaattgggtacataagggtttaaccaggctttcctgggttagactaagcctctaacctctgttcctatcctgttcttatgggaggaaaaaaaatgttccatgggatgaaaagaaaatgcattgactttgtagtctttattctcctagccgcacttcgggtatatccagaaggaagaggaaatgcaaagaggaagaagatgtaatagttcttctctccagctaggtgcacttgaggttgttcataaatgtaaaattatgtcaggtttctaacatgggacactgcacacagttgtctgacctgatgaaccatcccatttgaaagtatagattattattatttcttgtagtatttggttgttttccatctcattcatgaacaactcaacctgatagtagtatccaataaatgcctttcagggctcaggaatgaattgacatcctagttaagaaatgagacttaataatggagactgaatgaggcggtttgtattaaattatatgccatgaagtgttcattttagctttaacctaattatgactgtaccaccatgaagtacagaatgaaaaattatatatatgggggggaaacagaatgaatatctgattcttttgaatgcttgtggaaatctttgagatcgtgcagggcataccacaaaatagcctttagaacagatacccaattttacagttcataggacaacatcaaacattagtaagtctaaataagatgaatagaatttttgttatgtaaattttgctagaacagtctattttcttgcacccctcaagttaacctcttaaaaaaatgaatgtataatttctaccgaaagaatatcagagagaatctctctggcctatagtgttaaaatattgttcacaaatcctgattagttaagtgcatacattatgaaacttacagaataaaacttattatacatctctttcttaaattaatatctttacacattttcaactggctccccaagtctgataaggaaggattaaaagaaaaaagaaatgtattagttgggtggccaaggagtttcctttgtaatgttgagagacttccgctttctgaatttcgctggttctctaaggtaaaagagttaaatagtacccttgttcaccaaggaaagtgatccaaactatatatctagtgcagatatttcctttgcattatttagtcttctctggagagaaaatacagtttccccttcctctttctcttcacatttactcttttcaacccaaaataagagacatagaaagcaaaccacagccagtttggcatcttctcagtgctactagtataggcacatacacatacacagtctcagcaaggttataaagaaccctgtcaggtccacttgcaacatggccttgctacttggattagctcctttaagcctgaaaataactttcctggtcatggaagaactggacgcatcttttaacttatgaaatagaagttgaacttgaaaactctttttaaaaaatcctggttttgcaggacagctacataatgaatgtatatattaagactgtagctgaattgcacatgaaatcagattgccaacttcttgactttcaatgttagacatttatccttaagttgtgagcgatatatgtagcatgctgtgaaatgtctgttatagctctttaattcatcagtattaatacagaattatcatttgcgtttcttggtactttttattcaatgtaatcagaagctgtgatgttttgcctttgtagtcctgtgctttgttactgtaattttttttttttttttacgaagcacgtgactggactaatgtaaggcagatgacgtgatctttaagactgctatatatatcagtctcttactctataaggttttaaattagaataagcttttatcaaatagataattgatgcaatttaggattcacgcaagtttcagtgtcaaatggcggtcttatagtttcaattctgaaaatagcaaacttaataaacagccactttaaacttgttctggcaaaccagaccctgctgtagatatagtctaaggtagttaaccatataagccttttcaactcttaatgccctccacatgaatcagcagttaagaaggttctagaacccatgaaagcttttgtatgtattactaggttttgtttttcttatgtttgctgattttacagttctgactaaagctgacctaaatggatcagtttatgtgtaatattctagtgctttaatgactctttttttctttggagggagggtaacattatttggacagatgcagaaggaactgttagtgagtcaagacaaacacatctgaaataaaggaactgtgtattaacatgttaacaattcataactgcactttttatgacattttgaaaatctatttataggtacagaacaatgggttttgttaaactgtatcacatttatacttgcagaaatttatttcattgttattagtaggaattttattggttcaataaaattggcaaaactgaacaccaa

SEQ ID NO: 2087 - DNA, 1330 bp, Homo sapiens
ggcggacggcggggtccgggccggagtacgtcgttcccgctgcgctaggggaagcgggcagtcagaaaaatgggtaagaagagtcgagtaaaaactcagaaatctggcactggtgctacagcaactgtgtcaccaaaggaaatcttgaacctgaccagtgagctgctgcagaaatgcagcagtccggcgcctggcccaggaaaagagtgggaagagtatgtgcagatccggactctggttgagaaaatacggaaaaagcaaaaaggtctgtccgttacttttgatggaaaaagagaagattactttcctgatctaatgaaatgggcctctgaaaatggggcttctgtcgagggttttgaaatggttaacttcaaagaagagggctttggtttgagagcaacaagagatatcaaggcagaagaattgtttttatgggttccacgaaaattgctaatgactgttgaatctgctaaaaattcagtgttggggcccttatattctcaagaccgaatccttcaagccatgggaaacatcgcactggcctttcatttgctgtgtgagcgagccagccctaactccttctggcagccctatattcaaaccctccccagtgaatatgacactcctctctactttgaagaagatgaagttcggtatcttcagtccacacaagctatacatgatgtcttcagccagtataaaaacacagctcgacagtacgcctacttctataaagtcatccagacccatcctcatgccaacaaactacccttgaaggattctttcacttacgaggactacaggtgggcagtctcttctgttatgacgaggcaaaaccaaattcccacagaggatggttcccgcgtgaccctggctctgattcctttatgggatatgtgtaaccacaccaacggcctgacaccagaagattccttcgctcttgctgtcgcctctgcctaagaccctccattccttaggcacttacgggactcactcatagacctcctccagcgtggctgccctgagcaccctatgtggaatgactacgcctccagctcatccgccctcctgccctgtcctgttacatttccctctattgtccagatccgcttgtttctgcctttttaaaaaattattgttggttcacccccccgcctcccattagaatggaagatccatgaacgcagggtgattttgggggagggtctgttttgctcattgctatatcgctgtggtttttaatgaattcatgaccggtaaataaatgactgtaaaagccccatgcctaggaaaaaagatcagaaagaaataaaccaaaatgttaacgtga

SEQ ID NO: 2088 - DNA, 2878 bp, Homo sapiens
cgcggtcgcggggccgtctcaggctgccgtcccgcccctcccgtccggccgccgccgccgccaccgccgccaccgcctgggggttggttgaggcggacggcggggtccgggccggagtacgtcgttcccgctgcgctaggggaagcgggcagtcagaaaaatgggtaagaagagtcgagtaaaaactcagaaatctggcactggtgctacagcaactgtgtcaccaaaggaaatcttgaacctgaccagtgagctgctgcagaaatgcagcagtccggcgcctggcccaggaaaagagtgggaagagtatgtgcagatccggactctggttgagaaaatacggaaaaagcaaaaaggtctgtccgttacttttgatggaaaaagagaagattactttcctgatctaatgaaatgggcctctgaaaatggggcttctgtcgagggttttgaaatggttaacttcaaagaagagggctttggtttgagagcaacaagagatatcaaggcagaagaattgtttttatgggttccacgaaaattgctaatgactgttgaatctgctaaaaattcagtgttggggcccttatattctcaagaccgaatccttcaagccatgggaaacatcgcactggcctttcatttgctgtgtgagcgagccagccctaactccttctggcagccctatattcaaaccctccccagtgaatatgacactcctctctactttgaagaagatgaagttcggtatcttcagtccacacaagctatacatgatgtcttcagccagtataaaaacacagctcgacagtacgcctacttctataaagtcatccagacccatcctcatgccaacaaactacccttgaaggattctttcacttacgaggactacaggtgggcagtctcttctgttatgacgaggcaaaaccaaattcccacagaggatggttcccgcgtgaccctggctctgattcctttatgggatatgtgtaaccacaccaacggcctgatcactactggttacaacctggaagatgaccgctgtgagtgtgtggctctgcaggattttcgggctggagagcagatttacattttttatggcactcgatccaacgcagagtttgtgatccacagtggttttttctttgacaataactcacacgacagagtgaaaataaagcttggagtgagtaaaagtgacagactctacgccatgaaggccgaggtcttggctcgtgccggcatccccacttccagtgtttttgcattgcattttaccgagccgcccatctctgctcagcttttggcttttctccgagtattctgtatgactgaagaagaactgaaagaacacttgctgggagacagcgctattgatagaatcttcaccttggggaactcggaatttcctgttagctgggacaacgaggtcaaactttggacatttcttgaagatagagcctcacttcttttaaaaacatataaaacaactattgaggaagataaatccgtcttgaaaaaccacgatctttctgttcgtgcaaaaatggccatcaaattgcgcttaggtgagaaagagattttggaaaaagcagtaaagagtgcagctgtcaaccgggaatactatcgccaacagatggaggaaaaggctccgcttcccaaatatgaagagagtaaccttgggctgttggagagcagcgtgggggactcgaggctccccctggtcttgagaaacctcgaggaggaggctggagtgcaggatgccttgaacatcagagaggcaatcagcaaagcaaaggccacagaaaacgggcttgtaaacggtgaaaactctatccctaatgggaccaggtccgaaaatgaaagtctcaatcaagaaagtaaaagagcagttgaagacgccaaaggatcttcttcagacagcactgctggagttaaggagtagctcgaggtgaagctggatgggggatccagtggagcaggagttgacggacagtccgttcacatcgctgtgtttccttgttaacatttttctttctgcagagaggaagatatgtttttgctgctttatataaaaatggtttttttaagttattttaaaaatctagcttccctttttgattaagattgccatcttgcttttaggcaaaacaaaccaattaacaaacaaccacaagaaagggagaagaggtgcctgtgggagattttgcagacctattgtgggtataggtattttcttcctggggaagaattcagttcccgtctcagctgtacttttgtgggcctgtcatcttgatgaccagaatgaaagcttgctctgcctcctgccagccagaattggtggcgggacttggggatacagcgtgaaggtggggaagttgcacagcagaaaacagaattgaagttgggaaactctagagtctgggcaaaatgtttggttttttctcttaaaaaaaataacaccccattaccaaaagaaaaggtaaggtggcaaccttatttttaatagtttgaaatgatgataatcctaattatataaaaatatatatataaacacacatatatatagtgatttctaaagatttgtttacttttgtgttttgttttactgtactaagaacttgtcctttctccttgaatcaaagtaggacatgcatcatcctcctaattttaaatgttggctctgattttaaagtggtgcatttgattccagccttggtaatggagagtttgcaaacacacagcggcccacagcttcacgtggtggtgtgcagtgtgaggcagctccttggctttcctggttttcacaacaagctagagattttcaaagctacacttttgagtaaaaacccttattaaaagaaaaacatgattaata

SEQ ID NO: 2089 - DNA, 1553 bp, Homo sapiens
ggaagtgaccgcgcggtgcgccggcccgcgaggaaacgcgctcttagaccatggcgacccaggcgaagcgtccacgggtggcggggcccgtggacggcggcgacctggatcctgtggcctgcttcctgagctggtgccggcgggtggggctggagctgagtcccaaggtgagcgagcgagccggcgggcggaggacccgcggcggggcgcgggctgccctgaccagccctcctgctcaggtggcggtcagccggcagggcacggtggccggctacggcatggtggcccgggagagcgtgcaggccggagagctgttgttcgtggtgccgcgggccgcgctcctgtcgcagcacacctgctccatcggcggcctgctggagcgagagcgagttgcgctgcagagccagtcgggctgggtgccactgctgctggcgctgctccacgagctgcaggccccggcctcacgctggaggccctactttgcgctctggcccgagctgggccgcttggagcacccgatgttctggccagaggaggagcgccggtgcctgctccagggcacaggcgtacctgaggccgtggagaaggatttggccaacatccgcagcgagtaccagtccatcgtgctgcccttcatggaagcccaccccgatctcttcagcctcagggttcgctccctagaactctaccaccagctggtggcccttgtgatggcctatagctttcaggaaccactggaggaagaagaggatgaaaaggagcccaactcccccgtgatggtgcctgctgcagacatactaaaccacttagccaatcacaacgccaatctagaatactctgcgaattgtcttcggatggtagccactcagcccattcctaaaggccatgagattttcaacacttatgggcaaatggctaactggcaactgattcatatgtacggttttgttgaaccatatcctgacaacacagatgacacagctgacattcagatggtgacagttcgtgaggcagcattacagggaacaaaaactgaagctgaaaggcacctagtgtacgagcgctgggatttcctatgcaaactggagatggtaggggaagagggagcctttgtgatagggagggaggaggtgctgactgaagaggagctgaccaccacactaaaggtactgtgcatgcctgctgaggagttcagagagcttaaagaccaggatggagggggagatgataaaagggaagagggcagcctgacgatcacaaatattcccaagctcaaagcatcgtggagacagctgcttcaaaacagtgttctactgactttgcagacctatgccacagacttaaaaactgaccaaggtttactcagtaataaggaagtctatgcgaaactcagctggagggaacagcaagccttacaggttcgctatggtcagaagatgatcttacatcagttgttggagctgacaagttagcagtttccctgttccctgaaggaacagcaataagaactttattctaagctaatactcattgatgtttgaaaaagaggaaaa

SEQ ID NO: 2090 - DNA, 2042 bp, Homo sapiens
agagacgccggaagtgaccgcgcggtgcgccggcccgcgaggaaacgcgctcttagaccatggcgacccaggcgaagcgtccacgggtggcggggcccgtggacggcggcgacctggatcctgtggcctgcttcctgagctggtgccggcgggtggggctggagctgagtcccaaggtggcggtcagccggcagggcacggtggccggctacggcatggtggcccgggagagcgtgcaggccggagagctgttgttcgtggtgccgcgggccgcgctcctgtcgcagcacacctgctccatcggcggcctgctggagcgagagcgagttgcgctgcagagccagtcgggctgggtgccactgctgctggcgctgctccacgagctgcaggccccggcctcacgctggaggccctactttgcgctctggcccgagctgggccgcttggagcacccgatgttctggccagaggaggagcgccggtgcctgctccagggcacaggcgtacctgaggccgtggagaaggatttggccaacatccgcagcgagtaccagtccatcgtgctgcccttcatggaagcccaccccgatctcttcagcctcagggttcgctccctagaactctaccaccagctggtggcccttgtgatggcctatagctttcaggaaccactggaggaagaagaggatgaaaaggagcccaactcccccgtgatggtgcctgctgcagacatactaaaccacttagccaatcacaacgccaatctagaatactctgcgaattgtcttcggatggtagccactcagcccattcctaaaggccatgagattttcaacacttatgggcaaatggctaactggcaactgattcatatgtacggttttgttgaaccatatcctgacaacacagatgacacagctgacattcagatggtgacagttcgtgaggcagcattacagggaacaaaaactgaagctgaaaggcacctagtgtacgagcgctgggatttcctatgcaaactggagatggtaggggaagagggagcctttgtgatagggagggaggaggtgctgactgaagaggagctgaccaccacactaaaggtactgtgcatgcctgctgaggagttcagagagcttaaagaccaggatggagggggagatgataaaagggaagagggcagcctgacgatcacaaatattcccaagctcaaagcatcgtggagacagctgcttcaaaacagtgttctactgactttgcagacctatgccacagacttaaaaactgaccaaggtttactcagtaataaggaagtctatgcgaaactcagctggagggaacagcaagccttacaggttcgctatggtcagaagatgatcttacatcagttgttggagctgacaagttagcagtttccctgttccctgaaggaacagcaataagaactttattctaagctaatactcattgatgtttgaaaaagaggaaaatttggatctttcttttgcttactaaacaccaagaggaaaagtagcaaagttggtgtgctaggattaactcaggtaagggtgatgtgttttaggattgagaacagcagacttgggaatcactgctaattgttacttaaagcatgttacagatgttttgttctcagttttaaccaaagccagtggacatacggtagtaataagtaagtcttgttgtgtttcagcatttaataatagactttggaggtagacccctggtttaaatctaagtctagtttgaggaagtcacttaacctttattgaaaagactctggatttaataagctgtgtaactggtactcgatagttacccaaagttcagtctagatggcacaaaccacctctcagggaataaaccctaagacatcactcaaggaggacttcaattatttaattttgaactgttttgtcctctctggccataaaacttgacagtcatgaaaggtaaggcaaattttaagtgggttaagtttttaaatacgtatctactcattttctttaaaaaaaaaaaaaaaa

SEQ ID NO: 2091 - DNA, 438 bp, Homo sapiens
gaggaaacgcgctcttagaccatggcgacccaggcgaagcgtccacgggtggcggggcccgtggacggcggcgacctggatcctgtggcctgcttcctgagctggtgccggcgggtggggctggagctgagtcccaaggtgagcgagcgagccgcgggccgcgctcctgtcgcagcacacctgctccatcggcggcctgctggagcgagagcgagttgcgctgcagagccagtcgggctgggtgccactgctgctggcgctgctccacgagctgcaggccccggcctcacgctggaggccctactttgcgctctggcccgagctgggccgcttggagcacccgatgttctggtgagagccttgggaggggttggggagcgcctgcaccgtagcctgctgcaagaatttccccgcccctgcaccagtcctacccagtaa

SEQ ID NO: 2092 - DNA, 4030 bp, Homo sapiens
aagccgggctggagcggagtgtctcagaggctgcgctccttccagggcccaaggactcacagcttcctccgctgccttcccggaccaacaaccccccaaaagttgtgatgcttttctttacccagtgctttggggctgtattagatctcattcatctccggtttcagcactacaaggctaaacgggttttctccgctgccgggcaacttgtctgtgtcgtcaaccccacacacaacctaaagtatgtgtccagtcggcgcgccgtcactcagagcgctccagagcaaggcagcttccaccctcaccatctctcccaccaccactgccaccaccgccaccaccaccacctccgccaccacgcccacccccaccaccttcaccaccaggaggcggggctgcacgccaacccggtgacgccctgcctgtgcatgtgtcccttgttctcctgccagtgggaaggccgcctggaggtggtggtgccccacctgcggcagatccatagggttgacatcctccagggagccgagatcgtcttcctggccacggacatgcacctccccgcgccggctgattggatcatcatgcactcctgccttggccaccactttctgttggtgctgaggaaacaggagaggcatgaagggcacccccagttctttgccaccatgatgctgattgggacccccacccaggccgactgcttcacctatcgcctggagctcaacagaaaccatcggcgcctcaagtgggaggccacgccccggtctgttcttgagtgcgtggactcggtgattacggacggggactgcctcgtcctcaacacctcgctggcacagctcttctctgacaacggcagccttgccattgggattgccatcaccgcgacagaggtcctcccctcagaagctgaaatgtgaggccaggagccacggatgctccccacacagcctccctaggaaacgcctgggacctcccaataccaggactccagactcctttttattcttctcctttcttttttttttttttaatttttaattattattatttttttgtctcaggtactttgtgagatttagtttttgtctgccatgggcattatattatgtaaacatcctgtaatttaagatcttggtgtgatgtttgtcctgccttgttggtgttgttttatagaatgtttgtaagatttattcagaatagttttttcctgtcacctccaagtcctttctccgctagttttgaaaggatcaaaacaccatcaagcagactgttggggttgaaaggaggcttcgtgtgagaatcatttcttgtttctcttttcagtctatttcagagcaagctaaatctgaacgtgtgcagtcggcaggttggggaaggggcccagctcagagatggatcacatttcagaccatccagacatgactctgacagcttcccaggaacctcaaggtcaaagctgagctagccgggcatgaggagatcgtgtctccaccgcagggctggggactgggctagaggtgtcattgtgtgctgagtgctcaggttgatgctggggctcaggagagtagtcagaggcccaccttcctgtgacgggctcttgtcaccttgttcccaggctgtgccgtcttctcctgctctggaatcaaagtcctcagatttttgatgctttcttaaaaacccctttgccttctgttgagcaagtagtagaaaagaataggcaagatggggggtggggatgaaaagcaacaggaaaaagagaacataaaattaatctcccatctctgagagggcactccctcctcagagagttttattatcaagttataaaatccatcagttcctccctagggtgcagttctttcatatcatgcaaaaagcagaaccaggactcatcatcaaatgcaaagaactcagagggtggcacccaggatctctgacctggcgggctggtcatcacttacaaacctgggaggctctcttccctttcctcactttctaaaatgctcctaccgtcccattcagcacgcagacgtgaccacggctcaagtatgtattcagcacctgttgcagtatgaatgacacagtgacggaaatccatatttcctctgcgcaggctgctttctcttatttggttgtcagaacaattcatcaacatcttcttgtagaagtctctcgtgtatttgaagaaagtcagcatgtttagtcaactttgtcttttctgttctaagttggacacctataagccttcccagtaggacctcttctagctcctttttatcgcatttgtcccccccctctggctgctctccagacactgcagaagtcaggcaccccatccccagcacattcccatgacagccaaatgggcctttggccaaccagacattactctccgtgccctgttcctgcacctcaccccctcggcttggtcctggcaggcatccaagtgactacttagtctcaggcaggttgccctggctggccatctgcaattttttctccaccaaaaataactgatcctgaaacacaacacccttcccccaacaactgggttaattctccagccacttttggtgccaacttacacccccacgcaccagaagggaggtgccagtcgatacaagatttaataacagaggctgctctggtcacacagtaatcgctgggcccctggggctgagactgcattccgtcagagccctgagaggggcaaaaaacattgccacagatggaggcacatgtcagatgctgcagtcgcaaaaaaggattggggcctgcgcattctttgagctctcagatgccctgccagggcaccagccaccctcctccaatcacacagatgcccaagaacacctgaggctggtccgtctgtgcgtggaaagactggctgtcttcctcctcactgcatccccaatccccttcccagaacctaagacccccttggctgtaagtcttatgcctttagaagccacaggtcctctcctggtttttgagactcaaccactttgaaagcatttgtgtagcatcacaggtgctccagatcaacaaacaaaaacctcactaagaatataactaacattcacagggccttagggctcctgcagacatcacctttgccttctggttgtgccaagttacctgagccacactgggaatgacttcaggttattttcactgcacacaagactgtattatgaataagtgatcccagatgggagcttatatttttgttcctagaaagctttaggacaaagcatgggaaatgtattattatcttccatctatggtgctccccaaaaggcctctccatatccatatgtgaagaactggagaagaaggagcaaactaacaaccaagaattgggaataggaaatggtaccagcagtttgtatttgagcttcacagttcctgaagggctctttgatttgagtctcaggttaatcctcattagtatcctcaatatactaacagaatagaggttctaagacatgaagtgatcttttcaaggtcacacatcaggtggttagaccacaaccaaaacccagatcaactgactgcaaacttggtgttcttgaagtaagactgatccgaaatattcagcagtcttgccagcttaccagtggactgaggacctgagaatcaactgagtctttgtcctgggatagttgagggagcagggagagaaagactggagtagatttgcttttagaagcatctctgctttaagaactaggccagggatggtggctcacgtccataatcccaggactttgggaggccaaggaaggaggattgcttgagctcaggagtttgagaccagcctgggcaatatagcgagacttcatttctacaaaaaaaaaaatcagctgggcatggtgacacaagcctatagtcttaactactcggaggccaagacagggggatggcttgagcccaggaggttgaggtcacagtgagctgtgattgcaccacttgtaactccagcctgggcaacagagtgagaccctatctctttagaaaaaaaaaaaaa

SEQ ID NO: 2093 - DNA, 3275 bp, Homo sapiens
aagctgctgacatcctggatctagggttgtaaagaagattacatgagctaatggatgtgaaaacatcttaaaaactctcaaatacttttcaactttggaggattattatgattttcattctgttcagcggctatactcagactttactctaaaagtcaaatcttctgacattctttgaagtgaagcattctatgaatgtgagctgaagaaatgaatgaaatgaaataatgcagcatctagtgctttttgcatggcccaaaggggctctgtgctgctccactacagaggaaacttcaagaaatgctggtttgctacagtgttttagcttgtgagattctctgggaccttccctgctccatcatggggtcacctctaggtcattttacctgggacaaatacctaaaagaaacatgttcagtcccagcgcctgtccattgcttcaagcagtcctacacacctccaagcaacgagttcaagatcagtatgaaattggaagcacaggaccccaggaacaccacatccacctgtattgccacagtagttggactgacaggtgcccgccttcgcctgcgccttgatgggagcgacaacaaaaatgacttctggcggctggttgactcagctgaaatccagcctattgggaactgtgaaaagaatgggggtatgctacagccacctcttggatttcggctgaatgcgtcttcttggcccatgttccttttgaagacgctaaatggagcagagatggctcccatcaggattttccacaaggagccaccatcgccttcccacaacttcttcaaaatgggaatgaagctagaagctgtggacaggaagaaccctcatttcatttgcccagccactattggggaggttcggggctcagaggtgcttgtcacttttgatgggtggcgaggggcctttgactactggtgccgcttcgactcccgagacatcttccctgtgggctggtgttccttgactggagacaacctgcagcctcctggcaccaaagttgtgattccaaagaatccctatcctgcctccgatgtgaatactgagaagcccagcatccacagcagcaccaaaactgtcttggaacatcaaccagggcagagggggcgtaaaccaggaaagaagcggggccggacacccaagaccctaatttcccatcccatctctgccccatccaagacagctgaacctttgaaattcccaaagaagagaggtcccaaacctggcagcaagaggaaacctcggactttgctgaacccaccacctgcctcaccaacaaccagcactcctgaaccggataccagcactgtaccccaggatgctgccaccatccccagctcagccatgcaggccccaacagtttgtatctacttgaacaagaatggcagcacaggcccccacttagataagaagaaggtccagcaactccctgaccattttggaccagcccgtgcctctgtggtgttgcagcaggctgtccaggcctgtatcgactgtgcttatcaccagaaaaccgtcttcagcttcctcaagcaaggccatggtggtgaggttatctcagccgtgtttgaccgggaacagcataccctcaacctcccagcagtcaacagcatcacctacgtcctccgcttcctggagaaactctgccacaaccttcgtagtgacaatctgtttggcaaccagccctttacacagactcacttgtcactcactgccatagagtacagccacagccacgacaggtacctaccaggtgaaacctttgtcctggggaatagtctggcccgctccttggaaccacactcagactcaatggactctgcctcaaatcccaccaaccttgtcagcacctcccaaaggcaccggcccttgctttcatcctgtggcctcccaccaagcactgcctcagctgtgcgcaggctatgctccaggggagtgttaaaaggatcaaatgaaagaagggatatggaatcattttggaaactaaatcgttccccagggtcggaccgatacctggagagccgcgatgcctctcgactgagtggccgggacccctcctcatggacagtcgaggatgtgatgcagtttgtccgggaagctgatcctcagcttggaccccacgctgacctgtttcgcaaacacgagatcgatggcaaggccctgctgctgctgcgcagtgacatgatgatgaagtacatgggcctgaagctggggcctgcactcaagctctcctaccacattgaccggctgaagcagggcaagttctgaaccaggagaggcagcctagacaaccaagtggcagcaggtgggggcattcttctaggaatgaggggcatcagcccaccccaggcacctcagtggggttccgggccacctcaggactccaagaggctgtgtggagccaccactcctagccacagctgccatgataagtccttccatgaaggactgaggagggagagtgggggtccagggctggtgctgctcttccctcagctctgccggggctctaaggtccctctatttatttctcaaccctggctggcctctcaccaggagtttaggctgaatgccttccacgtgatggaggaaaaggccaactctgtcctggtcttgctgtggcaccccatcgccccacagctcgtaccttctcaccagattcccctgaatccaaactcgtggtgcaaacctctaccttttttacaaaaagatcttattgttaatttattgtttctggcacttgggcaaaccctgtagttaatactcctcccacactagacactgggtttcaggaggagggagactgccctgctttggtcccagagaggccctctgcagataggcgtggcccctcttcagaggacactaccctagggcactttctctttgaggtggagagacccataaagccttgaccacatcactccatatggggaggagaaggatccctgtcaccttctcctctcttcacggggcccttttgcagccctaggcctcatctgtgggaagggagtccctggcttatactgcccccaccacagctccttgccctggccagaactgctgtcgaagaaaatcaggccggaaggccaagaaggcgctaagggggatgggagggcaggttttccaggctggagtcggttccacccactcgcctgtccacaggcttccttgtaagcaagtcagcagcacagctactcacgctgccatctggacttattttatgtcaatctgtttataaataaaaaccaatatagata

SEQ ID NO: 2094 - DNA, 3108 bp, Homo sapiens
acatggcggcgggaagagagtgagccgccccgcgcccccgccgcgccctcagatggagaaattagcatacaaagaaactgacttgtcagaagtcagagcaaggtattggtggatccagggataaatcccaaacttcttaacccctagaccggtttttagtccattgactatgcagcctaatgtgatagactggagtgatgttagaaaacacaaatatggtcacctatcagagtctgcatcccaatatcaagaagctgctgacatcctggatctaggtcattttacctgggacaaatacctaaaagaaacatgttcagtcccagcgcctgtccattgcttcaagcagtcctacacacctccaagcaacgagttcaagatcagtatgaaattggaagcacaggaccccaggaacaccacatccacctgtattgccacagtagttggactgacaggtgcccgccttcgcctgcgccttgatgggagcgacaacaaaaatgacttctggcggctggttgactcagctgaaatccagcctattgggaactgtgaaaagaatgggggtatgctacagccacctcttggatttcggctgaatgcgtcttcttggcccatgttccttttgaagacgctaaatggagcagagatggctcccatcaggattttccacaaggagccaccatcgccttcccacaacttcttcaaaatgggaatgaagctagaagctgtggacaggaagaaccctcatttcatttgcccagccactattggggaggttcggggctcagaggtgcttgtcacttttgatgggtggcgaggggcctttgactactggtgccgcttcgactcccgagacatcttccctgtgggctggtgttccttgactggagacaacctgcagcctcctggcaccaaagttgtgattccaaagaatccctatcctgcctccgatgtgaatactgagaagcccagcatccacagcagcaccaaaactgtcttggaacatcaaccagggcagagggggcgtaaaccaggaaagaagcggggccggacacccaagaccctaatttcccatcccatctctgccccatccaagacagctgaacctttgaaattcccaaagaagagaggtcccaaacctggcagcaagaggaaacctcggactttgctgaacccaccacctgcctcaccaacaaccagcactcctgaaccggataccagcactgtaccccaggatgctgccaccatccccagctcagccatgcaggccccaacagtttgtatctacttgaacaagaatggcagcacaggcccccacttagataagaagaaggtccagcaactccctgaccattttggaccagcccgtgcctctgtggtgttgcagcaggctgtccaggcctgtatcgactgtgcttatcaccagaaaaccgtcttcagcttcctcaagcaaggccatggtggtgaggttatctcagccgtgtttgaccgggaacagcataccctcaacctcccagcagtcaacagcatcacctacgtcctccgcttcctggagaaactctgccacaaccttcgtagtgacaatctgtttggcaaccagccctttacacagactcacttgtcactcactgccatagagtacagccacagccacgacaggtacctaccaggtgaaacctttgtcctggggaatagtctggcccgctccttggaaccacactcagactcaatggactctgcctcaaatcccaccaaccttgtcagcacctcccaaaggcaccggcccttgctttcatcctgtggcctcccaccaagcactgcctcagctgtgcgcaggctatgctccagggggtcggaccgatacctggagagccgcgatgcctctcgactgagtggccgggacccctcctcatggacagtcgaggatgtgatgcagtttgtccgggaagctgatcctcagcttggaccccacgctgacctgtttcgcaaacacgagatcgatggcaaggccctgctgctgctgcgcagtgacatgatgatgaagtacatgggcctgaagctggggcctgcactcaagctctcctaccacattgaccggctgaagcagggcaagttctgaaccaggagaggcagcctagacaaccaagtggcagcaggtgggggcattcttctaggaatgaggggcatcagcccaccccaggcacctcagtggggttccgggccacctcaggactccaagaggctgtgtggagccaccactcctagccacagctgccatgataagtccttccatgaaggactgaggagggagagtgggggtccagggctggtgctgctcttccctcagctctgccggggctctaaggtccctctatttatttctcaaccctggctggcctctcaccaggagtttaggctgaatgccttccacgtgatggaggaaaaggccaactctgtcctggtcttgctgtggcaccccatcgccccacagctcgtaccttctcaccagattcccctgaatccaaactcgtggtgcaaacctctaccttttttacaaaaagatcttattgttaatttattgtttctggcacttgggcaaaccctgtagttaatactcctcccacactagacactgggtttcaggaggagggagactgccctgctttggtcccagagaggccctctgcagataggcgtggcccctcttcagaggacactaccctagggcactttctctttgaggtggagagacccataaagccttgaccacatcactccatatggggaggagaaggatccctgtcaccttctcctctcttcacggggcccttttgcagccctaggcctcatctgtgggaagggagtccctggcttatactgcccccaccacagctccttgccctggccagaactgctgtcgaagaaaatcaggccggaaggccaagaaggcgctaagggggatgggagggcaggttttccaggctggagtcggttccacccactcgcctgtccacaggcttccttgtaagcaagtcagcagcacagctactcacgctgccatctggacttattttatgtcaatctgtttataaataaaaaccaatatagata

SEQ ID NO: 2095 - DNA, 2906 bp, Homo sapiens
ttaatcttatactttctttccacatgactatttttctctccctctgcagtgatagactggagtgatgttagaaaacacaaatatggtcacctatcagagtctgcatcccaatatcaagaagctgctgacatcctggatctagtcctacacacctccaagcaacgagttcaagatcagtatgaaattggaagcacaggaccccaggaacaccacatccacctgtattgccacagtagttggactgacaggtgcccgccttcgcctgcgccttgatgggagcgacaacaaaaatgacttctggcggctggttgactcagctgaaatccagcctattgggaactgtgaaaagaatgggggtatgctacagccacctcttggatttcggctgaatgcgtcttcttggcccatgttccttttgaagacgctaaatggagcagagatggctcccatcaggattttccacaaggagccaccatcgccttcccacaacttcttcaaaatgggaatgaagctagaagctgtggacaggaagaaccctcatttcatttgcccagccactattggggaggttcggggctcagaggtgcttgtcacttttgatgggtggcgaggggcctttgactactggtgccgcttcgactcccgagacatcttccctgtgggctggtgttccttgactggagacaacctgcagcctcctggcaccaaagttgtgattccaaagaatccctatcctgcctccgatgtgaatactgagaagcccagcatccacagcagcaccaaaactgtcttggaacatcaaccagggcagagggggcgtaaaccaggaaagaagcggggccggacacccaagaccctaatttcccatcccatctctgccccatccaagacagctgaacctttgaaattcccaaagaagagaggtcccaaacctggcagcaagaggaaacctcggactttgctgaacccaccacctgcctcaccaacaaccagcactcctgaaccggataccagcactgtaccccaggatgctgccaccatccccagctcagccatgcaggccccaacagtttgtatctacttgaacaagaatggcagcacaggcccccacttagataagaagaaggtccagcaactccctgaccattttggaccagcccgtgcctctgtggtgttgcagcaggctgtccaggcctgtatcgactgtgcttatcaccagaaaaccgtcttcagcttcctcaagcaaggccatggtggtgaggttatctcagccgtgtttgaccgggaacagcataccctcaacctcccagcagtcaacagcatcacctacgtcctccgcttcctggagaaactctgccacaaccttcgtagtgacaatctgtttggcaaccagccctttacacagactcacttgtcactcactgccatagagtacagccacagccacgacaggtacctaccaggtgaaacctttgtcctggggaatagtctggcccgctccttggaaccacactcagactcaatggactctgcctcaaatcccaccaaccttgtcagcacctcccaaaggcaccggcccttgctttcatcctgtggcctcccaccaagcactgcctcagctgtgcgcaggctatgctccagggggtcggaccgatacctggagagccgcgatgcctctcgactgagtggccgggacccctcctcatggacagtcgaggatgtgatgcagtttgtccgggaagctgatcctcagcttggaccccacgctgacctgtttcgcaaacacgagatcgatggcaaggccctgctgctgctgcgcagtgacatgatgatgaagtacatgggcctgaagctggggcctgcactcaagctctcctaccacattgaccggctgaagcagggcaagttctgaaccaggagaggcagcctagacaaccaagtggcagcaggtgggggcattcttctaggaatgaggggcatcagcccaccccaggcacctcagtggggttccgggccacctcaggactccaagaggctgtgtggagccaccactcctagccacagctgccatgataagtccttccatgaaggactgaggagggagagtgggggtccagggctggtgctgctcttccctcagctctgccggggctctaaggtccctctatttatttctcaaccctggctggcctctcaccaggagtttaggctgaatgccttccacgtgatggaggaaaaggccaactctgtcctggtcttgctgtggcaccccatcgccccacagctcgtaccttctcaccagattcccctgaatccaaactcgtggtgcaaacctctaccttttttacaaaaagatcttattgttaatttattgtttctggcacttgggcaaaccctgtagttaatactcctcccacactagacactgggtttcaggaggagggagactgccctgctttggtcccagagaggccctctgcagataggcgtggcccctcttcagaggacactaccctagggcactttctctttgaggtggagagacccataaagccttgaccacatcactccatatggggaggagaaggatccctgtcaccttctcctctcttcacggggcccttttgcagccctaggcctcatctgtgggaagggagtccctggcttatactgcccccaccacagctccttgccctggccagaactgctgtcgaagaaaatcaggccggaaggccaagaaggcgctaagggggatgggagggcaggttttccaggctggagtcggttccacccactcgcctgtccacaggcttccttgtaagcaagtcagcagcacagctactcacgctgccatctggacttattttatgtcaatctgtttataaataaaaaccaatatagatacc

SEQ ID NO: 2096 - DNA, 3115 bp, Homo sapiens
ttaatcttatactttctttccacatgactatttttctctccctctgcagtgatagactggagtgatgttagaaaacacaaatatggtcacctatcagagtctgcatcccaatatcaagaagctgctgacatcctggatctagggttgtaaagaagattacatgagctaatggatgtgaaaacatcttaaaaactctcaaatacttttcaactttggaggattattatgattttcattctgttcagcggctatactcagactttactctaaaagtcaaatcttctgacattctttgaagtgaagcattctatgaatgtgagctgaagaaatgaatgaaatgaaataatgcagtcctacacacctccaagcaacgagttcaagatcagtatgaaattggaagcacaggaccccaggaacaccacatccacctgtattgccacagtagttggactgacaggtgcccgccttcgcctgcgccttgatgggagcgacaacaaaaatgacttctggcggctggttgactcagctgaaatccagcctattgggaactgtgaaaagaatgggggtatgctacagccacctcttggatttcggctgaatgcgtcttcttggcccatgttccttttgaagacgctaaatggagcagagatggctcccatcaggattttccacaaggagccaccatcgccttcccacaacttcttcaaaatgggaatgaagctagaagctgtggacaggaagaaccctcatttcatttgcccagccactattggggaggttcggggctcagaggtgcttgtcacttttgatgggtggcgaggggcctttgactactggtgccgcttcgactcccgagacatcttccctgtgggctggtgttccttgactggagacaacctgcagcctcctggcaccaaagttgtgattccaaagaatccctatcctgcctccgatgtgaatactgagaagcccagcatccacagcagcaccaaaactgtcttggaacatcaaccagggcagagggggcgtaaaccaggaaagaagcggggccggacacccaagaccctaatttcccatcccatctctgccccatccaagacagctgaacctttgaaattcccaaagaagagaggtcccaaacctggcagcaagaggaaacctcggactttgctgaacccaccacctgcctcaccaacaaccagcactcctgaaccggataccagcactgtaccccaggatgctgccaccatccccagctcagccatgcaggccccaacagtttgtatctacttgaacaagaatggcagcacaggcccccacttagataagaagaaggtccagcaactccctgaccattttggaccagcccgtgcctctgtggtgttgcagcaggctgtccaggcctgtatcgactgtgcttatcaccagaaaaccgtcttcagcttcctcaagcaaggccatggtggtgaggttatctcagccgtgtttgaccgggaacagcataccctcaacctcccagcagtcaacagcatcacctacgtcctccgcttcctggagaaactctgccacaaccttcgtagtgacaatctgtttggcaaccagccctttacacagactcacttgtcactcactgccatagagtacagccacagccacgacaggtacctaccaggtgaaacctttgtcctggggaatagtctggcccgctccttggaaccacactcagactcaatggactctgcctcaaatcccaccaaccttgtcagcacctcccaaaggcaccggcccttgctttcatcctgtggcctcccaccaagcactgcctcagctgtgcgcaggctatgctccagggggtcggaccgatacctggagagccgcgatgcctctcgactgagtggccgggacccctcctcatggacagtcgaggatgtgatgcagtttgtccgggaagctgatcctcagcttggaccccacgctgacctgtttcgcaaacacgagatcgatggcaaggccctgctgctgctgcgcagtgacatgatgatgaagtacatgggcctgaagctggggcctgcactcaagctctcctaccacattgaccggctgaagcagggcaagttctgaaccaggagaggcagcctagacaaccaagtggcagcaggtgggggcattcttctaggaatgaggggcatcagcccaccccaggcacctcagtggggttccgggccacctcaggactccaagaggctgtgtggagccaccactcctagccacagctgccatgataagtccttccatgaaggactgaggagggagagtgggggtccagggctggtgctgctcttccctcagctctgccggggctctaaggtccctctatttatttctcaaccctggctggcctctcaccaggagtttaggctgaatgccttccacgtgatggaggaaaaggccaactctgtcctggtcttgctgtggcaccccatcgccccacagctcgtaccttctcaccagattcccctgaatccaaactcgtggtgcaaacctctaccttttttacaaaaagatcttattgttaatttattgtttctggcacttgggcaaaccctgtagttaatactcctcccacactagacactgggtttcaggaggagggagactgccctgctttggtcccagagaggccctctgcagataggcgtggcccctcttcagaggacactaccctagggcactttctctttgaggtggagagacccataaagccttgaccacatcactccatatggggaggagaaggatccctgtcaccttctcctctcttcacggggcccttttgcagccctaggcctcatctgtgggaagggagtccctggcttatactgcccccaccacagctccttgccctggccagaactgctgtcgaagaaaatcaggccggaaggccaagaaggcgctaagggggatgggagggcaggttttccaggctggagtcggttccacccactcgcctgtccacaggcttccttgtaagcaagtcagcagcacagctactcacgctgccatctggacttattttatgtcaatctgtttataaataaaaaccaatatagatacc

SEQ ID NO: 2097 - DNA, 3231 bp, Homo sapiens
caagcagggggcatatttcagcccttttggtgttacagcaactcttttagccacgccgttcagcagatcccgagttcttgtcctgcaaccaggaagaatgaggtacgcagacaagtggagggtgagcaagatgaagaggtgctgtattgagcaatggaacagctcagagaagactcacagtgccagggcgtcccagtgagtgttcagcccctagcaggaaggatagctcctctctgcagtgatagactggagtgatgttagaaaacacaaatatggtcacctatcagagtctgcatcccaatatcaagaagctgctgacatcctggatctaggtcattttacctgggacaaatacctaaaagaaacatgttcagtcccagcgcctgtccattgcttcaagcagtcctacacacctccaagcaacgagttcaagatcagtatgaaattggaagcacaggaccccaggaacaccacatccacctgtattgccacagtagttggactgacaggtgcccgccttcgcctgcgccttgatgggagcgacaacaaaaatgacttctggcggctggttgactcagctgaaatccagcctattgggaactgtgaaaagaatgggggtatgctacagccacctcttggatttcggctgaatgcgtcttcttggcccatgttccttttgaagacgctaaatggagcagagatggctcccatcaggattttccacaaggagccaccatcgccttcccacaacttcttcaaaatgggaatgaagctagaagctgtggacaggaagaaccctcatttcatttgcccagccactattggggaggttcggggctcagaggtgcttgtcacttttgatgggtggcgaggggcctttgactactggtgccgcttcgactcccgagacatcttccctgtgggctggtgttccttgactggagacaacctgcagcctcctggcaccaaagttgtgattccaaagaatccctatcctgcctccgatgtgaatactgagaagcccagcatccacagcagcaccaaaactgtcttggaacatcaaccagggcagagggggcgtaaaccaggaaagaagcggggccggacacccaagaccctaatttcccatcccatctctgccccatccaagacagctgaacctttgaaattcccaaagaagagaggtcccaaacctggcagcaagaggaaacctcggactttgctgaacccaccacctgcctcaccaacaaccagcactcctgaaccggataccagcactgtaccccaggatgctgccaccatccccagctcagccatgcaggccccaacagtttgtatctacttgaacaagaatggcagcacaggcccccacttagataagaagaaggtccagcaactccctgaccattttggaccagcccgtgcctctgtggtgttgcagcaggctgtccaggcctgtatcgactgtgcttatcaccagaaaaccgtcttcagcttcctcaagcaaggccatggtggtgaggttatctcagccgtgtttgaccgggaacagcataccctcaacctcccagcagtcaacagcatcacctacgtcctccgcttcctggagaaactctgccacaaccttcgtagtgacaatctgtttggcaaccagccctttacacagactcacttgtcactcactgccatagagtacagccacagccacgacaggtacctaccaggtgaaacctttgtcctggggaatagtctggcccgctccttggaaccacactcagactcaatggactctgcctcaaatcccaccaaccttgtcagcacctcccaaaggcaccggcccttgctttcatcctgtggcctcccaccaagcactgcctcagctgtgcgcaggctatgctccaggggagtgttaaaaggatcaaatgaaagaagggatatggaatcattttggaaactaaatcgttccccagggtcggaccgatacctggagagccgcgatgcctctcgactgagtggccgggacccctcctcatggacagtcgaggatgtgatgcagtttgtccgggaagctgatcctcagcttggaccccacgctgacctgtttcgcaaacacgagatcgatggcaaggccctgctgctgctgcgcagtgacatgatgatgaagtacatgggcctgaagctggggcctgcactcaagctctcctaccacattgaccggctgaagcagggcaagttctgaaccaggagaggcagcctagacaaccaagtggcagcaggtgggggcattcttctaggaatgaggggcatcagcccaccccaggcacctcagtggggttccgggccacctcaggactccaagaggctgtgtggagccaccactcctagccacagctgccatgataagtccttccatgaaggactgaggagggagagtgggggtccagggctggtgctgctcttccctcagctctgccggggctctaaggtccctctatttatttctcaaccctggctggcctctcaccaggagtttaggctgaatgccttccacgtgatggaggaaaaggccaactctgtcctggtcttgctgtggcaccccatcgccccacagctcgtaccttctcaccagattcccctgaatccaaactcgtggtgcaaacctctaccttttttacaaaaagatcttattgttaatttattgtttctggcacttgggcaaaccctgtagttaatactcctcccacactagacactgggtttcaggaggagggagactgccctgctttggtcccagagaggccctctgcagataggcgtggcccctcttcagaggacactaccctagggcactttctctttgaggtggagagacccataaagccttgaccacatcactccatatggggaggagaaggatccctgtcaccttctcctctcttcacggggcccttttgcagccctaggcctcatctgtgggaagggagtccctggcttatactgcccccaccacagctccttgccctggccagaactgctgtcgaagaaaatcaggccggaaggccaagaaggcgctaagggggatgggagggcaggttttccaggctggagtcggttccacccactcgcctgtccacaggcttccttgtaagcaagtcagcagcacagctactcacgctgccatctggacttattttatgtcaatctgtttataaataaaaaccaatatagata

SEQ ID NO: 2098 - DNA, 3323 bp, Homo sapiens
gcggaaacatggcggcgggaagagagtgagccgccccgcgcccccgccgcgccctcagatggagaaattagcatacaaagaaactgacttgtcagaagtcagagcaaggtattggtggatccagggataaatcccaaacttcttaacccctagaccggtttttagtccattgactatgcagcctaatgtgatagactggagtgatgttagaaaacacaaatatggtcacctatcagagtctgcatcccaatatcaagaagctgctgacatcctggatctagggttgtaaagaagattacatgagctaatggatgtgaaaacatcttaaaaactctcaaatacttttcaactttggaggattattatgattttcattctgttcagcggctatactcagactttactctaaaagtcaaatcttctgacattctttgaagtgaagcattctatgaatgtgagctgaagaaatgaatgaaatgaaataatgcaggtcattttacctgggacaaatacctaaaagaaacatgttcagtcccagcgcctgtccattgcttcaagcagtcctacacacctccaagcaacgagttcaagatcagtatgaaattggaagcacaggaccccaggaacaccacatccacctgtattgccacagtagttggactgacaggtgcccgccttcgcctgcgccttgatgggagcgacaacaaaaatgacttctggcggctggttgactcagctgaaatccagcctattgggaactgtgaaaagaatgggggtatgctacagccacctcttggatttcggctgaatgcgtcttcttggcccatgttccttttgaagacgctaaatggagcagagatggctcccatcaggattttccacaaggagccaccatcgccttcccacaacttcttcaaaatgggaatgaagctagaagctgtggacaggaagaaccctcatttcatttgcccagccactattggggaggttcggggctcagaggtgcttgtcacttttgatgggtggcgaggggcctttgactactggtgccgcttcgactcccgagacatcttccctgtgggctggtgttccttgactggagacaacctgcagcctcctggcaccaaagttgtgattccaaagaatccctatcctgcctccgatgtgaatactgagaagcccagcatccacagcagcaccaaaactgtcttggaacatcaaccagggcagagggggcgtaaaccaggaaagaagcggggccggacacccaagaccctaatttcccatcccatctctgccccatccaagacagctgaacctttgaaattcccaaagaagagaggtcccaaacctggcagcaagaggaaacctcggactttgctgaacccaccacctgcctcaccaacaaccagcactcctgaaccggataccagcactgtaccccaggatgctgccaccatccccagctcagccatgcaggccccaacagtttgtatctacttgaacaagaatggcagcacaggcccccacttagataagaagaaggtccagcaactccctgaccattttggaccagcccgtgcctctgtggtgttgcagcaggctgtccaggcctgtatcgactgtgcttatcaccagaaaaccgtcttcagcttcctcaagcaaggccatggtggtgaggttatctcagccgtgtttgaccgggaacagcataccctcaacctcccagcagtcaacagcatcacctacgtcctccgcttcctggagaaactctgccacaaccttcgtagtgacaatctgtttggcaaccagccctttacacagactcacttgtcactcactgccatagagtacagccacagccacgacaggtacctaccaggtgaaacctttgtcctggggaatagtctggcccgctccttggaaccacactcagactcaatggactctgcctcaaatcccaccaaccttgtcagcacctcccaaaggcaccggcccttgctttcatcctgtggcctcccaccaagcactgcctcagctgtgcgcaggctatgctccagggggtcggaccgatacctggagagccgcgatgcctctcgactgagtggccgggacccctcctcatggacagtcgaggatgtgatgcagtttgtccgggaagctgatcctcagcttggaccccacgctgacctgtttcgcaaacacgagatcgatggcaaggccctgctgctgctgcgcagtgacatgatgatgaagtacatgggcctgaagctggggcctgcactcaagctctcctaccacattgaccggctgaagcagggcaagttctgaaccaggagaggcagcctagacaaccaagtggcagcaggtgggggcattcttctaggaatgaggggcatcagcccaccccaggcacctcagtggggttccgggccacctcaggactccaagaggctgtgtggagccaccactcctagccacagctgccatgataagtccttccatgaaggactgaggagggagagtgggggtccagggctggtgctgctcttccctcagctctgccggggctctaaggtccctctatttatttctcaaccctggctggcctctcaccaggagtttaggctgaatgccttccacgtgatggaggaaaaggccaactctgtcctggtcttgctgtggcaccccatcgccccacagctcgtaccttctcaccagattcccctgaatccaaactcgtggtgcaaacctctaccttttttacaaaaagatcttattgttaatttattgtttctggcacttgggcaaaccctgtagttaatactcctcccacactagacactgggtttcaggaggagggagactgccctgctttggtcccagagaggccctctgcagataggcgtggcccctcttcagaggacactaccctagggcactttctctttgaggtggagagacccataaagccttgaccacatcactccatatggggaggagaaggatccctgtcaccttctcctctcttcacggggcccttttgcagccctaggcctcatctgtgggaagggagtccctggcttatactgcccccaccacagctccttgccctggccagaactgctgtcgaagaaaatcaggccggaaggccaagaaggcgctaagggggatgggagggcaggttttccaggctggagtcggttccacccactcgcctgtccacaggcttccttgtaagcaagtcagcagcacagctactcacgctgccatctggacttattttatgtcaatctgtttataaataaaaaccaatatagata

SEQ ID NO: 2099 - DNA, 3252 bp, Homo sapiens
gcggaaacatggcggcgggaagagagtgagccgccccgcgcccccgccgcgccctcagatggagaaattagcatacaaagaaactgacttgtcagaagtcagagcaaggtattggtggatccagggataaatcccaaacttcttaacccctagaccggtttttagtccattgactatgcagcctaatgtgatagactggagtgatgttagaaaacacaaatatggtcacctatcagagtctgcatcccaatatcaagaagctgctgacatcctggatctagggttgtaaagaagattacatgagctaatggatgtgaaaacatcttaaaaactctcaaatacttttcaactttggaggattattatgattttcattctgttcagcggctatactcagactttactctaaaagtcaaatcttctgacattctttgaagtgaagcattctatgaatgtgagctgaagaaatgaatgaaatgaaataatgcagtcctacacacctccaagcaacgagttcaagatcagtatgaaattggaagcacaggaccccaggaacaccacatccacctgtattgccacagtagttggactgacaggtgcccgccttcgcctgcgccttgatgggagcgacaacaaaaatgacttctggcggctggttgactcagctgaaatccagcctattgggaactgtgaaaagaatgggggtatgctacagccacctcttggatttcggctgaatgcgtcttcttggcccatgttccttttgaagacgctaaatggagcagagatggctcccatcaggattttccacaaggagccaccatcgccttcccacaacttcttcaaaatgggaatgaagctagaagctgtggacaggaagaaccctcatttcatttgcccagccactattggggaggttcggggctcagaggtgcttgtcacttttgatgggtggcgaggggcctttgactactggtgccgcttcgactcccgagacatcttccctgtgggctggtgttccttgactggagacaacctgcagcctcctggcaccaaagttgtgattccaaagaatccctatcctgcctccgatgtgaatactgagaagcccagcatccacagcagcaccaaaactgtcttggaacatcaaccagggcagagggggcgtaaaccaggaaagaagcggggccggacacccaagaccctaatttcccatcccatctctgccccatccaagacagctgaacctttgaaattcccaaagaagagaggtcccaaacctggcagcaagaggaaacctcggactttgctgaacccaccacctgcctcaccaacaaccagcactcctgaaccggataccagcactgtaccccaggatgctgccaccatccccagctcagccatgcaggccccaacagtttgtatctacttgaacaagaatggcagcacaggcccccacttagataagaagaaggtccagcaactccctgaccattttggaccagcccgtgcctctgtggtgttgcagcaggctgtccaggcctgtatcgactgtgcttatcaccagaaaaccgtcttcagcttcctcaagcaaggccatggtggtgaggttatctcagccgtgtttgaccgggaacagcataccctcaacctcccagcagtcaacagcatcacctacgtcctccgcttcctggagaaactctgccacaaccttcgtagtgacaatctgtttggcaaccagccctttacacagactcacttgtcactcactgccatagagtacagccacagccacgacaggtacctaccaggtgaaacctttgtcctggggaatagtctggcccgctccttggaaccacactcagactcaatggactctgcctcaaatcccaccaaccttgtcagcacctcccaaaggcaccggcccttgctttcatcctgtggcctcccaccaagcactgcctcagctgtgcgcaggctatgctccagggggtcggaccgatacctggagagccgcgatgcctctcgactgagtggccgggacccctcctcatggacagtcgaggatgtgatgcagtttgtccgggaagctgatcctcagcttggaccccacgctgacctgtttcgcaaacacgagatcgatggcaaggccctgctgctgctgcgcagtgacatgatgatgaagtacatgggcctgaagctggggcctgcactcaagctctcctaccacattgaccggctgaagcagggcaagttctgaaccaggagaggcagcctagacaaccaagtggcagcaggtgggggcattcttctaggaatgaggggcatcagcccaccccaggcacctcagtggggttccgggccacctcaggactccaagaggctgtgtggagccaccactcctagccacagctgccatgataagtccttccatgaaggactgaggagggagagtgggggtccagggctggtgctgctcttccctcagctctgccggggctctaaggtccctctatttatttctcaaccctggctggcctctcaccaggagtttaggctgaatgccttccacgtgatggaggaaaaggccaactctgtcctggtcttgctgtggcaccccatcgccccacagctcgtaccttctcaccagattcccctgaatccaaactcgtggtgcaaacctctaccttttttacaaaaagatcttattgttaatttattgtttctggcacttgggcaaaccctgtagttaatactcctcccacactagacactgggtttcaggaggagggagactgccctgctttggtcccagagaggccctctgcagataggcgtggcccctcttcagaggacactaccctagggcactttctctttgaggtggagagacccataaagccttgaccacatcactccatatggggaggagaaggatccctgtcaccttctcctctcttcacggggcccttttgcagccctaggcctcatctgtgggaagggagtccctggcttatactgcccccaccacagctccttgccctggccagaactgctgtcgaagaaaatcaggccggaaggccaagaaggcgctaagggggatgggagggcaggttttccaggctggagtcggttccacccactcgcctgtccacaggcttccttgtaagcaagtcagcagcacagctactcacgctgccatctggacttattttatgtcaatctgtttataaataaaaaccaatatagata

SEQ ID NO: 2100 - DNA, 3186 bp, Homo sapiens
ttaatcttatactttctttccacatgactatttttctctccctctgcagtgatagactggagtgatgttagaaaacacaaatatggtcacctatcagagtctgcatcccaatatcaagaagctgctgacatcctggatctagggttgtaaagaagattacatgagctaatggatgtgaaaacatcttaaaaactctcaaatacttttcaactttggaggattattatgattttcattctgttcagcggctatactcagactttactctaaaagtcaaatcttctgacattctttgaagtgaagcattctatgaatgtgagctgaagaaatgaatgaaatgaaataatgcaggtcattttacctgggacaaatacctaaaagaaacatgttcagtcccagcgcctgtccattgcttcaagcagtcctacacacctccaagcaacgagttcaagatcagtatgaaattggaagcacaggaccccaggaacaccacatccacctgtattgccacagtagttggactgacaggtgcccgccttcgcctgcgccttgatgggagcgacaacaaaaatgacttctggcggctggttgactcagctgaaatccagcctattgggaactgtgaaaagaatgggggtatgctacagccacctcttggatttcggctgaatgcgtcttcttggcccatgttccttttgaagacgctaaatggagcagagatggctcccatcaggattttccacaaggagccaccatcgccttcccacaacttcttcaaaatgggaatgaagctagaagctgtggacaggaagaaccctcatttcatttgcccagccactattggggaggttcggggctcagaggtgcttgtcacttttgatgggtggcgaggggcctttgactactggtgccgcttcgactcccgagacatcttccctgtgggctggtgttccttgactggagacaacctgcagcctcctggcaccaaagttgtgattccaaagaatccctatcctgcctccgatgtgaatactgagaagcccagcatccacagcagcaccaaaactgtcttggaacatcaaccagggcagagggggcgtaaaccaggaaagaagcggggccggacacccaagaccctaatttcccatcccatctctgccccatccaagacagctgaacctttgaaattcccaaagaagagaggtcccaaacctggcagcaagaggaaacctcggactttgctgaacccaccacctgcctcaccaacaaccagcactcctgaaccggataccagcactgtaccccaggatgctgccaccatccccagctcagccatgcaggccccaacagtttgtatctacttgaacaagaatggcagcacaggcccccacttagataagaagaaggtccagcaactccctgaccattttggaccagcccgtgcctctgtggtgttgcagcaggctgtccaggcctgtatcgactgtgcttatcaccagaaaaccgtcttcagcttcctcaagcaaggccatggtggtgaggttatctcagccgtgtttgaccgggaacagcataccctcaacctcccagcagtcaacagcatcacctacgtcctccgcttcctggagaaactctgccacaaccttcgtagtgacaatctgtttggcaaccagccctttacacagactcacttgtcactcactgccatagagtacagccacagccacgacaggtacctaccaggtgaaacctttgtcctggggaatagtctggcccgctccttggaaccacactcagactcaatggactctgcctcaaatcccaccaaccttgtcagcacctcccaaaggcaccggcccttgctttcatcctgtggcctcccaccaagcactgcctcagctgtgcgcaggctatgctccagggggtcggaccgatacctggagagccgcgatgcctctcgactgagtggccgggacccctcctcatggacagtcgaggatgtgatgcagtttgtccgggaagctgatcctcagcttggaccccacgctgacctgtttcgcaaacacgagatcgatggcaaggccctgctgctgctgcgcagtgacatgatgatgaagtacatgggcctgaagctggggcctgcactcaagctctcctaccacattgaccggctgaagcagggcaagttctgaaccaggagaggcagcctagacaaccaagtggcagcaggtgggggcattcttctaggaatgaggggcatcagcccaccccaggcacctcagtggggttccgggccacctcaggactccaagaggctgtgtggagccaccactcctagccacagctgccatgataagtccttccatgaaggactgaggagggagagtgggggtccagggctggtgctgctcttccctcagctctgccggggctctaaggtccctctatttatttctcaaccctggctggcctctcaccaggagtttaggctgaatgccttccacgtgatggaggaaaaggccaactctgtcctggtcttgctgtggcaccccatcgccccacagctcgtaccttctcaccagattcccctgaatccaaactcgtggtgcaaacctctaccttttttacaaaaagatcttattgttaatttattgtttctggcacttgggcaaaccctgtagttaatactcctcccacactagacactgggtttcaggaggagggagactgccctgctttggtcccagagaggccctctgcagataggcgtggcccctcttcagaggacactaccctagggcactttctctttgaggtggagagacccataaagccttgaccacatcactccatatggggaggagaaggatccctgtcaccttctcctctcttcacggggcccttttgcagccctaggcctcatctgtgggaagggagtccctggcttatactgcccccaccacagctccttgccctggccagaactgctgtcgaagaaaatcaggccggaaggccaagaaggcgctaagggggatgggagggcaggttttccaggctggagtcggttccacccactcgcctgtccacaggcttccttgtaagcaagtcagcagcacagctactcacgctgccatctggacttattttatgtcaatctgtttataaataaaaaccaatatagatacc

SEQ ID NO: 2101 - DNA, 3280 bp, Homo sapiens
tgatagactggagtgatgttagaaaacacaaatatggtcacctatcagagtctgcatcccaatatcaagaagctgctgacatcctggatctagggttgtaaagaagattacatgagctaatggatgtgaaaacatcttaaaaactctcaaatacttttcaactttggaggattattatgattttcattctgttcagcggctatactcagactttactctaaaagtcaaatcttctgacattctttgaagtgaagcattctatgaatgtgagctgaagaaatgaatgaaatgaaataatgcagcatctagtgctttttgcatggcccaaaggggctctgtgctgctccactacagaggaaacttcaagaaatgctggtttgctacagtgttttagcttgtgagattctctgggaccttccctgctccatcatggggtcacctctaggtcattttacctgggacaaatacctaaaagaaacatgttcagtcccagcgcctgtccattgcttcaagcagtcctacacacctccaagcaacgagttcaagatcagtatgaaattggaagcacaggaccccaggaacaccacatccacctgtattgccacagtagttggactgacaggtgcccgccttcgcctgcgccttgatgggagcgacaacaaaaatgacttctggcggctggttgactcagctgaaatccagcctattgggaactgtgaaaagaatgggggtatgctacagccacctcttggatttcggctgaatgcgtcttcttggcccatgttccttttgaagacgctaaatggagcagagatggctcccatcaggattttccacaaggagccaccatcgccttcccacaacttcttcaaaatgggaatgaagctagaagctgtggacaggaagaaccctcatttcatttgcccagccactattggggaggttcggggctcagaggtgcttgtcacttttgatgggtggcgaggggcctttgactactggtgccgcttcgactcccgagacatcttccctgtgggctggtgttccttgactggagacaacctgcagcctcctggcaccaaagttgtgattccaaagaatccctatcctgcctccgatgtgaatactgagaagcccagcatccacagcagcaccaaaactgtcttggaacatcaaccagggcagagggggcgtaaaccaggaaagaagcggggccggacacccaagaccctaatttcccatcccatctctgccccatccaagacagctgaacctttgaaattcccaaagaagagaggtcccaaacctggcagcaagaggaaacctcggactttgctgaacccaccacctgcctcaccaacaaccagcactcctgaaccggataccagcactgtaccccaggatgctgccaccatccccagctcagccatgcaggccccaacagtttgtatctacttgaacaagaatggcagcacaggcccccacttagataagaagaaggtccagcaactccctgaccattttggaccagcccgtgcctctgtggtgttgcagcaggctgtccaggcctgtatcgactgtgcttatcaccagaaaaccgtcttcagcttcctcaagcaaggccatggtggtgaggttatctcagccgtgtttgaccgggaacagcataccctcaacctcccagcagtcaacagcatcacctacgtcctccgcttcctggagaaactctgccacaaccttcgtagtgacaatctgtttggcaaccagccctttacacagactcacttgtcactcactgccatagagtacagccacagccacgacaggtacctaccaggtgaaacctttgtcctggggaatagtctggcccgctccttggaaccacactcagactcaatggactctgcctcaaatcccaccaaccttgtcagcacctcccaaaggcaccggcccttgctttcatcctgtggcctcccaccaagcactgcctcagctgtgcgcaggctatgctccagggggtcggaccgatacctggagagccgcgatgcctctcgactgagtggccgggacccctcctcatggacagtcgaggatgtgatgcagtttgtccgggaagctgatcctcagcttggaccccacgctgacctgtttcgcaaacacgagatcgatggcaaggccctgctgctgctgcgcagtgacatgatgatgaagtacatgggcctgaagctggggcctgcactcaagctctcctaccacattgaccggctgaagcagggcaagttctgaaccaggagaggcagcctagacaaccaagtggcagcaggtgggggcattcttctaggaatgaggggcatcagcccaccccaggcacctcagtggggttccgggccacctcaggactccaagaggctgtgtggagccaccactcctagccacagctgccatgataagtccttccatgaaggactgaggagggagagtgggggtccagggctggtgctgctcttccctcagctctgccggggctctaaggtccctctatttatttctcaaccctggctggcctctcaccaggagtttaggctgaatgccttccacgtgatggaggaaaaggccaactctgtcctggtcttgctgtggcaccccatcgccccacagctcgtaccttctcaccagattcccctgaatccaaactcgtggtgcaaacctctaccttttttacaaaaagatcttattgttaatttattgtttctggcacttgggcaaaccctgtagttaatactcctcccacactagacactgggtttcaggaggagggagactgccctgctttggtcccagagaggccctctgcagataggcgtggcccctcttcagaggacactaccctagggcactttctctttgaggtggagagacccataaagccttgaccacatcactccatatggggaggagaaggatccctgtcaccttctcctctcttcacggggcccttttgcagccctaggcctcatctgtgggaagggagtccctggcttatactgcccccaccacagctccttgccctggccagaactgctgtcgaagaaaatcaggccggaaggccaagaaggcgctaagggggatgggagggcaggttttccaggctggagtcggttccacccactcgcctgtccacaggcttccttgtaagcaagtcagcagcacagctactcacgctgccatctggacttattttatgtcaatctgtttataaataaaaaccaatatagatacc

SEQ ID NO: 2102 - DNA, 3346 bp, Homo sapiens
tgatagactggagtgatgttagaaaacacaaatatggtcacctatcagagtctgcatcccaatatcaagaagctgctgacatcctggatctagggttgtaaagaagattacatgagctaatggatgtgaaaacatcttaaaaactctcaaatacttttcaactttggaggattattatgattttcattctgttcagcggctatactcagactttactctaaaagtcaaatcttctgacattctttgaagtgaagcattctatgaatgtgagctgaagaaatgaatgaaatgaaataatgcagcatctagtgctttttgcatggcccaaaggggctctgtgctgctccactacagaggaaacttcaagaaatgctggtttgctacagtgttttagcttgtgagattctctgggaccttccctgctccatcatggggtcacctctaggtcattttacctgggacaaatacctaaaagaaacatgttcagtcccagcgcctgtccattgcttcaagcagtcctacacacctccaagcaacgagttcaagatcagtatgaaattggaagcacaggaccccaggaacaccacatccacctgtattgccacagtagttggactgacaggtgcccgccttcgcctgcgccttgatgggagcgacaacaaaaatgacttctggcggctggttgactcagctgaaatccagcctattgggaactgtgaaaagaatgggggtatgctacagccacctcttggatttcggctgaatgcgtcttcttggcccatgttccttttgaagacgctaaatggagcagagatggctcccatcaggattttccacaaggagccaccatcgccttcccacaacttcttcaaaatgggaatgaagctagaagctgtggacaggaagaaccctcatttcatttgcccagccactattggggaggttcggggctcagaggtgcttgtcacttttgatgggtggcgaggggcctttgactactggtgccgcttcgactcccgagacatcttccctgtgggctggtgttccttgactggagacaacctgcagcctcctggcaccaaagttgtgattccaaagaatccctatcctgcctccgatgtgaatactgagaagcccagcatccacagcagcaccaaaactgtcttggaacatcaaccagggcagagggggcgtaaaccaggaaagaagcggggccggacacccaagaccctaatttcccatcccatctctgccccatccaagacagctgaacctttgaaattcccaaagaagagaggtcccaaacctggcagcaagaggaaacctcggactttgctgaacccaccacctgcctcaccaacaaccagcactcctgaaccggataccagcactgtaccccaggatgctgccaccatccccagctcagccatgcaggccccaacagtttgtatctacttgaacaagaatggcagcacaggcccccacttagataagaagaaggtccagcaactccctgaccattttggaccagcccgtgcctctgtggtgttgcagcaggctgtccaggcctgtatcgactgtgcttatcaccagaaaaccgtcttcagcttcctcaagcaaggccatggtggtgaggttatctcagccgtgtttgaccgggaacagcataccctcaacctcccagcagtcaacagcatcacctacgtcctccgcttcctggagaaactctgccacaaccttcgtagtgacaatctgtttggcaaccagccctttacacagactcacttgtcactcactgccatagagtacagccacagccacgacaggtacctaccaggtgaaacctttgtcctggggaatagtctggcccgctccttggaaccacactcagactcaatggactctgcctcaaatcccaccaaccttgtcagcacctcccaaaggcaccggcccttgctttcatcctgtggcctcccaccaagcactgcctcagctgtgcgcaggctatgctccaggggagtgttaaaaggatcaaatgaaagaagggatatggaatcattttggaaactaaatcgttccccagggtcggaccgatacctggagagccgcgatgcctctcgactgagtggccgggacccctcctcatggacagtcgaggatgtgatgcagtttgtccgggaagctgatcctcagcttggaccccacgctgacctgtttcgcaaacacgagatcgatggcaaggccctgctgctgctgcgcagtgacatgatgatgaagtacatgggcctgaagctggggcctgcactcaagctctcctaccacattgaccggctgaagcagggcaagttctgaaccaggagaggcagcctagacaaccaagtggcagcaggtgggggcattcttctaggaatgaggggcatcagcccaccccaggcacctcagtggggttccgggccacctcaggactccaagaggctgtgtggagccaccactcctagccacagctgccatgataagtccttccatgaaggactgaggagggagagtgggggtccagggctggtgctgctcttccctcagctctgccggggctctaaggtccctctatttatttctcaaccctggctggcctctcaccaggagtttaggctgaatgccttccacgtgatggaggaaaaggccaactctgtcctggtcttgctgtggcaccccatcgccccacagctcgtaccttctcaccagattcccctgaatccaaactcgtggtgcaaacctctaccttttttacaaaaagatcttattgttaatttattgtttctggcacttgggcaaaccctgtagttaatactcctcccacactagacactgggtttcaggaggagggagactgccctgctttggtcccagagaggccctctgcagataggcgtggcccctcttcagaggacactaccctagggcactttctctttgaggtggagagacccataaagccttgaccacatcactccatatggggaggagaaggatccctgtcaccttctcctctcttcacggggcccttttgcagccctaggcctcatctgtgggaagggagtccctggcttatactgcccccaccacagctccttgccctggccagaactgctgtcgaagaaaatcaggccggaaggccaagaaggcgctaagggggatgggagggcaggttttccaggctggagtcggttccacccactcgcctgtccacaggcttccttgtaagcaagtcagcagcacagctactcacgctgccatctggacttattttatgtcaatctgtttataaataaaaaccaatatagatacc

SEQ ID NO: 2103 - DNA, 2640 bp, Homo sapiens
ggttgtaaagaagattacatgagctaatggatgtgaaaacatcttaaaaactctcaaatacttttcaactttggaggattattatgattttcattctgttcagcggctatactcagactttactctaaaagtcaaatcttctgacattctttgaagtgaagcattctatgaatgtgagctgaagaaatgaatgaaatgaaataatgcagtcctacacacctccaagcaacgagttcaagatcagtatgaaattggaagcacaggaccccaggaacaccacatccacctgtattgccacagtagttggactgacaggtgcccgccttcgcctgcgccttgatgggagcgacaacaaaaatgacttctggcggctggttgactcagctgaaatccagcctattgggaactgtgaaaagaatgggggtatgctacagccacctcttgttgtgattccaaagaatccctatcctgcctccgatgtgaatactgagaagcccagcatccacagcagcaccaaaactgtcttggaacatcaaccagggcagagggggcgtaaaccaggaaagaagcggggccggacacccaagaccctaatttcccatcccatctctgccccatccaagacagctgaacctttgaaattcccaaagaagagaggtcccaaacctggcagcaagaggaaacctcggactttgctgaacccaccacctgcctcaccaacaaccagcactcctgaaccggataccagcactgtaccccaggatgctgccaccatccccagctcagccatgcaggccccaacagtttgtatctacttgaacaagaatggcagcacaggcccccacttagataagaagaaggtccagcaactccctgaccattttggaccagcccgtgcctctgtggtgttgcagcaggctgtccaggcctgtatcgactgtgcttatcaccagaaaaccgtcttcagcttcctcaagcaaggccatggtggtgaggttatctcagccgtgtttgaccgggaacagcataccctcaacctcccagcagtcaacagcatcacctacgtcctccgcttcctggagaaactctgccacaaccttcgtagtgacaatctgtttggcaaccagccctttacacagactcacttgtcactcactgccatagagtacagccacagccacgacaggtacctaccaggtgaaacctttgtcctggggaatagtctggcccgctccttggaaccacactcagactcaatggactctgcctcaaatcccaccaaccttgtcagcacctcccaaaggcaccggcccttgctttcatcctgtggcctcccaccaagcactgcctcagctgtgcgcaggctatgctccagggggtcggaccgatacctggagagccgcgatgcctctcgactgagtggccgggacccctcctcatggacagtcgaggatgtgatgcagtttgtccgggaagctgatcctcagcttggaccccacgctgacctgtttcgcaaacacgagatcgatggcaaggccctgctgctgctgcgcagtgacatgatgatgaagtacatgggcctgaagctggggcctgcactcaagctctcctaccacattgaccggctgaagcagggcaagttctgaaccaggagaggcagcctagacaaccaagtggcagcaggtgggggcattcttctaggaatgaggggcatcagcccaccccaggcacctcagtggggttccgggccacctcaggactccaagaggctgtgtggagccaccactcctagccacagctgccatgataagtccttccatgaaggactgaggagggagagtgggggtccagggctggtgctgctcttccctcagctctgccggggctctaaggtccctctatttatttctcaaccctggctggcctctcaccaggagtttaggctgaatgccttccacgtgatggaggaaaaggccaactctgtcctggtcttgctgtggcaccccatcgccccacagctcgtaccttctcaccagattcccctgaatccaaactcgtggtgcaaacctctaccttttttacaaaaagatcttattgttaatttattgtttctggcacttgggcaaaccctgtagttaatactcctcccacactagacactgggtttcaggaggagggagactgccctgctttggtcccagagaggccctctgcagataggcgtggcccctcttcagaggacactaccctagggcactttctctttgaggtggagagacccataaagccttgaccacatcactccatatggggaggagaaggatccctgtcaccttctcctctcttcacggggcccttttgcagccctaggcctcatctgtgggaagggagtccctggcttatactgcccccaccacagctccttgccctggccagaactgctgtcgaagaaaatcaggccggaaggccaagaaggcgctaagggggatgggagggcaggttttccaggctggagtcggttccacccactcgcctgtccacaggcttccttgtaagcaagtcagcagcacagctactcacgctgccatctggacttattttatgtcaatctgtttataaataaaaaccaatatagatacc

SEQ ID NO: 2104 - DNA, 1491 bp, Homo sapiens
cattagtctaatgagatgtttgcagctggagcgcagggctgctggagactaactgtgagctactaacacgggtggaagatagcttttgcaatactcggtttgcatgtgctgaaagtcatctgtcttctgagtcaacactcccgacctggtaaacaacctgctcagggctctggtgaacaagctgtagcacctcttctgcctgtgagcgatttgtcacctcattctgtaagactggcaccagcagaaatgcagtctcaaaggatcccggggagaaagcgaggccgaccctcacttcactccacgcctatgaagatggcagttcataacctttattctgcttcagctggctctttaccagcagtgaagatcccaaagaaaagagggcggaaacccgggtacaagatcaagtctcgggttctcatgactcccttagccctctcacctccgcggagtaccccagagcccgacctcagctccatccctcaggacgcagccacggtccccagcttggcggccccacaggctctcacagtctgcctctacatcaacaagcaggccaatgcggggccctatctggagaggaagaaggtgcagcagctcccggagcattttgggcccgagcggccatcggcggtgctgcagcaggccgtccaagcctgcatcgactgcgcccaccagcagaagctggtcttctccctggtcaagcagggctatggtggtgagatggtgtcagtctcggcttcctttgatggcaaacagcacctgcggagcctgcctgtggtgaacagcatcggctatgtcctccgcttcctcgccaagctgtgccgaagcctcctgtgcgatgacctcttcagccaccagcccttccccaggggctgcagtgcctctgagaaagtccaggagaaagaggaagggaggatggaatcagtcaagacagtcaccaccgaagagtacctggtgaaccctgtgggcatgaaccgctacagcgtggacacctccgcctccacctttaaccacaggggctccttgcacccctcctcctcgctgtactgcaagaggcagaactctggagacagccaccttgggggtggtcctgctgccaccgctggtggtccccgcactagccccatgtcttctggtggcccctcggcacctgggctgaggcctccagcctccagccccaagagaaacacgacctctcttgaaggaaacagatgtgcctcaagcccttctcaggatgcgcaggatgccaggcggccacggagcaggaacccctccgcctggactgtggaggacgtggtgtggtttgtgaaggacgccgacccacaggctctggggcctcacgtggagctcttcagaaagcacgagattgatggcaacgctctgctgttgctgaagagtgacatggtcatgaagtacctgggcctgaagctgggacctgcactgaaactctgctaccacattgacaaactgaagcaagccaagttctga

SEQ ID NO: 2105 - DNA, 1352 bp, Homo sapiens
atgccctgccagagaacagcttggataggttgcgacaggcagagaacccccccattccactggagagagatcaagtctcgggttctcatgactcccttagccctctcacctccgcggagtaccccagagcccgacctcagctccatccctcaggacgcagccacggtccccagcttggcggccccacaggctctcacagtctgcctctacatcaacaagcaggccaatgcggggccctatctggagaggaagaaggtgcagcagctcccggagcattttgggcccgagcggccatcggcggtgctgcagcaggccgtccaagcctgcatcgactgcgcccaccagcagaagctggtcttctccctggtcaagcagggctatggtggtgagatggtgtcagtctcggcttcctttgatggcaaacagcacctgcggagcctgcctgtggtgaacagcatcggctatgtcctccgcttcctcgccaagctgtgccgaagcctcctgtgcgatgacctcttcagccaccagcccttccccaggggctgcagtgcctctgagaaagtccaggagaaagaggaagggaggatggaatcagtcaagacagtcaccaccgaagagtacctggtgaaccctgtgggcatgaaccgctacagcgtggacacctccgcctccacctttaaccacaggggctccttgcacccctcctcctcgctgtactgcaagaggcagaactctggagacagccaccttgggggtggtcctgctgccaccgctggtggtccccgcactagccccatgtcttctggtggcccctcggcacctgggctgaggcctccagcctccagccccaagagaaacacgacctctcttgaaggaaacagatgtggtaatgtaatgcatgcatcagcttcccactgacttaacatcccttgcccttgcgcggggagcacagcatctggggaagggggagtgtggctgtttaaacgtgggactgctgggagatcagaaatttccacaagtcctttcatggatcttgaggttctcaaaaacagccaaactcaacctttgataagcaaagaaaatcgtgtattagggcaggctaggccacaggatacgtagactccaaaatgtacacaggctcaaataccatagaaatttttgttcgagagccaaaggtgaatgttcctgattcatggatgcatctcaatatagggacataggctccatctattttgtggctctgccaccctctacagccttcatgccccatgcattagggaatagaaagggaaagaaggtgtggagaagacacaggtgcttccctgcaatctgaaagtgatgctcatcacttc

SEQ ID NO: 2106 - DNA, 4649 bp, Homo sapiens
ccgggcggcgctgggcttttatctgcggacccgccgggagggagccagatcccagcgatcttccccgacggcagcgctttacccagaggctgccggcggctcgtagctgggttcagctctgcgtccacgccagcccggagcccggggggcaaggggtctgtcccgggcgcagcgagaggatggtcatccgcgtgttcatcgcctcttcctcgggcttcgtggcgataaagaagaagcagcaagatgtggttagatttctggaagccaacaagatagagtttgaggaggtggatatcacaatgtcagaagaacagaggcaatggatgtacaaaaacgtccccccggaaaagaaacccactcagggcaaccccctgccacctcagatatttaatggcgaccgatactgtggagattatgacagtttttttgaatccaaggaaagcaacacagtcttttcatttttaggcctgaaaccacggttggcatcaaaggcagaaccttagagaagaagagtggaagatgacggagatgcattttgaagcacccctggtactcagcacacacatgcttacctaatgcatcactgtgacaaaagccacacgcattatcagtaactttgcttgccacggaaaaggtgtttttgaaagatgtggctataatgagaattgcatgattgctttaaaccaaatcaggtggtggattttttttttcttattctatttgcctgcagttgcctcactcacctggaaataccgtcacctgttacaggtgtactttcttaatgactgaaagataagtgggtagcaccgtcagagagaaaatgttggatctgccctaggttatagtagatgccggaattgcgtaaacccacttctctttaagctgcctggattgcacctttgaaatatgtctgccaagttgttagaatctttgaatcagaaggaaaaaaagcagcgctggttgacaaagggtgttgaagatttttgctgcagaatcagttacaaacatcacagttcccatgctttgtaataacacctggtgaaaaagttagatattctagacttgttttagtaatggaaactcttacctccacatattatcctacagatgtttccagaaatccctgttgtaacatcaagtgatcagaactaagttactgggatgacaataattgctatttgaaatatatgcttctttatttcttgcaaggggcaagtttcacccaaatgcctgagactgcttgaaagatatattttaagtggtgcactaattagtgaatatataggaaaattatctgacgagtatctgaaggcattttcagctctagcaatttatttataatatataagttcatatattttttaatccagctcccctaacagacagctgctgcttctattttgtgaagggactatattttttgagaaaggaaaatctcagttagatatattttgtgaacccttgattagacatattaaaatataccaatgttgtagtaaaatttaatttttccttttgttacttttcatttgcctctaattttgcttgctcatatttctggccaatgtacagcctcatatttttcagagtaatacagatacttgttctcattccgtatatgagcacaagtaaggtttcagagcaacacacatgagaaagagagtaacccggaattgtacttgtcaagcaaaatctatactcctattggagtggatgctgatgaacatcgaacatatctacttcattagagcagaggctatttttctgcattcttgtccctataacagggatgcttaattttttttttaacttagagttttaaattgccaaacatgggaacagccttgaataggataaattttcagagggctgcctaaaatattttatttctagcatcctgattctggacttttcattataattctgagcaggaaatttataagaaattgaaagagcagaagaattacagccctgtcacatgtgcccagcactccgccccatgccttgctaaatgtagactaaagaacttgttgaatgctaaggctgaaatcccaacctgagatttgtagtccaggattacaaccagaaggaaagtatgacagatttctacttaactagaatggacacatgatccacaattttctcttcaagggaagctgttgtcaaattatggatattactggttagttgtcattaagtaagatccaggtcaaattccatttgacaaatcccagggactatccaggaatttttttttaactggatattgtgtttgagtatgtgagtcttctgataaaactcagaatttctttttaagcagttgtaaaaattgtcatgttgtaattcattactcagctaacatttagtctactcttgctagtgagtgccaagaaccaacttggtaaggttgaggctttgcaagttaactgctggggttataggatcaataccatacttgctagacaaagctacccagatttgtcttatattataatttttgagttaaccgtagtatacctattatgattatagtaaacagactagtgggtagtaatgctaaattaccatcacagttatgtgccatctccccaccccatttttttttttttttttttgatcagcaaagaaatacaggagaccagtctcgagtggtgctgtacttgttatgagtgaggcagcagcacagtgtgtggcatttacatggtacccaggctccacagagtaccaagatgttgccctctgggaccacacttagctcagagaatatggggtccttacttgtattcttttatcagctgattttgaaacatataataatgattttcttgttcccttctttaactagctgcctttagattttgataatcacagtcttaaaatactaggaaagaagtggatgggaattgtaggcatagatttcatatcaagggcatttcaagacagaatttttatttcctgtagtaggcttgctggagcaaaggaaatgtgctgctaaaaatcaacttatgccattttaaaattagataaaatatggagtgccatcctgctaggtgagtacagaccagaagaaaatttagttgggaaaatacttgtttttccaaattccggtgttttattacaatcaaagaagaggaaagcaaggtattttttcacctcagattctaatatattctagatttgtttctgttttatagatttaattcaatacctccacatagatgtttttatattacatgaatttaataataaactaaacttttttttgtctcccgttattgaaaagtaccaaagcttctttctgttgtgtttgattttactataggggttttgctttttctagagatacttttcatttaacagcttttgttaagtgtcaggctgcactttgctccatataattattgttttcagatttcaacttgtatgtgtttgtctcttaaagcattggtgaaatcacatattttatattcagcataaaggagaataaattccagaaaacacatattctgaaaatggagtgtttgttccctgccatttttcacacctctcttaattttagttctgtttagttgagaggctgtgattttactcttgcctgtgaacctcatgcatgaaagcagcacattaaattgtaaaaatacaaacagatcgtgtgatcattcaaggagccagacatgaggtcctgcacgagggtgttgggaggacaccacagattcatctcagacagtgatcaggactgaggatggagttaaatcactcagcccctgggtggggtggggtggttcaaatggatgactgatctcctgagtacactgaagccacaggctggtggccatgttctctgaattgggtgcagaagacaagggcagagtggctgcggcccctattacctttgtagcagccacatcagaaagcagaagaaaacagtatttctgaaggcattgtttgaggttgatctcagcactgaacgatttcaagccctacgcaccagaacagaaggagggtggaggaagtgatcagagggaacgagctgtaggtttgcagaaatgtgtgaaaccaaaatgatcactgcctacttgtgattcaaatcttcagagttttcctagttcttctagaaatacatgtcaggtttgtttgttcatcctttctgtcagcatggatcaagcccctaaaatgtggtaagtgttgtcagagcagggcaatatctctactctcaagtatgaggggaatagaaacaaagcagcagttttagccagggttcaatgatagagtggaggtaaattaagagcctccaggctgtgattcaccatttgagacattatacataatttgtttttgttataagccatttgaatttttaaaaaatttcatacatgcaatggaatatagatatgtatatacacatataatatatatgctaaagtataaagagtaataataatgacaataaacaaacccctgtgtgcctaccacccaccttattgcctttcctttgaggtaccgtgtgcggtttcctgaacctatctctatccctgtctgatagagggaacccctgtactgaactttgtgttgaccatagccttcttgtctttcatcactttatctccatgtatgtatccttaaagaataataaatggaattaaactgaa

SEQ ID NO: 2107 - DNA, 960 bp, Homo sapiens
atggaagaacttacggcgttcgtctccaagtcttttgaccagaaagtgaaggagaagaaggaggcgatcacgtaccgggaggtgctggagagcgggccgctgcgcggggccaaggagccgaccggctgcaccgaggcgggccgcgacgaccgcagcagcccggcagtccgggcggccggcggaggcggcggcggaggaggcggaggcggcggcggaggaggcggaggaggtgtaggaggaggaggagcaggcggaggagctggaggagggcgctctcccgtccgggagctggacatgggcgccgccgagagaagcagggagccgggcagcccgcgactgacggaggtgtccccggagctgaaagatcgcaaagaggatgcgaaagggatggaggacgaaggccagaccaaaatcaagcagaggcgaagtcggaccaatttcaccctggaacaactcaatgagctggagaggctttttgacgagacccactatcccgacgccttcatgcgagaggaactgagccagcgactgggcctgtcggaggcccgagtgcaggtttggtttcaaaatcgaagagctaaatgtagaaaacaagaaaatcaactccataaaggtgttctcataggggccgccagccagtttgaagcttgtagagtcgcaccttatgtcaacgtaggtgctttaaggatgccatttcagcaggttcaggcgcagctgcagctggacagcgctgtggcgcacgcgcaccaccacctgcatccgcacctggccgcgcacgcgccctacatgatgttcccagcaccgcccttcggactgccgctcgccacgctggccgcggattcggcttccgccgcctcggtagtggcggccgcagcagccgccaagaccaccagcaagaactccagcatcgccgatctcagactgaaagccaaaaagcacgccgcagccctgggtctgtga

SEQ ID NO: 2108 - DNA, 1108 bp, Homo sapiens
ccccatgtgacagtgagcggggtccccgctccaggagacgctcgagtctgcgtcccggccctcagcactgtccactgtttcggtgccagcagagaccagcaggcccgggacagttggtgtttggccgtgccgctgtctaacttggtgtgcagagtgaattgccgctgccggagcggagagaggcggagcggccaggagagaggggatttctgtcagcgccggcctcgggagctcggagacatgaacggcttcacgcctgacgagatgagccgcggcggggatgcggccgccgcagtggccgcagtggtcgctgccgcggccgccgccgcctcggcggggaacgggaccggcgcgggcaccggggctgaggtgccgggcgcgggggcggtctcagcggctgggcccccgggggcggccgggccgggccccgggcaactgtgctgcctgcgggaggatggtgagcggtgcggccgggcggcaggcaacgccagcttcagcaagaggatccagaagagcatctcccagaagaaggtgaagatcgagctggataagagcgcaaggcatctttacatatgtgattatcataaaaacttaattcagagtgttcgaaacagaagaaagagaaaagggagtgatgatgatggaggtgattcacctgttcaagatattgataccccagaggttgatttataccaattacaagtaaatacacttaggagatacaaaagacacttcaagctaccaaccagaccaggacttaataaagcacaacttgttgagatagttggttgccactttaggtctattccagtgaatgaaaaagacaccttaacatatttcatctactcagtgaagaatgacaagaacaaatcagatctcaaggttgatagtggtgttcactaggagacgtggaattgagactaataacttggatgttaacactgtttactgttttttcacatgtagaaatgttctttgtgtattttttctacagaggattttctctgattttattttctttgtttctgactctaataattagttggaaactcatataaaatgagctttcctaaattaaatctattttaaataaaggttattactatta

SEQ ID NO: 2109 - DNA, 1091 bp, Homo sapiens
aggagaggggcacgtaccggcgctacggcttcctgcaggctgcctccggatagtccccgagagcttgttccgaagcaagcaccctgcagccctagcgatccagccctcccctggaccctaggtcacggcaatcaaccccctgctgtggttcccgaaccccaaggcccgatgggtcccgcgggggtcgcggcgaggccagggcgctttttcggcgtctacctgctctactgcctgaacccccggtaccggggccgcgtctacgtggggttcactgtcaacactgctcgtcgggtccagcagcacaatgggggccgcaaaaaaggcggggcctggcggaccagcgggcgagggccctgggagatggtgctcgtcgtgcacggcttcccgtcctccgtggccgcccttcggtttgagtgggcttggcagcacccgcacgcctcgcgccgcctggcgcacgtggggcctcgcctgcgaggagagacagccttcgctttccacctgcgcgtgctggcgcacatgctgcgcgcaccgccctgggctcgcctcccgctcacgctgcgctgggtgcgcccagacctccgccaggacctctgcctcccgccgccgccgcacgtgcctctggccttcgggcctccaccgccccaggccccggccccaaggcgccgcgcaggtccctttgatgacgcggagcctgagccagaccagggggatccaggggcctgctgctccctgtgcgcccagaccatccaggatgaagaggggcccttgtgttgcccccaccctggctgcctgctaagggcccatgtgatctgcctggcagaggagtttcttcaggaagaaccagggcagcttctgcccctagagggccaatgcccttgctgtgagaagtcactgctttggggagacctgatctggctgtgccagatggacactgagaaagaagtagaagactcagaattagaagaggcacactggacagacctgctggagacctgatcctcagtgtccttaccccctcctacctcttttctgtgccacctgctgtgggtccagcaggtttttacttgagtacaataaaaagtctgagtcaa

SEQ ID NO: 2110 - DNA, 770 bp, Homo sapiens
cttctacacccgcctccagacaggagaggggcacgtaccggcgctacggcttcctgcaggctgcctccggatagtccccgagagcttgttccgaagcaagcaccctgcagccctagcgatccagccctcccctggaccctaggtcacggcaatcaaccccctgctgtggttcccgaaccccaaggcccgatgggtcccgcgggggtcgcggcgaggccagggcgctttttcggcgtctacctgctctactgcctgaacccccggtaccggggccgcgtctacgtggggttcactgtcaacactgctcgtcgggtccagcagcacaatgggggccgcaaaaaaggcggggcctggcggaccagcgggcgagggccctgggagatggtgctcgtcgtgcacggcttcccgtcctccgtggccgcccttcgggatgaagaggggcccttgtgttgcccccaccctggctgcctgctaagggcccatgtgatctgcctggcagaggagtttcttcaggaagaaccagggcagcttctgcccctagagggccaatgcccttgctgtgagaagtcactgctttggggagacctgatctggctgtgccagatggacactgagaaagaagtagaagactcagaattagaagaggcacactggacagacctgctggagacctgatcctcagtgtccttaccccctcctacctcttttctgtgccacctgctgtgggtccagcaggtttttacttgagtacaataaaaagtctgagtcaa

SEQ ID NO: 2111 - DNA, 1026 bp, Homo sapiens
ttctacacccgcctccagacaggagaggggcacgtaccggcgctacggcttcctgcaggctgcctccggatagtccccgagagcttgttccgaagcaagcaccctgcagccctagcgatccagccctcccctggaccctaggtcacggcaatcaaccccctgctgtggttcccgaaccccaaggcccgatgggtcccgcgggggtcgcggcgaggccagggcgctttttcggcgtctacctgctctactgcctgaacccccggtaccggggccgcgtctacgtggggttcactgtcaacactgctcgtcgggtccagcagcacaatgggggccgcaaaaaaggcggggcctggcggaccagcgggcgagggccctgggagatggtgctcgtcgtgcacggcttcccgtcctccgtggccgcccttcggtttgagtgggcttggcagcacccgcacgcctcgcgccgcctggcgcacgtggggcctcgcctgcgaggagagacagccttcgctttccacctgcgcgtgctggcgcacatgctgcgcgcaccgccctgggctcgcctcccgctcacgctgcgctgggtgcgcccagacctccgccaggacctctgcctcccgccgccgccgcacgtgcctctggccttcgggcctccaccgccccaggccccggccccaaggcgccgcgcaggtccctttgatgacgcggagcctgagccagaccagggggatccaggggcctgctgctccctgtgcgcccagaccatccaggatgaagaggggcccttgtgttgcccccaccctggctgcctgctaagggcccatgtgatctgcctggcagaggagtttcttcaggaagaaccagggcagcttctgcccctagagggccaatgcccttgctgtgagaagtcagctttggggagacctgatctggctgtgccagatggacactgagaaagaagtagaagactcagaattagaagaggtccagcaggtttttacttgagtacaataaaaagtctgagtc

SEQ ID NO: 2112 - DNA, 1165 bp, Homo sapiens
gctgaatggtacgcgctcgccgactggacagcagtctggcttccgcggtcggacttctacacccgcctccagacaggagaggggcacgtaccggcgctacggcttcctgcaggctgcctccggatagtccccgagagcttgttccgaagcaagcaccctgcagccctagcgatccagccctcccctggaccctaggtcacggcaatcaaccccctgctgtggttcccgaaccccaaggcccgatgggtcccgcgggggtcgcggcgaggccagggcgctttttcggcgtctacctgctctactgcctgaacccccggtaccggggccgcgtctacgtggggttcactgtcaacactgctcgtcgggtccagcagcacaatgggggccgcaaaaaaggcggggcctggcggaccagcgggcgagggccctgggagatggtgctcgtcgtgcacggcttcccgtcctccgtggccgcccttcggtttgagtgggcttggcagcacccgcacgcctcgcgccgcctggcgcacgtggggcctcgcctgcgaggagagacagccttcgctttccacctgcgcgtgctggcgcacatgctgcgcgcaccgccctgggctcgcctcccgctcacgctgcgctgggtgcgcccagacctccgccaggacctctgcctcccgccgccgccgcacgtgcctctggccttcgggcctccaccgccccaggccccggccccaaggcgccgcgcaggtccctttgatgacgcggagcctgagccagaccagggggatccaggggcctgctgctccctgtgcgcccagaccatccaggatgaagaggggcccttgtgttgcccccaccctggctgcctgctaagggcccatgtgatctgcctggcagaggagtttcttcaggaagaaccagggcagcttctgcccctagagggccaatgcccttgctgtgagaagtcactgctttggggagacctgatctggctgtgccagatggacactgagaaagaagtagaagactcagaattagaagaggcacactggacagacctgctggagacctgatcctcagtgtccttaccccctcctacctcttttctgtgccacctgctgtgggtccagcaggtttttacttgagtacaataaaaagtctgagtcaa

SEQ ID NO: 2113 - DNA, 762 bp, Homo sapiens
cccgcctccagacaggagaggggcacgtaccggcgctacggcttcctgcaggctgcctccggatagtccccgagagcttgttccgaagcaagcaccctgcagccctagcgatccagccctcccctggaccctaggtcacggcaatcaaccccctgctgtggttcccgaaccccaaggcccgatgggtcccgcgggggtcgcggcgaggccagggcgctttttcggcgtctacctgctctactgcctgaacccccggtaccggggccgcgtctacgtggggttcactgtcaacactgctcgtcgggtccagcagcacaatgggggccgcaaaaaaggcggggcctggcggaccagcgggcgagggccctgggagatggtgctcgtcgtgcacggcttcccgtcctccgtggccgcccttcgggatgaagaggggcccttgtgttgcccccaccctggctgcctgctaagggcccatgtgatctgcctggcagaggagtttcttcaggaagaaccagggcagcttctgcccctagagggccaatgcccttgctgtgagaagtcactgctttggggagacctgatctggctgtgccagatggacactgagaaagaagtagaagactcagaattagaagaggcacactggacagacctgctggagacctgatcctcagtgtccttaccccctcctacctcttttctgtgccacctgctgtgggtccagcaggtttttacttgagtacaataaaaagtctgagtcaa

SEQ ID NO: 2114 - DNA, 1026 bp, Homo sapiens; identical to SEQ ID NO: 2111

SEQ ID NO: 2115 - DNA, 1905 bp, Homo sapiens
gcacgatgagagatcgtccaggaggcggtgttgatgcggcaaagggcaacaggaagggcattaggacttgaaatcggagacgcacgcaggggagggagtcagtgtcggaacctggtaggccctgggagaactccggcttttcgtctgcgtgagctggagaagagccgaaggtttctgcgcacagcacggacctgcgtgcctcagctttaaggaaatcaccgtggccgccgctgtgaacgcagagaagggcgcgagcgtgggagcaggaacccaaggcggtgggaaacggtggggctttctgagtgtattggaaagtagagcccacagatctgctgcagaccagaaaggggcgcgagaaagagcggacagaggcagacgccggggctggcggcgatggagcagcagtcggaggacgcggaaggcctgcgagagtcgcccgcgcccagcgccggccttcgggtcccaccttgcgggtgatgttgtgcacgtaggggcacgtgttgcaggagaagcggtggcagcgttgtccctcctccacgatcagcccgttcccgcagccggggcagaacagcagcatggtctcgaactccgcaggctccaactcccggcagctcccactgccgctcagcgccgatgcgccgcccgcctcgagctcacattggtcctggcagccttcccgccacaccaaccaaccaatagacagggcgattctgcgctcccggccctgctgcaggctgtctcgcacttgtcattggtcactgcagccgccccaccccccccggcgcgccagtggctgggcggcctcgctggggcgggccgcagttcctgcgcgtgcgcgcttggcctccctagtgcgggctggcagtgcgggcagagcccggctgagaggggcggccctggaggagacggaggccgcgggtgggcccgaggcgcaagaggaagatgaggacgaagaagaggcgctgccgcactccgaggccatggacgtgttccaggagggtctggctatggtggtgcaggacccgctgctctgcgatctgccgatccaggttactctggaagaagtcaactcccaaatagccctagaatacggccaggcaatgacggtccgagtgtgcaagatggatggagaagtaatgcccgtggttgtagtgcagagtgccacagtcctggacctgaagaaggccatccagagatacgtgcagctcaagcaggagcgtgaagggggcattcagcacatcagctggtcctacgtgtggaggacgtaccatctgacctctgcaggagagaaactcacggaagacagaaagaagctccgagactacggcatccggaatcgagacgaggtttccttcatcaaaaagctgaggcaaaagtgagcctccagacaggacaaccctcttcatcactggtggctgagctttttcccagcaggaatgggtcctcgaatcatcgtgcctctttcacagaaaggacgttgtggtggcctcaccccaggcatgcccaacagtaactgtcagcataaacctgggggccctcaggactaggacagggtgagccagtgctccctcctttcatgtacttggcctgagactgacctctccctaggtccaaatgccctagtcacatggcagacccacggcctggcccactgtataaaataaacctgtttgcttcttagtttgaaaagtagaaagccacagtaacctgggtagcaaagactgagattgccccatcacagaggtgagttaaggggagagaattggtacaggcgagtcctatagtccaagatggcgccacaccaccaaagccttgaggccacaccactccccaaaccacacaactgtgttaccatgatctccacagcaaggaggaaataaaagcagagcggctttagggtttgca

SEQ ID NO: 2116 - DNA, 1085 bp, Homo sapiens
cagttcctgcgcgtgcgcgcttggcctccctagtgcgggctggcagtgcgggcagagcccggctgagaggggcggccctggaggagacggaggccgcgggtgggcccgaggcgcaagaggaagatgaggacgaagaagaggcgctgccgcactccgaggccatggacgtgttccaggagggtctggctatggtggtgcaggacccgctgctctgcgatctgccgatccaggttactctggaagaagtcaactcccaaatagccctagaatacggccaggcaatgacggtccgagtgtgcaagatggatggagaagtaatgcccgtggttgtagtgcagagtgccacagtcctggacctgaagaaggccatccagagatacgtgcagctcaagcaggagcgtgaagggggcattcagcacatcagctggtcctacgtgtggaggacgtaccatctgacctctgcaggagagaaactcacggaagacagaaagaagctccgagactacggcatccggaatcgagacgaggtttccttcatcaaaaagctgaggcaaaagtgagcctccagacaggacaaccctcttcatcactggtggctgagctttttcccagcaggaatgggtcctcgaatcatcgtgcctctttcacagaaaggacgttgtggtggcctcaccccaggcatgcccaacagtaactgtcagcataaacctgggggccctcaggactaggacagggtgagccagtgctccctcctttcatgtacttggcctgagactgacctctccctaggtccaaatgccctagtcacatggcagacccacggcctggcccactgtataaaataaacctgtttgcttcttagtttgaaaagtagaaagccacagtaacctgggtagcaaagactgagattgccccatcacagaggtgagttaaggggagagaattggtacaggcgagtcctatagtccaagatggcgccacaccaccaaagccttgaggccacaccactccccaaaccacacaactgtgttaccatgatctccacagcaaggaggaaataaaagcagagcggctttagggtttgc

SEQ ID NO: 2117 - DNA, 1802 bp, Homo sapiens
gggcctttagttttccttccaagagcccataggaggttttgggtgccttctcaatgctggcatgagaaaatataaagcagatggacagtgaactttggtatattcactccttatgaatgttatgtggaaaagtggaagaacataagctgtttgtctatgctatgtttacaattggtttgctctattttgtgcatgtggacaaaaatgggggaaaaatgaaagctgtgttaggataatgggtatacggctgaattttccaggaatttctataataacaccaaatcgcatgttttaatgcccaccgtgaacaaagaagaccggaaccctcgcaactcgttttgacgttttctggtcggcggtaaaagctcggttcccggccctcccggaagttgttgcacagttgtttccgggaagcgggactccaaatgggtcgcagtcgcagccgctctccacggagggaacgtaggcgttcccggtccacatcccgggagagagaacgcaggcgccgagaaaggtccaggtctcgggagagagatcggagaaggagccgctcgcgatccccgcaccgaagacgctcccgatctccaagacgacatagatccacatctccttccccttctcgactgaaagaaagaagagatgaggaaaagaaagaaacaaaagaaacaaagagcaaagaacggcagattactgaggaagacttagagggcaaaacagaggaagaaatagaaatgatgaagttaatgggatttgcctcctttgactccacaaaaggtaagaaggtggatggctctgtaaatgcctatgccataaatgtctctcagaagaggaagtacaggcagtacatgaatcgaaaaggtggattcaacagacctttggatttcattgcatgagaattgaagtgttgaaggatgattttttttcccctcatcttggtcagagagtggattttgtattttgtatttaacttgcattcaaaaaacaggatctcagttctcctttcttgtaaagtaagaaaatcttatttatgatatatgcagttaacttaccttgcctcaacagaagaaaggttaaatattacatttttttcttttaggaaatatcatttgtggcaggcgtcaaccccattttatttgtccttattcctgtggaagcagtatatgttttcttcctgaatgctcattaggacttcttaaaaaacatgaaagtaatttggaagtaagtttatccaataaagcagtatttctacccttttagatttgataaatatttttattactaaagaatctccccagacattttcttttttttttcacacatagatttaagtatcttgattgttagtagtctaaaaatgggaagaatgaaaaagcataactagatttttctatcttctgtggtcgcccgcccccccccaaaaaaataccatttatggttctctccgcaagtataaaagcattacatgcaaaaaaaagatctcagagaaaacaaaagtaaaagaaaagcagaaaatcacctgttatctactcccagaaataatcaatttcaacattttggtatatgtttttccaggcttctttgggttgatcccacctatgagatcagaatatgtatgcagttctttctttaacccttttttctcctatgtactgtgaacatttaaaaagtacttttaaatattctttggaaacttagcttttagtaactacttggttgtatcataatttattaactaatgttttattggtaaacattggcttgcctcccatgacttgccattataattaaaactgtgactacta

SEQ ID NO: 2118 - DNA, 766 bp, Homo sapiens
ttccgggaagcgggactccaaatgggtcgcagtcgcagccgctctccacggagggaacgtaggcgttcccggtccacatcccgggagagagaacgcaggcgccgagaaaggtccaggtctcgggagagagatcggagaaggagccgctcgcgatccccgcaccgaagacgctcccgatctccaagacgacatagatccacatctccttccccttctcgactgaaagaaagaagagatgaggaaaagaaagaaacaaaagaaacaaagagcaaagaacggcagattactgaggaagacttagagggcaaaacagaggaagaaatagaaatgatgaagttaatgggatttgcctcctttgactccacaaaaggtaagaaggtggatggctctgtaaatgcctatgccataaatgtctctcagaagaggaagtacaggcagtacatgaatcgaaaaggtggattcaacagacctttggatttcattgcatgagaattgaagtgttgaaggatgattttttttcccctcatcttggtcagagagtggattttgtattttgtatttaacttgcattcaaaaaacaggatctcagttctcctttcttgtaaagaaatatcatttgtggcaggcgtcaaccccattttatttgtccttattcctgtggaagcagtatatgttttcttcctgaatgctcattaggacttcttaaaaaacatgaaagtaatttggaagtaagtttatccaataaagcagtatttctaccctttta

SEQ ID NO: 2119 - DNA, 942 bp, Homo sapiens
tgctgggattacaggcgtgagccaccgcgtctggcctcagccaaggtttttaagtaacatatttcagcattggctctacagcgttgcagaacatgaacgattggatgcccatcgccaaggagtatgatccactcaaagcgggcagcattgatggcaccgatgaagacccacacgaccgcgcggtctggagggcaatgctggcacgatatgtccccaacaaaggtgtcataggagatcccctcctcaccctgtttgtggccagactaaacttgcagaccaaggaggacaaattaaaggaagtcttttcccgctatggtgacatccggcggcttcggctggtcagggacttggtcacaggtttttcaaagggctacgccttcatcgaatacaaggaggagcgtgccgtgatcaaagcttaccgagatgctgatggcctggttattgaccagcatgagatatttgtggactacgagctggaaaggactctcaaagggtggatccctcggcgacttggaggcggtcttgggggaaaaaaggagtctgggcaactgagatttgggggacgggaccggccttttcgaaaacctattaacttgccagttgttaaaaacgacctctatagagagggaaaacgggaaaggcgggagcgatctcgatcccgagaaagacactgggactcgaggacaagggatcgagaccatgacaggggccgggagaagagatggcaagaaagagagccgaccagggtgtggcccgacaatgactgggagagagagagggacttcagagatgacaggatcaaggggagggagaagaaggaaagaggcaagtagaggcccaacagcagaaccccaaagtgaagttacagtggaaatgagtggagggggattgtctttcaacgcagcgtgagtctaatggttgaataaaacttactgatgatca

SEQ ID NO: 2120 - DNA, 1140 bp, Homo sapiens
cacgcctgtaatcccagcactttgggaggctgaggcaggcgggtcatctgacatcaggagtttgagaccagcttggccaacatggtgaaatcctgtctgtactaaaaatgcaaaaattagctgggcgtggtggtgtgtgtctgtaatcccagctactcgggaggctgaggcaggagaatcacttgaacctgggaggcagaggttgcagtgagccgagattggccattgcactccagcctgggtgacagagtgagactttgtctcgagtaaaaaaagagaatgtaaaaatcgaaagagattgttgtaggaaatctcaacctaatgctgccggggaggaagtgcacctagaaagattaatgagaaacaatgaaaccagctaacatgaacgattggatgcccatcgccaaggagtatgatccactcaaagcgggcagcattgatggcaccgatgaagacccacacgaccgcgcggtctggagggcaatgctggcacgatatgtccccaacaaaggtgtcataggagatcccctcctcaccctgtttgtggccagactaaacttgcagaccaaggaggacaaattaaaggaagtcttttcccgctatggtgacatccggcggcttcggctggtcagggacttggtcacaggtttttcaaagggctacgccttcatcgaatacaaggaggagcgtgccgtgatcaaagcttaccgagatgctgatggcctggttattgaccagcatgagatatttgtggactacgagctggaaaggactctcaaagggtggatccctcggcgacttggaggcggtcttgggggaaaaaaggagtctgggcaactgagatttgggggacgggaccggccttttcgaaaacctattaacttgccagttgttaaaaacgacctctatagagagggaaaacgggaaaggcgggagcgatctcgatcccgagaaagacactgggactcgaggacaagggatcgagaccatgacaggggccgggagaagagatggcaagaaagagagccgaccagggtgtggcccgacaatgactgggagagagagagggacttcagagatgacaggatcaaggggagggagaagaaggaaagaggcaagtagaggcccaacagcagaacc

SEQ ID NO: 2121 - DNA, 1975 bp, Homo sapiens
agcactttgggaggccgaggcgggcggatcacttgaggtcagaagttcgagaccagcctggccaacatggcaaaaccctgtctctactaaaaatacaaaaaatagccgggcgtggtggcgggcgccagtaatcccagctacgcgggaggctgaggcaggaaaatcacttgaacccgggaggcggaggttgcagtgagccgagttcgcaccactgcactccagcctgggcgacagagggagtctccgtctcaagaaaaaataataaataagaataaataaataataaagtaaaatgtcccaggtaactgcatattcgatagtctttctttcaacttagttgttgaattagcaatttttctcttaaaaaaatttttttttagcttattgtcttcggagatgataacaccctcgttgcgtgggagtaaaattttaaaggtaaaacaaacaggaaacgagcgtcggcggcgaatctgctgctaccaatgtaaaggtcaggccgaggccggcgcggagaatctgctgtcgcctgcagctgctcgcctgtctccgtcggaagggagcccaagctttgcagagaacatgaacgattggatgcccatcgccaaggagtatgatccactcaaagcgggcagcattgatggcaccgatgaagacccacacgaccgcgcggtctggagggcaatgctggcacgatatgtccccaacaaaggtgtcataggagatcccctcctcaccctgtttgtggccagactaaacttgcagaccaaggaggacaaattaaaggaagtcttttcccgctatggtgacatccggcggcttcggctggtcagggacttggtcacaggtttttcaaagggctacgccttcatcgaatacaaggaggagcgtgccgtgatcaaagcttaccgagatgctgatggcctggttattgaccagcatgagatatttgtggactacgagctggaaaggactctcaaagggtggatccctcggcgacttggaggcggtcttgggggaaaaaaggagtctgggcaactgagatttgggggacgggaccggccttttcgaaaacctattaacttgccagttgttaaaaacgacctctatagagagggaaaacgggaaaggcgggagcgatctcgatcccgagaaagacactgggactcgaggacaagggatcgagaccatgacaggggccgggagaagagatggcaagaaagagagccgaccagggtgtggcccgacaatgactgggagagagagagggacttcagagatgacaggatcaaggggagggagaagaaggaaagaggcaagtagaggcccaacagcagaaccccaaagtgaagttacagtggaaatgagtggagggggattgtctttcaacgcagcgtgagtctaatggttgaataaaacttactgatgatcatggggtttggaatagttttctttccaatctggaacttcggttcaagctgataggaatttatcatcttcctcacatagttctaaggacatgttatttaacaggatcaagaagcaattttgtagttactggcatctgtacagaagggcattttcttttcttttcttttttttttttttgagacagagtctcactctgttgccagggctggagtgcagtggtaaaatcttggctcactgtaacctctgcctcctgggttcaagtgattctcctgcctcagcctccccagtagttgggattacaggcatgtgccaccatgcccgactaatttttgtatttttagtggagatggggtttcaccatgttggtcaggctgttttcgaactcctgacctcagatgatccacctgccttggcctcccaaagtgctgggattacaggtgtgagccactactcctggcctggtctccaactcttgacctcaaatgagccacctgccttagcctcccaaagtgctgggattacaggcataagccactgcgcccagcca

SEQ ID NO: 2122 - DNA, 1922 bp, Homo sapiens
gcggttcggcgcggaaagcgggaggtggaggggcggcttggggcaagcgcgcgcgcgcagtgcagaagccagccccccgcggctgaggtactcaaggtgcccaaaggcggggtagtgacctcgcgcgtgcgctgtgcccgcggcagcgccgggtcctagtgtgtgggttgttgttggcaccgcacggcgcgtgcgcagtgaggacggcggagggatttgcggccgggacccaccccctgctccagtcgctatcggaggccgcgcgggtggctgagcagcggcctggtgcgctcgcttagcgggcgacggaatcagacggacgtggacgcccccggagtggaagccgaagcaggagttgttgttgctgaggggctgccgcagccgccgcgagcctccggacagacgccagagcgaggagggcgctacgcgacttggcaagatgacccagttcctgccgcccaaccttctggccctctttgccccccgtgaccctattccatacctgccacccctggagaaactgccacatgaaaaacaccacaatcaaccttattgtggcattgcgccgtacattcgagagtttgaggaccctcgagatgcccctcctccaactcgtgctgaaacccgagaggagcgcatggagaggaaaagacgggaaaagattgagcggcgacagcaagaagtggagacagagcttaaaatgtgggaccctcacaatgatcccaatgctcagggggatgccttcaagactctcttcgtggcgagagtgaattatgacacaacagaatccaagctccggagagagtttgaggtgtacggacctatcaaaagaatacacatggtctacagtaagcggtcaggaaagccccgtggctatgccttcatcgagtacgaacacgagcgagacatgcactccgcttacaaacacgcagatggcaagaagattgatggcaggagggtccttgtggacgtggagaggggccgaaccgtgaagggctggaggccccggcggctaggaggaggcctcggtggtaccagaagaggaggggctgatgtgaacatccggcattcaggccgcgatgacacctcccgctacgatgagaggcccggcccctccccgcttccgcacagggaccgggaccgggaccgtgagcgggagcgcagagagcggagccgggagcgagacaaggagcgagaacggcgacgctcccgctcccgggaccggcggaggcgctcacggagtcgcgacaaggaggagcggaggcgctccagggagcggagcaaggacaaggaccgggaccggaagcggcgaagcagccggagtcgggagcgggcccggcgggagcgggagcgcaaggaggagctgcgtggcggcggtggcgacatggcggagccctccgaggcgggtgacgcgccccctgatgatgggcctccaggggagctcgggcctgacggccctgacggtccagaggaaaagggccgggatcgtgaccgggagcgacggcggagccaccggagcgagcgcgagcggcgccgggaccgggatcgtgaccgtgaccgtgaccgcgagcacaaacggggggagcggggcagtgagcggggcagggatgaggcccgaggtgggggcggtggccaggacaacgggctggagggtctgggcaacgacagccgagacatgtacatggagtctgagggcggcgacggctacctggctccggagaatgggtatttgatggaggctgcgccggagtgaagaggtcgtcctctccatctgctgtgtttggacgcgttcctgcccagccccttgctgtcatcccctcccccaaccttggccacttgagtttgtcctccaagggtaggtgtctcatttgttctggccccttggatttaaaaataaaattaatttcctgttgatagtgggc

SEQ ID NO: 2123 - DNA, 3144 bp, Homo sapiens
agtcgctatcggaggccgcgcgggtggctgagcagcggcctggtgcgctcgcttagcgggcgacggaatcagacggacgtggacgcccccggagtggaagccgaagcaggagttgttgttgctgaggggctgccgcagccgccgcgagcctccggacagacgccagagcgaggagggcgctacgcgacttggcaagatgacccagttcctgccgcccaaccttctggccctctttgccccccgtgaccctattccatacctgccacccctggagaaactgccacatgaaaaacaccacaatcaaccttattgtggcattgcgccgtacattcgagagtttgaggaccctcgagatgcccctcctccaactcgtgctgaaacccgagaggagcgcatggagaggaaaagacgggaaaagattgagcggcgacagcaagaagtggagacagagcttaaaatgtgggaccctcacaatgatcccaatgctcagggggatgccttcaagactctcttcgtggcgagagtgaattatgacacaacagaatccaagctccggagagagtttgaggtgtacggacctatcaaaagaatacacatggtctacagtaagcggtcaggaaagccccgtggctatgccttcatcgagtacgaacacgagcgagacatgcactccaccacgcagctggcttgcagctgatgcttacgctccccttacaacacctcagtgtatggttggtataagggtttgtatcatgggtaagatcactcagcaccgcacaccagcccagcttagccaggcagctcaggagcagcgaggcgcccctcctcccaccccagtcgcccccgtagcctccccgcacccatggccctttccttgtttgggtgccctttgtccctcctgccccgatccgtatgctctctgagaatcttgctgatcccaggaggggaaggatgaacctggtgggaaaggcggcggcctctccgcttgggttccacccagcctctgatgacccggcttcgtgatgtcagcggcgaggtggcaggaacaccgagggcagggctccaggccagggctccactggagcccttcagccttccctccctgcccccgtgctttctatggggctgctactgtgctggccctggagagtctttttggctgctagttttggggtgctctgccccctttctgtcttccttactgtggttgaggcctcccgagggggctggctgtggtgtccagcagctctccagaggtggtcaggagctccctaaagtgcatggaattggggcttggggtgtgggagggaccaaggggtaggctgctagcagctgaaggtgtcgtaggtttttactaaagaaccttccactgtctagagacttgagagagggaaagagagagagaggcctagacgaacacaatcacatgttttctttgctgttcctcccgggatgggcctgttttggggtttgggactctgaacccgagcggggttccttcgcttgactttgatcctggtccttaaatgcctttccccactcccctcccgtgggttcaggggccaagcggcccctcctcagagcacgggcagcaccgtctcctggacccctgtgtgccagcctctgcagacgcagctggtgggagggagcatggatttggaggtggagaagtcactcctggtcctcggagggggtgggctgtgtgcctagttcagtgtgactcggggattggtgagggcggacaggtttctgaggcctccctagccttctttgtaaattcacacgagatagtccagggctttccagcgcccagcttggatgataatcctcgtctcccccactctaaggcctccttgagatttctttggggtctaccacgtcctctgcctgtctccaggtggtacaggagatgtggttcctctccctctcctggctccctagaaccccccacttcccctccctgtagctttagctgaccccgtggtggtgggtgtggggtctgtgcgcgtgctcaggtaagcttgggggctccaggtaagcggtcccgtgtcccccccccgggaagcccgcctcctcgccaggcccccaggagttgccgagccccccccatcccgctcggtttggacacccgcaaggccggcatcgccgcttacaaacacgcagatggcaagaagattgatggcaggagggtccttgtggacgtggagaggggccgaaccgtgaagggctggaggccccggcggctaggaggaggcctcggtggtaccagaagaggaggggctgatgtgaacatccggcattcaggccgcgatgacacctcccgctacgatgagaggcccggcccctccccgcttccgcacagggaccgggaccgggaccgtgagcgggagcgcagagagcggagccgggagcgagacaaggagcgagaacggcgacgctcccgctcccgggaccggcggaggcgctcacggagtcgcgacaaggaggagcggaggcgctccagggagcggagcaaggacaaggaccgggaccggaagcggcgaagcagccggagtcgggagcgggcccggcgggagcgggagcgcaaggaggagctgcgtggcggcggtggcgacatggcggagccctccgaggcgggtgacgcgccccctgatgatgggcctccaggggagctcgggcctgacggccctgacggtccagaggaaaagggccgggatcgtgaccgggagcgacggcggagccaccggagcgagcgcgagcggcgccgggaccgggatcgtgaccgtgaccgtgaccgcgagcacaaacggggggagcggggcagtgagcggggcagggatgaggcccgaggtgggggcggtggccaggacaacgggctggagggtctgggcaacgacagccgagacatgtacatggagtctgagggcggcgacggctacctggctccggagaatgggtatttgatggaggctgcgccggagtgaagaggtcgtcctctccatctgctgtgtttggacgcgttcctgcccagccccttgctgtcatcccctcccccaaccttggccacttgagtttgtcctccaagggtaggtgtctcatttgttctggccccttggatttaaaaataaaattaatttcctgttg

SEQ ID NO: 2124 - DNA, 946 bp, Homo sapiens
gcgggtggctgagcagcggcctggtgcgctcgcttagcgggcgacggaatcagacggacgtggacgcccccggagtggaagccgaagcaggagttgttgttgctgaggggctgccgcagccgccgcgagcctccggacagacgccagagcgaggaggtacgcgacttggcaagatgacccagttcctgccgcccaaccttctggccctctttgccccccgtgaccctattccatacctgccacccctggagaaactgccacatgaaaaacaccacaatcaaccttattgtggcattgcgccgtacattcgagagtttgaggaccctcgagatgcccctcctccaactcgtgctgaaacccgagaggagcgcatggagaggaaaagacgggaaaagattgagcggcgacagcaagaagtggagacagagcttaaaatgtgggaccctcacaatgatcccaatgctcagggggatgccttcaagactctcttcgtggcgagagtgaattatgacacaacagaatccaagctccggagagagtttgaggtgtacggacctatcaaaagaatacacatggtctacagtaagcggtcaggaaagccccgtggctatgccttcatcgagtacgaacacgagcgagacatgcactccgcttacaaacacgcagatggcaagaagattgatggcaggagggtccttgtggacgtggagaggggccgaaccgtgaagggctggaggccccggcggctaggaggaggcctcggtggtaccagaagaggaggggctgatgtgaacatccggcattcaggccgcgatgacacctcccgctacgatgagagggaccgggaccgggaccgtgagcgggagcgcagagagcggagccgggagcgagacaaggagcgagaacggcgacgctcccgctcccgggaccggcggaggcgctcacg

SEQ ID NO: 2125 - DNA, 3071 bp, Homo sapiens
atggggctgctactgtgctggccctggagagtctttttggctgctagttttggggtgctctgccccctttctgtcttccttactgtggttgaggcctcccgagggggctggctgtggtgtccagcagctctccagaggtggtcaggagctccctaaagtgcatggaattggggcttggggtgtgggagggaccaaggggtaggctgctagcagctgaaggtgtcgtaggtttttactaaagaaccttccactgtctagagacttgagagagggaaagagagagagaggcctagacgaacacaatcacatgttttctttgctgttcctcccgggatgggcctgttttggggtttgggactctgaacccgagcggggttccttcgcttgactttgatcctggtccttaaatgcctttccccactcccctcccgtgggttcaggggccaagcggcccctcctcagagcacgggcagcaccgtctcctggacccctgtgtgccagcctctgcagacgcagctggtgggagggagcatggatttggaggtggagaagtcactcctggtcctcggagggggtgggctgtgtgcctagttcagtgtgactcggggattggtgagggcggacaggtttctgaggcctccctagccttctttgtaaattcacacgagatagtccagggctttccagcgcccagcttggatgataatcctcgtctcccccactctaaggcctccttgagatttctttggggtctaccacgtcctctgcctgtctccaggtggtacaggagatgtggttcctctccctctcctggctccctagaaccccccacttcccctccctgtagctttagctgaccccgtggtggtgggtgtggggtctgtgcgcgtgctcaggtaagcttgggggctccaggtaagcggtcccgtgtcccccccccgggaagcccgcctcctcgccaggcccccaggagttgccgagccccccccatcccgctcggtttggacacccgcaaggccggcatcggtaaatggcacctttttctcttcctctggttgttatttgggggggagcgggctggggcggggcagggtattacggttggttgaggacagccccctaggccagggctgggtgggggaacggggactttttggccttcatgacagccccacgttgatcacaggccagggcctcaggcttgccttctgctacgcgctgcccgagagcagcagtgagcctctcccccgtctcccctctacgactcccctttcctggcaggctcaggctggggtgcgctcccagcacgtgttgagccgggggtgtggagggcgagatggggcagggctggggggaggcagagtcagtcgtctcaggtaaggcagggattttcagtagcaccgcacggctccccatgcttcctccactgcccctctcccctgctgcaggggccccgccaggccccctgggagtgtataacccgcctctctgctccctgccatttcctgaagatttctcccacccccttctggttcattttctgttctgatgtctgttccccccacactcacccccctccaaaaaaaacaaaaacagaaaaaaccggtgtggtctggggtgcggagcgtcccagctgggcctcctgccccggcttggtgtctcagggtgcatgcttggggttgtggaggagccccctcccccacagcagagtccagcgtggagttaaccttcagtttctttgcagcgattttggccgccctggcgggagggggctgttccatcatgtgggagaggaagggccggggagcctagggggtggcgggtgagggtggacgtctcccccgaccaggagtggttggggcgctgagaggaagcagacgctgagatggagcaggcccttcaccggtttgggagagggttggtctggctgtcagttgcctggctgtctgttgggcgtgtgcgtgtgcgtgatgatggggacacggggcggggattctgtagagctgggcctgtcctgactagaggaccctctggggactcctctcccctccccctccccacatctgttacagccgcttacaaacacgcagatggcaagaagattgatggcaggagggtccttgtggacgtggagaggggccgaaccgtgaagggctggaggccccggcggctaggaggaggcctcggtggtaccagaagaggaggggctgatgtgaacatccggcattcaggccgcgatgacacctcccgctacgatgagaggcccggcccctccccgcttccgcacagggaccgggaccgggaccgtgagcgggagcgcagagagcggagccgggagcgagacaaggagcgagaacggcgacgctcccgctcccgggaccggcggaggcgctcacggagtcgcgacaaggaggagcggaggcgctccagggagcggagcaaggacaaggaccgggaccggaagcggcgaagcagccggagtcgggagcgggcccggcgggagcgggagcgcaaggaggagctgcgtggcggcggtggcgacatggcggagccctccgaggcgggtgacgcgccccctgatgatgggcctccaggggagctcgggcctgacggccctgacggtccagaggaaaagggccgggatcgtgaccgggagcgacggcggagccaccggagcgagcgcgagcggcgccgggaccgggatcgtgaccgtgaccgtgaccgcgagcacaaacggggggagcggggcagtgagcggggcagggatgaggcccgaggtgggggcggtggccaggacaacgggctggagggtctgggcaacgacagccgagacatgtacatggagtctgagggcggcgacggctacctggctccggagaatgggtatttgatggaggctgcgccggagtgaagaggtcgtcctctccatctgctgtgtttggacgcgttcctgcccagccccttgctgtcatcccctcccccaaccttggccacttgagtttgtcctccaagggtaggtgtctcatttgttctggccccttggatttaaaaataaaattaatttcctgttg

SEQ ID NO: 2126 - DNA, 1574 bp, Homo sapiens
tttgcggccgggacccaccccctgctccagtcgctatcggaggccgcgcgggtggctgagcagcggcctggtgcgctcgcttagcgggcgacggaatcagacggacgtggacgcccccggagtggaagccgaagcaggagttgttgttgctgaggggctgccgcagccgccgcgagcctccggacagacgccagagcgaggagggcgctacgcgacttggcaagatgacccagttcctgccgcccaaccttctggccctctttgccccccgtgaccctattccatacctgccacccctggagaaactgccacatgaaaaacaccacaatcaaccttattgtggcattgcgccgtacattcgagagtttgaggaccctcgagatgcccctcctccaactcgtgctgaaacccgagaggagcgcatggagaggaaaagacgggaaaagattgagcggcgacagcaagaagtggagacagagcttaaaatgtgggaccctcacaatgatcccaatgctcagggggatgccttcaagactctcttcgtggcgagagtgaattatgacacaacagaatccaagctccggagagagtttgaggtgtacggacctatcaaaagaatacacatggtctacagtaagcggtcaggaaagccccgtggctatgccttcatcgagtacgaacacgagcgagacatgcactccgcttacaaacacgcagatggcaagaagattgatggcaggagggtccttgtggacgtggagaggggccgaaccgtgaagggctggaggccccggcggctaggaggaggcctcggtggtaccagaagaggaggggctgatgtgaacatccggcattcaggccgcgatgacacctcccgctacgatgagaggcccggcccctccccgcttccgcacagggaccgggaccgggaccgtgagcgggagcgcagagagcggagccgggagcgagacaaggagcgagaacggcgacgctcccgctcccgggaccggcggaggcgctcacggagtcgcgacaaggaggagcggaggcgctccagggagcggagcaaggacaaggaccgggaccggaagcggcgaagcagccggagtcgggagcgggcccggcgggagcgggagcgcaaggaggagctgcgtggcggcggtggcgacatggcggagccctccgaggcgggtgacgcgccccctgatgatgggcctccaggggagctcgggcctgacggccctgacggtccagaggaaaagggccgggatcgtgaccgggagcgacggcggagccaccggagcgagcgcgagcggcgccgggaccgggatcgtgaccgtgaccgtgaccgcgagcacaaacggggggagcggggcagtgagcggggcagggatgaggcccgaggtgggggcggtggccaggacaacgggctggagggtctgggcaacgacagccgagacatgtacatggagtctgagggcggcgacggctacctggctccggagaatgggtatttgatggaggctgcgccggagtgaagaggtcgtcctctccatctgctgtgtttggacgcg

SEQ ID NO: 2127 - DNA, 1665 bp, Homo sapiens
tgaggagcgtggctacgttgcttccggtgcctggctccgtttcctgcttttggttcttacagtagtcggcgtaggccttaggtgggttcgtgcgccttctacctcgctgtttcggttttcctggctcctcggcccttttctcccctgttgcagctgggagcggacgaagcgcgaagctgggattttttactgtctcctgaagaatttaacacaaacatggatatcagaccaaatcatacaatttatatcaacaatatgaatgacaaaattaaaaaggaagaattgaagagatccctatatgccctgttttctcagtttggtcatgtggtggacattgtggctttaaagaccatgaagatgagggggcaggcctttgtcatatttaaggaactgggctcatccacaaatgccttgagacagctacaaggatttccattttatggtaaaccaatgcgaatacagtatgcaaaaacagattcggatataatatcaaaaatgcgtggaacttttgctgacaaagaaaagaaaaaagaaaagaaaaaagccaaaactgtggaacagactgcaacaaccacaaacaaaaagcctggccagggaactccaaattcagctaatacccaaggaaattcaacaccaaatcctcaggtccctgattaccctccaaactatattttattccttaataacttaccagaagagactaatgagatgatgttatccatgctgtttaatcagttccctggcttcaaggaagtacgtctggtaccagggaggcatgacattgcttttgttgaatttgaaaatgatgggcaggctggagctgccagggatgctttacagggatttaagatcacaccgtcccatgctatgaagatcacctatgccaagaaataacatttgggatagtcgtctttaaaagacttggtgttatttacagtgtttgttttgataacatttggctgggtcattttaatagttagagatgaggaggagtaaaagtgaaatttttgtgaaggacttaaattatccagtgtttctttagccttggtgaactatgaaatacgaaggccttaattttgtacaataaacttttatttgtattctgtgtatataatgctttcttgattgacccatctccctatcatcaaatgacttctagtctagaacacacttaaggtttataaacttgtgtaataggatgcttttctagtgttactttggaggagctaattatacaacatcattgaaccattcaataaaagttaagtaaaattagatcacagaagctagtagatgactgttgtattaatggtaacaatgattgttctgggtattagaagaaaatgagacccaggcaggatctaaatttgatctttgtatccttttaagaaatgaatatattattttgctgctagtagggattccacaagttttcttcattcagtattaaataaaggctgttcttactgtttactgagaaaacagaaagggaatgctatcttcacactttgcatttaatgctgtttccttcatgaggcaggactgttctaaggttaatatgcaatctctttattgaaagacctccagggtaaaaattttttgatctatagtctcttttcccccttaagacaaatagactgattaataaagagttgccagtgctaa

SEQ ID NO: 2128 - DNA, 1588 bp, Homo sapiens
ttctagacttgtcggcgctcgattgaggagcgtggctacgttgcttccggtgcctggctccgtttcctgcttttggttcttacagtagtcggcgtaggccttagattttttactgtctcctgaagaatttaacacaaacatggatatcagaccaaatcatacaatttatatcaacaatatgaatgacaaaattaaaaaggaagaattgaagagatccctatatgccctgttttctcagtttggtcatgtggtggacattgtggctttaaagaccatgaagatgagggggcaggcctttgtcatatttaaggaactgggctcatccacaaatgccttgagacagctacaaggatttccattttatggtaaaccaatgcgaatacagtatgcaaaaacagattcggatataatatcaaaaatgcgtggaacttttgctgacaaagaaaagaaaaaagaaaagaaaaaagccaaaactgtggaacagactgcaacaaccacaaacaaaaagcctggccagggaactccaaattcagctaatacccaaggaaattcaacaccaaatcctcaggtccctgattaccctccaaactatattttattccttaataacttaccagaagagactaatgagatgatgttatccatgctgtttaatcagttccctggcttcaaggaagtacgtctggtaccagggaggcatgacattgcttttgttgaatttgaaaatgatgggcaggctggagctgccagggatgctttacagggatttaagatcacaccgtcccatgctatgaagatcacctatgccaagaaataacatttgggatagtcgtctttaaaagacttggtgttatttacagtgtttgttttgataacatttggctgggtcattttaatagttagagatgaggaggagtaaaagtgaaatttttgtgaaggacttaaattatccagtgtttctttagccttggtgaactatgaaatacgaaggccttaattttgtacaataaacttttatttgtattctgtgtatataatgctttcttgattgacccatctccctatcatcaaatgacttctagtctagaacacacttaaggtttataaacttgtgtaataggatgcttttctagtgttactttggaggagctaattatacaacatcattgaaccattcaataaaagttaagtaaaattagatcacagaagctagtagatgactgttgtattaatggtaacaatgattgttctgggtattagaagaaaatgagacccaggcaggatctaaatttgatctttgtatccttttaagaaatgaatatattattttgctgctagtagggattccacaagttttcttcattcagtattaaataaaggctgttcttactgtttactgagaaaacagaaagggaatgctatcttcacactttgcatttaatgctgtttccttcatgaggcaggactgttctaaggttaatatgcaatctctttattgaaagacctccagggtaaaaattttttgatctatagtctcttttcccccttaagacaaatagactgattaataaagagttgccagtgctaa

SEQ ID NO: 2129 - DNA, 2656 bp, Homo sapiens
acgccgtagggggcgggccgttcgggcttggtttcctgggcgaccaccgctggctagtccgttagaggcgtgcgggcttcggaggcgtgcgggcttcgggtgccatggggactcctcccggcctgcagaccgactgcgaggcgctgctcagccgcttccaggagacggacagtgtacgcttcgaggacttcacggagctctggagaaacatgaagttcgggactatcttctgtggcagaatgagaaatttagaaaagaacatgtttacaaaagaagctttagctttggcttggcgatattttttacctccatacaccttccagatcagagttggtgctttgtatctgctatatggattatataatacccaactgtgtcaaccaaaacaaaagatcagagttgccctgaaggattgggatgaagttttaaaatttcagcaagatttagtaaatgcacagcattttgatgcagcttatatttttaggaagctacgactagacagagcatttcactttacagcaatgcccaaattgctgtcatataggatgaagaaaaaaattcaccgagctgaagttacagaagaatttaaggacccaagtgatcgtgtgatgaaacttatcacttctgatgtattagaggaaatgctgaatgttcatgatcattatcagaacatgaaacatgtaatttcagttgataagtccaagccagataaagccctcagcttgataaaggatgatttttttgacaatattaagaacatagttttggagcatcagcagtggcacaaagacagaaagaatccatccttaaagtcaaaaactaatgatggagaagaaaaaatggaaggaaattcacaagaaacggagagatgtgaaagggcagaatcattagcgaaaataaaatcaaaggccttttcagttgtcatacaggcatccaaatcaagaaggcatcgtcaagtcaaactcgactcttctgactctgattctgcatctggtcaagggcaagtcaaagcaactaggaaaaaagagaagaaagaaagattgaaaccagcaggaaggaagatgtctctcagaaacaaaggcaatgtgcagaatatacacaaggaagataaacctttaagtctgagtatgcctgtaattacagaagaagaagagaatgaaagtttgagtggaacagagttcactgcatccaagaagaggagaaaacactgaacaaagagcctggtgtagtttttaattttgagttttctgacagaagaaaagattgatattttgtgtattgaacaggaagactgccagtattaaaaaaatccttctgggaatctgtaggttatttcttggaaattgcaatacgtagttctagaataaaagtacaaaaaattagaataagaattctttaacattttctttaatgatttgcataaatggagataaaacttgtatttagtatgtaatagaaaaaattctgttattcgcagattgttactatttcctataaggttttgtgatactatactgtcctaatacagtctggtaatactattctattttatttaaaatattttttattgaaatattaatgtttattacatgcaaataactattttgtatctacagtcggataatggattttttattttgtatatttattctattttgtatattgttaagtgcaataaagtttttgccttgctttattttttaatacataaaacttacattctcataacgtgattgataacttaggaagttcacaatgtattttctacttctgcaattaaatattctttagtgcttgtttattattactaaatactaattaagtactaacaagtacttaaatactaatgtattaagtatttaagtactttctaataaaatctttaacaataataatgtaaatttcagaatgtgtctctggtacagaatagttgatattaacagaaaaaaaaaaatctgtagcttcatgaatatgccactctgttaatttcttgttccagacattttaatagagattgcttgagccatgttgtttgaattgctgccaatagcagaccatatccctatcatgttgttggctcaactgttttttttttttccctaatagagatggagtatcgctatgttgctcaggctggtcttgaactcctgggctcaagctatcctcctgcctcagcctcccaaagtactgggattataggtgtgagctactgtacccagccttaacctgtttcacagttgattatacttcatgctgttttccagcatggtattattaagggatttaaagtttgggttgcatgcctgtaatcccagcattttgggaggccgaggtgggcggatcacgaggtcaggagatcgagaccatcgtgactaacacagtgaaaccccgtctctaataaaaatacgaaaaattagccaggcgtggtggcgggcgcctgtaatcccagctactcgggaagctgaggcaggagaatggtgtgaacccagtgagccgagatcgtgccactgcactccagcctgggcaacagagtgagacttcgtctcaaaaaaaaaaaaaagtttgggttgaagatcaaattcgtgatatctctatatctaatctttaaaaatcagaatgctaatgctgacgcaaataaaattttcatttattagca

SEQ ID NO: 2130 - DNA, 1548 bp, Homo sapiens
cccgtagctccgcccatcggagaagcgaccttacagcgcctgcctctttctgagcggcatgaagccacctcccaggcggcgagcggccccggcgcgctatctgggcgaggtgaccggtcccgcgacctggagcgctcgcgagaagcggcagctagtgcgactcctgcaggcgcggcagggccagccggagccggacgccaccgagctggcccgggagctgcggggccggagcgaggctgagatccgggtcttcctccagcagctcaagggccgcgtagcccgggaggccattcagaaagtgcatccgggtggccttcagggaccaaggcgccgggaggcacagcccccagcccccatagaggtctggacggatctggctgagaagataacagggccactggaagaagccctggcagtggctttctcgcaggtgctcaccatcgcggccacggaaccggtcaccctcctgcactccaagccccccaagcccacgcaggcccgtggaaagcctttgctcctgagcgcccctggaggacaggaagaccccgcccctgaaatacctagctctgcccctgctgcacctagctccgcacccaggactcctgaccctgcccctgagaaaccttctgagtcgtcggctggtccctccactgaagaagactttgctgtggactttgagaagatctacaagtacttgtcctctgtctcccgaagtggccgcagccccgagctctcagcagctgagtccgctgtggtcctcgacctgctcatgtcacttccagaggagctgccactcctgccctgcacagccctggttgagcatatgacggagacgtacctacgcctgacagccccccagcccattcccgctggagggagcctggggcctgcagcagaaggggatggggctggctccaaggcaccagaggagacccccccagccaccgagaaggccgagcacagcgaactgaaatcgccttggcaagcagctgggatctgtcccctgaacccgttcctggtgcccctggagcttctgggtcgggcagccacccctgccaggtgaggggcatggcgggcaggaggccacaccaggccccccgccctgcccctcggttctgctcggctggccctggctctttctgaggatcccgtcatgggggaaggtccttgagatgatgctcagctgtggggcgggcctctaagatgccccatactttgggggtctcagaaatggaacccccgttgtacaggggttgggtgggggttgcaggactccactcacaagcctcctgatgtcaaggacaggcggacagggctggcctcccccagtccccaagccccactgtgccttgttgtctgctggggggccatagctggcactgcccaccgtaaaggccctcgcacattttcccccttcctgtacacctcggggccagcatcctcaccttcttcaactgaccagtcgtggttactccctgctgccaggtccttccccttcccgggggtattctgtgaccatgaataaagttatcattctctttctctttc

SEQ ID NO: 2131 - DNA, 72 bp, Homo sapiens
ttggcaagcagctgggatctgtcccctgaacccgttcctgagtcgctggggcctccggtagggcccggtctg

SEQ ID NO: 2132 - DNA, 753 bp, Homo sapiens
ataccaaacaatgctggtgttgggcagtcaaaaactcacacaactgagggattcaattcgatgtgtcagtgacctccagattggtggtgaattcagcaacactcctgaccaagcccctgagcacatcagcaaagacctatacaaatcagccttcttttattttgaaggaacattttataatgataaaagatacccagaatgcagagatttgagcagaactatcattgagtggtcagagtcccatgatagaggctatggaaagtttcagactgctagaatggaagatttcaccttcaatgacttgtgtattaaactgggttttccttacttatactgtcatcagggagactgtgaacatgtcattgtcattactgacataaggtaggtgacagcacttaagacattttgttacctttttttttctttatttcagagtacaaaaccagagatagtttttttaaaaataagaggagtaaaagtaataaccattgcaacttggcttgggagcagcaaaaatactgtcttctttccatgcaaataccaactctttccatccatttgcatcctctattgttcattattttggaaaatctttaagaaatactttactattagacggttaaaaatctgttaatactttaaaaagtatctctattttgtattaaatagctgttattcagatatagtacttatccatttatatataacattgcaactttatttttaggtttgtctttttgccaaaatttgaag

SEQ ID NO: 2133 - DNA, 2303 bp, Homo sapiens
atggcctgccgggaaatgtagtttctgatgccctgcccgcgccgcctcgccgctcgccggccgggcgccccaagcaactacaacttccatcacgctctgcgaggccttgatctgcaggcttttgcaggggaaggagtggggcgaacatggctgaaggaagccgaggtggccctacgtgtagcggggtgggtggcaggcaggacccagtctccggcagtggcggctgcaactttccagagtatgagcttcccgagctaaatacgcgcgctttccatgtgggcgcctttggggagctgtggcggggccgtctgcgcggggccggggacttgtcgctgagggagccgccggcatccgctctgcctgggagccaggcagctgactccgaccgggaggatgccgcggtggccagggatctggactgcagcctggaggcggcggctgagctgagggcggtgtgcggccttgataaactgaaatgccttgaggacggtgaggatccagaagtcattccggagaatactgacctggtgactttgggggttagaaaaaggttcttggaacatcgggaagaaaccattacaatagatcgagcctgcagacaagaaacattcgtttatgagatggagtcacatgccataggaaaaaagcctgaaaattcagcagacatgattgaagaaggggagcttatcctatctgtgaatatcttgtaccctgttatatttcataaggacctatacaaatcagccttcttttattttgaaggaacattttataatgataaaagatacccagaatgcagagatttgagcagaactatcattgagtggtcagagtcccatgatagaggctatggaaagtttcagactgctagaatggaagatttcaccttcaatgacttgtgtattaaactgggttttccttacttatactgtcatcagggagactgtgaacatgtcattgtcattactgacataaggcttgtgcatcatgatgactgcttggataggacattgtatcccctccttatcaagaagcattggctatggaccagaaaatgttttgtttgtaaaatgtatacagccagatgggtgacgaacaatgacagttttgcaccagaggacccatgcttcttttgtgatgtttgcttccgaatgctgcactatgattcagaaggcaacaaactgggggaattccttgcttatccttatgttgatcctggaacctttaattaagaatagctacactcacaaaaataccccctcatgaaataactgttctcttggatggttaccttatttctaagaaacgccactgaggaacaggatccactttgaacagtccgctaaagctatcaaaaaaaagtccaaatgacagattttcttataatgatagtatttaaatgtttataacatagtttaattttatatttattccagatagtatttaatttagtgctttttacccattttgagttgagttgtagtactttatatattctgactttaaatcctttgtcagacacacatattctttctcccaatccatgccttccctattcattctctgtccagagttttttgctaaagatagaattattaatgatacatcaagtagtggaagtgttttgaaaattctttgaagaatgtgagagctacaccttctaccatgaggcttccaaggttgtatttaaatttgactgaatatctggatggctaagaacagacatttatcttacacatggaaaactgacgaaacctataagcctatgtgtttgacagtgaagtatgttttatggacttaaatgccacaaacagttaagtccattggcttggagatgacaagcacgagtttctgagcatcctttttctggccaatcggacaaaatagagttagcaaagccctcacagcaccctatgaaaaatctctgctcttatacaggattagatgcagacctcatcttgacctaacatctgtaaccaggtatgtcaacctagttatctagtgtagaatccttcagagatatttcagtctctctctcttcactggatggcctgaagaaaagggggaaaggtacaactggaattaggattttctcctgatgaaggaaaaaaagacattaagtctgcattatatttttaaacccatgaaaagactgaaaccaaccaaacaaaagaaaaacttgacttgttattagaacagtcattattatttttttcttcttcaaaactgttattttaccatgttgtatcttcttcccaaagtaatatgcagatgaagcaaaataactcagcaaagtgtcatgg

SEQ ID NO: 2134 - DNA, 5680 bp, Homo sapiens
gcggtgccgcgccctggggcgggcctgcccatggcctgccgggaaatgtagtttctgatgccctgcccgcgccgcctcgccgctcgccggccgggcgccccaagcaactacaacttccatcacgctctgcgaggccttgatctgcaggcttttgcaggggaaggagtggggcgaacatggctgaaggaagccgaggtggccctacgtgtagcggggtgggtggcaggcaggacccagtctccggcagtggcggctgcaactttccagagtatgagcttcccgagctaaatacgcgcgctttccatgtgggcgcctttggggagctgtggcggggccgtctgcgcggggccggggacttgtcgctgagggagccgccggcatccgctctgcctgggagccaggcagctgactccgaccgggaggatgccgcggtggccagggatctggactgcagcctggaggcggcggctgagctgagggcggtgtgcggccttgataaactgaaatgccttgaggacggtgaggatccagaagtcattccggagaatactgacctggtgactttgggggttagaaaaaggttcttggaacatcgggaagaaaccattacaatagatcgagcctgcagacaagaaacattcgtttatgagatggagtcacatgccataggaaaaaagcctgaaaattcagcagacatgattgaagaaggggagcttatcctatctgtgaatatcttgtaccctgttatatttcataagcacaaagaacacaaaccataccaaacaatgctggtgttgggcagtcaaaaactcacacaactgagggattcaattcgatgtgtcagtgacctccagattggtggtgaattcagcaacactcctgaccaagcccctgagcacatcagcaaagacctatacaaatcagccttcttttattttgaaggaacattttataatgataaaagatacccagaatgcagagatttgagcagaactatcattgagtggtcagagtcccatgatagaggctatggaaagtttcagactgctagaatggaagatttcaccttcaatgacttgtgtattaaactgggttttccttacttatactgtcatcagggagactgtgaacatgtcattgtcattactgacataaggcttgtgcatcatgatgactgcttggataggacattgtatcccctccttatcaagaagcattggctatggaccagaaaatgttttgtttgtaaaatgtatacagccagatgggtgacgaacaatgacagttttgcaccagaggacccatgcttcttttgtgatgtttgcttccgaatgctgcactatgattcagaaggcaacaaactgggggaattccttgcttatccttatgttgatcctggaacctttaattaagaatagctacactcacaaaaataccccctcatgaaataactgttctcttggatggttaccttatttctaagaaacgccactgaggaacaggatccactttgaacagtccgctaaagctatcaaaaaaaagtccaaatgacagattttcttataatgatagtatttaaatgtttataacatagtttaattttatatttattccagatagtatttaatttagtgctttttacccattttgagttgagttgtagtactttatatattctgactttaaatcctttgtcagacacacatattctttctcccaatccatgccttccctattcattctctgtccagagttttttgctaaagatagaattattaatgatacatcaagtagtggaagtgttttgaaaattctttgaagaatgtgagagctacaccttctaccatgaggcttccaaggtaaagatccttcaaataactgtaatggaaactagggagaatgaattatttacaaataagacaaaattaatagctttgggattatttattttttgagacaaaatctcgctcttgttgcccaggctggaatacagtggcgcaatctcagctcactgcagcctccgcctcccggattcaagtgattctcctgccacagcctcctgagtagctgggattgcaggcacctggcaccatgcctggctaatttttgtatttttagtagagacggggtttcaccatgttggccaggctggtctcaaactcctaacctcaggcgatccacccgcctaagcctcccaaaattttgggatcacaggcgtgagccaccgcgcccggctgctttgggggaatttaatcttagtgtgctgtttagtaatgttaggttttgttttggaggaaactaggcatacaagacatgttaataagactatgtgaataatgaatttaaaaagatcttgagtatatactcataactccagaaataacattaacttgaagctttatttcttgacaaaagctttatgaatgttatgagtttaaaatatgtcaatttaatactatgatttaaaaaacaatagcagatttcgtatgactgtggggacatggaaaaatcaagatcctattgattgctagctctggctcacttattctccggtaatgatactattggatatataccaaaattatataagcaaaaagaaaaaaaataagttttcctggcccaggtcttccattcttctggtccccttactatagtaattctagttactctcatcttattctgaggaaaaaaaaaaaaaccaaaactttttaaacttattttttgacatagggtcttactgtgtcacccaggctggagtacagtggcgtgatcttggctcactggagccctgacctccctaggctcaggtgatcctcccacctcagcctaccgagtagctgagacatggtggcacaggccaccatggcgggctaatttttttatttcttgtagatacagggtttcactatgttgcgcagaatagtctcgaactcctgacctcaagtgatccatccgccttggcctcccagagtgctgcgattacaggcatgaaccacagcgcccagcaaaataaactttctttattttcaggtctagaccatcagatagatttattcaaatattttctgggaacctttatgggtagaacatttaatactgtttagaagacttttaggaatactatagatttcaaatgcatcatttaaaataaataaattccactttctctctcctaggttgtatttaaatttgactgaatatctggatggctaagaacagacatttatcttacacatggaaaactgacgaaacctataagcctatgtgtttgacagtgaagtatgttttatggacttaaatgccacaaacagttaagtccattggcttggagatgacaagcacgagtttctggtatgtctagtgttctcattcactgattcagtcagtacacagataatcagtatagagaacttaagaggctggcttatgttatacctaaatttttactttcttgtatacaacaatgctaaaattgagcagattgataactgccagcaaaccatagatttaagataaatgaatgatttacccaaccctaaaattccatgggtaaaaattttgattcctttattttcaatactgcgttccttataggtcttacatgcatatgcaaggatattttatcttattcattcatttcatactctcaaaacaccaaacttcaaaaagttaattattgtcataatgcattattccatgtgtggtgtcaatacattttagcggacaaagaagaaacatgccagttaaaacatttctgctactgggattctttattaattatttgagaatgttattttgctagttcttaaggttaagtttttcatcaaagactcaggtacctattattgttccctggtgaaactgaggagaaaagttaatcaaccaggttactcccacagtttgcccgtgtgttatgtatcagttatacaggtatcccaccaagttcaagtcaaaagaaattcctaactttgtatatttctggagctataaaacccctgatttaagacagcttttctcttttttcgaggcagcttttctttatgcttatttcaatcaaatgtaacacgcctgtcaaattacatgtaacacattagctaatgaagataggcaactgaaaatgttgtcatgaacatgtcaacctgcttggtagttgaatttgacttttatataatagtggatacacatgcacagaagttactagagaagcaatagctatttctttaaacattcttcaggcatcagtaccatttaaggacaattagacattctagttttactaggagaaaggtcagtcatctctaacattgtgttgcagaattacacgacacaaacataaacacatttctgcctattaaaccagtttctttgtttctaaagagtttaatgatacaggtttgctatttccattagagcatcctttttctggccaatcggacaaaatagagttagcaaagccctcacagcaccctatgaaaaatctctgctcttatacaggattagatgcagacctcatcttgacctaacatctgtaaccaggtaagtgtatgagtaggaacacagacagcagtactgtatcagcaaaatctatcatattatttgaaatcactggatataatattaattataaagtgtatggttctctccagttgttcacataccaaatcccagtcagttctcagattcagatagatgtatctgcaatttctccaagcagctaagaaaaccttcaatggtcagttctgcttggtcatggtatgactctttttttttttttttttttttttttttgagatggagtcttgctctgtctcccaggctggagtgcagtggggcaatctcagctcactgcaacctctgcctcccgggttcaagcaattctcctgcctcagcctcccgaggagctgggattacaggcacgtgccactgcgcccggctgatgtatgactcttttatccagtaatcaaaacacatacgtacatacacacacataccagcccaaaagaggtgttaaaacatacatattacacgtactttttggaggggtggggtggggtggggtggggtggggtgggggttatctatctcaaaattaccttttggtgccttgtcaagctgtggagttttgaccacacacacaaattgagccaatgaacaatttcaatgatcctgaaagttcttaagtcttatgaataattatcaagagttctgagaagttatctgtaaatcagcctatgacaccatttcttgagagttatgattaaagaaacagcaattatgcttgaagcgaacatacatcaactagttagagcaaggtcagcctgtacaagctgacataaattatgagaatgatgctctatctctagaattggaatattctgtggcttctttgtaaaactatagatctggtgggtcatgggaagaaagggagggtgaacaaaagataaatattacctttattttttatcatcttgagcttactgtttagttaccccgtttcccaaaacagcacaacctctgtgaccagttaactaagaaattatttccttggcagcaaacccagaattccatcacttactcttgtaaatagcaagaaagtaatttactagcagagtttgatagaaaaattctttaatgaaaacaagtttacacgttgaacttatggcttaactagaataaatct

SEQ ID NO: 2135 - DNA, 730 bp, Homo sapiens
catggctgaaggaagccgaggtggccctacgtgtagcggggtgggtggcaggcaggacccagtctccggcagtggcggctgcaactttccagagtatgagcttcccgagctaaatacgcgcgctttccatgtgggcgcctttggggagctgtggcggggccgtctgcgcggggccggggacttgtcgctgagggagccgccggcatccgctctgcctgggagccaggcagctgactccgaccgggaggatgccgcggtggccagggatctggactgcagcctggaggcggcggctgagctgagggcggtgtgcggccttgataaactgaaatgccttgaggacggtgaggatccagaagtcattccggagaatactgacctggtgactttgggggttagaaaaaggttcttggaacatcgggaagaaaccattacaatagatcgagcctgcagacaagaaacattcgtttatgagatggagtcacatgccataggaaaaaagcctgaaaattcagcagacatgattgaagaaggggagcttatcctatctgtgaatatcttgtaccctgttatatttcataaggacctatacaaatcagccttcttttattttgaaggaacattttataatgataaaagatacccagaatgcagagatttgagcagaactatcattgagtggtcagagtcccatgatagaggctatggaaagtttcagactgctagaatg

SEQ ID NO: 2136 - DNA, 814 bp, Homo sapiens
gaacatggctgaaggaagccgaggtggccctacgtgtagcggggtgggtggcaggcaggacccagtctccggcagtggcggctgcaactttccagagtatgagcttcccgagctaaatacgcgcgctttccatgtgggcgcctttggggagctgtggcggggccgtctgcgcggggccagggatctggactgcagcctggaggcggcggctgagctgagggcggtgtgcggccttgataaactgaaatgccttgaggacggtgaggatccagaagtcattccggagaatactgacctggtgactttgggggttagaaaaaggttcttggaacatcgggaagaaaccattacaatagatcgagcctgcagacaagaaacattcgtttatgagatggagtcacatgccataggaaaaaagcctgaaaattcagcagacatgattgaagaaggggagcttatcctatctgtgaatatcttgtaccctgttatatttcataagcacaaagaacacaaaccataccaaacaatgctggtgttgggcagtcaaaaactcacacaactgagggattcaattcgatgtgtcagtgacctccagattggtggtgaattcagcaacactcctgaccaagcccctgagcacatcagcaaaaactatcattgagtggtcagagtcccatgatagaggctatggaaagtttcagactgctagaatggaagatttcaccttcaatgacttgtgtattaaactgggttttccttacttatactgtcatcagggagactgtgaacatgtcattgtcattactgacataag

SEQ ID NO: 2137 - DNA, 2574 bp, Homo sapiens
atggcctgccgggaaatgtagtttctgatgccctgcccgcgccgcctcgccgctcgccggccgggcgccccaagcaactacaacttccatcacgctctgcgaggccttgatctgcaggcttttgcaggggaaggagtggggcgaacatggctgaaggaagccgaggtggccctacgtgtagcggggtgggtggcaggcaggacccagtctccggcagtggcggctgcaactttccagagtatgagcttcccgagctaaatacgcgcgctttccatgtgggcgcctttggggagctgtggcggggccgtctgcgcggggccggggacttgtcgctgagggagccgccggcatccgctctgcctgggagccaggcagctgactccgaccgggaggatgccgcggtggccagggatctggactgcagcctggaggcggcggctgagctgagggcggtgtgcggccttgataaactgaaatgccttgaggacggtgaggatccagaagtcattccggagaatactgacctggtgactttgggggttagaaaaaggttcttggaacatcgggaagaaaccattacaatagatcgagcctgcagacaagaaacattcgtttatgagatggagtcacatgccataggaaaaaagcctgaaaattcagcagacatgattgaagaaggggagcttatcctatctgtgaatatcttgtaccctgttatatttcataagcacaaagaacacaaaccataccaaacaatgctggtgttgggcagtcaaaaactcacacaactgagggattcaattcgatgtgtcagtgacctccagattggtggtgaattcagcaacactcctgaccaagcccctgagcacatcagcaaagacctatacaaatcagccttcttttattttgaaggaacattttataatgataaaagatacccagaatgcagagatttgagcagaactatcattgagtggtcagagtcccatgatagaggctatggaaagtttcagactgctagaatggaagatttcaccttcaatgacttgtgtattaaactgggttttccttacttatactgtcatcagggagactgtgaacatgtcattgtcattactgacataaggcttgtgcatcatgatgactgcttggataggacattgtatcccctccttatcaagaagcattggctatggaccagaaaatgttttgtttgtaaaatgtatacagccagatgggtgacgaacaatgacagttttgcaccagaggacccatgcttcttttgtgatgtttgcttccgaatgctgcactatgattcagaaggcaacaaactgggggaattccttgcttatccttatgttgatcctggaacctttaattaagaatagctacactcacaaaaataccccctcatgaaataactgttctcttggatggttaccttatttctaagaaacgccactgaggaacaggatccactttgaacagtccgctaaagctatcaaaaaaaagtccaaatgacagattttcttataatgatagtatttaaatgtttataacatagtttaattttatatttattccagatagtatttaatttagtgctttttacccattttgagttgagttgtagtactttatatattctgactttaaatcctttgtcagacacacatattctttctcccaatccatgccttccctattcattctctgtccagagttttttgctaaagatagaattattaatgatacatcaagtagtggaagtgttttgaaaattctttgaagaatgtgagagctacaccttctaccatgaggcttccaaggttgtatttaaatttgactgaatatctggatggctaagaacagacatttatcttacacatggaaaactgacgaaacctataagcctatgtgtttgacagtgaagtatgttttatggacttaaatgccacaaacagttaagtccattggcttggagatgacaagcacgagtttctgagcatcctttttctggccaatcggacaaaatagagttagcaaagccctcacagcaccctatgaaaaatctctgctcttatacaggattagatgcagacctcatcttgacctaacatctgtaaccaggtatgtcaacctagttatctagtgtagaatccttcagagatatttcagtctctctctcttcactggatggcctgaagaaaagggggaaaggtacaactggaattaggattttctcctgatgaaggaaaaaaagacattaagtctgcattatatttttaaacccatgaaaagactgaaaccaaccaaacaaaagaaaaacttgacttgttattagaacagtcattattatttttttcttcttcaaaactgttattttaccatgttgtatcttcttcccaaagtaatatgcagatgaagcaaaataactcagcaaagtgtcatggaccaagccctttccatcatttctagcataaaagtgaattctctttaaagaacatgagaatgttttatatctgtgataccaacatatttcaaaatcttaataaaaagagaggttgatacaca

SEQ ID NO: 2138 - DNA, 2524 bp, Homo sapiens
gtggggcgaacatggctgaaggaagccgaggtggccctacgtgtagcggggtgggtggcaggcaggacccagtctccggcagtggcggctgcaactttccagagtatgagcttcccgagctaaatacgcgcgctttccatgtgggcgcctttggggagctgtggcggggccgtctgcgcggggccggggacttgtcgctgagggagccgccggcatccgctctgcctgggagccaggcagctgactccgaccgggaggatgccgcggtggccagggatctggactgcagcctggaggcggcggctgagctgagggcggtgtgcggccttgataaactgaaatgccttgaggacggtgaggatccagaagtcattccggagaatactgacctggtgactttgggggttagaaaaaggttcttggaacatcgggaagaaaccattacaatagatcgagcctgcagacaagaaacattcgtttatgagatggagtcacatgccataggaaaaaagcctgaaaattcagcagacatgattgaagaaggggagcttatcctatctgtgaatatcttgtaccctgttatatttcataagcacaaagaacacaaaccataccaaacaatgctggtgttgggcagtcaaaaactcacacaactgagggattcaattcgatgtgtcagtgacctccagattggtggtgaattcagcaacactcctgaccaagcccctgagcacatcagcaaagacctatacaaatcagccttcttttattttgaaggaacattttataatgataaaagatacccagaatgcagagatttgagcagaactatcattgagtggtcagagtcccatgatagaggctatggaaagtttcagactgctagaatggaagatttcaccttcaatgacttgtgtattaaactgggttttccttacttatactgtcatcagggagactgtgaacatgtcattgtcattactgacataaggcttgtgcatcatgatgactgcttggataggacattgtatcccctccttatcaagaagcattggctatggaccagaaaatgttttgtttgtaaaatgtatacagccagatgggtgacgaacaatgacagttttgcaccagaggacccatgcttcttttgtgatgtttgcttccgaatgctgcactatgattcagaaggcaacaaactgggggaattccttgcttatccttatgttgatcctggaacctttaattaagaatagctacactcacaaaaataccccctcatgaaataactgttctcttggatggttaccttatttctaagaaacgccactgaggaacaggatccactttgaacagtccgctaaagctatcaaaaaaaagtccaaatgacagattttcttataatgatagtatttaaatgtttataacatagtttaattttatatttattccagatagtatttaatttagtgctttttacccattttgagttgagttgtagtactttatatattctgactttaaatcctttgtcagacacacatattctttctcccaatccatgccttccctattcattctctgtccagagttttttgctaaagatagaattattaatgatacatcaagtagtggaagtgttttgaaaattctttgaagaatgtgagagctacaccttctaccatgaggcttccaaggttgtatttaaatttgactgaatatctggatggctaagaacagacatttatcttacacatggaaaactgacgaaacctataagcctatgtgtttgacagtgaagtatgttttatggacttaaatgccacaaacagttaagtccattggcttggagatgacaagcacgagtttctggtatgtctagtgttctcattcactgattcagtcagtacacagataatcagtatagagaacttaagaggctggcttatgttatacctaaatttttactttcttgtatacaacaatgctaaaattgagcagattgataactgccagcaaaccatagatttaagataaatgaatgatttacccaaccctaaaattccatgggtaaaaattttgattcctttattttcaatactgcgttccttataggtcttacatgcatatgcaaggatattttatcttattcattcatttcatactctcaaaacaccaaacttcaaaaagttaattattgtcataatgcattattccatgtgtggtgtcaatacattttagcggacaaagaagaaacatgccagttaaaacatttctgctactgggattctttattaattatttgagaatgttattttgctagttcttaaggttaagtttttcatcaaagactcaggtacctattattgttccctggtgaaactgaggagaaaagttaatcaaccaggttactcccacagtttgcccgtgtgttatgtatcagttatacaggtatcccaccaagttcaagtcaaaagaaattcctaactttgtatatttctggagctataaaacccctgatttaaga

SEQ ID NO: 2139 - DNA, 5010 bp, Homo sapiens
acaccttctacgctgggtggccagtttccatgtggcttggtgtgggagcagagacgggacagtggggcctgtccttgttcatccactccctgcctgtgctggttgcagcctcagagcaggcgggagatgttcttggggcttaggctcctggcagagcacatagcaggagtttgtggggtctgaggttcctgtcccagggttccccgattctgtgcctggcctattaatctttctctggggagcccagtgcccactgccgagcaggctcctgccatcccccatgggcgggtgtgtctgaaggagaatgggatcccggcacggtcttggtttctaacatctcggggtgtgttttggaggcaggcgggagtcatggatgtagatgctgaaagagagaagataacacaggagatcaaggagctggaaaggattttggatcccggctcctcgggctcccacgtggagatctcagaatcaagtctcgagtcagattctgaagcagattcactgccttctgaggacttggatcctgccgatcccccgatctcggaagaagaaaggtggggcgaagccagcaatgacgaggacgatcccaaggataaaaccctccctgaagacccagaaacctgcctgcagctgaacatggtctaccaggaggtcatccaggagaagctggctgaggccaacctgctgctggcccagaaccgggagcagcaggaggaactcatgagggatctggctgggtccaaaggcaccaaggtgaaagatggcaaaagcctgcccccaagcacatacatggggcacttcatgaagccgtatttcaaggacaaggtcacgggcgtggggccacctgccaacgaggacacacgagagaaggctgcccaggggatcaaggctttcgaggagctccttgtgaccaaatggaaaaactgggaaaaggccttgctccgaaagtcagtggtgagtgaccgcctgcagcgattgcttcagcccaagttactgaagctcgagtacttgcaccagaagcagagcaaagtctccagtgagctggagaggcaagccctggagaagcagggcagggaagccgagaaggagatccaggacatcaaccagcttccagaagaggccttgctgggaaacaggctggacagccacgactgggagaagatttccaatattaactttgaaggcagccgcagtgcagaggagatccggaagttctggcagaactcggagcaccccagcatcaacaagcaggagtggagcagggaggaggaggagcggctgcaggcgatcgcggctgcacacggccacctggagtggcagaagattgcagaggagctggggaccagccgcagcgccttccagtgcctgcagaaattccagcagcacaacaaagctctgaaacgcaaggagtggacagaggaggaggaccgcatgctcacgcagctggtgcaggagatgcgcgtcggcagccacatcccctaccgcagaattgtctactatatggaagggagagactccatgcagctgatctaccgatggaccaagagcttggatcctggtctgaagaagggttactgggccccggaggaagatgctaagttgcttcaagctgttgccaaatacggggagcaggattggtttaaaatccgggaagaggtgccaggtaggagcgatgcccagtgccgagatcggtatctcaggagattacatttcagcttgaaaaagggtcggtggaatttaaaagaagaggaacagttaattgaattaatagaaaaatatggtgtcggtcactgggcaaaaatagcttctgagctgccccatcggtctggctcccagtgtctgagcaagtggaagatcatgatggggaagaagcagggtctccggaggcggcggcggagggcccgtcacagcgtccggtggagctctaccagcagcagcggcagcagcagtggcagcagtggagggagcagcagcagcagcagcagcagcagcgaggaggacgagccagagcaggcgcaggccggggagggtgacagagcgctgctgtccccacagtacatggtcccggacatggacctgtgggttcctgccaggcagagcaccagccagccatggagaggaggggcaggggcctggctgggaggccccgctgcctccctcagccctcccaaggggtccagtgccagccagggcggcagcaaggaagcttccaccacagccgcggctcctggagaggagacgagtccggtgcaggtccctgccagggcccacggccctgtcccgaggtctgcccaggcctcccactcagcagacactcgcccggcgggcgcagagaagcaggccctggagggtgggaggcgtctgctgacagtgcctgtggagaccgtgctgagggtgctcagggccaacacggctgctcggagctgcacacagaaagagcagctgaggcagccacccctgcccacctcatccccaggggtcagctctggtgacagcgtggcccgatcccatgtgcagtggctacggcacagagccacccagagtgggcagcggcgctggagacacgctctgcaccggaggctcctgaaccgcaggctgctgctggctgtgaccccttgggtaggggacgttgtcgtgccctgcacacaggcttcccagagacccgccgtagtgcagactcaagcggatggcctcagggagcagctgcagcaggcccgcctggccagcacccctgtgtttaccctgtttacccagctgttccacatcgatactgccggctgcttggaggtcgtccgagagaggaaggccctgccacccaggctgccccaggctggtgctcgggacccaccagttcatcttctgcaggcatcctcaagtgcccagagcaccccaggccacctcttcccaaacgtgccggctcaagaagcctcaaagagtgccagccacaaagggagccgaagactggcgtccagccgggtggagcgcaccctaccccaggcgtccctgctggcttcaaccggcccccggcccaagcccaagactgtgtcggagctgcttcaggagaagcggcttcaggaggcccgtgccagggaggccacccggggcccggtggtgctcccgtcccagctgctggtctcctcgtctgtgatcctccagccccctctaccacacaccccacacggccgcccagccccgggtcccaccgtcttaaatgtaccgctctctgggcctggggcccccgcggcagccaaacctggcacttctggctcctggcaggaggctgggacttcagccaaggacaagagactctccaccatgcaagccctgcccctcgctcctgtcttctcagaggccgagggcacagcccctgctgcttcccaagcccctgccctgggccccggccagatctctgtgagctgccccgagagtggtctcggacagtctcaggcccccgctgcatcccggaagcagggcctgcctgaggcgccaccctttctccccgcagcccccagccccaccccactgcccgtccagcccctcagcctgacgcacataggagggccacatgtggcgaccagtgtccccctgcctgtcacctgggtgctcacagcccaggggcttctccctgttcctgtaccagctgtggtgagccttcccaggccagcagggacccctggccccgcagggctgctggccactctgctgcctcccctgactgagactcgggcggcccagggccccagggccccagcgttgagcagctcttggcagcccccagccaatatgaacagggaaccggagccttcctgcaggacagacaccccagctcctcccacacacgccctctcccaaagtcctgcagaagcggatggcagtgtggcctttgtccctggagaggcccaggtggccagggagatacctgagcccaggacgtcctcccacgctgaccctcctgaagcagaacccccttggtccgggaggctgccagccttcggtggtgtcatcccagcaactgagccaagggggacgccggggtccccctcagggacacaggagcccagggggcctctgggcctggagaagctgcccctgcgccagcctgggcctgagaagggggccctggacctggagaagccgcccctaccccagcctgggcctgagaagggggccctggacctgggcctgctgtcccaggagggcgaggcggccacacagcagtggctggggggccagcggggggtgcgtgtgcctcttctgggcagcagactgccctatcagcccccagccctgtgcagcctgcgagctctgtccggtctcctactccacaagaaggccctggagcacaaggccacctccctggtggtggggggcgaggctgagcggccggccggagcactgcaagcctcactggggctggtgcgggggcagctccaggacaacccggcctacctcctgttgcgggcgcggttcctggcagccttcaccctccctgcgctcctggccaccctggccccccaaggcgtccgcaccaccctctcagtaccttcgagggtgggctctgagagtgaggatgaagacctcctgagtgagctggaacttgcagacagggacgggcagccgggctgcacgacagccacatgccccattcagggagccccagactctggtaaatgctctgcttcctcctgcctggatacttctaatgaccctgacgacctggacgtgctcagaacccggcatgccaggcacacccggaagcggaggcggctggtgtgagcagcaggacaagcactttctcagaagcccgtggccctgctgacgagagacagcccacccccagcctgcaagagaggcagccagaggccaggtatctgctggccgctgactgaccaggtccgcagtgaacagaggcgggcctgccgactgactgtgtggcatggagcatggctgttccccaagtgcacacctgaacacttggaggaataaagttctgtttttaattgtgga

SEQ ID NO: 2140 - DNA, 599 bp, Homo sapiens
gcagcccggaggttggctatgtgaccaggcaacatgctgagccggcttcaggaactgcgcaaggaggaggagacgctgctgcggttgaaggcagccctgcacgaccagctgaaccgcctcaagatgttggtgcatgtagacaatgaagcatcaatcaaccaaacaaccctggagctgagcacaaagagtcatgtgacggaagaggaggaggaggaagaggaagaagaatcagattcctaaaggagggggaaagccaggctggtcagttatacaaattgcatttctaaggctcaggctacttctcctcaaggaaatcatcttgccctgggccctgtgatctgcttgaaaggaaagcaagaactataaggaggatgtgtagttgcaaaaatggctccatcggtaactcaagcttcagaatgttatgacatacagaaaatcaaagatgctgtgtcttagcattgagtaatatgggtggtgctgtctgtaatctggtcagattcagttaactgttcagaacaaaatttcctctgaaatactgttgagaaagtctgtcatttgcaaaaagagcagagtttaaatacaagccagtctttccagtc

SEQ ID NO: 2141 - DNA, 989 bp, Homo sapiens
gcggcgatggcgtcatcaccgagtgccgggccgacagcagcccggaggttggctatgtgaccaggcaacatgctgagccggcttcaggaactgcgcaaggaggaggagacgctgctgcggttgaaggcagccctgcacgaccagctgaaccgcctcaaggttgaagaattagccctccaatcaatgatcagttctagaagaggggatgagatgctgtcttctcacactgtacctgaacagtcacatgatatgttggtgcatgtagacaatgaagcatcaatcaaccaaacaaccctggagctgagcacaaagagtcatgtgacggaagaggaggaggaggaagaggaagaagaatcagattcctaaaggagggggaaagccaggctggtcagttatacaaattgcatttctaaggctcaggctacttctcctcaaggaaatcatcttgccctgggccctgtgatctgcttgaaaggaaagcaagaactataaggaggatgtgtagttgcaaaaatggctccatcggtaactcaagcttcagaatgttatgacatacagaaaatcaaagatgctgtgtcttagcattgagtaatatgggtggtgctgtctgtaatctggtcagattcagttaactgttcagaacaaaatttcctctgaaatactgttgagaaagtctgtcatttgcaaaaagagcagagtttaaatacaagccagtctttccagtcaacaatgcctctttgaagaaaaccaattaaagactgtttgcatgccgctgaacccttgtgagcagttaggacacagtctaggacagaaagatgacaaggggaaggactgagggccgtctgagagcacaagctgtttctacctctcagaggcattgaaatattgcatgctataaactgctttgtgtatctgttaccacctctcacttgagacatcactcactggtaaaatgttttataaataaatttataagtagccatcatgga

SEQ ID NO: 2142 - DNA, 785 bp, Homo sapiens
gggagtcggcggcgatggcgtcatcaccgagtgccgggccgacagcagcccggaggttggctatgtgaccaggcaacatgctgagccggcttcaggaactgcgcaaggaggaggagacgctgctgcggttgaaggcagccctgcacgaccagctgaaccgcctcaaggttgaagaattagccctccaatcaatgatcagttctagaagaggggatgagatgctgtcttctcacactgtacctgaacagtcacatgatatgttggtgcatgtagacaatgaagcatcaatcaaccaaacaaccctggagctgagcacaaagagtcatgtgacggaagaggaggaggaggaagaggaagaagaatcagattcctaaaggagggggaaagccaggctggtgaaatgcacatctgaacagagacaggcatgggaaggaggcccaaaagcgacatggcaaaccaccgggcaggggactcgctctttgttgcttcccaaacacttagacgccagcagcatgggttggtgtgctgggctggttaaggccgatggtggagcagagccaacctgcaaaatccacttcctcagcatcagatctcttgataaaagcatgaacctgcatgtaaggaaacgagaggacgtggtgttaaaaagaaacaaaaaaacaaaacccaccaggaaggaaaatccaagagtttcaggtctagagcttgtgctgcacttggaaagagcacctggcacctgcccctgagcaacagtggggccagctgcaggcccaaagacctgctcc

SEQ ID NO: 2143 - DNA, 6649 bp, Homo sapiens
gtctttggcctccgggaccagggagggaggacgctggttgtcctggagcccgggaagctcaagggctgagagggagccgctgcgcgagtcttccccacctcttcccgatcccggactagcgaacttcggaccaccacgtccctccggggataaagtggggtcgtgggaaaggaggctgtgcttctcctcatgcactggggcctgcggtgtttgtctcgagcgtccaacacactaggatccgggagtccgtcgtcacgctccttggcctcgcggtcgcttgtttgctcggcctgctgggagcgatccggcgctgacagccccgctcagactccgggagccgcttgtgggtctttcggaagataactgaagttcacagttaccagccaagaaaacttgaaaatgagcagccgacggaaacgtgctcctccagtgagggtagatgaggaaaagaggcagcagcttcattggaatatgcatgaggacagaaggaatgaacctatcatcataagtgatgatgacgagcagccctgcccaggttcagatacctcttctgctcattatatcattctaagtgatagtctaaaggaagaagtggctcacagagataagaagaggtgttcaaaagtggtgagcttctcaaaaccaattgaaaaagaagagactgttggtattttttcccctttgtctgtaaagttaaatattgtgatttctccctatcattttgataattcctggaaagcatttctaggagaattaactcttcagcttcttcctgcacagagtttaattgaaaatttttccgaaaggagtattacattgatgagttcagagtcaagcaatcagttcctgatttatgttcattcaaaaggtgaagatgtagagaaacaaaaaaaagaaccgatgagtatttgtgacaagggtattctggtggagtcatccttcagtggtgaaatgttagaagatttggggtggctacaaaagaagagaagaataaaactctatcagaaaccagaaggaaatcacattatcaaggttggaatttatcttttggaagctggcctagcaaaactagacttcttgagtgatgcaaattcaagaatgaaaaagttcaatcagctcatgaagaaagtaatggaaaagttacacaattctattattccagatgtgttggaagaggatgaagatgatccggagagtgagccagagggacaagacattgacgagctgtatcactttgtgaaacaaacacatcagcaagaaacgcagtccatccaagtggatgtccagcatcctgcattgatccctgtgttgagaccctaccaaagagaggctgtcaattggatgctacaacaagagtgtttcagaagcagtcctgctactgaaagtgccctgcacttcttatggcgagagattgttacatctgagggtctgaaactctactataatccatatacaggctgcatcattcgtgagtacccaaattctgggccgcagttgcttggtggaattttagcagatgagatgggtcttggaaagacagtggaggttttggctctgattctgacacatactcgacaagatgtcaagcaagatgctctcactcttcccgagggaaaagtggtgaattattttattccgtcacattattttggaggaaaactgaaaaagacagaaatccagaatatcgaatttgaaccaaaagaaaaagttcaatgccctcctacacgtgtgatgatactgacagctgtgaaagaaatgaatggaaaaaaaggagtgtccatcctttccatctataagtatgtcagttctatatatagatacgatgttcaacggaacaggagtcttttgaaacggatgctgaaatgtttaatttttgaaggtctcgtgaaacagatcaaaggccatggtttttctgggacttttacattgggaaagaattacaaggaagaggatatatgtgataaaacaaaaaagcaggcagtagggagtccaaggaaaattcagaaagaaactagaaaatcagggaacaaggacacagattctgaatacttgccatcagacacctctgatgatgatgatgatccttactattattattataagtccaggagaaatcgcagtaaattgaggaaaaagcttgttccatccacaaaaaaaggaaaaagtcaaccatttatcaatcccgattcacaaggtcactgtccagctactagcgactctggaataactgatgttgctatgtctaaaagtacatgtatctctgaattcaaccaagaacatgaaacagaggactgtgctgaatctctaaatcatgctgatagtgatgtaccaccttctaataccatgagtccctttaacacctctgattaccgctttgagtgtatatgtggtgaacttgatcagatagatcgtaagcctcgtgttcaatgcctgaagtgtcacctgtggcaacatgcaaagtgtgtgaattatgatgagaaaaatctgaagatcaagcctttttactgcccccactgccttgttgcaatggaaccagtgtcaacaagagcaactctgatcatctctccaagttccatctgtcaccagtgggtggatgagatcaacaggcatgtgaggtcgtcatctcttcgagtcttggtatatcaaggagtgaagaaagatggctttttacaacctcattttttggcagaacaggatatagttatcattacctatgatgtactgcgttcagaattaaattatgtcgatatcccacatagcaatagtgaggatgggcgtcgcctacggaaccagaagcgctatatggctatcccgagccccctggtagctgtggagtggtggaggatctgccttgatgaagctcagatggttgagtgtcccacagtaaaagctgcagaaatggcccagcgtttgagtgggattaatcgatggtgtatcagtggcactccagtacagagaggattagaggatctttttgggttagtggtctttcttggtattgaaccttactgtgtcaaacactggtgggttcgacttctctatcggccttactgcaagaagaatcctcagcatctctacagctttattgccaagatactgtggaggtctgcaaagaaagatgtgattgaccaaatccaaataccaccacaaaccgaagaaatacactggctccacttttctccagtggaaaggcatttctatcaccgtcagcatgaggtgtgctgccaggatgtggtggtaaaactcaggaagatttctgactgggctctgaagctcagcagcctagacagaaggactgtcacctctatcctgtatccattgctgaggctcagacaggcctgctgtcacccacaggctgttcgtggagagttcttgccactccaaaaaagcaccatgacaatggaagagctgctgacatctttgcagaagaaatgtggaactgaatgtgaagaagcacatcgacagctagtttgtgctctcaatggcttagcaggcattcatattattaaaggtgagtatgccttggcagcagaattgtacagagaagtgttgcgctcctcggaggaacacaaaggaaaactcaaaactgattcacttcaaagacttcatgctacccataacttgatggaattgttgatagccaggcacccagggataccacctaccttgcgtgatggccgacttgaggaagaggccaaacagctgcgagagcactacatgagcaagtgtaatacagaagttgctgaagcccagcaagctttatatcctgtgcagcagaccatccatgagcttcaaagaaagattcattctaattctccttggtggctaaatgtgatccacagagcaatagaatttactattgatgaggagctagttcagcgagtgcgaaatgaaataaccagcaactacaagcaacaaactggcaagctttctatgtcagagaagttccgtgattgcagaggtcttcagttcttacttacaacacaaatggaagagctaaataaatgccagaagctagtaagagaggctgtaaaaaacctggagggacctccatctcgtaatgttattgagtctgcaacagtctgtcacctccgaccagccagacttcctctcaactgctgtgtcttttgtaaagctgatgaattgttcacagagtatgaatcaaagctattttccaacacagtcaaaggccagactgcaatatttgaggagatgatagaagatgaagaaggactggtggatgatcgagcacctaccaccacccggggtctctgggcaataagtgagacagagcgatctatgaaagcaatactatcatttgcaaaatcacataggtttgatgttgaatttgttgatgaaggaagcacttcaatggatctctttgaagcatggaagaaggaatataagttgcttcatgaatattggatggctctgaggaatcgtgtgtctgctgttgatgaacttgcaatggctacagaacgactaagagtgcgtgatcctagggagccaaagcctaatccgcctgttcttcatatcattgaaccacatgaggtagaacaaaaccgaataaaactactaaatgataaagctgttgctacatcacagcttcagaaaaaacttgggcagcttctttacctaactaatttggagaagtctcaagataaaacatcgggaggtgttaatccagaaccttgcccaatctgtgctcgacagctaggaaaacagtgggcggtactgacctgtggtcactgtttctgtaatgaatgcatttctataattattgaacaatacagcgtgggatctcacagaagctccattaagtgtgcaatctgccgccagaccacatctcacaaagaaatctcgtatgtctttacctcagagaaagcaaaccaggaggaggacatccctgtgaagggcagccattctacaaaagtggaagctgtggtcagaactctgatgaaaatacagcttagagatccaggggccaaagcactcgttttctcaacgtggcaagatgtattagatattatttcaaaagctcttactgacaacaacatggaatttgcacaaatcagtcgtgttaagacatttcaggagaacctttcagcatttaaacgtgatccccaaatcaatattttgctgctgcccctgcacacaggttctaatggattaactatcattgaagcaactcatgttctcttggtggagcccatattgaaccctgcccatgagcttcaggccatagggagggtgcaccgaattggacagacaaaacctactattgtacacagattcttaattaaagcaacaatagaagaaagaatgcaggcaatgctgaaaactgctgagagaagtcacacgaactcatcagcaaagcattcagaggcctctgtcttgactgtggctgacctggcagacctatttaccaaagaaactgaagagcttgaatgaactacacttgattcattccatggactttagtgtattaataaactttcatagctgtagagcaaagttacaagttttaaaaacccagtagataacagtaacactgttcctagttgaatgaatttgtttattgttctggttatacagtggcttagtacttattgagtccttttcaatatactgtttccaaaagatctataaagattcttaattttacactcctaataaaacatttattttttgtcccaaatagtatctatatctgatgatgcaagggaattaagagaggtaatgtgtacttttcttatgataagatcactcataaaacagttggaataagaaagtaaactagtctagttttatatgacctggtatattgaacaaacatagatctcagttttggaagggccttcagtatctttagcacatgattcaccaatatcttgttagtaatattttaagtagatggtgaattatattaacccattttttgagtaggcttataccataactttacacctagtaattttgcagtaatacaactccttacaataagttaatgttagacagttatttgtttcttctgcatcttgctactgaaaacaaaaacaatgaaaatattcatatttctattatgtgtaaagtggtgttagtgtaaacagttaactccaaatagattttttaatgtattaatgattaccttaaaattatctgctttccctactcttaatttttcttattgttaaagtttttatatgttgtaagattgatgtatctgtaaatattgcagtttttatgattttgttttattataacatggaaatatggcagggttttttttttaatcattattatactgatgtcttggattctttttctttcccatgttcttgtgtaactagactttttagccagtgatatctgaattcatggtagagttgttatttcactccagttgttcctcccttaagcacgagtctttgaccttttgaacaagagaatgccatgttcacataagcaaatcgttgcaagtgataataacgaagtgtttcttcttctgtgaggaattaatggactttgaaattgctgaataaggagtagcttgttacatcctagccatttgatgtaatacaaatgttcttatttggcttccttttctttgagccttcagagttttaaaggaccctctttgaccctcagg

SEQ ID NO: 2144 - DNA, 7343 bp, Homo sapiens
gtctttggcctccgggaccagggagggaggacgctggttgtcctggagcccgggaagctcaagggctgagagggagccgctgcgcgagtcttccccacctcttcccgatcccggactagcgaacttcggaccaccacgtccctccggggataaagtggggtcgtgggaaaggaggctgtgcttctcctcatgcactggggcctgcggtgtttgtctcgagcgtccaacacactaggatccgggagtccgtcgtcacgctccttggcctcgcggtcgcttgtttgctcggcctgctgggagcgatccggcgctgacagccccgctcagactccgggagccgcttgtgggtctttcggaagataactgaagttcacagttaccagccaagaaaacttgaaaatgagcagccgacggaaacgtgctcctccagtgagggtagatgaggaaaagaggcagcagcttcattggaatatgcatgaggacagaaggaatgaacctatcatcataagtgatgatgacgagcagccctgcccaggttcagatacctcttctgctcattatatcattctaagtgatagtctaaaggaagaagtggctcacagagataagaagaggtgttcaaaagtggtgagcttctcaaaaccaattgaaaaagaagagactgttggtattttttcccctttgtctgtaaagttaaatattgtgatttctccctatcattttgataattcctggaaagcatttctaggagaattaactcttcagcttcttcctgcacagagtttaattgaaaatttttccgaaaggagtattacattgatgagttcagagtcaagcaatcagttcctgatttatgttcattcaaaaggtgaagatgtagagaaacaaaaaaaagaaccgatgagtatttgtgacaagggtattctggtggagtcatccttcagtggtgaaatgttagaagatttggggtggctacaaaagaagagaagaataaaactctatcagaaaccagaaggaaatcacattatcaaggttggaatttatcttttggaagctggcctagcaaaactagacttcttgagtgatgcaaattcaagaatgaaaaagttcaatcagctcatgaagaaagtaatggaaaagttacacaattctattattccagatgtgttggaagaggatgaagatgatccggagagtgagccagagggacaagacattgacgagctgtatcactttgtgaaacaaacacatcagcaagaaacgcagtccatccaagtggatgtccagcatcctgcattgatccctgtgttgagaccctaccaaagagaggctgtcaattggatgctacaacaagagtgtttcagaagcagtcctgctactgaaagtgccctgcacttcttatggcgagagattgttacatctgagggtctgaaactctactataatccatatacaggctgcatcattcgtgagtacccaaattctgggccgcagttgcttggtggaattttagcagatgagatgggtcttggaaagacagtggaggttttggctctgattctgacacatactcgacaagatgtcaagcaagatgctctcactcttcccgagggaaaagtggtgaattattttattccgtcacattattttggaggaaaactgaaaaagacagaaatccagaatatcgaatttgaaccaaaagaaaaagttcaatgccctcctacacgtgtgatgatactgacagctgtgaaagaaatgaatggaaaaaaaggagtgtccatcctttccatctataagtatgtcagttctatatatagatacgatgttcaacggaacaggagtcttttgaaacggatgctgaaatgtttaatttttgaaggtctcgtgaaacagatcaaaggccatggtttttctgggacttttacattgggaaagaattacaaggaagaggatatatgtgataaaacaaaaaagcaggcagtagggagtccaaggaaaattcagaaagaaactagaaaatcagggaacaaggacacagattctgaatacttgccatcagacacctctgatgatgatgatgatccttactattattattataagtccaggagaaatcgcagtaaattgaggaaaaagcttgttccatccacaaaaaaaggaaaaagtcaaccatttatcaatcccgattcacaaggtcactgtccagctactagcgactctggaataactgatgttgctatgtctaaaagtacatgtatctctgaattcaaccaagaacatgaaacagaggactgtgctgaatctctaaatcatgctgatagtgatgtaccaccttctaataccatgagtccctttaacacctctgattaccgctttgagtgtatatgtggtgaacttgatcagatagatcgtaagcctcgtgttcaatgcctgaagtgtcacctgtggcaacatgcaaagtgtgtgaattatgatgagaaaaatctgaagatcaagcctttttactgcccccactgccttgttgcaatggaaccagtgtcaacaagagcaactctgatcatctctccaagttccatctgtcaccagtgggtggatgagatcaacaggcatgtgaggtcgtcatctcttcgagtcttggtatatcaaggagtgaagaaagatggctttttacaacctcattttttggcagaacaggatatagttatcattacctatgatgtactgcgttcagaattaaattatgtcgatatcccacatagcaatagtgaggatgggcgtcgcctacggaaccagaagcgctatatggctatcccgagccccctggtagctgtggagtggtggaggatctgccttgatgaagctcagatggttgagtgtcccacagtaaaagctgcagaaatggcccagcgtttgagtgggattaatcgatggtgtatcagtggcactccagtacagagaggattagaggatctttttgggttagtggtctttcttggtattgaaccttactgtgtcaaacactggtgggttcgacttctctatcggccttactgcaagaagaatcctcagcatctctacagctttattgccaagatactgtggaggtctgcaaagaaagatgtgattgaccaaatccaaataccaccacaaaccgaagaaatacactggctccacttttctccagtggaaaggcatttctatcaccgtcagcatgaggtgtgctgccaggatgtggtggtaaaactcaggaagatttctgactgggctctgaagctcagcagcctagacagaaggactgtcacctctatcctgtatccattgctgaggctcagacaggcctgctgtcacccacaggctgttcgtggagagttcttgccactccaaaaaagttttgaacagtctaccttttcttttagcaccatgacaatggaagagctgctgacatctttgcagaagaaatgtggaactgaatgtgaagaagcacatcgacagctagtttgtgctctcaatggcttagcaggcattcatattattaaaggtgagtatgccttggcagcagaattgtacagagaagtgttgcgctcctcggaggaacacaaaggaaaactcaaaactgattcacttcaaagacttcatgctacccataacttgatggaattgttgatagccaggcacccagggataccacctaccttgcgtgatggccgacttgaggaagaggccaaacagctgcgagagcactacatgagcaagtgtaatacagaagttgctgaagcccagcaagctttatatcctgtgcagcagaccatccatgagcttcaaagaaagattcattctaattctccttggtggctaaatgtgatccacagagcaatagaatttactattgatgaggagctagttcagcgagtgcgaaatgaaataaccagcaactacaagcaacaaactggcaagctttctatgtcagagaaaggtcttcagttcttacttacaacacaaatggaagagctaaataaatgccagaagctagtaagagaggctgtaaaaaacctggagggacctccatctcgtaatgttattgagtctgcaacagtctgtcacctccgaccagccagacttcctctcaactgctgtgtcttttgtaaagctgatgaattgttcacagagtatgaatcaaagctattttccaacacagtcaaaggccagactgcaatatttgaggagatgatagaagatgaagaaggactggtggatgatcgagcacctaccaccacccggggtctctgggcaataagtgagacagagcgatctatgaaagcaatactatcatttgcaaaatcacataggtttgatgttgaatttgttgatgaaggaagcacttcaatggatctctttgaagcatggaagaaggaatataagttgcttcatgaatattggatggctctgaggaatcgtgtgtctgctgttgatgaacttgcaatggctacagaacgactaagagtgcgtgatcctagggagccaaagcctaatccgcctgttcttcatatcattgaaccacatgaggtagaacaaaaccgaataaaactactaaatgataaagctgttgctacatcacagcttcagaaaaaacttgggcagcttctttacctaactaatttggagaagtctcaagataaaacatcgggaggtgttaatccagaaccttgcccaatctgtgctcgacagctaggaaaacagtgggcggtactgacctgtggtcactgtttctgtaatgaatgcatttctataattattgaacaatacagcgtgggatctcacagaagctccattaagtgtgcaatctgccgccagaccacatctcacaaagaaatctcgtatgtctttacctcagagaaagcaaaccaggaggaggacatccctgtgaagggcagccattctacaaaagtggaagctgtggtcagaactctgatgaaaatacagcttagagatccaggggccaaagcactcgttttctcaacgtggcaagatgtattagatattatttcaaaagctcttactgacaacaacatggaatttgcacaaatcagtcgtgttaagacatttcaggagaacctttcagcatttaaacgtgatccccaaatcaatattttgctgctgcccctgcacacaggttctaatggattaactatcattgaagcaactcatgttctcttggtggagcccatattgaaccctgcccatgagcttcaggccatagggagggtgcaccgaattggacagacaaaacctactattgtacacagattcttaattaaagcaacaatagaagaaagaatgcaggcaatgctgaaaactgctgagagaagtcacacgaactcatcagcaaagcattcagaggcctctgtcttgactgtggctgacctggcagacctatttaccaaagaaactgaagagcttgaatgaactacacttgattcattccatggactttagtgtattaataaactttcatagctgtagagcaaagttacaagttttaaaaacccagtagataacagtaacactgttcctagttgaatgaatttgtttattgttctggttatacagtggcttagtacttattgagtccttttcaatatactgtttccaaaagatctataaagattcttaattttacactcctaataaaacatttattttttgtcccaaatagtatctatatctgatgatgcaagggaattaagagaggtaatgtgtacttttcttatgataagatcactcataaaacagttggaataagaaagtaaactagtctagttttatatgacctggtatattgaacaaacatagatctcagttttggaagggccttcagtatctttagcacatgattcaccaatatcttgttagtaatattttaagtagatggtgaattatattaacccattttttgagtaggcttataccataactttacacctagtaattttgcagtaatacaactccttacaataagttaatgttagacagttatttgtttcttctgcatcttgctactgaaaacaaaaacaatgaaaatattcatatttctattatgtgtaaagtggtgttagtgtaaacagttaactccaaatagattttttaatgtattaatgattaccttaaaattatctgctttccctactcttaatttttcttattgttaaagtttttatatgttgtaagattgatgtatctgtaaatattgcagtttttatgattttgttttattataacatggaaatatggcagggttttttttttaatcattattatactgatgtcttggattctttttctttcccatgttcttgtgtaactagactttttagccagtgatatctgaattcatggtagagttgttatttcactccagttgttcctcccttaagcacgagtctttgaccttttgaacaagagaatgccatgttcacataagcaaatcgttgcaagtgataataacgaagtgtttcttcttctgtgaggaattaatggactttgaaattgctgaataaggagtagcttgttacatcctagccatttgatgtaatacaaatgttcttatttggcttccttttctttgagccttcagagttttaaaggaccctctttgaccctcaggacttattagctcccagttagctgcctggaaaactcatagaaccattccctagatcccatttgtccgagaggctttggtgcttagttaaggtgcattttcttactctaggtttatagagtgatgtaattcaactgaagaaaacacacacatgcttttggtgcttattcttcagttaaaaggaggtatccattgattcttttatatgaaattaaatcaaactgttatttttatagctcttcacatattaaaaagagctttcatgtacatttacgtgtttaatttacccaacaatcttgtgaagttgatataattaatatctttactgttttaaaggtagagaactgaagttcagatatattgaaactttcttaggacatgtagcaagtaaacagtggagcccaggtcccctgactccatatcttacattcttttactaataacatgtcatgctgagattcagaaggcccatgcttataatttaaaaatgagactatttcagtatttctttgtgtttgttttctactattcctttctgagctatgttttagagaaaacaatttgatatgcttcaattttgtaaaatcaaattacatatatataaaaaaacctatctgtattagacaaaaactgtttttatttatttctgtaagatatccattaaataaatattttagtggaaatg

SEQ ID NO: 2145 - DNA, 7201 bp, Homo sapiens
gtgctctgacgagcgcgttcgccttgaccccacgctacagcgcgcgcccggcagctaggcgctgtggtttctgggtctcccgggggacccctacacgttccggcaaaaagcgctcgtgcccacctcaagcccatgttcggtgggtggcgaatgcgtgcccgtgatctgctgggtctgtagaggagcgcaggcctggtgcaaacagactcaagaggctcggagaaccagcttggagttcacagttaccagccaagaaaacttgaaaatgagcagccgacggaaacgtgctcctccagtgagggtagatgaggaaaagaggcagcagcttcattggaatatgcatgaggacagaaggaatgaacctatcatcataagtgatgatgacgagcagccctgcccaggttcagatacctcttctgctcattatatcattctaagtgatagtctaaaggaagaagtggctcacagagataagaagaggtgttcaaaagtggtgagcttctcaaaaccaattgaaaaagaagagactgttggtattttttcccctttgtctgtaaagttaaatattgtgatttctccctatcattttgataattcctggaaagcatttctaggagaattaactcttcagcttcttcctgcacagagtttaattgaaaatttttccgaaaggagtattacattgatgagttcagagtcaagcaatcagttcctgatttatgttcattcaaaaggtgaagatgtagagaaacaaaaaaaagaaccgatgagtatttgtgacaagggtattctggtggagtcatccttcagtggtgaaatgttagaagatttggggtggctacaaaagaagagaagaataaaactctatcagaaaccagaaggaaatcacattatcaaggttggaatttatcttttggaagctggcctagcaaaactagacttcttgagtgatgcaaattcaagaatgaaaaagttcaatcagctcatgaagaaagtaatggaaaagttacacaattctattattccagatgtgttggaagaggatgaagatgatccggagagtgagccagagggacaagacattgacgagctgtatcactttgtgaaacaaacacatcagcaagaaacgcagtccatccaagtggatgtccagcatcctgcattgatccctgtgttgagaccctaccaaagagaggctgtcaattggatgctacaacaagagtgtttcagaagcagtcctgctactgaaagtgccctgcacttcttatggcgagagattgttacatctgagggtctgaaactctactataatccatatacaggctgcatcattcgtgagtacccaaattctgggccgcagttgcttggtggaattttagcagatgagatgggtcttggaaagacagtggaggttttggctctgattctgacacatactcgacaagatgtcaagcaagatgctctcactcttcccgagggaaaagtggtgaattattttattccgtcacattattttggaggaaaactgaaaaagacagaaatccagaatatcgaatttgaaccaaaagaaaaagttcaatgccctcctacacgtgtgatgatactgacagctgtgaaagaaatgaatggaaaaaaaggagtgtccatcctttccatctataagtatgtcagttctatatatagatacgatgttcaacggaacaggagtcttttgaaacggatgctgaaatgtttaatttttgaaggtctcgtgaaacagatcaaaggccatggtttttctgggacttttacattgggaaagaattacaaggaagaggatatatgtgataaaacaaaaaagcaggcagtagggagtccaaggaaaattcagaaagaaactagaaaatcagggaacaaggacacagattctgaatacttgccatcagacacctctgatgatgatgatgatccttactattattattataagtccaggagaaatcgcagtaaattgaggaaaaagcttgttccatccacaaaaaaaggaaaaagtcaaccatttatcaatcccgattcacaaggtcactgtccagctactagcgactctggaataactgatgttgctatgtctaaaagtacatgtatctctgaattcaaccaagaacatgaaacagaggactgtgctgaatctctaaatcatgctgatagtgatgtaccaccttctaataccatgagtccctttaacacctctgattaccgctttgagtgtatatgtggtgaacttgatcagatagatcgtaagcctcgtgttcaatgcctgaagtgtcacctgtggcaacatgcaaagtgtgtgaattatgatgagaaaaatctgaagatcaagcctttttactgcccccactgccttgttgcaatggaaccagtgtcaacaagagcaactctgatcatctctccaagttccatctgtcaccagtgggtggatgagatcaacaggcatgtgaggtcgtcatctcttcgagtcttggtatatcaaggagtgaagaaagatggctttttacaacctcattttttggcagaacaggatatagttatcattacctatgatgtactgcgttcagaattaaattatgtcgatatcccacatagcaatagtgaggatgggcgtcgcctacggaaccagaagcgctatatggctatcccgagccccctggtagctgtggagtggtggaggatctgccttgatgaagctcagatggttgagtgtcccacagtaaaagctgcagaaatggcccagcgtttgagtgggattaatcgatggtgtatcagtggcactccagtacagagaggattagaggatctttttgggttagtggtctttcttggtattgaaccttactgtgtcaaacactggtgggttcgacttctctatcggccttactgcaagaagaatcctcagcatctctacagctttattgccaagatactgtggaggtctgcaaagaaagatgtgattgaccaaatccaaataccaccacaaaccgaagaaatacactggctccacttttctccagtggaaaggcatttctatcaccgtcagcatgaggtgtgctgccaggatgtggtggtaaaactcaggaagatttctgactgggctctgaagctcagcagcctagacagaaggactgtcacctctatcctgtatccattgctgaggctcagacaggcctgctgtcacccacaggctgttcgtggagagttcttgccactccaaaaaagcaccatgacaatggaagagctgctgacatctttgcagaagaaatgtggaactgaatgtgaagaagcacatcgacagctagtttgtgctctcaatggcttagcaggcattcatattattaaaggtgagtatgccttggcagcagaattgtacagagaagtgttgcgctcctcggaggaacacaaaggaaaactcaaaactgattcacttcaaagacttcatgctacccataacttgatggaattgttgatagccaggcacccagggataccacctaccttgcgtgatggccgacttgaggaagaggccaaacagctgcgagagcactacatgagcaagtgtaatacagaagttgctgaagcccagcaagctttatatcctgtgcagcagaccatccatgagcttcaaagaaagattcattctaattctccttggtggctaaatgtgatccacagagcaatagaatttactattgatgaggagctagttcagcgagtgcgaaatgaaataaccagcaactacaagcaacaaactggcaagctttctatgtcagagaagttccgtgattgcagaggtcttcagttcttacttacaacacaaatggaagagctaaataaatgccagaagctagtaagagaggctgtaaaaaacctggagggacctccatctcgtaatgttattgagtctgcaacagtctgtcacctccgaccagccagacttcctctcaactgctgtgtcttttgtaaagctgatgaattgttcacagagtatgaatcaaagctattttccaacacagtcaaaggccagactgcaatatttgaggagatgatagaagatgaagaaggactggtggatgatcgagcacctaccaccacccggggtctctgggcaataagtgagacagagcgatctatgaaagcaatactatcatttgcaaaatcacataggtttgatgttgaatttgttgatgaaggaagcacttcaatggatctctttgaagcatggaagaaggaatataagttgcttcatgaatattggatggctctgaggaatcgtgtgtctgctgttgatgaacttgcaatggctacagaacgactaagagtgcgtgatcctagggagccaaagcctaatccgcctgttcttcatatcattgaaccacatgaggtagaacaaaaccgaataaaactactaaatgataaagctgttgctacatcacagcttcagaaaaaacttgggcagcttctttacctaactaatttggagaagtctcaagataaaacatcgggaggtgttaatccagaaccttgcccaatctgtgctcgacagctaggaaaacagtgggcggtactgacctgtggtcactgtttctgtaatgaatgcatttctataattattgaacaatacagcgtgggatctcacagaagctccattaagtgtgcaatctgccgccagaccacatctcacaaagaaatctcgtatgtctttacctcagagaaagcaaaccaggaggaggacatccctgtgaagggcagccattctacaaaagtggaagctgtggtcagaactctgatgaaaatacagcttagagatccaggggccaaagcactcgttttctcaacgtggcaagatgtattagatattatttcaaaagctcttactgacaacaacatggaatttgcacaaatcagtcgtgttaagacatttcaggagaacctttcagcatttaaacgtgatccccaaatcaatattttgctgctgcccctgcacacaggttctaatggattaactatcattgaagcaactcatgttctcttggtggagcccatattgaaccctgcccatgagcttcaggccatagggagggtgcaccgaattggacagacaaaacctactattgtacacagattcttaattaaagcaacaatagaagaaagaatgcaggcaatgctgaaaactgctgagagaagtcacacgaactcatcagcaaagcattcagaggcctctgtcttgactgtggctgacctggcagacctatttaccaaagaaactgaagagcttgaatgaactacacttgattcattccatggactttagtgtattaataaactttcatagctgtagagcaaagttacaagttttaaaaacccagtagataacagtaacactgttcctagttgaatgaatttgtttattgttctggttatacagtggcttagtacttattgagtccttttcaatatactgtttccaaaagatctataaagattcttaattttacactcctaataaaacatttattttttgtcccaaatagtatctatatctgatgatgcaagggaattaagagaggtaatgtgtacttttcttatgataagatcactcataaaacagttggaataagaaagtaaactagtctagttttatatgacctggtatattgaacaaacatagatctcagttttggaagggccttcagtatctttagcacatgattcaccaatatcttgttagtaatattttaagtagatggtgaattatattaacccattttttgagtaggcttataccataactttacacctagtaattttgcagtaatacaactccttacaataagttaatgttagacagttatttgtttcttctgcatcttgctactgaaaacaaaaacaatgaaaatattcatatttctattatgtgtaaagtggtgttagtgtaaacagttaactccaaatagattttttaatgtattaatgattaccttaaaattatctgctttccctactcttaatttttcttattgttaaagtttttatatgttgtaagattgatgtatctgtaaatattgcagtttttatgattttgttttattataacatggaaatatggcagggttttttttttaatcattattatactgatgtcttggattctttttctttcccatgttcttgtgtaactagactttttagccagtgatatctgaattcatggtagagttgttatttcactccagttgttcctcccttaagcacgagtctttgaccttttgaacaagagaatgccatgttcacataagcaaatcgttgcaagtgataataacgaagtgtttcttcttctgtgaggaattaatggactttgaaattgctgaataaggagtagcttgttacatcctagccatttgatgtaatacaaatgttcttatttggcttccttttctttgagccttcagagttttaaaggaccctctttgaccctcaggacttattagctcccagttagctgcctggaaaactcatagaaccattccctagatcccatttgtccgagaggctttggtgcttagttaaggtgcattttcttactctaggtttatagagtgatgtaattcaactgaagaaaacacacacatgcttttggtgcttattcttcagttaaaaggaggtatccattgattcttttatatgaaattaaatcaaactgttatttttatagctcttcacatattaaaaagagctttcatgtacatttacgtgtttaatttacccaacaatcttgtgaagttgatataattaatatctttactgttttaaaggtagagaactgaagttcagatatattgaaactttcttaggacatgtagcaagtaaacagtggagcccaggtcccctgactccatatcttacattcttttactaataacatgtcatgctgagattcagaaggcccatgcttataatttaaaaatgagactatttcagtatttctttgtgtttgttttctactattcctttctgagctatgttttagagaaaacaatttgatatgcttcaattttgtaaaatcaaattacatatatataaaaaaacctatctgtattagacaaaaactgtttttatttatttctgtaagatatccattaaataaatattttagtggaaatgaaaa

SEQ ID NO: 2146 - DNA, 1498 bp, Homo sapiens
ggctgtaaaaaacctggagggacctccatctcgtaatgttattgagtctgcaacagtctgtcacctccgaccagccagacttcctctcaactgctgtgtcttttgtaaagctgatgaattgttcacagagtatgaatcaaagctattttccaacacagtcaaaggccagactgcaatatttgaggagatgatagaagatgaagaaggactggtggatgatcgagcacctaccaccacccggggtctctgggcaataagtgagacagagcgatctatgaaagcaatactatcatttgcaaaatcacataggtttgatgttgaatttgttgatgaaggaagcacttcaatggatctctttgaagcatggaagaaggaatataagttgcttcatgaatattggatggctctgaggaatcgtgtgtctgctgttgatgaacttgcaatggctacagaacgactaagagtgcgtgatcctagggagccaaagcctaatccgcctgttcttcatatcattgaaccacatgaggtagaacaaaaccgaataaaactactaaatgataaagctgttgctacatcacagcttcagaaaaaacttgggcagcttctttacctaactaatttggagaagtctcaagataaaacatcgggaggtgttaatccagaaccttgcccaatctgtgctcgacagctaggaaaacagtgggcggtactgacctgtggtcactgtttctgtaatgaatgcatttctataattattgaacaatacagcgtgggatctcacagaagctccattaagtgtgcaatctgccgccagaccacatctcacaaagaaatctcgtatgtctttacctcagagaaagcaaaccaggaggaggacatccctgtgaagggcagccattctacaaaagtggaagctgtggtcagaactctgatgaaaatacagcttagagatccaggggccaaagcactcgttttctcaacgtggcaagatgtattagatattatttcaaaagctcttactgacaacaacatggaatttgcacaaatcagtcgtgttaagacatttcaggagaacctttcagcatttaaacgtgatccccaaatcaatattttgctgctgcccctgcacacaggttctaatggattaactatcattgaagcaactcatgttctcttggtggagcccatattgaaccctgcccatgagcttcaggccatagggagggtgcaccgaattggacagacaaaacctactattgtacacagattcttaattaaagcaacaatagaagaaagaatgcaggcaatgctgaaaactgctgagagaaggttttttgaggaacaggcgttattttgttttcatgacatcaccccattctcccacccctggtccctgacaactgccattctacagttgagagatttggtgatttgtgagttgttttttatttactttaaaaattttttgatttgttttttatcatctttttcaatttag

SEQ ID NO: 2147 - DNA, 6994 bp, Homo sapiens
gtctttggcctccgggaccagggagggaggacgctggttgtcctggagcccgggaagctcaagggctgagagggagccgctgcgcgagtcttccccacctcttcccgatcccggactagcgaacttcggaccaccacgtccctccggggataaagtggggtcgtgggaaaggaggctgtgcttctcctcatgcactggggcctgcggtgtttgtctcgagcgtccaacacactaggatccgggagtccgtcgtcacgctccttggcctcgcggtcgcttgtttgctcggcctgctgggagcgatccggcgctgacagccccgctcagactccgggagccgcttgtgggtctttcggaagataactgaagttcacagttaccagccaagaaaacttgaaaatgagcagccgacggaaacgtgctcctccagtgagggtagatgaggaaaagaggcagcagcttcattggaatatgcatgaggacagaaggaatgaacctatcatcataagtgatgatgacgagcagccctgcccaggttcagatacctcttctgctcattatatcattctaagtgatagtctaaaggaagaagtggctcacagagataagaagaggtgttcaaaagtggtgagcttctcaaaaccaattgaaaaagaagagactgttggtattttttcccctttgtctgtaaagttaaatattgtgatttctccctatcattttgataattcctggaaagcatttctaggagaattaactcttcagcttcttcctgcacagagtttaattgaaaatttttccgaaaggagtattacattgatgagttcagagtcaagcaatcagttcctgatttatgttcattcaaaaggtgaagatgtagagaaacaaaaaaaagaaccgatgagtatttgtgacaagggtattctggtggagtcatccttcagtggtgaaatgttagaagatttggggtggctacaaaagaagagaagaataaaactctatcagaaaccagaaggaaatcacattatcaaggttggaatttatcttttggaagctggcctagcaaaactagacttcttgagtgatgcaaattcaagaatgaaaaagttcaatcagctcatgaagaaagtaatggaaaagttacacaattctattattccagatgtgttggaagaggatgaagatgatccggagagtgagccagagggacaagacattgacgagctgtatcactttgtgaaacaaacacatcagcaagaaacgcagtccatccaagtggatgtccagcatcctgcattgatccctgtgttgagaccctaccaaagagaggctgtcaattggatgctacaacaagagtgtttcagaagcagtcctgctactgaaagtgccctgcacttcttatggcgagagattgttacatctgagggtctgaaactctactataatccatatacaggctgcatcattcgtgagtacccaaattctgggccgcagttgcttggtggaattttagcagatgagatgggtcttggaaagacagtggaggttttggctctgattctgacacatactcgacaagatgtcaagcaagatgctctcactcttcccgagggaaaagtggtgaattattttattccgtcacattattttggaggaaaactgaaaaagacagaaatccagaatatcgaatttgaaccaaaagaaaaagttcaatgccctcctacacgtgtgatgatactgacagctgtgaaagaaatgaatggaaaaaaaggagtgtccatcctttccatctataagtatgtcagttctatatatagatacgatgttcaacggaacaggagtcttttgaaacggatgctgaaatgtttaatttttgaaggtctcgtgaaacagatcaaaggccatggtttttctgggacttttacattgggaaagaattacaaggaagaggatatatgtgataaaacaaaaaagcaggcagtagggagtccaaggaaaattcagaaagaaactagaaaatcagggaacaaggacacagattctgaatacttgccatcagacacctctgatgatgatgatgatccttactattattattataagtccaggagaaatcgcagtaaattgaggaaaaagcttgttccatccacaaaaaaaggaaaaagtcaaccatttatcaatcccgattcacaaggtcactgtccagctactagcgactctggaataactgatgttgctatgtctaaaagtacatgtatctctgaattcaaccaagaacatgaaacagaggactgtgctgaatctctaaatcatgctgatagtgatgtaccaccttctaataccatgagtccctttaacacctctgattaccgctttgagtgtatatgtggtgaacttgatcagatagatcgtaagcctcgtgttcaatgcctgaagtgtcacctgtggcaacatgcaaagtgtgtgaattatgatgagaaaaatctgaagatcaagcctttttactgcccccactgccttgttgcaatggaaccagtgtcaacaagagcaactctgatcatctctccaagttccatctgtcaccagtgggtggatgagatcaacaggcatgtgaggtcgtcatctcttcgagtcttggtatatcaaggagtgaagaaagatggctttttacaacctcattttttggcagaacaggatatagttatcattacctatgatgtactgcgttcagaattaaattatgtcgatatcccacatagcaatagtgaggatgggcgtcgcctacggaaccagaagcgctatatggctatcccgagccccctggtagctgtggagtggtggaggatctgccttgatgaagctcagatggttgagtgtcccacagtaaaagctgcagaaatggcccagcgtttgagtgggattaatcgatggtgtatcagtggcactccagtacagagaggattagaggatctttttgggttagtggtctttcttggtattgaaccttactgtgtcaaacactggtgggttcgacttctctatcggccttactgcaagaagaatcctcagcatctctacagctttattgccaagatactgtggaggtctgcaaagaaagatgtgattgaccaaatccaaataccaccacaaaccgaagaaatacactggctccacttttctccagtggaaaggcatttctatcaccgtcagcatgaggtgtgctgccaggatgtggtggtaaaactcaggaagatttctgactgggctctgaagctcagcagcctagacagaaggactgtcacctctatcctgtatccattgctgaggctcagacaggcctgctgtcacccacaggctgttcgtggagagttcttgccactccaaaaaagttttgaacagtctaccttttcttttagcaccatgacaatggaagagctgctgacatctttgcagaagaaatgtggaactgaatgtgaagaagcacatcgacagctagtttgtgctctcaatggcttagcaggcattcatattattaaaggtgagtatgccttggcagcagaattgtacagagaagtgttgcgctcctcggaggaacacaaaggaaaactcaaaactgattcacttcaaagacttcatgctacccataacttgatggaattgttgatagccaggcacccagggataccacctaccttgcgtgatggccgacttgaggaagaggccaaacagctgcgagagcactacatgagcaagtgtaatacagaagttgctgaagcccagcaagctttatatcctgtgcagcagaccatccatgagcttcaaagaaagattcattctaattctccttggtggctaaatgtgatccacagagcaatagaatttactattgatgaggagctagttcagcgagtgcgaaatgaaataaccagcaactacaagcaacaaactggcaagctttctatgtcagagaaaggtcttcagttcttacttacaacacaaatggaagagctaaataaatgccagaagctagtaagagaggctgtaaaaaacctggagggacctccatctcgtaatgttattgagtctgcaacagtctgtcacctccgaccagccagacttcctctcaactgctgtgtcttttgtaaagctgatgaattgttcacagagtatgaatcaaagctattttccaacacagtcaaaggccagactgcaatatttgaggagatgatagaagatgaagaaggactggtggatgatcgagcacctaccaccacccggggtctctgggcaataagtgagacagagcgatctatgaaagcaatactatcatttgcaaaatcacataggtttgatgttgaatttgttgatgaaggaagcacttcaatggatctctttgaagcatggaagaaggaatataagttgcttcatgaatattggatggctctgaggaatcgtgtgtctgctgttgatgaacttgcaatggctacagaacgactaagagtgcgtgatcctagggagccaaagcctaatccgcctgttcttcatatcattgaaccacatgaggtagaacaaaaccgaataaaactactaaatgataaagctgttgctacatcacagcttcagaaaaaacttgggcagcttctttacctaactaatttggagaagtctcaagataaaacatcgggaggtgttaatccagaaccttgcccaatctgtgctcgacagctaggaaaacagtgggcggtactgacctgtggtcactgtttctgtaatgaatgcatttctataattattgaacaatacagcgtgggatctcacagaagctccattaagtgtgcaatctgccgccagaccacatctcacaaagaaatctcgtatgtctttacctcagagaaagcaaaccaggaggaggacatccctgtgaagggcagccattctacaaaagtggaagctgtggtcagaactctgatgaaaatacagcttagagatccaggggccaaagcactcgttttctcaacgtggcaagatgtattagatattatttcaaaagctcttactgacaacaacatggaatttgcacaaatcagtcgtgttaagacatttcaggagaacctttcagcatttaaacgtgatccccaaatcaatattttgctgctgcccctgcacacaggttctaatggattaactatcattgaagcaactcatgttctcttggtggagcccatattgaaccctgcccatgagcttcaggccatagggagggtgcaccgaattggacagacaaaacctactattgtacacagattcttaattaaagcaacaatagaagaaagaatgcaggcaatgctgaaaactgctgagagaagtatctatatctgatgatgcaagggaattaagagaggtaatgtgtacttttcttatgataagatcactcataaaacagttggaataagaaagtaaactagtctagttttatatgacctggtatattgaacaaacatagatctcagttttggaagggccttcagtatctttagcacatgattcaccaatatcttgttagtaatattttaagtagatggtgaattatattaacccattttttgagtaggcttataccataactttacacctagtaattttgcagtaatacaactccttacaataagttaatgttagacagttatttgtttcttctgcatcttgctactgaaaacaaaaacaatgaaaatattcatatttctattatgtgtaaagtggtgttagtgtaaacagttaactccaaatagattttttaatgtattaatgattaccttaaaattatctgctttccctactcttaatttttcttattgttaaagtttttatatgttgtaagattgatgtatctgtaaatattgcagtttttatgattttgttttattataacatggaaatatggcagggttttttttttaatcattattatactgatgtcttggattctttttctttcccatgttcttgtgtaactagactttttagccagtgatatctgaattcatggtagagttgttatttcactccagttgttcctcccttaagcacgagtctttgaccttttgaacaagagaatgccatgttcacataagcaaatcgttgcaagtgataataacgaagtgtttcttcttctgtgaggaattaatggactttgaaattgctgaataaggagtagcttgttacatcctagccatttgatgtaatacaaatgttcttatttggcttccttttctttgagccttcagagttttaaaggaccctctttgaccctcaggacttattagctcccagttagctgcctggaaaactcatagaaccattccctagatcccatttgtccgagaggctttggtgcttagttaaggtgcattttcttactctaggtttatagagtgatgtaattcaactgaagaaaacacacacatgcttttggtgcttattcttcagttaaaaggaggtatccattgattcttttatatgaaattaaatcaaactgttatttttatagctcttcacatattaaaaagagctttcatgtacatttacgtgtttaatttacccaacaatcttgtgaagttgatataattaatatctttactgttttaaaggtagagaactgaagttcagatatattgaaactttcttaggacatgtagcaagtaaacagtggagcccaggtcccctgactccatatcttacattcttttactaataacatgtcatgctgagattcagaaggcccatgcttataatttaaaaatgagactatttcagtatttctttgtgtttgttttctactattcctttctgagctatgttttagagaaaacaatttgatatgcttcaattttgtaaaatcaaattacatatatataaaaaaacctatctgtattagacaaaaactgtttttatttatttctgtaagatatccattaaataaatattttagtggaaa

SEQ ID NO: 2148 - DNA, 5237 bp, Homo sapiens
actcatgaagccagcgcaggagaaagggggcggggtgctctgacgagcgcgttcgccttgaccccacgctacagcgcgcgcccggcagctaggcgctgtggtttctgggtctcccgggggacccctacacgttccggcaaaaagcgctcgtgcccacctcaagcccatgttcggtgggtggcgaatgcgtgcccgtgatctgctgggtctgtagaggagcgcaggcctggtgcaaacagactcaagaggctcggagaaccagcttggagttcacagttaccagccaagaaaacttgaaaatgagcagccgacggaaacgtgctcctccagtgagggtagatgaggaaaagaggcagcagcttcattggaatatgcatgaggacagaaggaatgaacctatcatcataagtgatgatgacgagcagccctgcccaggtgaagatgtagagaaacaaaaaaaagaaccgatgagtatttgtgacaagggtattctggtggagtcatccttcagtggtgaaatgttagaagatttggggtggctacaaaagaagagaagaataaaactctatcagaaaccagaaggaaatcacattatcaaggttggaatttatcttttggaagctggcctagcaaaactagacttcttgagtgatgcaaattcaagaatgaaaaagttcaatcagctcatgaagaaagtaatggaaaagttacacaattctattattccagatgtgttggaagaggatgaagatgatccggagagtgagccagagggacaagacattgacgagctgtatcactttgtgaaacaaacacatcagcaagaaacgcagtccatccaagtggatgtccagcatcctgcattgatccctgtgttgagaccctaccaaagagaggctgtcaattggatgctacaacaagagtgtttcagaagcagtcctgctactgaaagtgccctgcacttcttatggcgagagattgttacatctgagggtctgaaactctactataatccatatacaggctgcatcattcgtgagtacccaaattctgggccgcagttgcttggtggaattttagcagatgagatgggtcttggaaagacagtggaggttttggctctgattctgacacatactcgacaagatgtcaagcaagatgctctcactcttcccgagggaaaagtggtgaattattttattccgtcacattattttggaggaaaactgaaaaagacagaaatccagaatatcgaatttgaaccaaaagaaaaagttcaatgccctcctacacgtgtgatgatactgacagctgtgaaagaaatgaatggaaaaaaaggagtgtccatcctttccatctataagtatgtcagttctatatatagatacgatgttcaacggaacaggagtcttttgaaacggatgctgaaatgtttaatttttgaaggtctcgtgaaacagatcaaaggccatggtttttctgggacttttacattgggaaagaattacaaggaagaggatatatgtgataaaacaaaaaagcaggcagtagggagtccaaggaaaattcagaaagaaactagaaaatcagggaacaaggacacagattctgaatacttgccatcagacacctctgatgatgatgatgatccttactattattattataagtccaggagaaatcgcagtaaattgaggaaaaagcttgttccatccacaaaaaaaggaaaaagtcaaccatttatcaatcccgattcacaaggtcactgtccagctactagcgactctggaataactgatgttgctatgtctaaaagtacatgtatctctgaattcaaccaagaacatgaaacagaggactgtgctgaatctctaaatcatgctgatagtgatgtaccaccttctaataccatgagtccctttaacacctctgattaccgctttgagtgtatatgtggtgaacttgatcagatagatcgtaagcctcgtgttcaatgcctgaagtgtcacctgtggcaacatgcaaagtgtgtgaattatgatgagaaaaatctgaagatcaagcctttttactgcccccactgccttgttgcaatggaaccagtgtcaacaagagcaactctgatcatctctccaagttccatctgtcaccagtgggtggatgagatcaacaggcatgtgaggtcgtcatctcttcgagtcttggtatatcaaggagtgaagaaagatggctttttacaacctcattttggcagaacaggatatagttatcattacctatgatgtactgcgttcagaattaaattatgtcgatatcccacatagcaatagtgaggatgggcgtcgcctacggaaccagaagcgctatatggctatcccgagccccctggtagctgtggagtggtggaggatctgccttgatgaagctcagatggttgagtgtcccacagtaaaagctgcagaaatggcccagcgtttgagtgggattaatcgatggtgtatcagtggcactccagtacagagaggattagaggatctttttgggttagtggtctttcttggtattgaaccttactgtgtcaaacactggtgggttcgacttctctatcggccttactgcaagaagaatcctcagcatctctacagctttattgccaagatactgtggaggtctgcaaagaaagatgtgattgaccaaatccaaataccaccacaaaccgaagaaatacactggctccacttttctccagtggaaaggcatttctatcaccgtcagcatgaggtgtgctgccaggatgtggtggtaaaactcaggaagatttctgactgggctctgaagctcagcagcctagacagaaggactgtcacctctatcctgtatccattgctgaggctcagacaggcctgctgtcacccacaggctgttcgtggagagttcttgccactccaaaaaaggcaccatgacaatggaagagctgctgacatctttgcagaagaaatgtggaactgaatgtgaagaagcacatcgacagctagtttgtgctctcaatggcttagcaggcattcatattattaaaggtagaaggtgagtatgccttggcagcagaattgtacagagaagtgttgcgctcctcggaggaacacaaaggaaaactcaaaactgattcacttcaaagacttcatgctacccataacttgatggaattgttgatagccaggcacccagggataccacctaccttgcgtgatggccgacttgaggaagaggccaaacagctgcgagagcactacatgagcaagtgtaatacagaagttgctgaagcccagcaagctttatatcctgtgcagcagaccatccatgagcttcaaagaaagattcattctaattctccttggtggctaaatgtgatccacagagcaatagaatttactattgatgaggagctagttcagcgagtgcgaaatgaaataaccagcaactacaagcaacaaactggcaagctttctatgtcagagaagttccgtgattgcagaggtcttcagttcttacttacaacacaaatggaagagctaaataaatgccagaagctagtaagagaggctgtaaaaaacctggagggacctccatctcgtaatgttattgagtctgcaacagtctgtcacctccgaccagccagacttcctctcaactgctgtgtcttttgtaaagctgatgaattgttcacagagtatgaatcaaagctattttccaacacagtcaaaggccagactgcaatatttgaggagatgatagaagatgaagaaggactggtggatgatcgagcacctaccaccacccggggtctctgggcaataagtgagacagagcgatctatgaaagcaatactatcatttgcaaaatcacataggtttgatgttgaatttgttgatgaaggaagcacttcaatggatctctttgaagcatggaagaaggaatataagttgcttcatgaatattggatggctctgaggaatcgtgtgtctgctgttgatgaacttgcaatggctacagaacgactaagagtgcgtgatcctagggagccaaagcctaatccgcctgttcttcatatcattgaaccacatgaggtagaacaaaaccgaataaaactactaaatgataaagctgttgctacatcacagcttcagaaaaaacttgggcagcttctttacctaactaatttggagaaggtattgtttctaagacatgctactttttcctatgctgcattatcataaaccactttagtgactcctttcataattaatggtgcaaattgttgtaattagtatttggtgttatatgagtcagaacactacctatgtctctacaatagcttcagagatcacaaaagaatattgtatctatagaaatttattatgcagatgatatagaaggcatgcactcgatagtagagaacaatgtaaatggactgtagttcaaagccttgaatagtaaaagtattaaaacatatctcggtgaaactggcataatgcaatttatacacatgcattcattcatcaatacaaaaatatgttgtaatttgttatttgaaactgaagtgtgtttcgaaagctactaaatcagagtacatggtaataaaggtagacttcaaatattaagtaattcaaaacacatgttctgagttatgatctgagtattatactggacactgatgaattggtgggtcattgattaaatataatttcattttattgcaggaatcatattttgctagttggcagagaaccttctaggggcaagatatagtagtaaatatttggatagggcaagtgaggacaagatatagatttgaattcttctggaaactggtataacatatacttaagtgaatcagtaaatctcagacaaaatgaaaagttagacattcattatagatatagcatggcgactaagaaggtagactttggaactggacagcccaattttgaatcgtgactcaactgttttctagatatgtgactttatttaagttattcacctttcctcgcatcatcagtaaaatgagaatgatgtcaacactactttatagtatagggctgtcttgaggattgtgtgaattaatacatgtaaaatgctagagtagtttctgatctattaagcactttctaggtttttgctgctattaatattattaagatcattattactgttatgattaccaacacttattctgaaag

SEQ ID NO: 2149 - DNA, 1326 bp, Homo sapiens
cagagtggagcggccgccggagatgcctgacgcatctgtctgaggagcggtcagtgacgcgatggagcgggcaagggatcgcttacacctgagacgaactacagaacagcacgtaccagaggtggaagtccaagtcaaacgcagaaggactgcctcactgagcaaccaagagtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccaggctccatctactctttgaagcttctgcccagcttgcattgtttctaggagaacctgcgtcatacctttatctatagccttcccctaggtcttcagaagcatcaagttttaactgtggacattggatttggtggaacagcaatcatgactgttggcaagagtagcaagatgctgcagcacattgactatagaatgagatgtatcctgcaagatggccgaatcttcattggcacctttaaggcttttgacaagcatatgaatttgatcctctgtgattgtgatgagttcagaaagatcaagccaaagaatgcgaagcaaccagagcgtgaagaaaagcgggttttgggtctggtgttgctgcgtggggagaacttggtatccatgactgtggaggggccaccccccaaagatactggcattgctcgggtaccacttgctggagctgctggaggccctggggttggtagggcagctggtagaggagtaccagctggtgtgccaattccccaggcccctgctggattggcaggccctgtccgaggagttgggggaccatcccagcaggtaatgactccacagggaagaggcactgtagcagctgctgctgttgctgcgactgccagtattgctggagccccaacacagtacccaccaggacggggcactccgcccccacccgtcggcagagcaaccccacctccaggcattatggctcctccacctggtatgagaccacccatgggcccaccaattgggcttccccctgctcgagggacgccaataggcatgccgcctccgggaatgagaccccctccaccaggcattagaggtccacctcccccaggaatgcgtccaccaagaccttagcatactgttgatccatctcagtcactttttcccctgcaatgcgtcttgtgaaattgtgtagagtgtttgtgagctttttgttccctcattctgcattaataatagctaataataaatgcatagagcaattaaactgtg

SEQ ID NO: 2150 - DNA, 331 bp, Homo sapiens
ctgacgcatctgtctgaggagcggtcagtgacgcgatggagcgggcaagggatcgcttacacctgagacgaactacagaacagcacgtaccagaggtggaagtccaagtcaaacgcagaaggactgcctcactgagcaaccaagagtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccagacaatgtaataaaaatattattcataatttttcaa

SEQ ID NO: 2151 - DNA, 587 bp, Homo sapiens
gcggtcagtgacgcgatggagcgggcaagggatcgcttacacctgagacgaactacagaacagcacgtaccagaggtggaagtccaagtcaaacgcagaaggactgcctcactgagcaaccaagagtaatgactccacagggaagaggcactgtagcagctgctgctgttgctgcgactgccagtattgctggagccccaacacagtacccaccaggacggggcactccgcccccacccgtcggcagagcaaccccacctccaggcattatggctcctccacctggtatgagaccacccatgggcccaccaattgggcttccccctgctcgagggacgccaataggcatgccgcctccgggaatgagaccccctccaccaggcattagaggggaagcatttctccttgcattggtttgctggtatggatggcccttagattttggcatgagtgattatgcagcctatttgaagaaaacctgttttcaggacctttttaattaaatatggcctgttacatgagttaaaggcaatcaggatgagtgaaaaattgatttgcagctgacctgcaaatggaatcatcaggaa

SEQ ID NO: 2152 - DNA, 1325 bp, Homo sapiens
gcggtcagtgacgcgatggagcgggcaagggatcgcttacacctgagacgaactacagaacagcacgtaccagaggtggaagtccaagtcaaacgcagaaggactgcctcactgagcaaccaagagtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccaggtggtaatcactcaaggaaaaggaattatcagagtaacaatagttcctgttactgacttgatatggtctctgccagaatagcttctcagattaatggccactctcaggggaagcatttctccttgcattggtttgctggtatggatggcccttagattttggcatgagtgattatgcagcctatttgaagaaaacctgttttcaggacctttttaattaaatatggcctgttacatgagttaaagtgtcatacgataccattttttgaccacttagttgatgcctctgaaaggaagagagaatcagatcgctaaaatttgatgtgtcgtcagtgtggatcctactcagtagtgtcacaacgaggctgaaaatcatattaagtgcttttaggacagaaacgtaaactgctcaggtaaaataaccttataaagagaaataagcatatattgcagaggccttggctaggttcatgatgacacaggaccttgtctgaacataatgatttcaaaatttgagcttaaaaatgacactctgaaatccagtcagtgtgcctcactagacttttcgatttcaagattttctgcagaaaatgttttgaaaactttgaatacttaaaaatggcaggtgtagtattgcactttgctagttgctcagatacccttttttatttgtatagatattctgagttcctttttttttctacatgttgtacgttgtcgaaagctaaaaggaaacttatccttggatcacggaaggcagaggcatttggtgagatggaaacaaggatgtgtaaaaatgagacgaccacctctcggattaaaaaaaaaaagtgccagagttctagggttctaagtgatgtccaggaaggaggaggaataatatttatggagcatatattatggaacacagcaatcaggatgagtgaaaaattgatttgcagctgacctgcaaatggaatcatcaggaacatccctttctcatggagtcccttaatttacaagttaactgcaaacataggagatgatagttccaagaaggaacattttatc

SEQ ID NO: 2153 - DNA, 2163 bp, Homo sapiens
cctcatcatctggaaagacccgcccagcggtgctgtcgctcgcgctggaagaagcggaagaagatggcgctcaccagctttttacctgcacctactcagctatctcaggaccagcttgaggctgaagaaaaggcaagatcccagagatcacggcagacctcactggtctcctcccgaagagaacctcccccgtacggataccggaaaggctggatacctcggttattagaggattttggagatggaggtgcttttccagagatccatgtggcccagtatccactggatatgggacgaaagaaaaaaatgtcgaatgcgctggccattcaggtggattctgaaggaaaaattaaatatgatgcaattgctcgacaaggacagtcaaaagacaaggtcatttatagcaaatacactgacctggttccaaaggaggttatgaatgcagatgatccagacctgcaaaggcccgatgaagaagctattaaagagataacagaaaagacaagagtagccttagaaaaatctgtatcacagaaggtcgccgcagccatgccagttcgagcagctgacaaattggctcctgctcagtatatccgatacacaccatctcagcaaggagtggcattcaactctggagctaaacagagggttattcggatggtagaaatgcagaaagatccaatggagcctccaaggttcaagattaataagaaaattccccggggaccaccttctcctcctgcgcctgtcatgcattctcctagccgaaagatgactgtaaaggaacaacaagagtggaagattcctccttgtatttctaactggaaaaatgcaaagggttatacaattccattagacaaacgtctggctgctgatggaagaggactacagacagtacacataaatgaaaatttcgccaaattggcagaagccctctacattgctgatcggaaggctcgtgaagctgtggaaatgcgtgcccaagtagagagaaaaatggctcagaaagaaaaggaaaaacatgaagagaaacttagagaaatggcccagaaagccagggagagaagagctgggatcaaaactcatgtggaaaaagaggatggggaggcacgtgagagggatgaaatccggcatgacaggcgaaaagagagacagcatgaccggaatctttccagggcagctcctgataagaggtcgaaacttcagagaaatgaaaatcgggatatcagtgaagttattgctctcggtgttcctaatcctcggacttccaatgaagttcagtatgaccaaaggctcttcaaccaatccaagggtatggacagtggatttgcaggtggagaagatgaaatttataatgtttatgatcaagcctggagaggtggtaaagatatggcccagagtatttataggcccagtaaaaatctggacaaggacatgtatggtgatgacctagaagccagaataaagaccaacagatttgttcccgacaaggagttttctggttcagaccgtagacagagaggccgagaaggaccagtgcagtttgaggaagatccttttggtttggacaagtttttggaagaagccaaacagcatggtggctctaaaagaccctcagatagcagccgccccaaggaacacgagcatgaaggcaagaagaggaggaaggaataggcacaggtctctccaaagtgaatgaactcttacccataaccctaatgatgcaagtcatatgggggaacactttgtaaatggtcaggataaaaaccaaatctgggtgccagatcccagcactactttttattactggagaaatgggggggatagaaaattctactttgaattatttagttttttttaaagagtgggttgtgtttgtgcttctcccacctttcagcatttatagaacatgctgccccacatacaaagtcaagaccacttacttttatgtgacactagtagtttggggttaatgttttgtgtaagaacagctgcatatgagtaaagttaccccaaccacagtgaggaggaagatgttcacatactggaactgtcctgccaaataaattttgcccctattgtgctctgttttaatttggagtgggcaaagtaacctcttgcttggtgcaactatttgtttcaaataaaaacatttagacaaaa

SEQ ID NO: 2154 - DNA, 893 bp, Homo sapiens
gctcgcgctggaagaagcggaagaagatggcgctcaccagctttttacctgcacctactcagctatctcaggaccagcttgaggctgaagaaaaggcaagatcccagagatcacggcagacctcactggtctcctcccgaagagaacctcccccgtacggataccggaaaggctggatacctcggttattagaggattttggagatggaggtgcttttccagagatccatgtggcccagtatccactggatatgggacgaaagaaaaaaatgtcgaatgcgctggccattcaggtggattctgaaggaaaaattaaatatgatgcaattgctcgacaaggacagtcaaaagacaaggtcatttatagcaaatacactgacctggttccaaaggaggttatgaatgcagatgatccagacctgcaaaggcccgatgaagaagctattaaagagataacagaaaagacaagagtagccttagaaaaatctgtatcacagaaggtcgccgcagccatgccagttcgagcagctgacaaattggctcctgctcagtatatccgatacacaccatctcagcaaggagtggcattcaactctggagctaaacagagggttattcggatggtagaaatgcagaaagatccaatggagcctccaaggttcaagattaataagaaaattccccggggaccaccttctcctcctgcgcctgtcatgcattctcctagccgaaagatgactgtaaaggaacaacaagagtggaagattcctccttgtatttctaactggaaaaatgcaaagggttatacaattccattagacaaacgtctggctgctgatggaagaggactacagacagtacacaaaaaaaaaaaaaaaaaaaaaaggaaataa

SEQ ID NO: 2155 - DNA, 584 bp, Homo sapiens
gtcgctcgcgctggaagaagcggaagaagatggcgctcaccagctttttacctgcacctactcagctatctcaggaccagcttgaggctgaagaaaaggcaagatcccagagatcacggcagacctcactggtctcctcccgaagagaacctcccccgtacggataccggaaaggctggatacctcggttattagaggattttggagatggaggtgcttttccagagatccatgtggcccagtatccactggatatgggacgaaagaaaaaaatgtcgaatgcgctggccattcaggtggattctgaaggaaaaattaaatatgatgcaattgctcgacaaggacagtcaaaagacaaggtcatttatagcaaatacactgacctggttccaaaggaggttatgaatgcagatgatccagacctgcaaaggcccgatgaagaagctattaaagagatgactgtaaaggaacaacaagagtggaagattcctccttgtatttctaactggaaaaatgcaaagggttatacaattccattagacaaacgtctggctgctgatggaagaggactacagacagtacac

SEQ ID NO: 2156 - DNA, 2917 bp, Homo sapiens
acttttcttttcctctttgactgagcaccgaggggcagttggcagcttcacctcagagctgcaggaaggaacggggcagtgaaaatcgaatcgggtgtgatcctaggccaagctcatggcccagcagggccagcaggggcagatggcaagtggagacagcaatctcaacttcaggatggtcgcagagatccagaacgtagagggtcagaacctgcaggagcaggtttgccctgagcccattttcaggttcttcagagaaaacaaggtggagattgcaagtgcaataacaaggccatttcctttccttatgggcctccgagaccgctccttcatctccgagcagatgtatgaacattttcaagaagcttttagaaacctggtcccagtgacaagagtgatgtattgtgtactcagtgaactggagaagacatttggctggtcacatctggaagcattgttcagcaggattaacctgatggcctatcctgatttaaacgagatttacagaagcttccagaatgtatgctatgaacactcacctctccaaatgaataatgtaaacgatttagaagatagacccagattactaccatatggtaaacaagagaacagcaatgcctgtcatgaaatggatgatatagcagtgcctcaggaagccttgagctcctcgccaaggtgtgagccaggtttctcttcagagtcttgtgagcagttagctctcccaaaggctggtggaggagatgctgaagatgcacccagcctactaccaggtgggggagtgtcctgtaaacttgctatacaaatagatgaaggagaatcagaagaaatgcccaagttactgccttatgatacagaagagacctttgatctaaaaactccccaagtcactaatgaaggagaaccagagaaggggctctgtctactaccaggtgaaggagaagagggcagtgatgactgttcggaaatgtgtgatggagaagagcgccaggaagcctctagctccctagcaagacgtgggtcagtgtctagtgaactagaaaatcacccaatgaatgaagaaggagaatcagaagagcttgcttctagcctgctatatgataatgtaccaggagcggagcaatcagcatatgaaaatgagaagtgttcctgtgtcatgtgtttctcagaagaggtgccaggaagcccagaagcaaggacggaaagtgatcaagcgtgtggcacaatggatactgtggatattgcaaacaactccactttgggaaaacccaagaggaaaagaagaaaaaagagggggcatggctggagcagaatgagaatgagaaggcaggaaaacagccaacaaaatgataatagcaaagccgacggccaggtggtctccagtgaaaagaaggcgaacgtgaatctgaaagacctttccaagattagggggagaaagagaggcaaacctggaacccgcttcactcagagtgacagagctgcacagaaaagagtccgatcaagagcttcaagaaagcacaaagatgaaactgtggattttaaggctcctttgcttccagtgacctgtggtggggtgaagggaattttacataagaagaaattgcagcaaggaatcttggtgaagtgtatacagactgaggatggaaaatggttcacccccacggaatttgaaatcaaaggaggccatgcaagatcaaagaactggaggctgagtgtgcgctgtggcgggtggcccctacgatggctgatggagaatggatttctgcctgatcctccaagaatacgttacaggaaaaaaaagagaatactgaagtctcaaaacaatagctcagttgacccttgtatgagaaacctggatgagtgtgaggtgtgccgggacggaggggagctgttctgttgcgacacttgttcaagagtcttccatgaggactgtcacatcccgcctgtggaagctgagaggaccccgtggaattgcatcttctgcaggatgaaggagtctccgggaagccaacagtgttgtcaggaatctgaggtcctggagaggcagatgtgtcctgaggaacagttgaaatgtgagttcctcctcttgaaagtctattgctgttctgagagctccttttttgccaagattccatactattattatattagagaggcgtgtcaaggcctgaaggagcccatgtggttggataaaatcaagaaaaggctgaatgagcacggttacccccaagtggaggggtttgtacaagacatgcgcctcatcttccagaaccacagggcctcttacaagtacaaggattttggccaaatgggatttagactggaggctgagtttgagaagaatttcaaggaagtgtttgctattcaggaaacaaatgggaacaattgactggattagtggatgctgaaagcattcagcaaatggcaccctaaaatatgccgctggtttgccactgacttcaaaatgaggtcacttgggcacagcacatgcagggaggggcttttctctgagcctccttcatctgcccaaagacaaatcctcaaaaggaaattcaatcatcatgaatcacaaccccaagtatctcatcagccagggaagagtaagtgggatcacagggaaggatgttggcagcgacaccatcccatacaggctcttacctcttctcctgagggctgctccagacaacatttattacccagaagaccttttgtctgaaaaccagccaagctttattcaggacacacttcttgccttcactttcccacttccgtggccacctccatgcagaagccctaagcccacattctttcgatagctcacggtggtgcatgagtgtccatcatctgactcttctcggagtctcatattttgtgggactcctgtgcaaacatatgttattaaaatttttttcctcctgtt

SEQ ID NO: 2157 - DNA, 814 bp, Homo sapiens
gcagttggcagcttcacctcagagctgcaggaaggaacggggcagtgaaaatcgaatcgggtgtgatcctaggccaagctcatggcccagcagggccagcaggggcagatggcaagtggagacagcaatctcaacttcaggatggtcgcagagatccagaacgtagagggtcagaacctgcaggagcaggtttgccctgagcccattttcaggttcttcagagaaaacaaggtggagattgcaagtgcaataacaaggccatttcctttccttatgggcctccgagaccgctccttcatctccgagcagatgtatgaacattttcaagaagcttttagaaacctggtcccagtgacaagagtgatgtattgtgtactcagtgaactggagaagacatttggctggtcacatctggaagcattgttcagcaggattaacctgatggcctatcctgatttaaacgagatttacagaagcttccagaatgaaaatttatcatccagtgcagtcctgtgtcaacttgtttctccaaacaaagactggagaagtcacgaagagagcctagcacatactggtacactgaggaggagctgcatgtgaaagctatgaagacagaaaagggggttggtgggggcctttccgaaccatgtggttgaattgcagactgtgggaggcagggtgtgagagctgactctggagaaagaagttgaagtggattctggaaggcttgacaccctgtgctaaggaatctggagtttaatttttggaaaataaagaaggaataaagggcatttaaacgggaaaagtaaaagaa

SEQ ID NO: 2158 - DNA, 1330 bp, Homo sapiens
acttttcttttcctctttgactgagcaccgaggggcagttggcagcttcacctcagagctgcaggaaggaacggggcagtgaaaatcgaatcgggtgtgatcctaggccaagctcatggcccagcagggccagcaggggcagatggcaagtggagacagcaatctcaacttcaggatggtcgcagagatccagaacgtagagggtcagaacctgcaggagcaggtttgccctgagcccattttcaggttcttcagagaaaacaaggtggagattgcaagtgcaataacaaggccatttcctttccttatgggcctccgagaccgctccttcatctccgagcagatgtatgaacattttcaagaagcttttagaaacctggtcccagtgacaagagtgatgtattgtgtactcagtgaactggagaagacatttggctggtcacatctggaagcattgttcagcaggattaacctgatggcctatcctgatttaaacgagatttacagaagcttccagaatgtatgctatgaacactcacctctccaaatgaataatgtaaacgatttagaagatagacccagattactaccatatggtaaacaagagaacagcaatgcctgtcatgaaatggatgatatagcagtgcctcaggaagccttgagctcctcgccaaggtgtgagccaggtttctcttcagagtcttgtgagcagttagctctcccaaaggctggtggaggagatgctgaagatgcacccagcctactaccaggtgggggagtgtcctgtaaacttgctatacaaatagatgaaggagaatcagaagaaatgcccaagttactgccttatgatacagaagttctagaaagcaacgggatgatagatgcggcaaggacatacagcacagcaccaggggagaaacagggagaggaggaaggcaggaacagtcccagaaaaagaaaccaagacaaggagaagtaccaagagagtccagagggaagagacaaagagacctttgatctaaaaactccccaagtcactaatgaaggagaaccagagaaggggctctgtctactaccaggtgaaggagaagagggcagtgatgactgttcagaaatgtgtgatggagaagagccccaggaagcctctagctccctagcaagatgtgggtcagagggcagtgatgactgttcggaaatgtgtgatggagaagagcgccaggaagcccagaagcaaggacggaaagtgatcaagcgtgtggcacaatggatactgtggatattgcaaacaactccactttgggaaaacccaagaggaaaagaagacaaaagg

SEQ ID NO: 2159 - DNA, 3246 bp, Homo sapiens
cttttcttttcctctttgactgagcaccgaggggcagttggcagcttcacctcagagctgcaggaaggaacggggcagtgaaaatcgaatcgggtgtgatcctaggccaagctcatggcccagcagggccagcaggggcagatggcaagtggagacagcaatctcaacttcaggatggtcgcagagatccagaacgtagagggtcagaacctgcaggagcaggtttgccctgagcccattttcaggttcttcagagaaaacaaggtggagattgcaagtgcaataacaaggccatttcctttccttatgggcctccgagaccgctccttcatctccgagcagatgtatgaacattttcaagaagcttttagaaacctggtcccagtgacaagagtgatgtattgtgtactcagtgaactggagaagacatttggctggtcacatctggaagcattgttcagcaggattaacctgatggcctatcctgatttaaacgagatttacagaagcttccagaatgtatgctatgaacactcacctctccaaatgaataatgtaaacgatttagaagatagacccagattactaccatatggtaaacaagagaacagcaatgcctgtcatgaaatggatgatatagcagtgcctcaggaagccttgagctcctcgccaaggtgtgagccaggtttctcttcagagtcttgtgagcagttagctctcccaaaggctggtggaggagatgctgaagatgcacccagcctactaccaggtgggggagtgtcctgtaaacttgctatacaaatagatgaaggagaatcagaagaaatgcccaagttactgccttatgatacagaagttctagaaagcaacgggatgatagatgcggcaaggacatacagcacagcaccaggggagaaacagggagaggaggaaggcaggaacagtcccagaaaaagaaaccaagacaaggagaagtaccaagagagtccagagggaagagacaaagagacctttgatctaaaaactccccaagtcactaatgaaggagaaccagagaaggggctctgtctactaccaggtgaaggagaagagggcagtgatgactgttcagaaatgtgtgatggagaagagccccaggaagcctctagctccctagcaagatgtgggtcagtttcttgtttatctgcagagacctttgatctaaagactccccaagtcactaatgaaggagaaccagagaaggagctcagtctactaccaggtgaaggagaagagggcagtgatgactgttcggaaatgtgtgatggagaagagcgccaggaagcctctagctccctagcaagacgtgggtcagtgtctagtgaactagaaaatcacccaatgaatgaagaaggagaatcagaagagcttgcttctagcctgctatatgataatgtaccaggagcggagcaatcagcatatgaaaatgagaagtgttcctgtgtcatgtgtttctcagaagaggtgccaggaagcccagaagcaaggacggaaagtgatcaagcgtgtggcacaatggatactgtggatattgcaaacaactccactttgggaaaacccaagaggaaaagaagaaaaaagagggggcatggctggagcagaatgagaatgagaaggcaggaaaacagccaacaaaatgataatagcaaagccgacggccaggtggtctccagtgaaaagaaggcgaacgtgaatctgaaagacctttccaagattagggggagaaagagaggcaaacctggaacccgcttcactcagagtgacagagctgcacagaaaagagtccgatcaagagcttcaagaaagcacaaagatgaaactgtggattttaaggctcctttgcttccagtgacctgtggtggggtgaagggaattttacataagaagaaattgcagcaaggaatcttggtgaagtgtatacagactgaggatggaaaatggttcacccccacggaatttgaaatcaaaggaggccatgcaagatcaaagaactggaggctgagtgtgcgctgtggcgggtggcccctacgatggctgatggagaatggatttctgcctgatcctccaagaatacgttacaggaaaaaaaagagaatactgaagtctcaaaacaatagctcagttgacccttgtatgagaaacctggatgagtgtgaggtgtgccgggacggaggggagctgttctgttgcgacacttgttcaagagtcttccatgaggactgtcacatcccgcctgtggaagctgagaggaccccgtggaattgcatcttctgcaggatgaaggagtctccgggaagccaacagtgttgtcaggaatctgaggtcctggagaggcagatgtgtcctgaggaacagttgaaatgtgagttcctcctcttgaaagtctattgctgttctgagagctccttttttgccaagattccatactattattatattagagaggcgtgtcaaggcctgaaggagcccatgtggttggataaaatcaagaaaaggctgaatgagcacggttacccccaagtggaggggtttgtacaagacatgcgcctcatcttccagaaccacagggcctcttacaagtacaaggattttggccaaatgggatttagactggaggctgagtttgagaagaatttcaaggaagtgtttgctattcaggaaacaaatgggaacaattgactggattagtggatgctgaaagcattcagcaaatggcaccctaaaatatgccgctggtttgccactgacttcaaaatgaggtcacttgggcacagcacatgcagggaggggcttttctctgagcctccttcatctgcccaaagacaaatcctcaaaaggaaattcaatcatcatgaatcacaaccccaagtatctcatcagccagggaagagtaagtgggatcacagggaaggatgttggcagcgacaccatcccatacaggctcttacctcttctcctgagggctgctccagacaacatttattacccagaagaccttttgtctgaaaaccagccaagctttattcaggacacacttcttgccttcactttcccacttccgtggccacctccatgcagaagccctaagcccacattctttcgatagctcacggtggtgcatgagtgtccatcatctgactcttctcggagtctcatattttgtgggactcctgtgcaaacatatgttattaaaatttttttcctcct

SEQ ID NO: 2160 - DNA, 3009 bp, Homo sapiens
tttgactgagcaccgaggggcagttggcagcttcacctcagagctgcaggaaggaacggggcagtgaaaatcgaatcgggtgtgatcctaggccaagctcatggcccagcagggccagcaggggcagatggcaagtggagacagcaatctcaacttcaggatggtcgcagagatccagaacgtagagggtcagaacctgcaggagcaggtttgccctgagcccattttcaggttcttcagagaaaacaaggtggagattgcaagtgcaataacaaggccatttcctttccttatgggcctccgagaccgctccttcatctccgagcagatgtatgaacattttcaagaagcttttagaaacctggtcccagtgacaagagtgatgtattgtgtactcagtgaactggagaagacatttggctggtcacatctggaagcattgttcagcaggattaacctgatggcctatcctgatttaaacgagatttacagaagcttccagaatgtatgctatgaacactcacctctccaaatgaataatgtaaacgatttagaagatagacccagattactaccatatggtaaacaagagaacagcaatgcctgtcatgaaatggatgatatagcagtgcctcaggaagccttgagctcctcgccaaggtgtgagccaggtttctcttcagagtcttgtgagcagttagctctcccaaaggctggtggaggagatgctgaagatgcacccagcctactaccaggtgggggagtgtcctgtaaacttgctatacaaatagatgaaggagaatcagaagaaatgcccaagttactgccttatgatacagaagttctagaaagcaacgggatgatagatgcggcaaggacatacagcacagcaccaggggagaaacagggagaggaggaaggcaggaacagtcccagaaaaagaaaccaagacaaggagaagtaccaagagagtccagagggaagagacaaagagacctttgatctaaaaactccccaagtcactaatgaaggagaaccagagaaggggctctgtctactaccaggtgaaggagaagagggcagtgatgactgttcagaaatgtgtgatggagaagagccccaggaagcctctagctccctagcaagatgtgggtcagtttcttgtttatctgcagagacctttgatctaaagactccccaagtcactaatgaaggagaaccagagaaggagctcagtctactaccaggtgaaggagaagtgtctagtgaactagaaaatcacccaatgaatgaagaaggagaatcagaagagcttgcttctagcctgctatatgataatgtaccaggagcggagcaatcagcatatgaaaatgagaagtgttcctgtgtcatgtgtttctcagaagaggtgccaggaagcccagaagcaaggacggaaagtgatcaagcgtgtggcacaatggatactgtggatattgcaaacaactccactttgggaaaacccaagaggaaaagaagaaaaaagagggggcatggctggagcagaatgagaatgagaaggcaggaaaacagccaacaaaatgataatagcaaagccgacggccaggtggtctccagtgaaaagaaggcgaacgtgaatctgaaagacctttccaagattagggggagaaagagaggcaaacctggaacccgcttcactcagagtgacagagctgcacagaaaagagtccgatcaagagcttcaagaaagcacaaagatgaaactgtggattttaaggctcctttgcttccagtgacctgtggtggggtgaagggaattttacataagaagaaattgcagcaaggaatcttggtgaagtgtatacagactgaggatggaaaatggttcacccccacggaatttgaaatcaaaggaggccatgcaagatcaaagaactggaggctgagtgtgcgctgtggcgggtggcccctacgatggctgatggagaatggatttctgcctgatcctccaagaatacgttacaggaaaaaaaagagaatactgaagtctcaaaacaatagctcagttgacccttgtatgagaaacctggatgagtgtgaggtgtgccgggacggaggggagctgttctgttgcgacacttgttcaagagtcttccatgaggactgtcacatcccgcctgtggaagctgagaggaccccgtggaattgcatcttctgcaggatgaaggagtctccgggaagccaacagtgttgtcaggaatctgaggtcctggagaggcagatgtgtcctgaggaacagttgaaatgtgagttcctcctcttgaaagtctattgctgttctgagagctccttttttgccaagattccatactattattatattagagaggcgtgtcaaggcctgaaggagcccatgtggttggataaaatcaagaaaaggctgaatgagcacggttacccccaagtggaggggtttgtacaagacatgcgcctcatcttccagaaccacagggcctcttacaagtacaaggattttggccaaatgggatttagactggaggctgagtttgagaagaatttcaaggaagtgtttgctattcaggaaacaaatgggaacaattgactggattagtggatgctgaaagcattcagcaaatggcaccctaaaatatgccgctggtttgccactgacttcaaaatgaggtcacttgggcacagcacatgcagggaggggcttttctctgagcctccttcatctgcccaaagacaaatcctcaaaaggaaattcaatcatcatgaatcacaaccccaagtatctcatcagccagggaagagtaagtgggatcacagggaaggatgttggcagcgacaccatcccatacaggctcttacctcttctcctgagggctgctccagacaacatttattacccagaagaccttttgtctgaaaaccagccaagctttattcaggacacacttcttgccttcactttcccacttccgtggc

SEQ ID NO: 2161 - DNA, 2639 bp, Homo sapiens
acttttcttttcctctttgactgagcaccgaggggcagttggcagcttcacctcagagctgcaggaaggaacggggcagtgaaaatcgaatcgggtgtgatcctaggccaagctcatggcccagcagggccagcaggggcagatggcaagtggagacagcaatctcaacttcaggatggtcgcagagatccagaacgtagagggtcagaacctgcaggagcaggtttgccctgagcccattttcaggttcttcagagaaaacaaggtggagattgcaagtgcaataacaaggccatttcctttccttatgggcctccgagaccgctccttcatctccgagcagatgtatgaacattttcaagaagcttttagaaacctggtcccagtgacaagagtgatgtattgtgtactcagtgaactggagaagacatttggctggtcacatctggaagcattgttcagcaggattaacctgatggcctatcctgatttaaacgagatttacagaagcttccagaatgtatgctatgaacactcacctctccaaatgaataatgtaaacgatttagaagatagacccagattactaccatatggtaaacaagagaacagcaatgcctgtcatgaaatggatgatatagcagtgcctcaggaagccttgagctcctcgccaaggtgtgagccaggtttctcttcagagtcttgtgagcagttagctctcccaaaggctggtggaggagatgctgaagatgcacccagcctactaccaggtgggggagagacctttgatctaaaaactccccaagtcactaatgaaggagaaccagagaaggggctctgtctactaccaggtgaaggagaagagggcagtgatgactgttcagaaatgtgtgatggagaagagccccaggaagcctctagctccctagcaagatgtgggtcagtttcttgtttatctgcagagacctttgatctaaagactccccaagtcactaatgaaggagaaccagagaaggagctcagtctactaccaggtgaaggagaagagggcagtgatgactgttcggaaatgtgtgatggagaagagcgccaggaagcctctagctccctagcaagacgtgggtcagtgtctagtgaactagaaaatcacccaatgaatgaagaaggagaatcagaagagcttgcttctagcctgctatatgataatgtaccaggagcggagcaatcagcatatgaaaatgagaagtgttcctgtgtcatgtgtttctcagaagaggtgccaggaagcccagaagcaaggacggaaagtgatcaagcgtgtggcacaatggatactgtggatattgcaaacaactccactttgggaaaacccaagaggaaaagaagaaaaaagagggggcatggctggagcagaatgagaatgagaaggcaggaaaacagccaacaaaatgataatagcaaagccgacggccaggtggtctccagtgaaaagaaggcgaacgtgaatctgaaagacctttccaagattagggggagaaagagaggcaaacctggaacccgcttcactcagagtgacagagctgcacagaaaagagtccgatcaagagcttcaagaaagcacaaagatgaaactgtggattttaaggctcctttgcttccagtgacctgtggtggggtgaagggaattttacataagaagaaattgcagcaaggaatcttggtgaagtgtatacagactgaggatggaaaatggttcacccccacggaatttgaaatcaaaggaggccatgcaagatcaaagaactggaggctgagtgtgcgctgtggcgggtggcccctacgatggctgatggagaatggatttctgcctgatcctccaagaatacgttacaggaaaaaaaagagaatactgaagtctcaaaacaatagctcagttgacccttgtatgagaaacctggatgagtgtgaggtgtgccgggacggaggggagctgttctgttgcgacacttgttcaagagtcttccatgaggactgtcacatcccgcctgtggaagctgagaggaccccgtggaattgcatcttctgcaggatgaaggagtctccgggaagccaacagtgttgtcaggaatctgaggtcctggagaggcagatgtgtcctgaggaacagttgaaatgtgagttcctcctcttgaaagtctattgctgttctgagagctccttttttgccaagattccatactattattatattagagaggcgtgtcaaggcctgaaggagcccatgtggttggataaaatcaagaaaaggctgaatgagcacggttacccccaagtggaggggtttgtacaagacatgcgcctcatcttccagaaccacagggcctcttacaaggctgttcacggaagaccaggatgtagatgagggacttgtctatgacactgtattcaagcacttcaaaagacataagctggagatatcaaatgcaataaaaaagacatttccattccttgagggcctccgcgatcgggaactcatcacaaataaaatgtttgaagattctgaagattcttgtagaaacctggtccctgtacaaagagtggtgtacaatgttctcagtgaactggagaagacatttaac

SEQ ID NO: 2162 - DNA, 1047 bp, Homo sapiens
cacttttcttttcctctttgactgagcaccgaggggcagttggcagcttcacctcagagctgcaggaaggaacggggcagtgaaaatcgaatcgggtgtgatcctaggccaagctcatggcccagcagggccagcaggggcagatggcaagtggagacagcaatctcaacttcaggatggtcgcagagatccagaacgtagagggtcagaacctgcaggagcaggtttgccctgagcccattttcaggttcttcagagaaaacaaggtggagattgcaagtgcaataacaaggccatttcctttccttatgggcctccgagaccgctccttcatctccgagcagatgtatgaacattttcaagaagcttttagaaacctggtcccagtgacaagagtgatgtattgtgtactcagtgaactggagaagacatttggctggtcacatctggaagcattgttcagcaggattaacctgatggcctatcctgatttaaacgagatttacagaagcttccagaatgtatgctatgaacactcacctctccaaatgaataatgtaaacgatttagaagatagacccagattactaccatatggtaaacaagagaacagcaatgcctgtcatgaaatggatttctgcctgatcctccaagaatacgttacaggaaaaaaaagagaatactgaagtctcaaaacaatagctcagttgacccttgtatgagaaacctggatgagtgtgaggtgtgccgggacggaggggagctgttctgttgcgacacttgttcaagagtcttccatgaggactgtcacatcccgcctgtggaagctgagaggaccccgtggaattgcatcttctgcaggatgaaggagtctccgggaagccaacagtgttgtcaggaatctgaggtcctggagaggcagatgtgtcctgaggaacagttgaaatgtgagttcctcctcttgaaagtctattgctgttctgagagctccttttttgccaagattccatactattattatattagagaggcgtgtcaaggcctgaa

SEQ ID NO: 2163 - DNA, 3591 bp, Homo sapiens
atggcaggtgggggcagcgacctgagcaccagggggctgaacggaggtgtttcacaagtagcaaatgagatgaaccatcttcctgcacacagccaaagtctgcaaaggctgttcacggaagaccaggatgtagatgagggacttgtctatgacactgtattcaagcacttcaaaagacataagctggagatatcaaatgcaataaaaaagacatttccattccttgagggcctccgcgatcgggaactcatcacaaataaaatgtttgaagattctgaagattcttgtagaaacctggtccctgtacaaagagtggtgtacaatgttctcagtgaactggagaagacatttaacctgtcagttttggaagcactgttcagcgaggtcaacatgcaggaataccccgatttaattcacatttataaaagcttcaaaaatgcaatccaagacaaattgtctttccaagaaagtgatcgaaaagaaagggaagagaggcctgacatcaaactaagtcttaaacaaggagaagtgccagaaagcccggaagcaaggaaggaaagtgaccaagcatgtggcaaaatggatactgtggatattgcaaacaactctactttgggaaaacccaagaggaaaagaagaaaaaagaaggggcatggctggagcagaatgggaacgagaacgcagaaaaacaaccaacaaaatgataacagcaaagccgatggccagctggtctcgagtgaaaagaaggcgaacatgaatctgaaagacctttccaagattagggggagaaagagaggcaaacctggaacccactttactcagagtgacagagctccacagaaaagagtccgatcaagagcttcaagaaagcacaaagatgaaactgtggattttcaggctcctttacttccagtgacctgtggtggggtgaagggaattttacataaggagaaattggaacaaggaaccttggcaaagtgtatacagactgaggatggaaaatggttcacccccatggaatttgaaatcaaaggaggctacgcaagatcaaagaactggaggctgagtgtgcgctgtggcgggtggcccctacgacggctgatggaggaaggatctctacctaatcctccaagaatatattacaggaacaaaaagagaatactgaagtctcaaaacaatagctcagttgacccttgtatgagaaacttggatgagtgtgaggtgtgccgggacggaggggagctgttctgttgcgacacttgttcaagagtcttccatgaggactgccacatcccacctgtggaaagtgagaagtaagtgacatgcaggcacctctctttcatcctttaagggaccttccacctgccatgcgcactctccagcagaatgtctgcttgtgtctagatggggaaggagcaggttcatcgggtactgggacccagcagtgtgatccagagagcagtgggagacgctggcagcaggaggtaaatgctctctgtgctctcagggacacctcctctgatatgctgaggccagtgttggggacctttgcctacatactggtattgtcctttccttgaagttttgcagtagggtctcctgtcccagggggttgaggaaaaaaaacaccagttgtttatattttgtgcttattcatacaagacaggaagcacggtcttaggcggatggaggcctgacgtccctggagttgaaagcccagtttctgacacacaggcctggcaggcaggactccttgtgctcccagcagctcagacagggaaaggatagtccccactcacggtgacaccaccttcctgaggcttccctcctgctgctaccactgatgcgagggaaaggccagtggctggagaccccatgtgcagttcttggatactctgggaggtgttcccctccctcccatgactgagcccatcagccattcctgaaggaagacagtggtagccacaggaacggtggccatttccaagctccctgccctctgctcacccatgtccaatctctcaggaccccgtggaattgcatcttctgcaggatgaaggagtctccgggaagccaacagtgttgtcaggaatctgaggtcctggagaggcagatgtgtcctgaggaacagttggtaaatcagatgcaaaccccaagccttctcctttcccctcacacgtgagaaccatgaacaagcgcaagggcaggggaatgtactgaaaggagcctgctcttccgcgccacacttcaatggcactgatagaacaccacaccttgtttgcacaaaaaataactcagccatgacatgtctgtttccaagagccacacatgttagagaaacttgaggaagaagggtgtgagtcgtgtgctgtgtctcatgcatgtgggctcattctctccaagctgcttttcatttacggcctctttcttttgcagaaatgtgagttcctcctcttgaaagtctattgctgttctgagagctccttttttgccaagattccatactattattatattagagaggcgtgtcaaggcctgaaggagcccatgtggttggataaaatcaagaaaaggctgaatgagcacggttacccccaagtggaggggtttgtacaagacatgcgcctcatcttccagaaccacagggcctcttacaagtataaggattttggccaaatgggacttagactggaggctgaatttgagaaggatttcaaggaagtgtttgctattcaggaaacaaatgggaacagttgactggtttagtggatgctgaaggccttcaggaaatatgctactggttgccactgacttcaaactgagagcacttgggaaatagcacatgcagggagaggcttttctctgagcctccctcatctgcccaaaaacaaatcctcaaaagaaatttgatcatcatgaatcccatccccaagaatctcatcaaccagggaagaggaactgagatcacagggaaggagattggaggtgataccagcacagacagactctcacctcttctcctgaggtctgctccagacaacatttattactcacaagacctttttcctccgttttttttttgagatggagtctcacacagtcacccgggattggaatgcaatggcgcgatctcagctcactgcaacctctgcctcccggattcaagtgattctcctgtctcagcctcccaagtagctgggattacagtgcctgccaccatgcccagctaattttttgcatttttagtagagacggggtttcactatgttggccaggctggtctcgaactcctgacctcatgagccgcccgccttggcctcccaaagtgctgggacgtgacaggagtgagccaccacacctggccactcgcaagaccttttatctgaaaaccagccaagctttattcacgacacacttcttcccttcactctcccacttctgtggtcaactccctgcagaactcccaaactgccgttcttttcgatagctcacgatggtgtatgagtgtcaatcatctgacccttcttggagtctcatatttcgtggaactcctgtgcaaacatatattattaaattttttttcctcctgtc

SEQ ID NO: 2164 - DNA, 3486 bp, Homo sapiens
atggcaggtgggggcagcgacctgagcaccagggggctgaacggaggtgtttcacaagtagcaaatgagatgaaccatcttcctgcacacagccaaagtctgcaaaggctgttcacggaagaccaggatgtagatgagggacttgtctatgacactgtattcaagcacttcaaaagacataagctggagatatcaaatgcaataaaaaagacatttccattccttgagggcctccgcgatcgggaactcatcacaaataaaatgtttgaagattctgaagattcttgtagaaacctggtccctgtacaaagagtggtgtacaatgttctcagtgaactggagaagacatttaacctgtcagttttggaagcactgttcagcgaggtcaacatgcaggaataccccgatttaattcacatttataaaagcttcaaaaatgcaatccaagacaaattgtctttccaagaaagtgatcgaaaagaaagggaagagaggcctgacatcaaactaagtcttaaacaaggagaagtgccagaaagcccggaagcaaggaaggaaagtgaccaagcatgtggcaaaatggatactgtggatattgcaaacaactctactttgggaaaacccaagaggaaaagaagaaaaaagaaggggcatggctggagcagaatgggaacgagaacgcagaaaaacaaccaacaaaatgataacagcaaagccgatggccagctggtctcgagtgaaaagaaggcgaacatgaatctgaaagacctttccaagattagggggagaaagagaggcaaacctggaacccactttactcagagtgacagagctccacagaaaagagtccgatcaagaggaaccttggcaaagtgtatacagactgaggatggaaaatggttcacccccatggaatttgaaatcaaaggaggctacgcaagatcaaagaactggaggctgagtgtgcgctgtggcgggtggcccctacgacggctgatggaggaaggatctctacctaatcctccaagaatatattacaggaacaaaaagagaatactgaagtctcaaaacaatagctcagttgacccttgtatgagaaacttggatgagtgtgaggtgtgccgggacggaggggagctgttctgttgcgacacttgttcaagagtcttccatgaggactgccacatcccacctgtggaaagtgagaagtaagtgacatgcaggcacctctctttcatcctttaagggaccttccacctgccatgcgcactctccagcagaatgtctgcttgtgtctagatggggaaggagcaggttcatcgggtactgggacccagcagtgtgatccagagagcagtgggagacgctggcagcaggaggtaaatgctctctgtgctctcagggacacctcctctgatatgctgaggccagtgttggggacctttgcctacatactggtattgtcctttccttgaagttttgcagtagggtctcctgtcccagggggttgaggaaaaaaaacaccagttgtttatattttgtgcttattcatacaagacaggaagcacggtcttaggcggatggaggcctgacgtccctggagttgaaagcccagtttctgacacacaggcctggcaggcaggactccttgtgctcccagcagctcagacagggaaaggatagtccccactcacggtgacaccaccttcctgaggcttccctcctgctgctaccactgatgcgagggaaaggccagtggctggagaccccatgtgcagttcttggatactctgggaggtgttcccctccctcccatgactgagcccatcagccattcctgaaggaagacagtggtagccacaggaacggtggccatttccaagctccctgccctctgctcacccatgtccaatctctcaggaccccgtggaattgcatcttctgcaggatgaaggagtctccgggaagccaacagtgttgtcaggaatctgaggtcctggagaggcagatgtgtcctgaggaacagttggtaaatcagatgcaaaccccaagccttctcctttcccctcacacgtgagaaccatgaacaagcgcaagggcaggggaatgtactgaaaggagcctgctcttccgcgccacacttcaatggcactgatagaacaccacaccttgtttgcacaaaaaataactcagccatgacatgtctgtttccaagagccacacatgttagagaaacttgaggaagaagggtgtgagtcgtgtgctgtgtctcatgcatgtgggctcattctctccaagctgcttttcatttacggcctctttcttttgcagaaatgtgagttcctcctcttgaaagtctattgctgttctgagagctccttttttgccaagattccatactattattatattagagaggcgtgtcaaggcctgaaggagcccatgtggttggataaaatcaagaaaaggctgaatgagcacggttacccccaagtggaggggtttgtacaagacatgcgcctcatcttccagaaccacagggcctcttacaagtataaggattttggccaaatgggacttagactggaggctgaatttgagaaggatttcaaggaagtgtttgctattcaggaaacaaatgggaacagttgactggtttagtggatgctgaaggccttcaggaaatatgctactggttgccactgacttcaaactgagagcacttgggaaatagcacatgcagggagaggcttttctctgagcctccctcatctgcccaaaaacaaatcctcaaaagaaatttgatcatcatgaatcccatccccaagaatctcatcaaccagggaagaggaactgagatcacagggaaggagattggaggtgataccagcacagacagactctcacctcttctcctgaggtctgctccagacaacatttattactcacaagacctttttcctccgttttttttttgagatggagtctcacacagtcacccgggattggaatgcaatggcgcgatctcagctcactgcaacctctgcctcccggattcaagtgattctcctgtctcagcctcccaagtagctgggattacagtgcctgccaccatgcccagctaattttttgcatttttagtagagacggggtttcactatgttggccaggctggtctcgaactcctgacctcatgagccgcccgccttggcctcccaaagtgctgggacgtgacaggagtgagccaccacacctggccactcgcaagaccttttatctgaaaaccagccaagctttattcacgacacacttcttcccttcactctcccacttctgtggtcaactccctgcagaactcccaaactgccgttcttttcgatagctcacgatggtgtatgagtgtcaatcatctgacccttcttggagtctcatatttcgtggaactcctgtgcaaacatatattattaaattttttttcctcctgtc

SEQ ID NO: 2165 - DNA, 2665 bp, Homo sapiens
agggcagccacactgcacgcaggctgggccgactggggagctcataggccaggctctgacacccaggcagggcctagggtgggacgatggcaggtgggggcagcgacctgagcaccagggggctgaacggaggtgtttcacaagtagcaaatgagatgaaccatcttcctgcacacagccaaagtctgcaaaggctgttcacggaagaccaggatgtagatgagggacttgtctatgacactgtattcaagcacttcaaaagacataagctggagatatcaaatgcaataaaaaagacatttccattccttgagggcctccgcgatcgggaactcatcacaaataaaatgtttgaagattctgaagattcttgtagaaacctggtccctgtacaaagagtggtgtacaatgttctcagtgaactggagaagacatttaacctgtcagttttggaagcactgttcagcgaggtcaacatgcaggaataccccgatttaattcacatttataaaagcttcaaaaatgcaatccaagacaaattgtctttccaagaaagtgatcgaaaagaaagggaagagaggcctgacatcaaactaagtcttaaacaaggagaagtgccagaaagcccggaagcaaggaaggaaagtgaccaagcatgtggcaaaatggatactgtggatattgcaaacaactctactttgggaaaacccaagaggaaaagaagaaaaaagaaggggcatggctggagcagaatgggaacgagaacgcagaaaaacaaccaacaaaatgataacagcaaagccgatggccagctggtctcgagtgaaaagaaggcgaacatgaatctgaaagacctttccaagattagggggagaaagagaggcaaacctggaacccactttactcagagtgacagagctccacagaaaagagtccgatcaagagcttcaagaaagcacaaagatgaaactgtggattttcaggctcctttacttccagtgacctgtggtggggtgaagggaattttacataaggagaaattggaacaaggaaccttggcaaagtgtatacagactgaggatggaaaatggttcacccccatggaatttgaaatcaaaggaggctacgcaagatcaaagaactggaggctgagtgtgcgctgtggcgggtggcccctacgacggctgatggaggaaggatctctacctaatcctccaagaatatattacaggaacaaaaagagaatactgaagtctcaaaacaatagctcagttgacccttgtatgagaaacttggatgagtgtgaggtgtgccgggacggaggggagctgttctgttgcgacacttgttcaagagtcttccatgaggactgccacatcccacctgtggaaagtgagaagaccccgtggaattgcatcttctgcaggatgaaggagtctccgggaagccaacagtgttgtcaggaatctgaggtcctggagaggcagatgtgtcctgaggaacagttgaaatgtgagttcctcctcttgaaagtctattgctgttctgagagctccttttttgccaagattccatactattattatattagagaggcgtgtcaaggcctgaaggagcccatgtggttggataaaatcaagaaaaggctgaatgagcacggttacccccaagtggaggggtttgtacaagacatgcgcctcatcttccagaaccacagggcctcttacaagtataaggattttggccaaatgggacttagactggaggctgaatttgagaaggatttcaaggaagtgtttgctattcaggaaacaaatgggaacagttgactggtttagtggatgctgaaggccttcaggaaatatgctactggttgccactgacttcaaactgagagcacttgggaaatagcacatgcagggagaggcttttctctgagcctccctcatctgcccaaaaacaaatcctcaaaagaaatttgatcatcatgaatcccatccccaagaatctcatcaaccagggaagaggaactgagatcacagggaaggagattggaggtgataccagcacagacagactctcacctcttctcctgaggtctgctccagacaacatttattactcacaagacctttttcctccgttttttttttgagatggagtctcacacagtcacccgggattggaatgcaatggcgcgatctcagctcactgcaacctctgcctcccggattcaagtgattctcctgtctcagcctcccaagtagctgggattacagtgcctgccaccatgcccagctaattttttgcatttttagtagagacggggtttcactatgttggccaggctggtctcgaactcctgacctcatgagccgcccgccttggcctcccaaagtgctgggacgtgacaggagtgagccaccacacctggccactcgcaagaccttttatctgaaaaccagccaagctttattcacgacacacttcttcccttcactctcccacttctgtggtcaactccctgcagaactcccaaactgccgttcttttcgatagctcacgatggtgtatgagtgtcaatcatctgacccttcttggagtctcatatttcgtggaactcctgtgcaaacatatattattaaattttttttcctcctgtcaa

SEQ ID NO: 2166 - DNA, 1781 bp, Homo sapiens
agggcagccacactgcacgcaggctgggccgactggggagctcataggccaggctctgacacccaggcagggcctagggtgggacgatggcaggtgggggcagcgacctgagcaccagggggctgaacggaggtgtttcacaagtagcaaatgagatgaaccatcttcctgcacacagccaaagtctgcaaaggctgttcacggaagaccaggatgtagatgagggacttgtctatgacactgtattcaagcacttcaaaagacataagctggagatatcaaatgcaataaaaaagacatttccattccttgagggcctccgcgatcgggaactcatcacaaataaaatgtttgaagattctgaagattcttgtagaaacctggtccctgtacaaagagtggtgtacaatgttctcagtgaactggagaagacatttaacctgtcagttttggaagcactgttcagcgaggtcaacatgcaggaataccccgatttaattcacatttataaaagcttcaaaaatgcaatccaagacaaattgtctttccaagaaagtgatcgaaaagaaagggaagagaggcctgacatcaaactaagtcttaaacaaggagaagtgccagaaagcccggaagcaaggaaggaaagtgaccaagcatgtggcaaaatggatactgtggatattgcaaacaactctactttgggaaaacccaagaggaaaagaagaaaaaagaaggggcatggctggagcagaatgggaacgagaacgcagaaaaacaaccaacaaaatgataacagcaaagccgatggccagctggtctcgagtgaaaagaaggcgaacatgaatctgaaagacctttccaagattagggggagaaagagaggcaaacctggaacccactttactcagagtgacagagctccacagaaaagagtccgatcaagagcttcaagaaagcacaaagatgaaactgtggattttcaggctcctttacttccagtgacctgtggtggggtgaagggaattttacataaggagaaattggaacaaggaaccttggcaaagtgtatacagactgaggatggaaaatggttcacccccatggaatttgaaatcaaaggaggctacgcaagatcaaagaactggaggctgagtgtgcgctgtggcgggtggcccctacgacggctgatggaggaaggatctctacctaatcctccaagaatatattacaggaacaaaaagagaatactgaagtctcaaaacaatagctcagttgacccttgtatgagaaacttggatgagtgtgaggtgtgccgggacggaggggagctgttctgttgcgacacttgttcaagagtcttccatgaggactgccacatcccacctgtggaaagtgagaagtaagtgacatgcaggcacctctctttcatcctttaagggaccttccacctgccatgcgcactctccagcagaatgtctgcttgtgtctagatggggaaggagcaggttcatcgggtactgggacccagcagtgtgatccagagagcagtgggagacgctggcagcaggaggtaaatgctctctgtgctctcagggacacctcctctgatatgctgaggccagtgttggggacctttgcctacatactggtattgtcctttccttgaagttttgcagtagggtctcctgtcccagggggttgaggaaaaaaaacaccagttgtttatattttgtgcttattcatacaagacaggaagcacggtcttaggcggatggaggcct

SEQ ID NO: 2167 - DNA, 1727 bp, Homo sapiens
ggcgggcgcccctcccccagcgtcactgccgccttgcagtttgatctcagactgctgtgctagcaatcagtgagagtccgtgggcgtaggaccttccgagccaggctgttcacggaagaccaggatgtagatgagggacttgtctatgacactgtattcaagcacttcaaaagacataagctggagatatcaaatgcaataaaaaagacatttccattccttgagggcctccgcgatcgggaactcatcacaaataaaatgtttgaagattctgaagattcttgtagaaacctggtccctgtacaaagagtggtgtacaatgttctcagtgaactggagaagacatttaacctgtcagttttggaagcactgttcagcgaggtcaacatgcaggaataccccgatttaattcacatttataaaagcttcaaaaatgcaatccaagacaaattgtctttccaagaaagtgatcgaaaagaaagggaagagaggcctgacatcaaactaagtcttaaacaaggagaagtgccagaaagcccggaagcaaggaaggaaagtgaccaagcatgtggcaaaatggatactgtggatattgcaaacaactctactttgggaaaacccaagaggaaaagaagtaagaataaataagaatttacttgcttttgatgttacaaatacatttttaatgccagagttttctttttgtcattgttactgtttctgttattatttgcaatactgtggtagagagaatgatggccaccccaaaaaacgtccacctcctaatccctggacctgtaatctgctatcttacatggcaaacgggactttacagatacaattaatttagagaccttgaaatggggagatgatcctgggttatgtggtgggcccaatctaatcttgtaggctttaaagagtggagaacttttcctggctgtggagaaaggaaaatgtgactatggaagagtcatcagaaacatgtaatgttgcaggctttgaagatggaagagggaaccaaggaatgtggatgacctctagaagctgaaaaaacaaggaaatagtttgtcctttccagcccccagaaaggaatgaaggcctacaccttgactttaggcagtaagacccgtgtcacacttctcactgacataactggaagataatatatttgtgttgttttaaaccactaaatttgtggtaatttgttatggcagcaattaagagtaatacggattttagtacttggcagtggggtgtggctatcacatattcctgaaagtgttggggtgtctttgagattgcgcagtggaaagaggttggaagaattttaaatagagtgataggaaaatcctagatgaaaaaatggaaattaagtcaattaataaccctacaatggcctgtaagtgctcaagttaaagaaagagtcggccgggcgcggtggctcacgcctgtaatcctagcactttgggaggccgagacgggcggatcacgaggtcaggagatcgagaccatcttggctaacacggtgaaaccccgtttctactaaaaatacaaaaaattagccgggcgtgttggcgggcacctgtagtcccagctgcttgggaggctgaggcaggagaatggcatgaacctgggaggcggagcttgcagtgagccaggatcgcgccactgcactccaacctgggagacacagcgagactccgtctcaaaaaaaaaaaaaaaaaaaa

SEQ ID NO: 2168 - DNA, 908 bp, Homo sapiens
aatgttccaagcgcttattggtgaaggctgccgtcgctcgggcggtggcgggctccgggattggcggttgcttggcgggcggtgtcaggctctcggtggcggcggaggcggcggaggccagggaggaagatgtcgtaatgagcgatccacagaccagcatggctgccactgctgctgtgagtcccagtgactacctgcagcctgccgcctccaccacccaggactcccagccatctcccttagccctgcttgctgcaacatgtagcaaaattggccctccagcagttgaagctgctgtgacacctcctgctcccccacagcccacaccgcggaaacttgtccctatcaaacctgcccctctccctctcagccccggcaagaatagctttggaatcttgtcctccaaaggaaatatacttcagattcaggggtcacaactgagcgcctcctatcctggagggcagctggtgttcgctatccagaatcccaccatgatcaacaaagggacccgatcaaatgccaatatccagtaccaggcggtccctcagattcaggcaagcaattcccaaaccatccaagtacagcccaatctcaccaaccagatccagatcatccctggcaccaaccaagccatcatcaccccctcaccgtccagtcacaagcctgtccccatcaagccagcccccatccagaagtcgagtacgaccaccacccccgtgcagagcggggccaatgtggtgaagctgacaggtgggggcggcaatgtgacgctcactctgcccgtcaacaaccttgtgaacgccagtgacaccggggcccctactcagctcctcactgcttcctgccaaactgggatgctgaattcaacaagaatgttcttatttttggcatttattaatgtgctctaa

SEQ ID NO: 2169 - DNA, 3112 bp, Homo sapiens
aatgttccaagcgcttattggtgaaggctgccgtcgctcgggcggtggcgggctccgggattggcggttgcttggcgggcggtgtcaggctctcggtggcggcggaggcggcggaggccagggaggaagatgtcgtaatgagcgatccacagaccagcatggctgccactgctgctgtgagtcccagtgactacctgcagcctgccgcctccaccacccaggactcccagccatctcccttagccctgcttgctgcaacatgtagcaaaattggccctccagcagttgaagctgctgtgacacctcctgctcccccacagcccacaccgcggaaacttgtccctatcaaacctgcccctctccctctcagccccggcaagaatagctttggaatcttgtcctccaaaggaaatatacttcagattcaggggtcacaactgagcgcctcctatcctggagggcagctggtgttcgctatccagaatcccaccatgatcaacaaagggacccgatcaaatgccaatatccagtaccaggcggtccctcagattcaggcaagcaattcccaaaccatccaagtacagcccaatctcaccaaccagatccagatcatccctggcaccaaccaagccatcatcaccccctcaccgtccagtcacaagcctgtccccatcaagccagcccccatccagaagtcgagtacgaccaccacccccgtgcagagcggggccaatgtggtgaagctgacaggtgggggcggcaatgtgacgctcactctgcccgtcaacaaccttgtgaacgccagtgacaccggggcccctactcagctcctcactgaaagccccccaaccccgctgtctaagactaacaagaaagcaaggaagaagagccttcctgcctcccagccccctgtggctgtggctgagcaggtggagacggtgctgatcgagaccaccgcggacaacatcatccaggcaggaaataacctgctcattgttcagagccctggtgggggccagccagctgtggtccagcaggtccaggtggtgccccccaaggccgagcagcagcaggtggtacagatcccccagcaggctctgcgggtggtgcaggcggcatctgccaccctccccactgtaccccagaagccctcccagaactttcagatccaggcagctgagccgacacctactcaggtctacatccgcacgccttccggtgaggtgcagacagtccttgtccaggacagccccccagcaacagctgcagccacctctaacaccacctgtagcagccctgcatcccgtgctccccatctgagtgggaccagcaaaaagcactcagctgcaattctccgaaaagagcgtcccctgccaaagattgccccagccgggagcatcatcagcctgaatgcagcccagttggcggcagctgcccaggcaatgcagaccatcaacatcaatggtgtccaggtccagggcgtgcctgtcaccatcaccaacacaggcgggcagcagcagctgacagtgcagaatgtttctgggaacaacctgaccatcagtgggctgagccccacccagatccagctgcaaatggaacaagccctggccggagagacccagcccggggagaagcggcgccgcatggcctgcacgtgtcccaactgcaaggatggggagaagaggtctggagagcagggcaagaagaagcacgtgtgccacatccccgactgtggcaagacgttccgtaagacgtccttgctgcgtgcccatgtgcgcctgcacactggcgagcggccctttgtctgcaactggttcttctgtgggaagaggttcacacggagtgacgagctccaacggcatgctcgcacccacacaggggacaaacgcttcgagtgcgcccagtgtcagaagcgcttcatgaggagtgaccacctcaccaagcattacaagacccacctggtcacgaagaacttgtaaggccaactgcggcgggaggccctgaagatgcagtcccccacctgtgtcctccctgggcccctggtggaaaggagccctgtggctgccttgggcctgccctcagccccactcctgttctgcaactgtccccacaggaaggggctctgttccctgtattgtcctccttctgaagccccttggctctgccttggcccttcccctcaccacgagctcccggcctgcccagactgtggacactggccgtgcccaatgagacgttctaaaccaggacgcgtgggaacccttatttccaaaggaaaaacatgcatttcactccgtcgaggagcaaagtgagcccctaccccccaccccgatccccgctcccaacactgccggagtcgcgtcatgccatgccccctctcctgcacctccctggccctgccggccactgtggacgccctggggcttggcacccacctctggagaaactcggggccacctccactccatgtgcccagccccgccacaacctctcctccagcacattccagctctatttaaaaagtaaagacacccaccgactcctgatccccctctttttctatggagaacgttgccttatactctacttcagatgatgaacactgtgtactgtgtgtgctttaaagaagttttatttaattgctcccttcttcctttccttgttattcacctccctgatgcctgctttcagttgagggttgggggcaatgatgagcatatgaattttttctcactctagcaattcccttttctaaatgacacagcatttaaactcaaatctggattcagataacagcacctgcacatcctgcacctcctccctctcccttcacctcacccctgcccggcccaagctctacttgtgtacagtgtatattgtataatagacaattgtgtctactacatgtttaaaaacacattgcttgttatttttgaggcttttaaattaaacaaaaatccaactttatttttagttgtaactgcttgaggtatgttttatgaattaagtgacagatttgttatcctttattaacgtactttgttggtcagcactgggctgacaaaaattttttcttgctaataaatttagttgcctgaggcaaaatcttcaa

SEQ ID NO: 2170 - DNA, 2033 bp, Homo sapiens
gcgagcgagcggggcgcggcgaggggcaagggcggggagggccccggcgctcagagcaggcgccagggaggcaggctgggcggcccttcgtcctcgccttcgggtgtccatgcctcggcggcggcgtcccgctccgcagccaggggcctgcaagccgtagccatggccgcggtggccgtcctccggaacgactcgctgcaggcctttctccaggaccgcacccccagcgcctccccggacctgggcaagcactcgcccctggcattgctggccgccacctgtagccgcatcggccagccgggcgcggcggcgcccccggacttcctgcaggtgccctacgaccccgcgctgggctcaccctccaggctcttccacccgtggaccgccgacatgccggcgcactcgccaggcgcactgccgcccccgcatcccagcttggggctgacgccgcagaagacgcacctgcagccgtccttcggggctgcgcacgagcttccccttacaccccccgccgacccctcgtacccctacgagttctcgccggtcaagatgctgccctcgagcatggcggctctgcccgccagctgcgcgcccgcctacgtgccctacgcggcgcaggccgcgctgccgccaggctactccaacctgctgcctccgccgccgccaccgcccccgccgcccacctgccgccagttgtcacccaacccggcccccgacgacctcccgtggtggagcatcccgcaggcgggcgccgggccgggggcctccggggttccgggaagcggcctctccggcgcctgtgccggggccccccacgcgccccgcttccccgcctctgcggccgctgctgctgcggccgccgccgccctacaaagaggcctggtgttgggcccgtcggactttgcgcagtaccagagccagatcgccgcgctgctgcagaccaaggcccccctggcggccacggccaggaggtgccgccgctgccgctgtcccaactgccaggcggcgggcggcgcccccgaggcggagccggggaagaagaagcagcacgtgtgccacgtgccgggctgcggcaaggtgtacgggaagacgtcgcacctgaaggcgcacctgcgctggcacacgggcgagcgacccttcgtgtgcaactggctcttctgcgggaagagcttcacgcgctcggacgagctgcagcggcacctgcggactcacacgggcgagaagcgctttgcctgtcccgagtgcggcaagcgcttcatgcgcagcgaccacctcgcgaagcacgtcaagactcaccagaataagaagctcaaagtcgctgaggccggggttaagcgggaggacgcgcgggacctgtgagccctcccggaggtggacccccttcccagcacctctgcgagagatccggggacctgtgggcagctggcggaggggagactcagcagacggaccctctccgttgcctgcctcccaaaatggagccaggcttccaacttccgctgccttcggacatagggacccagttcccaggagcggggaggtagggttggggctggggcatttggattgtaattgggagctctgccgtacgccagggcggttccaaactctaaaccgttcccaccgtcagggagacctacagtttcgggggaccaccctggtctggccttgtatataggaaatgctgctgaactgaatagaaaggaacttgggagatttgaaacagtgctcgggttttcgctaggaccggtttgggctttgtacaggttatttaatagctttgttaaagataattataataattataacattaataaaaatgttgcttttgtcttcagctccatgcagagctacagcatgatatgtctctgtaaagtgatcagcagttgcagcgtgaaaataaatactttaactcaggggtcactacaggaagaccccgttgagccggtctcatttgatcttttcttcttctgggtggctgtactaagcggtcgggtttccccgggaatttgatggttcctatagtctgcctg

SEQ ID NO: 2171 - DNA, 3794 bp, Homo sapiens
gactcagatctcacctcctaccactcccctaggagagctgggggccactgtttcctggattatcctaaaagcttctgaggccgtgaggacttggcagcatccctgctccctccttcacctccccctttggcactgcctgtcacctcctttataaagcctggctcttttatcaccgccacttggccctcactgccgccgccagctctgggctccatggactggtcccgtctgaggtgcccctgaccgtccctgccctcaccccaccccggatcccggcaatgctaaccgctgtctgcggctctctgggcagccagcacacggaagcgccgcacgcctccccgccgcgcctcgacctgcagcctctccaaacttaccagggccacacgagccctgaggccggggactacccctccccgctgcagcctggagagctgcagagcctcccgctgggcccggaggtggacttctcgcagggctatgagctgccaggggcctcctcgcgggtaacctgcgaggacctggaaagcgacagtcccttggccccgggccccttttccaagctcctgcagccggacatgtcacaccattatgaatcgtggttcaggccgactcacccaggcgcggaggatggctcgtggtgggaccttcatccgggcaccagctggatggacctcccccacactcagggcgcgctgacctcacctggccacccgggggcgcttcaggcgggcttggggggctacgtcggagaccaccagctttgtgccccgccaccccacccgcatgcgcaccacctccttccagctgccggagggcagcatctcctagggccgcccgacggggctaaggccttggaagtagccgccccggagtctcaagggctggattccagcctggacggggcggcgcgtcccaaaggctcccggcggtcggtgccccgcagctcaggccagaccgtctgtcgctgccccaactgtctggaggcggagcgactgggggctccatgtgggcccgatgggggcaagaagaagcatttgcacaactgccacatcccgggctgcgggaaagcctacgccaagacgtcgcacctgaaggcgcacctgcgctggcacagcggcgaccgtcccttcgtgtgcaactggctcttctgcggcaagcgcttcacgcgctcggacgagctgcagcgccacctccagacccacaccggcaccaagaagttcccctgtgcagtctgcagccgcgtcttcatgcgcagcgaccacctggccaagcacatgaaaacccacgagggcgccaaggaggaggcggctggggcggcctcgggagagggcaaggccggcggcgcagtggagccccccgggggcaaaggcaaacgcgaggccgagggcagcgtggctccctccaactgagctcctcagtgccgcctccctgcgggtatcccggggggcactggatgcgagcccccaggtctgacgtccttgggggtggcttgaggaagaggggaaggtgcgtatttattcagggaggaggaaaagtggtgcagggacagggagatggggcgctaggggttcttagtctctggggctactaggcaggatgaatttgactgggtcggtaggagctgcgcaatgcccctctgttctcccctgcctcacagtttccctcgcccctgggctggggggttggggtgggacacccgtaccgcggctggctggcggggacaggctagaggagacagcaagtcccagtccccggagcagagagaagtggggccggcccggggcgctggtggtggctgtctggacacgtccttagcgcctgggaaccaggacataaaagcgcctccggagccgccctgcggcggggtccctttcatcccacttaaagtgcttctgcccctagggtttccggagggagagccgagatgggatgggggagcctgggggtcccccttggcaggggtgtctctttctggtttggagggttgttgctgtaaaaataactcctttgatgagcttccttattaaccctttcagacccagtctgttggagccatgaaggaagagggaaagagggctgccattcctgacagcctcccagccagggctggcgataaaggaccgagatagatggagggggcgagtagggaagtcctcttctaaaatgagagatagggatttggtggggtatggaaggaactaaccccttccctctccacctctgattcagcccttaattcttggtctatgataaataaagttcagtagtctcacattccccatctattaccctaggtgtgttttcaaggcagccagcggtagaatccatgtagttcccaccagttgccttcccctcagggatggaaggaagagggtttcttgggctggttgagggcagattgggggtgtctcatcagagggacctccactggttcccactcagagtggaggcctgcagcctacctgaccatctctttagctgtcaccaagaaaataaaccccactgtctctctagcttggcccttgtctttcccttgcccctgccatagcatgttcattaggggattccttcctccccctcatctcacaggggaagggagaggaaagagttgttctcccactggaaggggttctgccttctgaggtgacatccaggaagctgtccccattcccttctcctttagatgctagaaacacattttgattctgatcatggggtgggggagagaggaaaggagggaggggagaagcccagcagaagctgagccaggcagaggggaaagaagctgatatgaggaagggtctgacaggccacagcccttgcagccggagggctttcccacactcaagagaggggccttacagtccctctgacacccctcccccttcccctcgctccctttcttcacccggagccctctgcagagattagctgtgtattgatttttaagttataagcaaagggtattttatttaatattaggttatgtgtgtgcatgttgtgtgtacctgtgtgcatgtatgtgtgtttctctactgagcctggggtctctagccagggagaccccatcttattcaccatgtccaagatcctgggatctgggcccagcatctcttcctcctttgtagatgctggagcccagccaaggtctgggagctatatgggaagtgggggctgggatctgggtgggaatatgtgtttgtatacaaaggggccctccttaaaagggacaggatgaccttcccgaggaactcattggcctggggtagtttaagaagtaatgttctttctttctttctcttttccctacctcctgctaacccaaccagagatccccttccttgctgagagggttgggggcaggaggagatttggcagtgcctgcaggttgcctggccaggtggagagggggaaagaggaagggcaccgtgggtgtaagatgcctttctcctccacccatcgaaaccagccaccccttccctgtgccaccaagacagccttttccagtggccatcctaaggggaactcccaaatgggtgttgctggtggacacagatgctccccccaatggaagccccaagctctgaggtatgcgggtagaggctttggataggttttcttctgctcccctcttttatagatctaggctgcttggctgcctgtctttctaggcagtccccctagaggaaaaatgtaggaatttattttttctttaactgctgtgaactcactttgagggggtaggaggagggagaaacagcctgtgttttttatgcaataaagtcatcaactac

SEQ ID NO: 2172 - DNA, 3848 bp, Homo sapiens
aaaaagcagcgctggggagaggatgaaggcagagagcgcgggtgagtcacgggcggagctggccttgttcgctcgctggctcctgcccgccctccgtcctccgccctctcgccagcgctcacctccgccgcctgccgcctgccgccagccgccgggtctggctcgccctgggctcctgccccttaccgctggagagctcgccggcgcacagggcctatgagcgaccgtcagtagcgcaccagccagccgtgcccggagcccgccgcagcctcgaggtcccgtctgaggtgcccctgaccgtccctgccctcaccccaccccggatcccggcaatgctaaccgctgtctgcggctctctgggcagccagcacacggaagcgccgcacgcctccccgccgcgcctcgacctgcagcctctccaaacttaccagggccacacgagccctgaggccggggactacccctccccgctgcagcctggagagctgcagagcctcccgctgggcccggaggtggacttctcgcagggctatgagctgccaggggcctcctcgcgggtaacctgcgaggacctggaaagcgacagtcccttggccccgggccccttttccaagctcctgcagccggacatgtcacaccattatgaatcgtggttcaggccgactcacccaggcgcggaggatggctcgtggtgggaccttcatccgggcaccagctggatggacctcccccacactcagggcgcgctgacctcacctggccacccgggggcgcttcaggcgggcttggggggctacgtcggagaccaccagctttgtgccccgccaccccacccgcatgcgcaccacctccttccagctgccggagggcagcatctcctagggccgcccgacggggctaaggccttggaagtagccgccccggagtctcaagggctggattccagcctggacggggcggcgcgtcccaaaggctcccggcggtcggtgccccgcagctcaggccagaccgtctgtcgctgccccaactgtctggaggcggagcgactgggggctccatgtgggcccgatgggggcaagaagaagcatttgcacaactgccacatcccgggctgcgggaaagcctacgccaagacgtcgcacctgaaggcgcacctgcgctggcacagcggcgaccgtcccttcgtgtgcaactggctcttctgcggcaagcgcttcacgcgctcggacgagctgcagcgccacctccagacccacaccggcaccaagaagttcccctgtgcagtctgcagccgcgtcttcatgcgcagcgaccacctggccaagcacatgaaaacccacgagggcgccaaggaggaggcggctggggcggcctcgggagagggcaaggccggcggcgcagtggagccccccgggggcaaaggcaaacgcgaggccgagggcagcgtggctccctccaactgagctcctcagtgccgcctccctgcgggtatcccggggggcactggatgcgagcccccaggtctgacgtccttgggggtggcttgaggaagaggggaaggtgcgtatttattcagggaggaggaaaagtggtgcagggacagggagatggggcgctaggggttcttagtctctggggctactaggcaggatgaatttgactgggtcggtaggagctgcgcaatgcccctctgttctcccctgcctcacagtttccctcgcccctgggctggggggttggggtgggacacccgtaccgcggctggctggcggggacaggctagaggagacagcaagtcccagtccccggagcagagagaagtggggccggcccggggcgctggtggtggctgtctggacacgtccttagcgcctgggaaccaggacataaaagcgcctccggagccgccctgcggcggggtccctttcatcccacttaaagtgcttctgcccctagggtttccggagggagagccgagatgggatgggggagcctgggggtcccccttggcaggggtgtctctttctggtttggagggttgttgctgtaaaaataactcctttgatgagcttccttattaaccctttcagacccagtctgttggagccatgaaggaagagggaaagagggctgccattcctgacagcctcccagccagggctggcgataaaggaccgagatagatggagggggcgagtagggaagtcctcttctaaaatgagagatagggatttggtggggtatggaaggaactaaccccttccctctccacctctgattcagcccttaattcttggtctatgataaataaagttcagtagtctcacattccccatctattaccctaggtgtgttttcaaggcagccagcggtagaatccatgtagttcccaccagttgccttcccctcagggatggaaggaagagggtttcttgggctggttgagggcagattgggggtgtctcatcagagggacctccactggttcccactcagagtggaggcctgcagcctacctgaccatctctttagctgtcaccaagaaaataaaccccactgtctctctagcttggcccttgtctttcccttgcccctgccatagcatgttcattaggggattccttcctccccctcatctcacaggggaagggagaggaaagagttgttctcccactggaaggggttctgccttctgaggtgacatccaggaagctgtccccattcccttctcctttagatgctagaaacacattttgattctgatcatggggtgggggagagaggaaaggagggaggggagaagcccagcagaagctgagccaggcagaggggaaagaagctgatatgaggaagggtctgacaggccacagcccttgcagccggagggctttcccacactcaagagaggggccttacagtccctctgacacccctcccccttcccctcgctccctttcttcacccggagccctctgcagagattagctgtgtattgatttttaagttataagcaaagggtattttatttaatattaggttatgtgtgtgcatgttgtgtgtacctgtgtgcatgtatgtgtgtttctctactgagcctggggtctctagccagggagaccccatcttattcaccatgtccaagatcctgggatctgggcccagcatctcttcctcctttgtagatgctggagcccagccaaggtctgggagctatatgggaagtgggggctgggatctgggtgggaatatgtgtttgtatacaaaggggccctccttaaaagggacaggatgaccttcccgaggaactcattggcctggggtagtttaagaagtaatgttctttctttctttctcttttccctacctcctgctaacccaaccagagatccccttccttgctgagagggttgggggcaggaggagatttggcagtgcctgcaggttgcctggccaggtggagagggggaaagaggaagggcaccgtgggtgtaagatgcctttctcctccacccatcgaaaccagccaccccttccctgtgccaccaagacagccttttccagtggccatcctaaggggaactcccaaatgggtgttgctggtggacacagatgctccccccaatggaagccccaagctctgaggtatgcgggtagaggctttggataggttttcttctgctcccctcttttatagatctaggctgcttggctgcctgtctttctaggcagtccccctagaggaaaaatgtaggaatttattttttctttaactgctgtgaactcactttgagggggtaggaggagggagaaacagcctgtgttttttatgcaataaagtcatcaactac

SEQ ID NO: 2173 - DNA, 2554 bp, Homo sapiens
cttaggctgagtttagccggcgggagcctggagtccgctcggcacgagcgcggggacgcgggagccgcgcgggacccaagcagtttttccgagcagccgccaggctcagccccgctcccagcctcgctgcgcagccagagacctgctatggccacgtctatactcggggaagagccgcgcttcggaacgaccccgttggccatgctggcggcgacctgcaacaagatcggcaacacgagcccgctgacgacgctgccagagtcgagcgccttcgccaaaggcggctttcacccctggaagcgctcctcgtccagctgcaacctcggctccagcctctcgggcttcgcggtggccaccgggggccgtggctcgggcggcctggcgggcggctcgggcgccgccaacagcgccttctgcctggcctccacgtcgcccacgtcgtccgccttcagcagcgactacggcggcctcttctccaactcggcggctgccgcggcggcagcggccggggtgtccccgcaggaggcgggtggccagtcggccttcatttccaaggtgcacacgacggcagccgacgggctgtacccgcgcgtgggcatggcgcacccgtacgagtcctggtacaagtcgggcttccattcgacgctggcggccggcgaggtgaccaacggcgcggcgtcgtcgtggtgggacgtgcacagcagcccgggctcgtggctggaagtgcagaaccccgctggggggctccagagctcgctgcactcgggcgccccccaggcctcgctgcactcgcagctgggcacctacaaccccgacttcagctcgctcacgcactccgccttcagctccacgggcctcggctcctccgccgccgccgcctcccacctgctctccaccagccagcacctgctggcccaggacggcttcaagccggtgttgccctcctattcggactccagcgccgccgtggcagccgccgccgccagcgccatgatatcgggcgccgcggctgccgccgccggggggagctcggcacgctctgcccgccgctactcgggccgcgccacctgcgactgccccaactgccaggaggcggagcggctgggcccggccggggcgagcctgcggcgcaagggcctgcacagctgccacattccgggctgcggcaaggtgtacgggaagacgtcgcacctgaaggcgcacctgcgctggcacacgggcgagcggcccttcgtgtgcaactggctcttctgcggcaagcgcttcacgcgctcggacgagctgcagcggcatctgcggactcacacgggcgagaagcgcttcgcctgtccggtgtgcaacaagcgcttcatgcgcagcgaccacctgagcaaacacattaagacgcacaacgggggcggcgggggcaaaaagggcagcgacagtgacacggacgccagcaacctggagacgccccgttccgaatcccccgacctcatcctgcatgactccggcgtcagtgccgcccgggcggcggcagcggcggcggcggcagcggcggcggcggcggcggcggcctccgcgggaggcaaggaagcagcgtctggccccaacgactcttagaggccgggcgagaggcgcgagcacacaagcgagtagagacaccgagaacgaacgagaggttcggagggcgagcgagcgggaggcgggagggcaggggcttcagtgacgcccccagggcccgggctgggcgcgaggtggagccgctcagggctcccgggctgcggttcgcccgctgtgcgaggagctcccctctgccttccgcgcccggataagaatcgaacgcgtggtccggaaacaaaagcgaaccatcctccgacacaaacactttaaaaactgtactcccagacgtacacatacaccggagacctacaaccacaagcacgcacactcgcgcgcgcacacacataccactcgcccaaacttctcgagcgaagagcaatacatagaaaggctccctctttgcccactctccacctccctccaacacccgtctctttccttttctcaaaaacaagccaccacccagcaaaggactgtcagaacatttgaaaacaaacgggaccgataaaaacaccctttgtttggattatattatatataaaatgctccaagtcctgcctgatatctacttacaatgagacttttttcctaaaaaaggaagcatcaaaaggcttaaggtgagaaattaaactggaagtctagcgacagtttctctgtatttcataacatctgtataaatagggttcaaaagattgtgttctcttttattttcttgtaaatgttcattcgaatagagtttttttgggtgaatccctgaaattcagggagttttttttaattttctgatgcactttgtgaaagtcagtatatatgtaaaagatatttaaaatgttgagttatcatttcactcacaaacacgtaagttaaggtcatctaaagaaattaaatgcgtttatctgtatcaagaaaatcttgacatcatattttcattttggtattattaaaggactct

SEQ ID NO: 2174 - DNA, 2965 bp, Homo sapiens
ggggaggaggccgcgcggggtggggtctggcggtacgcgctggctgcgtcgacgtgctgacgccatgacgccccggctggtgtgtgtcggtgtgtatgtgtgtgtgtgagtgtgcgcgctccgagtgtgtgtgtatttgtgtatcggcggtcccgcaggtcccggatgttgcggacagtatgaggcaagcgcagggggacggggaccagcagctgtcgccgccgctctcagagatttcctgttagacaagacaaattagagttttcctactgacttaacttgggtgaagagggaacagaaatctttgccccctgactttggaaatctcgtttaaccttcaaactggcgatgtcaagggttccaagtcctccacctccggcagaaatgtcgagtggccccgtagctgagagttggtgctacacacagatcaaggtagtgaaattctcctacatgtggaccatcaataactttagcttttgccgggaggaaatgggtgaagtcattaaaagttctacattttcatcaggagcaaatgataaactgaaatggtgtttgcgagtaaaccccaaagggttagatgaagaaagcaaagattacctgtcactttacctgttactggtcagctgtccaaagagtgaagttcgggcaaaattcaaattctccatcctgaatgccaagggagaagaaaccaaagctatggagagtcaacgggcatataggtttgtgcaaggcaaagactggggattcaagaaattcatccgtagagattttcttttggatgaggccaacgggcttctccctgatgacaagcttaccctcttctgcgaggtgagtgttgtgcaagattctgtcaacatttctggccagaataccatgaacatggtaaaggttcctgagtgccggctggcagatgagttaggaggactgtgggagaattcccggttcacagactgctgcttgtgtgttgccggccaggaattccaggctcacaaggctatcttagcagctcgttctccggtttttagtgccatgtttgaacatgaaatggaggagagcaaaaagaatcgagttgaaatcaatgatgtggagcctgaagtttttaaggaaatgatgtgcttcatttacacggggaaggctccaaacctcgacaaaatggctgatgatttgctggcagctgctgacaagtatgccctggagcgcttaaaggtcatgtgtgaggatgccctctgcagtaacctgtccgtggagaacgctgcagaaattctcatcctggccgacctccacagtgcagatcagttgaaaactcaggcagtggatttcatcaactatcatgcttcggatgtcttggagacctctgggtggaagtcaatggtggtgtcacatccccacttggtggctgaggcataccgctctctggcttcagcacagtgcccttttctgggacccccacgcaaacgcctgaagcaatcctaagatcctgcttgttgtaagactccgtttaatttccagaagcagcagccactgttgctgccactgaccaccaggtagacagcgcaatctgtggagcttttactctgttgtgaggggaagagactgcattgtggccccagacttttaaaacagcactaaataacttgggggaaacggggggagggaaaatgaaatgaaaaccctgttgctgcgtcactgtgttccctttggcctggctgagtttgatactgtggggattcagtttaggcgctggcccgaggatatcccagcggtggtacttcggagacacctgtctgcatctgactgagcagaacaaatcgtcaggtgcctggagcaaaaaggaaaaaaaaaaaagaaaggacattgagttttaacagaagggaaaaggaaagaagaaaagatttttgcagaatttctcaaaaatcagtttgtggattccagtagtatttatattgagagaaacaaattttagtccttctaactgtgctaaaacttggatatttgtgaaaactccttaccaccatacaagcatcagaagagctctcttgttgttagcacttattgtttgcaagaacagaatacatccttttatccttttatgaaaaatgacaagtgaaggcaaaaggggaaggttatttgatctggaagatgagtgttctgatgtggtggcttttgcaaaaatctttattggtgttgaaaactggaaaaaataactcatccagaattcatattgtcttgacaagaactatggttctctgtttttagatattgtggaaaatgtttttgggcatttttctctgattttatttcttctcccccacccctttttctaaaaaacaaacaaaaaaaaaaacacacaaaacaaaaacagaacaaaagaagagagaaggaaattttatcaattaaaaatgctgtgtgataaaatcccagcccagattgctcagctgtttgtacctgacttgccgcctgcataggagccagttctgttccttctgactagcccctcttcctccaggggagaacttccaaatgttaatttttttttttttgaaaatataaataattactattttgtactgtgtggtatctctggtcttttgtttcactcacctgccttgtctcttgggtctgagtcccttgcttaagggattttgaagtcctagttttcagcttgcagagattatgtctgaaatgcctaatgagtcgcagggatttgttgagactccgtaatctcaagttctctttgtgagctatcagcatctgccagtctcttgtcctccctgagtatctcacagtccatatcctgatgagggatcaggcccctacctctgccaaggcaagtaatggtagtgggcttttaaactgccccccgtatgttttaagacctaatccccacctcccttcttctaactaaatataaaaagatccaggggacataaatgtggagattaaataaagggaaattattgtctct

SEQ ID NO: 2175 - DNA, 2985 bp, Homo sapiens
gtgctgacgccatgacgccccggctggtgtgtgtcggtgtgtatgtgtgtgtgtgagtgtgcgcgctccgagtgtgtgtgtatttgtgtatcggcggtcccgcaggtcccggatgttgcggacagtatgaggcaagcgcagggggacggggaccagcagctgtcgccgccgctctcagatcgagtcttgctctgtcacccaggctggagtgcagtggcgcgatctcagctcactgccacctttgcctcctgggttcaagcgattcttctgcctcagcctcccgagtagctgggattacagggtgaagagggaacagaaatctttgccccctgactttggaaatctcgtttaaccttcaaactggcgatgtcaagggttccaagtcctccacctccggcagaaatgtcgagtggccccgtagctgagagttggtgctacacacagatcaaggtagtgaaattctcctacatgtggaccatcaataactttagcttttgccgggaggaaatgggtgaagtcattaaaagttctacattttcatcaggagcaaatgataaactgaaatggtgtttgcgagtaaaccccaaagggttagatgaagaaagcaaagattacctgtcactttacctgttactggtcagctgtccaaagagtgaagttcgggcaaaattcaaattctccatcctgaatgccaagggagaagaaaccaaagctatggagagtcaacgggcatataggtttgtgcaaggcaaagactggggattcaagaaattcatccgtagagattttcttttggatgaggccaacgggcttctccctgatgacaagcttaccctcttctgcgaggtgagtgttgtgcaagattctgtcaacatttctggccagaataccatgaacatggtaaaggttcctgagtgccggctggcagatgagttaggaggactgtgggagaattcccggttcacagactgctgcttgtgtgttgccggccaggaattccaggctcacaaggctatcttagcagctcgttctccggtttttagtgccatgtttgaacatgaaatggaggagagcaaaaagaatcgagttgaaatcaatgatgtggagcctgaagtttttaaggaaatgatgtgcttcatttacacggggaaggctccaaacctcgacaaaatggctgatgatttgctggcagctgctgacaagtatgccctggagcgcttaaaggtcatgtgtgaggatgccctctgcagtaacctgtccgtggagaacgctgcagaaattctcatcctggccgacctccacagtgcagatcagttgaaaactcaggcagtggatttcatcaactatcatgcttcggatgtcttggagacctctgggtggaagtcaatggtggtgtcacatccccacttggtggctgaggcataccgctctctggcttcagcacagtgcccttttctgggacccccacgcaaacgcctgaagcaatcctaagatcctgcttgttgtaagactccgtttaatttccagaagcagcagccactgttgctgccactgaccaccaggtagacagcgcaatctgtggagcttttactctgttgtgaggggaagagactgcattgtggccccagacttttaaaacagcactaaataacttgggggaaacggggggagggaaaatgaaatgaaaaccctgttgctgcgtcactgtgttccctttggcctggctgagtttgatactgtggggattcagtttaggcgctggcccgaggatatcccagcggtggtacttcggagacacctgtctgcatctgactgagcagaacaaatcgtcaggtgcctggagcaaaaaggaaaaaaaaaaaagaaaggacattgagttttaacagaagggaaaaggaaagaagaaaagatttttgcagaatttctcaaaaatcagtttgtggattccagtagtatttatattgagagaaacaaattttagtccttctaactgtgctaaaacttggatatttgtgaaaactccttaccaccatacaagcatcagaagagctctcttgttgttagcacttattgtttgcaagaacagaatacatccttttatccttttatgaaaaatgacaagtgaaggcaaaaggggaaggttatttgatctggaagatgagtgttctgatgtggtggcttttgcaaaaatctttattggtgttgaaaactggaaaaaataactcatccagaattcatattgtcttgacaagaactatggttctctgtttttagatattgtggaaaatgtttttgggcatttttctctgattttatttcttctcccccacccctttttctaaaaaacaaacaaaaaaaaaaacacacaaaacaaaaacagaacaaaagaagagagaaggaaattttatcaattaaaaatgctgtgtgataaaatcccagcccagattgctcagctgtttgtacctgacttgccgcctgcataggagccagttctgttccttctgactagcccctcttcctccaggggagaacttccaaatgttaatttttttttttttgaaaatataaataattactattttgtactgtgtggtatctctggtcttttgtttcactcacctgccttgtctcttgggtctgagtcccttgcttaagggattttgaagtcctagttttcagcttgcagagattatgtctgaaatgcctaatgagtcgcagggatttgttgagactccgtaatctcaagttctctttgtgagctatcagcatctgccagtctcttgtcctccctgagtatctcacagtccatatcctgatgagggatcaggcccctacctctgccaaggcaagtaatggtagtgggcttttaaactgccccccgtatgttttaagacctaatccccacctcccttcttctaactaaatataaaaagatccaggggacataaatgtggagattaaataaagggaaattattgtctctaa

SEQ ID NO: 2176 - DNA, 3088 bp, Homo sapiens
ggggaggaggccgcgcggggtggggtctggcggtacgcgctggctgcgtcgacgtgctgacgccatgacgccccggctggtgtgtgtcggtgtgtatgtgtgtgtgtgagtgtgcgcgctccgagtgtgtgtgtatttgtgtatcggcggtcccgcaggtcccggatgttgcggacagtatgaggcaagcgcagggggacggggaccagcagctgtcgccgccgctctcagatcgagtcttgctctgtcacccaggctggagtgcagtggcgcgatctcagctcactgccacctttgcctcctgggttcaagcgattcttctgcctcagcctcccgagtagctgggattacaggctctgggaaccacccttctactttctgtctctaggaatttcactactctagggtgaagagggaacagaaatctttgccccctgactttggaaatctcgtttaaccttcaaactggcgatgtcaagggttccaagtcctccacctccggcagaaatgtcgagtggccccgtagctgagagttggtgctacacacagatcaaggtagtgaaattctcctacatgtggaccatcaataactttagcttttgccgggaggaaatgggtgaagtcattaaaagttctacattttcatcaggagcaaatgataaactgaaatggtgtttgcgagtaaaccccaaagggttagatgaagaaagcaaagattacctgtcactttacctgttactggtcagctgtccaaagagtgaagttcgggcaaaattcaaattctccatcctgaatgccaagggagaagaaaccaaagctatggagagtcaacgggcatataggtttgtgcaaggcaaagactggggattcaagaaattcatccgtagagattttcttttggatgaggccaacgggcttctccctgatgacaagcttaccctcttctgcgaggtgagtgttgtgcaagattctgtcaacatttctggccagaataccatgaacatggtaaaggttcctgagtgccggctggcagatgagttaggaggactgtgggagaattcccggttcacagactgctgcttgtgtgttgccggccaggaattccaggctcacaaggctatcttagcagctcgttctccggtttttagtgccatgtttgaacatgaaatggaggagagcaaaaagaatcgagttgaaatcaatgatgtggagcctgaagtttttaaggaaatgatgtgcttcatttacacggggaaggctccaaacctcgacaaaatggctgatgatttgctggcagctgctgacaagtatgccctggagcgcttaaaggtcatgtgtgaggatgccctctgcagtaacctgtccgtggagaacgctgcagaaattctcatcctggccgacctccacagtgcagatcagttgaaaactcaggcagtggatttcatcaactatcatgcttcggatgtcttggagacctctgggtggaagtcaatggtggtgtcacatccccacttggtggctgaggcataccgctctctggcttcagcacagtgcccttttctgggacccccacgcaaacgcctgaagcaatcctaagatcctgcttgttgtaagactccgtttaatttccagaagcagcagccactgttgctgccactgaccaccaggtagacagcgcaatctgtggagcttttactctgttgtgaggggaagagactgcattgtggccccagacttttaaaacagcactaaataacttgggggaaacggggggagggaaaatgaaatgaaaaccctgttgctgcgtcactgtgttccctttggcctggctgagtttgatactgtggggattcagtttaggcgctggcccgaggatatcccagcggtggtacttcggagacacctgtctgcatctgactgagcagaacaaatcgtcaggtgcctggagcaaaaaggaaaaaaaaaaaagaaaggacattgagttttaacagaagggaaaaggaaagaagaaaagatttttgcagaatttctcaaaaatcagtttgtggattccagtagtatttatattgagagaaacaaattttagtccttctaactgtgctaaaacttggatatttgtgaaaactccttaccaccatacaagcatcagaagagctctcttgttgttagcacttattgtttgcaagaacagaatacatccttttatccttttatgaaaaatgacaagtgaaggcaaaaggggaaggttatttgatctggaagatgagtgttctgatgtggtggcttttgcaaaaatctttattggtgttgaaaactggaaaaaataactcatccagaattcatattgtcttgacaagaactatggttctctgtttttagatattgtggaaaatgtttttgggcatttttctctgattttatttcttctcccccacccctttttctaaaaaacaaacaaaaaaaaaaacacacaaaacaaaaacagaacaaaagaagagagaaggaaattttatcaattaaaaatgctgtgtgataaaatcccagcccagattgctcagctgtttgtacctgacttgccgcctgcataggagccagttctgttccttctgactagcccctcttcctccaggggagaacttccaaatgttaatttttttttttttgaaaatataaataattactattttgtactgtgtggtatctctggtcttttgtttcactcacctgccttgtctcttgggtctgagtcccttgcttaagggattttgaagtcctagttttcagcttgcagagattatgtctgaaatgcctaatgagtcgcagggatttgttgagactccgtaatctcaagttctctttgtgagctatcagcatctgccagtctcttgtcctccctgagtatctcacagtccatatcctgatgagggatcaggcccctacctctgccaaggcaagtaatggtagtgggcttttaaactgccccccgtatgttttaagacctaatccccacctcccttcttctaactaaatataaaaagatccaggggacataaatgtggagattaaataaagggaaattattgtctct

SEQ ID NO: 2177 - DNA, 450 bp, Homo sapiens
gctccgagtgtgtgtgtatttgtgtatcggcggtcccgcaggtcccggatgttgcggacagtatgaggcaagcgcagggggacggggaccagcagctgtcgccgccgctctcagatcgagtcttgctctgtcacccaggctggagtgcagtggcgcgatctcagctcactgccacctttgcctcctgggttcaagcgattcttctgcctcagcctcccgagtagctgggattacaggctctgggaaccacccttctactttctgtctctaggaatttcactactctagggtgaagagggaacagaaatctttgccccctgactttggaaatctcgtttaaccttcaaactggcgatgtcaagggttccaagtcctccacctccggcagaaatgtcgagtggccccgtagctgagagttggtgctacacacagatcaaggtagtgaaattc

SEQ ID NO: 2178 - DNA, 1397 bp, Homo sapiens
gtgtatcggcggtcccgcaggtcccggatgttgcggacagtatgaggcaagcgcagggggacggggaccagcagctgtcgccgccgctctcagggtgaagagggaacagaaatctttgccccctgactttggaaatctcgtttaaccttcaaactggcgatgtcaagggttccaagtcctccacctccggcagaaatgtcgagtggccccgtagctgagagttggtgctacacacagacaggtgtttgcgagtaaaccccaaagggttagatgaagaaagcaaagattacctgtcactttacctgttactggtcagctgtccaaagagtgaagttcgggcaaaattcaaattctccatcctgaatgccaagggagaagaaaccaaagctatggagagtcaacgggcatataggtttgtgcaaggcaaagactggggattcaagaaattcatccgtagagattttcttttggatgaggccaacgggcttctccctgatgacaagcttaccctcttctgcgaggtgagtgttgtgcaagattctgtcaacatttctggccagaataccatgaacatggtaaaggttcctgagtgccggctggcagatgagttaggaggactgtgggagaattcccggttcacagactgctgcttgtgtgttgccggccaggaattccaggctcacaaggctatcttagcagctcgttctccggtttttagtgccatgtttgaacatgaaatggaggagagcaaaaagaatcgagttgaaatcaatgatgtggagcctgaagtttttaaggaaatgatgtgcttcatttacacggggaaggctccaaacctcgacaaaatggctgatgatttgctggcagctgctgacaagtatgccctggagcgcttaaaggtcatgtgtgaggatgccctctgcagtaacctgtccgtggagaacgctgcagaaattctcatcctggccgacctccacagtgcagatcagttgaaaactcaggcagtggatttcatcaactatcatgcttcggatgtcttggagacctctgggtggaagtcaatggtggtgtcacatccccacttggtggctgaggcataccgctctctggcttcagcacagtgcccttttctgggacccccacgcaaacgcctgaagcaatcctaagatcctgcttgttgtaagactccgtttaatttccagaagcagcagccactgttgctgccactgaccaccaggtagacagcgcaatctgtggagcttttactctgttgtgaggggaagagactgcattgtggccccagacttttaaaacagcactaaataacttgggggaaacggggggagggaaaatgaaatgaaaaccctgttgctgcgtcactgtgttccctttggcct

SEQ ID NO: 2179 - DNA, 1932 bp, Homo sapiens
atatagcttaaagcatttaactggaaaggaccttggaaatccttttaaaggaggatgggggtggaaatgcacaggttgcttctctctctctctctctttttttttttttttgagacggtcacccaggctgtagtgcagtggcgtgatctcggctcactgtggcctccacctcccaagtagctgggattacaggcttgcgccatcatgcagggctaatttttgtatttttagtagagacgaggtttcatcatgttggccaggctggtctggaactcctgacctcaagtgatctgcccaccttggcctcccaaagtgctgggattaaaggcatgagccaccacgcctggcctaggttgttcctctactgtgaatcttgaggttatggtttccactagactatagtgctcaactatagtggcctattttaagtggccttataattcctaaccaaagtgacttgtgaaacagaggaccctggataaatttaaatgttataaagatgataaaatgtacagagatttcctgttagacaagacaaattagagttttcctactgacttaacttgggtgaagagggaacagaaatctttgccccctgactttggaaatctcgtttaaccttcaaactggcgatgtcaagggttccaagtcctccacctccggcagaaatgtcgagtggccccgtagctgagagttggtgctacacacagatcaaggtagtgaaattctcctacatgtggaccatcaataactttagcttttgccgggaggaaatgggtgaagtcattaaaagttctacattttcatcaggagcaaatgataaactgaaatggtgtttgcgagtaaaccccaaagggttagatgaagaaagcaaagattacctgtcactttacctgttactggtcagctgtccaaagagtgaagttcgggcaaaattcaaattctccatcctgaatgccaagggagaagaaaccaaagctatggagagtcaacgggcatataggtttgtgcaaggcaaagactggggattcaagaaattcatccgtagagattttcttttggatgaggccaacgggcttctccctgatgacaagcttaccctcttctgcgaggtgagtgttgtgcaagattctgtcaacatttctggccagaataccatgaacatggtaaaggttcctgagtgccggctggcagatgagttaggaggactgtgggagaattcccggttcacagactgctgcttgtgtgttgccggccaggaattccaggctcacaaggctatcttagcagctcgttctccggtttttagtgccatgtttgaacatgaaatggaggagagcaaaaagaatcgagttgaaatcaatgatgtggagcctgaagtttttaaggaaatgatgtgcttcatttacacggggaaggctccaaacctcgacaaaatggctgatgatttgctggcagctgctgacaagtatgccctggagcgcttaaaggtcatgtgtgaggatgccctctgcagtaacctgtccgtggagaacgctgcagaaattctcatcctggccgacctccacagtgcagatcagttgaaaactcaggcagtggatttcatcaactatcatgcttcggatgtcttggagacctctgggtggaagtcaatggtggtgtcacatccccacttggtggctgaggcataccgctctctggcttcagcacagtgcccttttctgggacccccacgcaaacgcctgaagcaatcctaagatcctgcttgttgtaagactccgtttaatttccagaagcagcagccactgttgctgccactgaccaccaggtagacagcgcaatctgtggagcttttactctgttgtgaggggaagagactgcattgtggccccagacttttaaaacagcactaaataacttgggggaaacggg

SEQ ID NO: 2180 - DNA, 1865 bp, Homo sapiens
aagataggcggagtcttgagggaggaggagcagggaaacccagggaggggaggggaggagaagggagtaatggggaggaggccgcgcggggtggggtctggcggtacgcgctggctgcgtcgacgtgctgacgccatgacgccccggctggtgtgtgtcggtgtgtatgtgtgtgtgtgagtgtgcgcgctccgagtgtgtgtgtatttgtgtatcggcggtcccgcaggtcccggatgttgcggacagtatgaggcaagcgcagggggacggggaccagcagctgtcgccgccgctctcagggtgaagagggaacagaaatctttgccccctgactttggaaatctcgtttaaccttcaaactggcgatgtcaagggttccaagtcctccacctccggcagaaatgtcgagtggccccgtagctgagagttggtgctacacacagatcaaggtagtgaaattctcctacatgtggaccatcaataactttagcttttgccgggaggaaatgggtgaagtcattaaaagttctacattttcatcaggagcaaatgataaactgaaatggtgtttgcgagtaaaccccaaagggttagatgaagaaagcaaagattacctgtcactttacctgttactggtcagctgtccaaagagtgaagttcgggcaaaattcaaattctccatcctgaatgccaagggagaagaaaccaaagctatggagagtcaacgggcatataggtttgtgcaaggcaaagactggggattcaagaaattcatccgtagagattttcttttggatgaggccaacgggcttctccctgatgacaagcttaccctcttctgcgaggtgagtgttgtgcaagattctgtcaacatttctggccagaataccatgaacatggtaaaggttcctgagtgccggctggcagatgagttaggaggactgtgggagaattcccggttcacagactgctgcttgtgtgttgccggccaggaattccaggctcacaaggctatcttagcagctcgttctccggtttttagtgccatgtttgaacatgaaatggaggagagcaaaaagaatcgagttgaaatcaatgatgtggagcctgaagtttttaaggaaatgatgtgcttcatttacacggggaaggctccaaacctcgacaaaatggctgatgatttgctggcagctgctgacaagtatgccctggagcgcttaaaggtcatgtgtgaggatgccctctgcagtaacctgtccgtggagaacgctgcagaaattctcatcctggccgacctccacagtgcagatcagttgaaaactcaggcagtggatttcatcaactatcatgcttcggatgtcttggagacctctgggtggaagtcaatggtggtgtcacatccccacttggtggctgaggcataccgctctctggcttcagcacagtgcccttttctgggacccccacgcaaacgcctgaagcaatcctaagatcctgcttgttgtaagactccgtttaatttccagaagcagcagccactgttgctgccactgaccaccaggtagacagcgcaatctgtggagcttttactctgttgtgaggggaagagactgcattgtggccccagacttttaaaacagcactaaataacttgggggaaacggggggagggaaaatgaaatgaaaaccctgttgctgcgtcactgtgttccctttggcctggctgagtttgatactgtggggattcagtttaggcgctggcccgaggatatcccagcggtggtacttcggagacacctgtctgcatctgactgagcagaacaaatcgtcaggtgcctggagcaaaaaggaaaaaaaaaaaa

SEQ ID NO: 2181 - DNA, 984 bp, Homo sapiens
ggtgtgtgtcggtgtgtatgtgtgtgtgtgagtgtgcgcgctccgagtgtgtgtgtatttgtgtatcggcggtcccgcaggtcccggatgttgcggacagtatgaggcaagcgcagggggacggggaccagcagctgtcgccgccgctctcagagatttcctgttagacaagacaaattagagttttcctactgacttaacttgggtgaagagggaacagaaatctttgccccctgactttggaaatctcgtttaaccttcaaactggcgatgtcaagggttccaagtcctccacctccggcagaaatgtcgagtggccccgtagctgagagttggtgctacacacagatcaaggtagtgaaattctcctacatgtggaccatcaataactttagcttttgccgggaggaaatgggtgaagtcattaaaagttctacattttcatcaggagcaaatgataaactgaaatggtgtttgcgagtaaaccccaaagggttagatgaagaaagcaaagattacctgtcactttacctgttactggtcagctgtccaaagagtgaagttcgggcaaaattcaaattctccatcctgaatgccaagggagaagaaaccaaagctatggagagtcaacgggcatataggtttgtgcaaggcaaagactggggattcaagaaattcatccgtagagattttcttttggatgaggccaacgggcttctccctgatgacaagcttaccctcttctgcgaggtgagtgttgtgcaagattctgtcaacatttctggccagaataccatgaacatggtaaaggttcctgagtgccggctggcagatgagttaggaggactgtgggagaattcccggttcacagactgctgcttgtgtgttgccggccaggaattccaggctcacaaggctatcttagcagctcgttctccggtttttagtgccatgtttgaacatgaaatggaggagagcaaaaag

SEQ ID NO: 2182 - DNA, 919 bp, Homo sapiens
agtgtgcgcgctccgagtgtgtgtgtatttgtgtatcggcggtcccgcaggtcccggatgttgcggacagtatgaggcaagcgcagggggacggggaccagcagctgtcgccgccgctctcagatcgagtcttgctctgtcacccaggctggagtgcagtggcgcgatctcagctcactgccacctttgcctcctgggttcaagcgattcttctgcctcagcctcccgagtagctgggattacagagatttcctgttagacaagacaaattagagttttcctactgacttaacttgggtgaagagggaacagaaatctttgccccctgactttggaaatctcgtttaaccttcaaactggcgatgtcaagggttccaagtcctccacctccggcagaaatgtcgagtggccccgtagctgagagttggtgctacacacagatcaaggtagtgaaattctcctacatgtggaccatcaataactttagcttttgccgggaggaaatgggtgaagtcattaaaagttctacattttcatcaggagcaaatgataaactgaaatggtgtttgcgagtaaaccccaaagggttagatgaagaaagcaaagattacctgtcactttacctgttactggtcagctgtccaaagagtgaagttcgggcaaaattcaaattctccatcctgaatgccaagggagaagaaaccaaagctatggagagtcaacgggcatataggtttgtgcaaggcaaagactggggattcaagaaattcatccgtagagattttcttttggatgaggccaacgggcttctccctgatgacaagcttaccctcttctgcgaggtgagtgttgtgcaagattctgtcaacatttctggccagaataccatgaacatggtaaaggttcctgagtgccggct

SEQ ID NO: 2183 - DNA, 428 bp, Homo sapiens
gtcccggatgttgcggacagtatgaggcaagcgcagggggacggggaccagcagctgtcgccgccgctctcagagatttcctgttagacaagacaaattagagttttcctactgacttaacttgaaaagttcttcaggaaggtcgggcatggtgactcatgcctgtaatcccagcactttgggaggctgaggcaggaagattgcttgagctcaggagttcgagaccatcctggtcaacatgggtgaagagggaacagaaatctttgccccctgactttggaaatctcgtttaaccttcaaactggcgatgtcaagggttccaagtcctccacctccggcagaaatgtcgagtggccccgtagctgagagttggtgctacacacagatcaaggtagtgaaattctcctacatgtggaccatcaataact

SEQ ID NO: 2184 - DNA, 1134 bp, Homo sapiens
gtgctgacgccatgacgccccggctggtgtgtgtcggtgtgtatgtgtgtgtgtgagtgtgcgcgctccgagtgtgtgtgtatttgtgtatcggcggtcccgcaggtcccggatgttgcggacagtatgaggcaagcgcagggggacggggaccagcagctgtcgccgccgctctcaggctctgggaaccacccttctactttctgtctctaggaatttcactactctagagatttcctgttagacaagacaaattagagttttcctactgacttaacttgggtgaagagggaacagaaatctttgccccctgactttggaaatctcgtttaaccttcaaactggcgatgtcaagggttccaagtcctccacctccggcagaaatgtcgagtggccccgtagctgagagttggtgctacacacagatcaaggtagtgaaattctcctacatgtggaccatcaataactttagcttttgccgggaggaaatgggtgaagtcattaaaagttctacattttcatcaggagcaaatgataaactgaaatggtgtttgcgagtaaaccccaaagggttagatgaagaaagcaaagattacctgtcactttacctgttactggtcagctgtccaaagagtgaagttcgggcaaaattcaaattctccatcctgaatgccaagggagaagaaaccaaagctatggagagtcaacgggcatataggtttgtgcaaggcaaagactggggattcaagaaattcatccgtagagattttcttttggatgaggccaacgggcttctccctgatgacaagcttaccctcttctgcgaggtgagtgttgtgcaagattctgtcaacatttctggccagaataccatgaacatggtaaaggttcctgagtgccggctggcagatgagttaggaggactgtgggagaattcccggttcacagactgctgcttgtgtgttgccggccaggaattccaggctcacaaggctatcttagcagctcgttctccggtttttagtgccatgtttgaacatgaaatggaggagagcaaaaagaatcgagttgaaatcaatgatgtggagcctgaagtttttaaggaaatgatgtgcttcatttacacggggaagg

SEQ ID NO: 2185 - DNA, 773 bp, Homo sapiens
taaagcatttaactggaaaggaccttggaaatccttttaaaggaggatgggggtggaaatgcacaggttgcttctctctctctctctctttttttttttttttgagacggtcacccaggctgtagtgcagtggcgtgatctcggctcactgtggcctccacctcccaagtagctgggattacaggcttgcgccatcatgcagggctaatttttgtatttttagtagagacgaggtttcatcatgttggccaggctggtctggaactcctgacctcaagtgatctgcccaccttggcctcccaaagtgctgggattaaaggcatgagccaccacgcctggcctaggttgttcctctactgtgaatcttgaggttatggtttccactagactatagtgctcaactatagtggcctattttaagtggccttataattcctaaccaaagtgacttgtgaaacagaggaccctggataaatttaaatgttataaagatgataaaatgtacagggtgaagagggaacagaaatctttgccccctgactttggaaatctcgtttaaccttcaaactggcgatgtcaagggttccaagtcctccacctccggcagaaatgtcgagtggccccgtagctgagagttggtgctacacacagatcaaggtagtgaaattctcctacatgtggaccatcaataactttagcttttgccgggaggaaatgggtgaagtcattaaaagttctacattttcatcaggagcaaatgataaactgaaatg

SEQ ID NO: 2186 - DNA, 1454 bp, Homo sapiens
gtgtgtgtatttgtgtatcggcggtcccgcaggtcccggatgttgcggacagtatgaggcaagcgcagggggacggggaccagcagctgtcgccgccgctctcagagatttcctgttagacaagacaaattagagttttcctactgacttaacttgaataaatatatacttgatactggatgaaaaactcagttttaccaggactgggattagagggtgaagagggaacagaaatctttgccccctgactttggaaatctcgtttaaccttcaaactggcgatgtcaagggttccaagtcctccacctccggcagaaatgtcgcttttgccgggaggaaatgggtgaagtcattaaaagttctacattttcatcaggagcaaatgataaactgaaatggtgtttgcgagtaaaccccaaagggttagatgaagaaagcaaagattacctgtcactttacctgttactggtcagctgtccaaagagtgaagttcgggcaaaattcaaattctccatcctgaatgccaagggagaagaaaccaaagctatggagagtcaacgggcatataggtttgtgcaaggcaaagactggggattcaagaaattcatccgtagagattttcttttggatgaggccaacgggcttctccctgatgacaagcttaccctcttctgcgaggtgagtgttgtgcaagattctgtcaacatttctggccagaataccatgaacatggtaaaggttcctgagtgccggctggcagatgagttaggaggactgtgggagaattcccggttcacagactgctgcttgtgtgttgccggccaggaattccaggctcacaaggctatcttagcagctcgttctccggtttttagtgccatgtttgaacatgaaatggaggagagcaaaaagaatcgagttgaaatcaatgatgtggagcctgaagtttttaaggaaatgatgtgcttcatttacacggggaaggctccaaacctcgacaaaatggctgatgatttgctggcagctgctgacaagtatgccctggagcgcttaaaggtcatgtgtgaggatgccctctgcagtaacctgtccgtggagaacgctgcagaaattctcatcctggccgacctccacagtgcagatcagttgaaaactcaggcagtggatttcatcaactatcatgcttcggatgtcttggagacctctgggtggaagtcaatggtggtgtcacatccccacttggtggctgaggcataccgctctctggcttcagcacagtgcccttttctgggacccccacgcaaacgcctgaagcaatcctaagatcctgcttgttgtaagactccgtttaatttccagaagcagcagccactgttgctgccactgaccaccaggtagacagcgcaatctgtggagcttttactctgttgtgaggggaagagactgcattgtgg

SEQ ID NO: 2187 - DNA, 873 bp, Homo sapiens
atgacgccccggctggtgtgtgtcggtgtgtatgtgtgtgtgtgagtgtgcgcgctccgagtgtgtgtgtatttgtgtatcggcggtcccgcaggtcccggatgttgcggacagtatgaggcaagcgcagggggacggggaccagcagctgtcgccgccgctctcagatcgagtcttgctctgtcacccaggctggagtgcagtggcgcgatctcagctcactgccacctttgcctcctgggttcaagcgattcttctgcctcagcctcccgagtagctgggattacaggctctgggaaccacccttctactttctgtctctaggaatttcactactctagagatttcctgttagacaagacaaattagagttttcctactgacttaacttgggtgaagagggaacagaaatctttgccccctgactttggaaatctcgtttaaccttcaaactggcgatgtcaagggttccaagtcctccacctccggcagaaatgtcgagtggccccgtagctgagagttggtgctacacacagatcaaggtagtgaaattctcctacatgtggaccatcaataactttagcttttgccgggaggaaatgggtgaagtcattaaaagttctacattttcatcaggagcaaatgataaactgaaatggtgtttgcgagtaaaccccaaagggttagatgaagaaagcaaagattacctgtcactttacctgttactggtcagctgtccaaagagtgaagttcgggcaaaattcaaattctccatcctgaatgccaagggagaagaaaccaaagctatggagagtcaacgggcatataggtttgtgcaaggcaaagactggggattcaagaaattcatccgta

SEQ ID NO: 2188 - DNA, 563 bp, Homo sapiens
gtgtatcggcggtcccgcaggtcccggatgttgcggacagtatgaggcaagcgcagggggacggggaccagcagctgtcgccgccgctctcaggctctgggaaccacccttctactttctgtctctaggaatttcactactctagggtgaagagggaacagaaatctttgccccctgactttggaaatctcgtttaaccttcaaactggcgatgtcaagggttccaagtcctccacctccggcagaaatgtcgagtggccccgtagctgagagttggtgctacacacagatcaaggtagtgaaattctcctacatgtggaccatcaataactttagcttttgccgggaggaaatgggtgaagtcattaaaagttctacattttcatcaggagcaaatgataaactgaaatggtgtttgcgagtaaaccccaaagggttagatgaagaaagcaaagattacctgtcactttacctgttactggtcagctgtccaaagagtgaagttcgggcaaaattcaaattctccatcctgaatgccaagggagaagaaaccaaagctatgg

SEQ ID NO: 2189 - DNA, 6025 bp, Homo sapiens
agtcgtaactcggaagccggagcccagacgggcccgcggcgggggggtgggggctgcgcgggggcgggagtggcggaggtggccgcccctggcggcgggtttgtttatcccggggaagaagtttaggagcgggagatagggaaggagggcgggtcggggaggagggatgcggttcggcggaggcggccgccacagggacttgccgccatcacccctgctgccaccaccgcagcctcgggctcccagggcggacacggccaccgcctcagcgggagaggagtctccaccaggactgaccgctgccgcccagcacgtccaggtaaggtactcaactgtgtggggtactacataaatcctgaaagactacaataaagtggtgatgtctcgggaacccaccccacctctacctggagatatgtctactggtcccatagcagaaagctggtgttacacacaggttaaagtagtaaaattttcctatatgtggaccattaataacttcagtttttgtcgagaggaaatgggtgaagtgttaaaaagttcaacattttcatctggcccaagtgacaaaatgaaatggtgcctgagggtaaacccaaagggattagatgatgaaagtaaagactacttgtccttatatttgcttttagtcagctgccccaaaagtgaagttcgagcaaaattcaaattttcccttctgaatgctaaaagggaagaaacaaaagcaatggaaagccaaagagcatatcgatttgtgcaagggaaggactggggttttaaaaaattcattagaagggactttttgcttgatgaagctaatggtcttttaccagatgacaagcttacattattttgtgaggtgagtgtggtccaagattcagtaaacatatcaggacatactaatacaaatactttgaaggtgcctgagtgtcgtctagcagaagatttaggtaatctctgggaaaacacaagatttacagactgcagttttttcgtgagaggacaagaatttaaagctcataaatctgtgcttgcagctcgatctccagtttttaacgccatgtttgaacatgaaatggaagaaagcaaaaagaatcgagtggaaataaatgatttagaccctgaagtttttaaagaaatgatgagattcatttacacagggagagcaccaaaccttgacaaaatggctgacaacttgttggcagctgcagacaaatatgcactggaacggctgaaggtcatgtgcgaagaagctttgtgtagtaacctctcagtagagaatgttgcagatacccttgtccttgcagatttgcacagtgcagaacagttgaaagcacaagccatagactttattaataggtgcagtgtacttcgacaacttgggtgtaaagatgggaaaaactggaacagcaaccaagcaaccgacataatggaaacatcagggtggaagtccatgattcagtctcaccctcatttagtagcagaagcctttcgagcactagcatctgcacagtgtccacagtttggcattccacgcaaacggctaaaacagtcctgaaatcttccatgaacagttgaaaaatggaattgactttcactcctccaggtccagaaggattctaatacacaaaccataagcaagagttgtttctgttattttgtccacagaacagaagctgaaaaagcatattgcttgcatttcaggtggataatttatggtttattcttcagctttaaattagactgattaattcacttcaaggccttaaattatcttcaatgacttgtcttgttcatataatactttaatttttttttattgtgccttgtcattttgaccaaggctatgcaggattgcactagctccataatgcagtaatattgataactgaagatactaagtttcaaaaggatcttccattattttgcaaaaagaaaaatgaattttatagggtttgtcctatgctatctcaaagtttaagttctctttaaaagcacttgtattggagattaccagtaatatctccaatctaagttctataaatatgggagaaccctcttaccttcaaggtaagttatggcaatacactgcttcaattctaatttatttttcatttcagggggcaaatatgcaatgagttggcctagatttttagtgacatttatgatgtttgtcttgtatgttaactgtccaacaaactgtgggtttattctaagtttacaattattgagaactgattgaggttaagatttcatgaagaaagcatgtattgtgtggaagtaatttttttttaatttatactgacctacatttatacgaagaattctgtacatgttaaaagtaaggatgaccaaatgcaaatttaatgagtgggccaattaagaaagatacatatgcacttttactgtgtaacttttgtatgctgaatggtacatatatttttttgcttttgagggaattaataaggtataattaattgtgtcttaacttttcaaagaaatttttagatggaggcaactgggatgtttgtgataatagatgagaaagacatccttgattgtagttaaattggtttggattacagatattcattattgaattgactcctattttctcacactttggaaaagacacctgaacaataaatgaatcctggatagtctactctccttcaaacaattaactgatacttgcctttgggagatgcatacaaaaggagagaacccttagactatgtcaggtcacactaggaacctcccctcactccccgtttttcttcattgtgtttcagttactgtactaacattgtggatgatactgaaattctgcataatgtgaacaggataaactatttataaactgcttttcatgggccagttctttattataaatgaattttagctttaaatgcatatacacgttcagtgtttgatagttgtgttcttaagggaggtttgttctggtgcattgtcctggagaagcagaagcagtcagtgttggggtaccacatctgacttactgtggtggtgaccagtgtgcttcttaagggcaagatttatatttgaccacaagggaaaaagtgtgtcactggaaaaaaacgcatatacctatgtttgcaaacataactattcttcagattaaaatttgtataatttgtttatttaatgtttgaattcaggacaaaagaaaaaatgaagcttgaggtgttttcaaatagaccttatttttgctatctctttgttaggtgttaactgaagcaattcgaatatgtccagattcatttggattcatatttacattgaaaaaactcaactaagcatttgttatccacaacaacctagagtttaaaaagatcgtattttcacctgtcttcattactttctatgtagtttcattctttgtcgtggtaacttaaatttgaaattggaagaatctcttgggatagaagaaagattcttacctggtgatggaacttcatacttcatcctgtgtaagagtattatgggaagtagaaattcacttccttaaatccatcgtaagattgagcctcaagtttgcaatatacaattttaaaaatacacatacatacatacatatgtatacatttccagttttaagattttgcgagggtcttataagaaaacaaaaattccctcaggctatagaattatgttgtcatatatcagaaaagtactgatgtatccatttatatccaatgcgcaccacaccggcacattgtgatttaattcaccgcttgaatctatatttctaaccacagtgacttcagtaaaaataccgtataatgaacatttcagcttcttcttacttactcgagagtttattgcaaatcttaaggattttattataaagattttttttttagtttggtagcacattttgtaccaaaaatgtcaaacactgtgctgtaagaatatccatgtttgtagaaatgtccacttttcagataatataatgcctaccattatactaacagaatcatatggtagttgatttatttttttatttattatgtatatttttggtattgtgggttcttgaggcaatgataaaaacacttaatgtattctgacatgagtgctctaatagcctccttctcctcatttttaaactgcatacattactttcaaaataggtatagatactctgtcccgccttttgagctattagcctgttcctgtttccctttgtcacctaagcaaggctttttctgagaaggtagtgaatggtttcaaatgttgcatactataagaataatcattgggtaactgttgtttagaccaacacttagaaatactatatttgtgccttttcatttttaattttaatgtgtgttgatatttggagcacaaataatgaaggtgccataatatggcttgccaatgttacctccttgaatagtcatgtgtcattgtcttgaattggtaattggagaaccttgcatgaaatatgtgatcgtgtgtgtgtgtgtgtatgcgcgtgtgtgtctgtgtgtttgtgtacatacctgtatttgcttggggcttgtgtgtggtatgttacaaagagtgaatttctggaaatagaaatcagttaaatgttgaaagttcaggttagcagaaatatttcatttaaatatgctttactttggaggacaattgattaacagaggaaatgataattttcaaaaatgtgatcaatttactgcatgatgaaatgtgaaaacagtgcctttttaggacatcaattataataaaattgttttaaaatattaacaaagatctcaaaaagttgtcatgaacattattcatttatttttaaactggatctaaataagagcttagatggccaaaattagaattaataatatacccatttaaattttgttcataaatttaaaatcttaatcagaattctttataaaatgtgggtcatagatatgacccagtgttactaaaatagaacagggattgtgaaaatccagctcaacatacttaagtatacttggcttagagccaagtatacttgaagaggtgaattattctgacttggacatgcatgctctttgatggataaaataaaaatattcaatttattcttacaaaagaaggtgggtgggtgagtgggttcgttttagtgttctcagattataaagacagctataaagacagcactttccgcacacaaagtgtattttacaaaccttttttatacaaattaatgagctctactttatttaagtgttcatggaatgatgtaaattttaggtccagttgaacaaatattgagtgcctatcatatgcaagactaactccttactaggaatgaaatcacacagtgtcttctgtttgcagtatgtgaactttatgtttgaaaagaaattattatatttaaatttttttgttgtcagagtttatcattgtatactgtaacccagtaaattttgcattcagttttaaaaaatgaagatgtaacttacctgagtctcatttttgaaaatgaaattctgcaaaaattatttaaaaattagttcttggggaaattgattttcaagattcaagtgtataaaaacttatattgaacttttcagcctcgtttttaattagctgatgttaatgataagatacataatacatgtatcttgttgctgaaaatattttttgcatttcaacacattgagttaaaataaagttgttactacttattcaagattaattggcttatcttgtgtttatttgaagaatacatactcttctttttcaggttggtatgatgctttgcaaaagagccatgtatttgatacggtaaatcatgcatagtaattgtcttttctacataggggagctcttgttttttggaaccaattgaagacattcttaactgtaaaatattaatatgcatttattttaatatgtatgaaccatcaatactggatgacttattctaatgctacgtaccattaatgtaacagagatcaccttttccctgtcattcctatcctgtcttaatttcagttatcccagacaa

SEQ ID NO: 2190 - DNA, 9672 bp, Homo sapiens
atgcagaaagcccggggcacgcgaggcgaggatgcgggcacgagggcaccccccagccccggagtgcccccgaaaagggccaaggtgggggccggcggcggggctcctgtggccgtggccggggcgccagtcttcctgcggcccctgaagaacgcggcggtgtgcgcgggcagcgacgtgcggctgcgggtggtggtgagcgggacgccccagcccagcctccgctggttccgggatgggcagctcctgcccgcgccggcccccgagcccagctgcctgtggctgcggcgctgcggggcgcaggacgccggcgtgtacagctgcatggcccagaacgagcggggccgggcctcctgcgaggcggtgctcacagtgctggaggtcggagactcagagacggctgaggatgacatcagcgatgtgcagggaacccagcgcctggagcttcgggatgacggggccttcagcacccccacggggggttctgacaccctggtgggcacctccctggacacacccccgacctccgtgacaggcacctcagaggagcaagtgagctggtggggcagcgggcagacggtcctggagcaggaagcgggcagtgggggtggcacccgccgcctcccgggcagcccaaggcaagcacaggcaaccggggccgggccacggcacctgggggtggagccgctggtgcgggcatctcgagctaatctggtgggcgcaagctgggggtcagaggatagcctttccgtggccagtgacctgtacggcagcgcattcagcctgtacagaggacgggcgctctctatccacgtcagcgtccctcagagcgggttgcgcagggaggagcccgaccttcagcctcaactggccagcgaagccccacgccgccctgcccagccgcctccttccaaatccgcgctgctccccccaccgtcccctcgggtcgggaagcggtccccgccgggacccccggcccagcccgcggccacccccacgtcgccccaccgtcgcactcaggagcctgtgctgcccgaggacaccaccaccgaagagaagcgagggaagaagtccaagtcgtccgggccctccctggcgggcaccgcggaatcccgaccccagacgccactgagcgaggcctcaggccgcctgtcggcgttgggccgatcgcctaggctggtgcgcgccggctcccgcatcctggacaagctgcagttcttcgaggagcgacggcgcagcctggagcgcagcgactcgccgccggcgcccctgcggccctgggtgcccctgcgcaaggcccgctctctggagcagcccaagtcggagcgcggcgcaccgtggggcacccccggggcctcgcaggaagaactgcgggcgccaggcagcgtggccgagcggcgccgcctgttccagcagaaagcggcctcgctggacgagcgcacgcgtcagcgcagcccggcctcagacctcgagctgcgcttcgcccaggagctgggccgcatccgccgctccacgtcgcgggaggagctggtgcgctcgcacgagtccctgcgcgccacgctgcagcgtgccccatcccctcgagagcccggcgagcccccgctcttctctcggccctccacccccaagacatcgcgggccgtgagccccgccgccgcccagccgccctctccgagcagcgcggagaagccgggggacgagcctgggaggcccaggagccgcgggccggcgggcaggacagagccgggggaaggcccgcagcaggaggttaggcgtcgggaccaattcccgctgacccggagcagagccatccaggagtgcaggagccctgtgccgccccccgccgccgatcccccagaggccaggacgaaagcaccccccggtcggaagcgggagcccccggcgcaggccgtgcgcttcctgccctgggccacgccgggcctggagggcgctgctgtaccccagaccttggagaagaacagggcggggcctgaggcagagaagaggcttcgcagagggccggaggaggacggtccctgggggccctgggaccgccgaggggcccgcagccagggcaaaggtcgccgggcccggcccacctcccctgagctcgagtcttcggatgactcctacgtgtccgctggagaagagcccctagaggcccctgtgtttgagatccccctgcagaatgtggtggtggcaccaggggcagatgtgctgctcaagtgtatcatcactgccaaccccccgccccaagtgtcctggcacaaggatgggtcagcgctgcgcagcgagggccgcctcctcctccgggctgagggtgagcggcacaccctgctgctcagggaggccagggcagcagatgccgggagctatatggccaccgccaccaacgagctgggccaggccacctgtgccgcctcactgaccgtgagacccggtgggtctacatcccctttcagcagccccatcacctccgacgaggaatacctgagccccccagaggagttcccagagcctggggagacctggccgcgaacccccaccatgaagcccagtcccagccagaaccgccgttcttctgacactggctccaaggcaccccccaccttcaaggtctcacttatggaccagtcagtaagagaaggccaagatgtcatcatgagcatccgcgtgcagggggagcccaagcctgtggtctcctggctgagaaaccgccagcccgtgcgcccagaccagcggcgctttgcggaggaggctgagggtgggctgtgccggctgcggatcctggctgcagagcgtggcgatgctggtttctacacttgcaaagcggtcaatgagtatggtgctcggcagtgcgaggcccgcttggaggtccgagcacaccctgaaagccggtccctggccgtgctggcccccctgcaggacgtggacgtgggggccggggagatggcgctgtttgagtgcctggtggcggggcccactgacgtggaggtggattggctgtgccgtggccgcctgctgcagcctgcactgctcaaatgcaagatgcatttcgatggccgcaaatgcaagctgctacttacatctgtacatgaggacgacagtggcgtctacacctgcaagctcagcacggccaaagatgagctgacctgcagtgcccggctgaccgtgcggccctcgttggcacccctgttcacacggctgctggaagatgtggaggtgttggagggccgagctgcccgtttcgactgcaagatcagtggcaccccgccccctgttgttacctggactcattttggctgccccatggaggagagtgagaacttgcggctgcggcaggacgggggtctgcactcactgcacattgcccatgtgggcagcgaggacgaggggctctatgcggtcagtgctgttaacacccatggccaggcccactgctcagcccagctgtatgtagaagagccccggacagccgcctcaggccccagctcgaagctggagaagatgccatccattcccgaggagccagagcagggtgagctggagcggctgtccattcctgacttcctgcggccactgcaggacctggaggtgggactggccaaggaggccatgctagagtgccaggtgaccggcctgccctaccccaccatcagctggttccacaatggccaccgcatccagagcagcgacgaccggcgcatgacacagtacagggatgtccatcgcttggtgttccctgccgtggggcctcagcacgccggtgtctacaagagcgtcattgccaacaagctgggcaaagctgcctgctatgcccacctgtatgtcacagatgtggtcccaggccctccagatggcgccccgcaggtggtggctgtgacggggaggatggtcacactcacatggaacccccccaggagtctggacatggccatcgacccggactccctgacgtacacagtgcagcaccaggtgctgggctcggaccagtggacggcactggtcacaggcctgcgggagccagggtgggcagccacagggctgcgtaagggggtccagcacatcttccgggtcctcagcaccactgtcaagagcagcagcaagccctcacccccttctgagcctgtgcagctgctggagcacggcccaaccctggaggaggcccctgccatgctggacaaaccagacatcgtgtatgtggtggagggacagcctgccagcgtcaccgtcacattcaaccatgtggaggcccaggtcgtctggaggagctgccgaggggccctcctagaggcacgggccggtgtgtacgagctgagccagccagatgatgaccagtactgtcttcggatctgccgggtgagccgccgggacatgggggccctcacctgcaccgcccgaaaccgtcacggcacacagacctgctcggtcacattggagctggcagaggcccctcggtttgagtccatcatggaggacgtggaggtgggggctggggaaactgctcgctttgcggtggtggtcgagggaaaaccactgccggacatcatgtggtacaaggacgaggtgctgctgaccgagagcagccatgtgagcttcgtgtacgaggagaatgagtgctccctggtggtgctcagcacgggggcccaggatggaggcgtctacacctgcaccgcccagaacctggcgggtgaggtctcctgcaaagcagagttggctgtgcattcagctcagacagctatggaggtcgagggggtcggggaggatgaggaccatcgaggaaggagactcagcgacttttatgacatccaccaggagatcggcaggggtgctttctcctacttgcggcgcatagtggagcgtagctccggcctggagtttgcggccaagttcatccccagccaggccaagccaaaggcatcagcgcgtcgggaggcccggctgctggccaggctccagcacgactgtgtcctctacttccatgaggccttcgagaggcgccggggactggtcattgtcaccgagctctgcacagaggagctgctggagcgaatcgccaggaaacccaccgtgtgtgagtctgagatccgggcctatatgcggcaggtgctagagggaatacactacctgcaccagagccacgtgctgcacctcgatgtcaagcctgagaacctgctggtgtgggatggtgctgcgggcgagcagcaggtgcggatctgtgactttgggaatgcccaggagctgactccaggagagccccagtactgccagtatggcacacctgagtttgtagcacccgagattgtcaatcagagccccgtgtctggagtcactgacatctggcctgtgggtgttgttgccttcctctgtctgacaggaatctccccgtttgttggggaaaatgaccggacaacattgatgaacatccgaaactacaacgtggccttcgaggagaccacattcctgagcctgagcagggaggcccggggcttcctcatcaaagtgttggtgcaggaccggctgagacctaccgcagaagagaccctagaacatccttggttcaaaactcaggcaaagggcgcagaggtgagcacggatcacctgaagctattcctctcccggcggaggtggcagcgctcccagatcagctacaaatgccacctggtgctgcgccccatccccgagctgctgcgggcccccccagagcgggtgtgggtgaccatgcccagaaggccaccccccagtggggggctctcatcctcctcggattctgaagaggaagagctggaagagctgccctcagtgccccgcccactgcagcccgagttctctggctcccgggtgtccctcacagacattcccactgaggatgaggccctggggaccccagagactggggctgccacccccatggactggcaggagcagggaagggctccctctcaggaccaggaggctcccagcccagaggccctcccctccccaggccaggagcccgcagctggggctagccccaggcggggagagctccgcaggggcagctcggctgagagcgccctgccccgggccgggccgcgggagctgggccggggcctgcacaaggcggcgtctgtggagctgccgcagcgccggagccccagcccgggagccacccgcctggcccggggaggcctgggtgagggcgagtatgcccagaggctgcaggccctgcgccagcggctgctgcggggaggccccgaggatggcaaggtcagcggcctcaggggtcccctgctggagagcctggggggccgtgctcgggacccccggatggcacgagctgcctccagcgaggcagcgccccaccaccagcccccactcgagaaccggggcctgcaaaagagcagcagcttctcccagggtgaggcggagccccggggccggcaccgccgagcgggggcgcccctcgagatccccgtggccaggcttggggcccgtaggctacaggagtctccttccctgtctgccctcagcgaggcccagccatccagccctgcacggcccagcgcccccaaacccagtacccctaagtctgcagaaccttctgccaccacacctagtgatgctccgcagccccccgcaccccagcctgcccaagacaaggctccagagcccaggccagaaccagtccgagcctccaagcctgcaccacccccccaggccctgcaaaccctagcgctgcccctcacaccctatgctcagatcattcagtccctccagctgtcaggccacgcccagggcccctcgcagggccctgccgcgccgccttcagagcccaagccccacgctgctgtctttgccagggtggcctccccacctccgggagcccccgagaagcgcgtgccctcagccgggggtcccccggtgctagccgagaaagcccgagttcccacggtgccccccaggccaggcagcagtctcagtagcagcatcgaaaacttggagtcggaggccgtgttcgaggccaagttcaagcgcagccgcgagtcgcccctgtcgctggggctgcggctgctgagccgttcgcgctcggaggagcgcggccccttccgtggggccgaggaggaggatggcatataccggcccagcccggcggggaccccgctggagctggtgcgacggcctgagcgctcacgctcggtgcaggacctcagggctgtcggagagcctggcctcgtccgccgcctctcgctgtcactgtcccagcggctgcggcggacccctcccgcgcagcgccacccggcctgggaggcccgcggcggggacggagagagctcggagggcgggagctcggcgcggggctccccggtgctggcgatgcgcaggcggctgagcttcaccctggagcggctgtccagccgattgcagcgcagtggcagcagcgaggactcggggggcgcgtcgggccgcagcacgccgctgttcggacggcttcgcagggccacgtccgagggcgagagtctgcggcgccttggccttccgcacaaccagttggccgcccaggccggcgccaccacgccttccgccgagtccctgggctccgaggccagcgccacgtcgggctcctcagccccaggggaaagccgaagccggctccgctggggcttctctcggccgcggaaggacaaggggttatcgccaccaaacctctctgccagcgtccaggaggagttgggtcaccagtacgtgcgcagtgagtcagacttccccccagtcttccacatcaaactcaaggaccaggtgctgctggagggggaggcagccaccctgctctgcctgccagcggcctgccctgcaccgcacatctcctggatgaaagacaagaagtccttgaggtcagagccctcagtgatcatcgtgtcctgcaaagatgggcggcagctgctcagcatcccccgggcgggcaagcggcacgccggtctctatgagtgctcggccaccaacgtactgggcagcatcaccagctcctgtaccgtggctgtggcccgagtcccaggaaagctagctcctccagaggtaccccagacctaccaggacacggcgctggtgctgtggaagccgggagacagccgggcaccttgcacgtatacgctggagcggcgagtggatggggagtctgtgtggcaccctgtgagctcaggcatccccgactgttactacaacgtgacccacctgccagttggcgtgactgtgaggttccgtgtggcctgtgccaaccgtgctgggcaggggcccttcagcaactcttctgagaaggtctttgtcaggggtactcaagattcttcagctgtgccatctgctgcccaccaagaggcccctgtcacctcaaggccagccagggcccggcctcctgactctcctacctcactggccccacccctagctcctgctgcccccacacccccgtcagtcactgtcagcccctcatctccccccacacctcctagccaggccttgtcctcgctcaaggctgtgggtccaccaccccaaacccctccacgaagacacaggggcctgcaggctgcccggccagcggagcccaccctacccagtacccacgtcaccccaagtgagcccaagcctttcgtccttgacactgggaccccgatcccagcctccactcctcaaggggttaaaccagtgtcttcctctactcctgtgtatgtggtgacttcctttgtgtctgcaccaccagcccctgagcccccagcccctgagccccctcctgagcctaccaaggtgactgtgcagagcctcagcccggccaaggaggtggtcagctcccctgggagcagtccccgaagctctcccaggcctgagggtaccactcttcgacagggtccccctcagaaaccctacaccttcctggaggagaaagccaggggccgctttggtgttgtgcgagcgtgccgggagaatgccacggggcgaacgttcgtggccaagatcgtgccctatgctgccgagggcaagcggcgggtcctgcaggagtacgaggtgctgcggaccctgcaccacgagcggatcatgtccctgcacgaggcctacatcacccctcggtacctcgtgctcattgctgagagctgtggcaaccgggaactcctctgtgggctcagtgacaggttccggtattctgaggatgacgtggccacttacatggtgcagctgctacaaggcctggactacctccacggccaccacgtgctccacctagacatcaagccagacaacctgctgctggcccctgacaatgccctcaagattgtggactttggcagtgcccagccctacaacccccaggcccttaggccccttggccaccgcacgggcacgctggagttcatggctccggagatggtgaagggagaacccatcggctctgccacggacatctggggagcgggtgtgctcacttacattatgctcagtggacgctccccgttctatgagccagacccccaggaaacggaggctcggattgtggggggccgctttgatgccttccagctgtaccccaatacatcccagagcgccaccctcttcttgcgaaaggttctctctgtacatccctggctcagcaggccatccagctgtctgtctgtctgccacaaggaaataaaaatggcaagcagc

SEQ ID NO: 2191 - DNA, 10782 bp, Homo sapiens
acaggccgaaggcgggcgggcagcaggaaggcaggccgccggccccccagacttgtctcctagggcaccgtcccgcgggtgcccccgtggccgcccagttccggcgtccccccagcccagctctcagtggccatgcagaaagcccggggcacgcgaggcgaggatgcgggcacgagggcaccccccagccccggagtgcccccgaaaagggccaaggtgggggccggcggcggggctcctgtggccgtggccggggcgccagtcttcctgcggcccctgaagaacgcggcggtgtgcgcgggcagcgacgtgcggctgcgggtggtggtgagcgggacgccccagcccagcctccgctggttccgggatgggcagctcctgcccgcgccggcccccgagcccagctgcctgtggctgcggcgctgcggggcgcaggacgccggcgtgtacagctgcatggcccagaacgagcggggccgggcctcctgcgaggcggtgctcacagtgctggaggtcggagactcagagacggctgaggatgacatcagcgatgtgcagggaacccagcgcctggagcttcgggatgacggggccttcagcacccccacggggggttctgacaccctggtgggcacctccctggacacacccccgacctccgtgacaggcacctcagaggagcaagtgagctggtggggcagcgggcagacggtcctggagcaggaagcgggcagtgggggtggcacccgccgcctcccgggcagcccaaggcaagcacaggcaaccggggccgggccacggcacctgggggtggagccgctggtgcgggcatctcgagctaatctggtgggcgcaagctgggggtcagaggatagcctttccgtggccagtgacctgtacggcagcgcattcagcctgtacagaggacgggcgctctctatccacgtcagcgtccctcagagcgggttgcgcagggaggagcccgaccttcagcctcaactggccagcgaagccccacgccgccctgcccagccgcctccttccaaatccgcgctgctccccccaccgtcccctcgggtcgggaagcggtccccgccgggacccccggcccagcccgcggccacccccacgtcgccccaccgtcgcactcaggagcctgtgctgcccgaggacaccaccaccgaagagaagcgagggaagaagtccaagtcgtccgggccctccctggcgggcaccgcggaatcccgaccccagacgccactgagcgaggcctcaggccgcctgtcggcgttgggccgatcgcctaggctggtgcgcgccggctcccgcatcctggacaagctgcagttcttcgaggagcgacggcgcagcctggagcgcagcgactcgccgccggcgcccctgcggccctgggtgcccctgcgcaaggcccgctctctggagcagcccaagtcggagcgcggcgcaccgtggggcacccccggggcctcgcaggaagaactgcgggcgccaggcagcgtggccgagcggcgccgcctgttccagcagaaagcggcctcgctggacgagcgcacgcgtcagcgcagcccggcctcagacctcgagctgcgcttcgcccaggagctgggccgcatccgccgctccacgtcgcgggaggagctggtgcgctcgcacgagtccctgcgcgccacgctgcagcgtgccccatcccctcgagagcccggcgagcccccgctcttctctcggccctccacccccaagacatcgcgggccgtgagccccgccgccgcccagccgccctctccgagcagcgcggagaagccgggggacgagcctgggaggcccaggagccgcgggccggcgggcaggacagagccgggggaaggcccgcagcaggaggttaggcgtcgggaccaattcccgctgacccggagcagagccatccaggagtgcaggagccctgtgccgccccccgccgccgatcccccagaggccaggacgaaagcaccccccggtcggaagcgggagcccccggcgcaggccgtgcgcttcctgccctgggccacgccgggcctggagggcgctgctgtaccccagaccttggagaagaacagggcggggcctgaggcagagaagaggcttcgcagagggccggaggaggacggtccctgggggccctgggaccgccgaggggcccgcagccagggcaaaggtcgccgggcccggcccacctcccctgagctcgagtcttcggatgactcctacgtgtccgctggagaagagcccctagaggcccctgtgtttgagatccccctgcagaatgtggtggtggcaccaggggcagatgtgctgctcaagtgtatcatcactgccaaccccccgccccaagtgtcctggcacaaggatgggtcagcgctgcgcagcgagggccgcctcctcctccgggctgagggtgagcggcacaccctgctgctcagggaggccagggcagcagatgccgggagctatatggccaccgccaccaacgagctgggccaggccacctgtgccgcctcactgaccgtgagacccggtgggtctacatcccctttcagcagccccatcacctccgacgaggaatacctgagccccccagaggagttcccagagcctggggagacctggccgcgaacccccaccatgaagcccagtcccagccagaaccgccgttcttctgacactggctccaaggcaccccccaccttcaaggtctcacttatggaccagtcagtaagagaaggccaagatgtcatcatgagcatccgcgtgcagggggagcccaagcctgtggtctcctggctgagaaaccgccagcccgtgcgcccagaccagcggcgctttgcggaggaggctgagggtgggctgtgccggctgcggatcctggctgcagagcgtggcgatgctggtttctacacttgcaaagcggtcaatgagtatggtgctcggcagtgcgaggcccgcttggaggtccgagcacaccctgaaagccggtccctggccgtgctggcccccctgcaggacgtggacgtgggggccggggagatggcgctgtttgagtgcctggtggcggggcccactgacgtggaggtggattggctgtgccgtggccgcctgctgcagcctgcactgctcaaatgcaagatgcatttcgatggccgcaaatgcaagctgctacttacatctgtacatgaggacgacagtggcgtctacacctgcaagctcagcacggccaaagatgagctgacctgcagtgcccggctgaccgtgcggccctcgttggcacccctgttcacacggctgctggaagatgtggaggtgttggagggccgagctgcccgtttcgactgcaagatcagtggcaccccgccccctgttgttacctggactcattttggctgccccatggaggagagtgagaacttgcggctgcggcaggacgggggtctgcactcactgcacattgcccatgtgggcagcgaggacgaggggctctatgcggtcagtgctgttaacacccatggccaggcccactgctcagcccagctgtatgtagaagagccccggacagccgcctcaggccccagctcgaagctggagaagatgccatccattcccgaggagccagagcagggtgagctggagcggctgtccattcctgacttcctgcggccactgcaggacctggaggtgggactggccaaggaggccatgctagagtgccaggtgaccggcctgccctaccccaccatcagctggttccacaatggccaccgcatccagagcagcgacgaccggcgcatgacacagtacagggatgtccatcgcttggtgttccctgccgtggggcctcagcacgccggtgtctacaagagcgtcattgccaacaagctgggcaaagctgcctgctatgcccacctgtatgtcacagatgtggtcccaggccctccagatggcgccccgcaggtggtggctgtgacggggaggatggtcacactcacatggaacccccccaggagtctggacatggccatcgacccggactccctgacgtacacagtgcagcaccaggtgctgggctcggaccagtggacggcactggtcacaggcctgcgggagccagggtgggcagccacagggctgcgtaagggggtccagcacatcttccgggtcctcagcaccactgtcaagagcagcagcaagccctcacccccttctgagcctgtgcagctgctggagcacggcccaaccctggaggaggcccctgccatgctggacaaaccagacatcgtgtatgtggtggagggacagcctgccagcgtcaccgtcacattcaaccatgtggaggcccaggtcgtctggaggagctgccgaggggccctcctagaggcacgggccggtgtgtacgagctgagccagccagatgatgaccagtactgtcttcggatctgccgggtgagccgccgggacatgggggccctcacctgcaccgcccgaaaccgtcacggcacacagacctgctcggtcacattggagctggcagaggcccctcggtttgagtccatcatggaggacgtggaggtgggggctggggaaactgctcgctttgcggtggtggtcgagggaaaaccactgccggacatcatgtggtacaaggacgaggtgctgctgaccgagagcagccatgtgagcttcgtgtacgaggagaatgagtgctccctggtggtgctcagcacgggggcccaggatggaggcgtctacacctgcaccgcccagaacctggcgggtgaggtctcctgcaaagcagagttggctgtgcattcagctcagacagctatggaggtcgagggggtcggggaggatgaggaccatcgaggaaggagactcagcgacttttatgacatccaccaggagatcggcaggggtgctttctcctacttgcggcgcatagtggagcgtagctccggcctggagtttgcggccaagttcatccccagccaggccaagccaaaggcatcagcgcgtcgggaggcccggctgctggccaggctccagcacgactgtgtcctctacttccatgaggccttcgagaggcgccggggactggtcattgtcaccgagctctgcacagaggagctgctggagcgaatcgccaggaaacccaccgtgtgtgagtctgagatccgggcctatatgcggcaggtgctagagggaatacactacctgcaccagagccacgtgctgcacctcgatgtcaagcctgagaacctgctggtgtgggatggtgctgcgggcgagcagcaggtgcggatctgtgactttgggaatgcccaggagctgactccaggagagccccagtactgccagtatggcacacctgagtttgtagcacccgagattgtcaatcagagccccgtgtctggagtcactgacatctggcctgtgggtgttgttgccttcctctgtctgacaggaatctccccgtttgttggggaaaatgaccggacaacattgatgaacatccgaaactacaacgtggccttcgaggagaccacattcctgagcctgagcagggaggcccggggcttcctcatcaaagtgttggtgcaggaccggctgagacctaccgcagaagagaccctagaacatccttggttcaaaactcaggcaaagggcgcagaggtgagcacggatcacctgaagctattcctctcccggcggaggtggcagcgctcccagatcagctacaaatgccacctggtgctgcgccccatccccgagctgctgcgggcccccccagagcgggtgtgggtgaccatgcccagaaggccaccccccagtggggggctctcatcctcctcggattctgaagaggaagagctggaagagctgccctcagtgccccgcccactgcagcccgagttctctggctcccgggtgtccctcacagacattcccactgaggatgaggccctggggaccccagagactggggctgccacccccatggactggcaggagcagggaagggctccctctcaggaccaggaggctcccagcccagaggccctcccctccccaggccaggagcccgcagctggggctagccccaggcggggagagctccgcaggggcagctcggctgagagcgccctgccccgggccgggccgcgggagctgggccggggcctgcacaaggcggcgtctgtggagctgccgcagcgccggagccccagcccgggagccacccgcctggcccggggaggcctgggtgagggcgagtatgcccagaggctgcaggccctgcgccagcggctgctgcggggaggccccgaggatggcaaggtcagcggcctcaggggtcccctgctggagagcctggggggccgtgctcgggacccccggatggcacgagctgcctccagcgaggcagcgccccaccaccagcccccactcgagaaccggggcctgcaaaagagcagcagcttctcccagggtgaggcggagccccggggccggcaccgccgagcgggggcgcccctcgagatccccgtggccaggcttggggcccgtaggctacaggagtctccttccctgtctgccctcagcgaggcccagccatccagccctgcacggcccagcgcccccaaacccagtacccctaagtctgcagaaccttctgccaccacacctagtgatgctccgcagccccccgcaccccagcctgcccaagacaaggctccagagcccaggccagaaccagtccgagcctccaagcctgcaccacccccccaggccctgcaaaccctagcgctgcccctcacaccctatgctcagatcattcagtccctccagctgtcaggccacgcccagggcccctcgcagggccctgccgcgccgccttcagagcccaagccccacgctgctgtctttgccagggtggcctccccacctccgggagcccccgagaagcgcgtgccctcagccgggggtcccccggtgctagccgagaaagcccgagttcccacggtgccccccaggccaggcagcagtctcagtagcagcatcgaaaacttggagtcggaggccgtgttcgaggccaagttcaagcgcagccgcgagtcgcccctgtcgctggggctgcggctgctgagccgttcgcgctcggaggagcgcggccccttccgtggggccgaggaggaggatggcatataccggcccagcccggcggggaccccgctggagctggtgcgacggcctgagcgctcacgctcggtgcaggacctcagggctgtcggagagcctggcctcgtccgccgcctctcgctgtcactgtcccagcggctgcggcggacccctcccgcgcagcgccacccggcctgggaggcccgcggcggggacggagagagctcggagggcgggagctcggcgcggggctccccggtgctggcgatgcgcaggcggctgagcttcaccctggagcggctgtccagccgattgcagcgcagtggcagcagcgaggactcggggggcgcgtcgggccgcagcacgccgctgttcggacggcttcgcagggccacgtccgagggcgagagtctgcggcgccttggccttccgcacaaccagttggccgcccaggccggcgccaccacgccttccgccgagtccctgggctccgaggccagcgccacgtcgggctcctcagccccaggggaaagccgaagccggctccgctggggcttctctcggccgcggaaggacaaggggttatcgccaccaaacctctctgccagcgtccaggaggagttgggtcaccagtacgtgcgcagtgagtcagacttccccccagtcttccacatcaaactcaaggaccaggtgctgctggagggggaggcagccaccctgctctgcctgccagcggcctgccctgcaccgcacatctcctggatgaaagacaagaagtccttgaggtcagagccctcagtgatcatcgtgtcctgcaaagatgggcggcagctgctcagcatcccccgggcgggcaagcggcacgccggtctctatgagtgctcggccaccaacgtactgggcagcatcaccagctcctgtaccgtggctgtggcccgagtcccaggaaagctagctcctccagaggtaccccagacctaccaggacacggcgctggtgctgtggaagccgggagacagccgggcaccttgcacgtatacgctggagcggcgagtggatggggagtctgtgtggcaccctgtgagctcaggcatccccgactgttactacaacgtgacccacctgccagttggcgtgactgtgaggttccgtgtggcctgtgccaaccgtgctgggcaggggcccttcagcaactcttctgagaaggtctttgtcaggggtactcaagattcttcagctgtgccatctgctgcccaccaagaggcccctgtcacctcaaggccagccagggcccggcctcctgactctcctacctcactggccccacccctagctcctgctgcccccacacccccgtcagtcactgtcagcccctcatctccccccacacctcctagccaggccttgtcctcgctcaaggctgtgggtccaccaccccaaacccctccacgaagacacaggggcctgcaggctgcccggccagcggagcccaccctacccagtacccacgtcaccccaagtgagcccaagcctttcgtccttgacactgggaccccgatcccagcctccactcctcaaggggttaaaccagtgtcttcctctactcctgtgtatgtggtgacttcctttgtgtctgcaccaccagcccctgagcccccagcccctgagccccctcctgagcctaccaaggtgactgtgcagagcctcagcccggccaaggaggtggtcagctcccctgggagcagtccccgaagctctcccaggcctgagggtaccactcttcgacagggtccccctcagaaaccctacaccttcctggaggagaaagccaggggccgctttggtgttgtgcgagcgtgccgggagaatgccacggggcgaacgttcgtggccaagatcgtgccctatgctgccgagggcaagcggcgggtcctgcaggagtacgaggtgctgcggaccctgcaccacgagcggatcatgtccctgcacgaggcctacatcacccctcggtacctcgtgctcattgctgagagctgtggcaaccgggaactcctctgtgggctcagtgacaggttccggtattctgaggatgacgtggccacttacatggtgcagctgctacaaggcctggactacctccacggccaccacgtgctccacctagacatcaagccagacaacctgctgctggcccctgacaatgccctcaagattgtggactttggcagtgcccagccctacaacccccaggcccttaggccccttggccaccgcacgggcacgctggagttcatggctccggagatggtgaagggagaacccatcggctctgccacggacatctggggagcgggtgtgctcacttacattatgctcagtggacgctccccgttctatgagccagacccccaggaaacggaggctcggattgtggggggccgctttgatgccttccagctgtaccccaatacatcccagagcgccaccctcttcttgcgaaaggttctctctgtacatccctggagccggccctccctgcaggactgcctggcccacccatggttgcaggacgcctacctgatgaagctgcgccgccagacgctcaccttcaccaccaaccggctcaaggagttcctgggcgagcagcggcggcgccgggctgaggctgccacccgccacaaggtgctgctgcgctcctaccctggcggcccctagaggcacggaccacagccaggcctcgggcttcaactggggttcccaccaatgccacgggacattccagggcccacgctgagccaggcgggcctggggcttcggttaccaccagcagcaacatctggctgggctcttacctcatagaccttcaaggacagagaccccagggcctggacctgatgccaccccaggccaaagccagagtgggagacccattggtcaggctcagcagggtgggaacaggcagagggacaagaggggaatggagaagtggagaggaaaaggaatcgagggacaggaagggggaggctctaggaaggttctgggttgggggtcagtgcatctcagggagaaccaaggaaggtgggcatggctggagaggaggaaaaggaaggagccccaggtgtcagggcagtaggctgggagtcagtgtggcaaagcgggggcaggacacagatacagtggcaggggcccagggctgggacatgagagaaggcagcgaggcggcagagggagaagagaggactcaggtggaggtggggtgggtcagctgtcagcatccctcagaggagaaatgtggagagctggaggccagcagtcactcacactcgctctgtcctcctgtccagtggatacagccctgggcgctctgctggcccaaggatgtccccactgcccctccatggcctctggccttcttcccattcatatttatttatttattgacttttatgaagtttccccttccatccgatccctactgcccatgttgtcctgaccatccctcccagccatccagctgtctgtctgtctgccacaaggaaataaaaatggcaagcagcataa

SEQ ID NO: 2192 - DNA, 1086 bp, Homo sapiens
tccctcgagcgtttgggggtgcaagctgtagggctgtggccaacaggtgggtctacatcccctttcagcagccccatcacctccgacgaggaatacctgagccccccagaggagttcccagagcctggggagacctggccgcgaacccccaccatgaagcccagtcccagccagaaccgccgttcttctgacactggctccaaggcaccccccaccttcaaggtctcacttatggaccagtcagtaagagaaggccaagatgtcatcatgagcatccgcgtgcagggggagcccaagcctgtggtctcctggctgagaaaccgccagcccgtgcgcccagaccagcggcgctttgcggaggaggctgagggtgggctgtgccggctgcggatcctggctgcagagcgtggcgatgctggtttctacacttgcaaagcggtcaatgagtatggtgctcggcagtgcgaggcccgcttggaggtccgaggcgagtgagctcagggggccacctgtgctccccccgctaccctccgagccgcgcccctgtctcaggcacctctcggacctcgctgtgtttcactgcctcctgcccacagacccaggcctgccggcccggacccgtcccagcctcccctccccaccccatgcagcccccagggggatagcccatgggcccctgtggaccctccctccccaagtggacacatggctgtgcaggccaggaggcccacagatggactgagtgctgggaaggggcggctgcgaggggtatcaaccccccgagtctctccctgaaggggagcaccgggcgagtgcatgtgctactgctgctacaggcctgtctatctgtttgtctgtctgtgtgtctgtgacagtcagggaaggatgcctcggagctgaggtggggtgagacagagtgggagagattacggcatggcatggaggggcccaaggagcaggggctgttgacaaaggccttaccaggaagggttaggacactgaccattctagaaatgggtttcgaatggcacaacactttctatttcacaaaagaccaaaagccagaggccccaggctctgtgctga

SEQ ID NO: 2193 - DNA, 1457 bp, Homo sapiens
caacctcctccttcccctcctcaggcgccttcccctcccccagggccttctccgtgcagggcctcagctgggtcagccgagtgagtggggctgggcaggctggacaggctgggctcctgctccctggggagccacgctggggtgggcagtgggcaggcagcaggagggcctggtgccagggcagagccttcaggacaggcacaggctggggtctgtgtgcagagcctcggggtgggtctacatcccctttcagcagccccatcacctccgacgaggaatacctgagccccccagaggagttcccagagcctggggagacctggccgcgaacccccaccatgaagcccagtcccagccagaaccgccgttcttctgacactggctccaaggcaccccccaccttcaaggtctcacttatggaccagtcagtaagagaaggccaagatgtcatcatgagcatccgcgtgcagggggagcccaagcctgtggtctcctggctgagaaaccgccagcccgtgcgcccagaccagcggcgctttgcggaggaggctgagggtgggctgtgccggctgcggatcctggctgcagagcgtggcgatgctggtttctacacttgcaaagcggtcaatgagtatggtgctcggcagtgcgaggcccgcttggaggtccgaggcgagtgagctcagggggccacctgtgctccccccgctaccctccgagccgcgcccctgtctcaggcacctctcggacctcgctgtgtttcactgcctcctgcccacagacccaggcctgccggcccggacccgtcccagcctcccctccccaccccatgcagcccccagggggatagcccatgggcccctgtggaccctccctccccaagtggacacatggctgtgcaggccaggaggcccacagatggactgagtgctgggaaggggcggctgcgaggggtatcaaccccccgagtctctccctgaaggggagcaccgggcgagtgcatgtgctactgctgctacaggcctgtctatctgtttgtctgtctgtgtgtctgtgacagtcagggaaggatgcctcggagctgaggtggggtgagacagagtgggagagattacggcatggcatggaggggcccaaggagcaggggctgttgacaaaggccttaccaggaagggttaggacactgaccattctagaaatgggtttcgaatggcacaacactttctatttcacaaaagaccaaaagccagaggccccaggctctgtgctgatgaacagcctggctgagccctggccctggcaggtttagggcccatttggggccccctccttctctgtcagggctggggtgctctgtctgggaatgagggagttaaccaagtttggtgcaggagcaggggcagggggccactgtagtgagcgtggagaaatttggaaacacctatttcttaactcaa

SEQ ID NO: 2194 - DNA, 1274 bp, Homo sapiens
ccgaggtcgggatgtgacttgtctgcggtgggtctacatcccctttcagcagccccatcacctccgacgaggaatacctgagccccccagaggagttcccagagcctggggagacctggccgcgaacccccaccatgaagcccagtcccagccagaaccgccgttcttctgacactggctccaaggcaccccccaccttcaaggtctcacttatggaccagtcagtaagagaaggccaagatgtcatcatgagcatccgcgtgcagggggagcccaagcctgtggtctcctggctgagaaaccgccagcccgtgcgcccagaccagcggcgctttgcggaggaggctgagggtgggctgtgccggctgcggatcctggctgcagagcgtggcgatgctggtttctacacttgcaaagcggtcaatgagtatggtgctcggcagtgcgaggcccgcttggaggtccgaggcgagtgagctcagggggccacctgtgctccccccgctaccctccgagccgcgcccctgtctcaggcacctctcggacctcgctgtgtttcactgcctcctgcccacagacccaggcctgccggcccggacccgtcccagcctcccctccccaccccatgcagcccccagggggatagcccatgggcccctgtggaccctccctccccaagtggacacatggctgtgcaggccaggaggcccacagatggactgagtgctgggaaggggcggctgcgaggggtatcaaccccccgagtctctccctgaaggggagcaccgggcgagtgcatgtgctactgctgctacaggcctgtctatctgtttgtctgtctgtgtgtctgtgacagtcagggaaggatgcctcggagctgaggtggggtgagacagagtgggagagattacggcatggcatggaggggcccaaggagcaggggctgttgacaaaggccttaccaggaagggttaggacactgaccattctagaaatgggtttcgaatggcacaacactttctatttcacaaaagaccaaaagccagaggccccaggctctgtgctgatgaacagcctggctgagccctggccctggcaggtttagggcccatttggggccccctccttctctgtcagggctggggtgctctgtctgggaatgagggagttaaccaagtttggtgcaggagcaggggcagggggccactgtagtgagcgtggagaaatttggaaacacctatttcttaactcaaataaagtccagtttgtaccta

SEQ ID NO: 2195 - DNA, 3211 bp, Homo sapiens
atgaagaagctgtgggtgaagaagcgtttccagaaaaccggccattcccgccgggcctttggccgactcacccatgaaagcaaagttacgactcagagacggctgaggatgacatcagcgatgtgcagggaacccagcgcctggagcttcgggatgacggggccttcagcacccccacggggggttctgacaccctggtgggcacctccctggacacacccccgacctccgtgacaggcacctcagaggagcaagtgagctggtggggcagcgggcagacggtcctggagcaggaagcgggcagtgggggtggcacccgccgcctcccgggcagcccaagcagcgtccctcagagcgggttgcgcagggaggagcccgaccttcagcctcaactggccagcgaagccccacgccgccctgcccagccgcctccttccaaatccgcgctgctccccccaccgtcccctcgggtcgggaagcggtccccgccgggacccccggcccagcccgcggccacccccacgtcgccccaccgtcgcactcaggagcctgtgctgcccgaggacaccaccaccgaagagaagcgagggaagaagtccaagtcgtccgggccctccctggcgggcaccgcggaatcccgaccccagacgccactgagcgaggcctcaggccgcctgtcggcgttgggccgatcgcctaggctggtgcgcgccggctcccgcatcctggacaagctgcagttcttcgaggagcgacggcgcagcctggagcgcagcgactcgccgccggcgcccctgcggccctgggtgcccctgcgcaaggcccgctctctggagcagcccaagtcggagcgcggcgcaccgtggggcacccccggggcctcgcaggaagaactgcgggcgccaggcagcgtggccgagcggcgccgcctgttccagcagaaagcggcctcgctggacgagcgcacgcgtcagcgcagcccggcctcagacctcgagctgcgcttcgcccaggagctgggccgcatccgccgctccacgtcgcgggaggagctggtgcgctcgcacgagtccctgcgcgccacgctgcagcgtgccccatcccctcgagagcccggcgagcccccgctcttctctcggccctccacccccaagacatcgcgggccgtgagccccgccgccgcccagccgccctctccgagcagcgcggagaagccgggggacgagcctgggaggcccaggagccgcgggccggcgggcaggacagagccgggggaaggcccgcagcaggaggttaggcgtcgggaccaattcccgctgacccggagcagagccatccaggagtgcaggagccctgtgccgccccccgccgccgatcccccagaggccaggacgaaagcaccccccggtcggaagcgggagcccccggcgcaggccgtgcgcttcctgccctgggccacgccgggcctggagggcgctgctgtaccccagaccttggagaagaacagggcggggcctgaggcagagaagaggcttcgcagagggccggaggaggacggtccctgggggccctgggaccgccgaggggcccgcagccagggcaaaggtcgccgggcccggcccacctcccctgagctcgagtcttcggatgactcctacgtgtccgctggagaagagcccctagaggcccctgtgtttgagatccccctgcagaatgtggtggtggcaccaggggcagatgtgctgctcaagtgtatcatcactgccaaccccccgccccaagtgtcctggcacaaggatgggtcagcgctgcgcagcgagggccgcctcctcctccgggctgagggtgagcggcacaccctgctgctcagggaggccagggcagcagatgccgggagctatatggccaccgccaccaacgagctgggccaggccacctgtgccgcctcactgaccgtgagacccggtgggtctacatcccctttcagcagccccatcacctccgacgaggaatacctgagccccccagaggagttcccagagcctggggagacctggccgcgaacccccaccatgaagcccagtcccagccagaaccgccgttcttctgacactggctccaaggcaccccccaccttcaaggtctcacttatggaccagtcagtaagagaaggccaagatgtcatcatgagcatccgcgtgcagggggagcccaagcctgtggtctcctggctgagaaaccgccagcccgtgcgcccagaccagcggcgctttgcggaggaggctgagggtgggctgtgccggctgcggatcctggctgcagagcgtggcgatgctggtttctacacttgcaaagcggtcaatgagtatggtgctcggcagtgcgaggcccgcttggaggtccgaggcgagtgagctcagggggccacctgtgctccccccgctaccctccgagccgcgcccctgtctcaggcacctctcggacctcgctgtgtttcactgcctcctgcccacagacccaggcctgccggcccggacccgtcccagcctcccctccccaccccatgcagcccccagggggatagcccatgggcccctgtggaccctccctccccaagtggacacatggctgtgcaggccaggaggcccacagatggactgagtgctgggaaggggcggctgcgaggggtatcaaccccccgagtctctccctgaaggggagcaccgggcgagtgcatgtgctactgctgctacaggcctgtctatctgtttgtctgtctgtgtgtctgtgacagtcagggaaggatgcctcggagctgaggtggggtgagacagagtgggagagattacggcatggcatggaggggcccaaggagcaggggctgttgacaaaggccttaccaggaagggttaggacactgaccattctagaaatgggtttcgaatggcacaacactttctatttcacaaaagaccaaaagccagaggccccaggctctgtgctgatgaacagcctggctgagccctggccctggcaggtttagggcccatttggggccccctccttctctgtcagggctggggtgctctgtctgggaatgagggagttaaccaagtttggtgcaggagcaggggcagggggccactgtagtgagcgtggagaaatttggaaacacctatttcttaactcaaataaagtccagtttgtacct

SEQ ID NO: 2196 - DNA, 1023 bp, Homo sapiens
aagacgcaccgccccctctcagtcactcccaagatggcggacctactgggctccatcctgagctccatggagaagccacccagcctcggtgaccaggagactcggcgcaaggcccgagaacaggccgcccgcctgaagaaactacaagagcaagagaaacaacagaaagtggagtttcgtaaaaggatggagaaggaggtgtcagatttcattcaagacagtgggcagatcaagaaaaagtttcagccaatgaacaagatcgagaggagcatactacatgatgtggtggaagtggctggcctgacatccttctcctttggggaagatgatgactgtcgctatgtcatgatcttcaaaaaggagtttgcaccctcagatgaagagctagactcttaccgtcgtggagaggaatgggacccccagaaggctgaggagaagcggaagctgaaggagctggcccagaggcaagaggaggaggcagcccagcaggggcctgtggtggtgagccctgccagcgactacaaggacaagtacagccacctcatcggcaagggagcagccaaagacgcagcccacatgctacaggccaataagacctacggctgtgtgcccgtggccaataagagggacacacgctccattgaagaggctatgaatgagatcagagccaagaagcgtctgcggcagagtggggaagagttgccgccaacctcctaggcgccccgcccagctccctttgacccctggggcagggcagggggcagggagagacaaggctgctgctattagagcccatcctggagccccacctctgaaccacctcctaccagctgtccctcaggctgggggaaaacaggtgtttgatttgtcaccgttggagcttggatatgtgcgtggcatgtgtgtgtgtgtgtgagagtgtgaatgcacaggtgggtatttaatctgtattattccccgttcttggaattttcttccccatggggctggggtactttacattcaataaatactgtttaaccc

SEQ ID NO: 2197 - DNA, 2193 bp, Homo sapiens
ttagtgcagggggcgggcccgggacgcagcggctgtggagctcctcctgctgggaggctgccccaggacccagcacgtgcgcagcggccatggcttcctcaattatctgccaggagcactgccagatctcgggccaggcaaaaatagacatcttattagttggagatgtcactgtgggctacctggctgatactgtacagaaactatttgcaaacatagcagaagtcaccatcaccatcagtgacacgaaggaggcagcagcgcttttggatgattgcatattcaacatggttctcttgaaggtgccttcttcactaagtgccgaggagctggaagccatcaagttaattagatttggcaaaaagaaaaatacacattcactgtttgtttttataatccctgaaaattttaaaggttgtatttcagggcatggaatggatattgctttaactgaaccactgacaatggaaaaaatgagtaatgtggtaaaatactggacaacatgtccctcaaacactgttaagactgaaaacgcaactgggcctgaagaacttggattgcccctgcagaggtcctacagcgaacacctgggatattttcctactgatctatttgcctgctctgaatctttaaggaatggcaatgggcttgaattaaatgcttcgttgtcagagttcgagaaaaacaaaaagatctctcttcttcattcaagcaaggaaaaactaagaagggaaagaatcaaatattgctgtgagcagctgcgtactctcttgccgtatgtaaaagggagaaagaatgatgcggcttcagttcttgaggcaacagttgattatgtgaaatatatccgggagaaaatctctccagccgttatggcccagattacagaagcacttcagagcaacatgaggttttgtaagaaacaacaaacacccattgagctgtctctcccaggcactgtcatggcacagcgggaaaacagtgtgatgagcacttactcccctgagagagggctccaattcctgactaatacgtgctggaatgggtgctccactcctgatgcagagagctccttggatgaagctgtgagagttccatcaagctccgcctcagagaatgctattggtgatccatataaaactcacatttccagtgcagcgctgtctctgaattccttgcatactgtcagatattattctaaagtcaccccttcctacgatgcaactgctgtaacaaatcagaacatttcaattcatttaccttcagccatgcccccggtctcaaagcttctccctcggcactgcacttctgggttgggccagacgtgcactacacatcccaactgtctgcaacagttttgggcgtattaaaagcacatgtttgaaattcacactctcaaccacctactgggcgcagtttgacaatctaggaaaagtggaacaaagaatgattttgaaagctccacccaaagacctaatatcaaaagagttggcatggtttggcttctgataaatgcactcaaagcttctgcagatagaaagaccagcagcgaaaaagctggccacacactgtcactcatcttcatacacacttggatccccgccagccagagagctacaagaacaaatggcctcagtgacctacactctcttttctcaaaaaatattccacaatttatgaaaaaagcatgctataaggaagatccatgtagacacgataaaatgattagattgggaaggtgtgttgataccttgtgtcactgagtacagatattacaacttgattcttatttttagtatccctgtgaattactgtcactcatttctaggtggtcttttccttatttgacattttagagagtttccttcttcattcaccatccaaactaagatatgcagagagatgctgaaagaggggtttacctcctcacttgacaactaatgaataaattgatgtgtgcttttgcatttcacaatcccttgagtgaaacgatggctaataggtaaatatttctttctggaccttaagttacagactagcaggttttttgtttttcatctcttcctccctatgggtattagaaaggacagttgaaaataagggggaaaaaggtttgttttatatttcactgaattgttcttatatgtaagttttattattaaataaaatactcagttttcaccctgagcattgtaa

SEQ ID NO: 2198 - DNA, 2051 bp, Homo sapiens; identical to SEQ ID NO: 296

SEQ ID NO: 2199 - DNA, 1152 bp, Homo sapiens
gccaccgccagcagggaggcggagggctagcgagccaagcggtggggacgccgctgccttcctctttgcctgtctcgccgccctcctagacacgctcctcatctacggatcctaccctccccgctcttgcaagcattcactcggccggtcgcctgctgaccctccttcgccacaggctcgtagcggaggcagcagcgagcaggcatgaagacccccaacgcacaggaagccgaagggcaacaaaccagggcagctgcaggacgggccactgggtctgcaaacatgacaaagaaaaaagtctcccaaaagaagcagagaggccgaccttcatcccagccccgcaggaacatcgtgggctgcagaatttctcatggatggaaggaaggagatgagcccatcacgcagtggaaaggaaccgttctggatcaggtgcctataaatccctctctttatctggtgaaatatgatggaattgactgtgtctatggactggaacttcacagagatgaaagggttttgtctcttaaaattctttctgacagggtggcatcatctcacattagtgatgccaaccttgcaaataccataattggcaaagcagtggaacatatgtttgagggagagcatggttctaaggatgaatggagggggatggtcttagctcaagcacctatcatgaaagcctggttttatattacctatgagaaagatcctgtcttgtacatgtaccagcttctagatgattataaggaaggtgacctccgcatcatgccagaatccagtgagtctcctccaacagagagggagccaggaggagttgtagatggcctaataggtaagcatgtggaatataccaaagaagatggctccaaaaggatcggcatggtcattcaccaagtggaagccaaaccctctgtgtatttcatcaagtttgatgatgatttccatatctatgtctacgatttggtgaaaaagtcctaactgttagggtaaaatttggcacatgtgtggaaacaaatgtataatttgtagacatgcaaaaaatgttgcctttcagtgtattgaaagcttatggaatccctgataactaaacatctttgccagcattaactgttgttttgctctaaaaaatacaaacttgtgtgtacatga

SEQ ID NO: 2200 - DNA, 1258 bp, Homo sapiens
gagactgccgcggcgacagcagggactggtggaatcccgatgtggctgaggggccgccaccgccagcagggaggcggagggctagcgagccaagcggtggggacgccgctgccttcctctttgcctgtctcgccgccctcctagacacgctcctcatctacggatcctaccctccccgctcttgcaagcattcactcggccggtcgcctgctgaccctccttcgccacaggctcgtagcggaggcagcagcgaggtgtccgatttgggcacgtgaggcccgcgatccccggcggtggacgccaggcagggcatgaagacccccaacgcacaggaagccgaagggcaacaaaccagggcagctgcaggacgggccactgggtctgcaaacatgacaaagaaaaaagtctcccaaaagaagcagagaggccgaccttcatcccagccccgcaggaacatcgtgggctgcagaatttctcatggatggaaggaaggagatgagcccatcacgcagtggaaaggaaccgttctggatcaggtgcctataaatccctctctttatctggtgaaatatgatggaattgactgtgtctatggactggaacttcacagagatgaaagggttttgtctcttaaaattctttctgacagggtggcatcatctcacattagtgatgccaaccttgcaaataccataattggcaaagcagtggaacatatgtttgagggagagcatggttctaaggatgaatggagggggatggtcttagctcaagcacctatcatgaaagcctggttttatattacctatgagaaagatcctgtcttgtacatgtaccagcttctagatgattataaggaaggtgacctccgcatcatgccagaatccagtgagtctcctccaacagagagggagccaggaggagttgtagatggcctaataggtaagcatgtggaatataccaaagaagatggctccaaaaggatcggcatggtcattcaccaagtggaagccaaaccctctgtgtatttcatcaagtttgatgatgatttccatatctatgtctacgatttggtgaaaaagtcctaactgttagggtaaaatttggcacatgtgtggaaacaaatgtataatttgtagacatgcaaaaaatgttgcctttcagtgtattgaaagcttatggaatccctgataactaaacatctttgccagcattaactgttgttttgctctaaaaaatacaaacttgtgtgtacatg

SEQ ID NO: 2201 - DNA, 725 bp, Homo sapiens
ctcgtagcggaggcagcagcgaggtgtccgatttgggcacgtgaggcccgcgatccccggcggtggacgccaggcagggcatgaagacccccaacgcacaggaagccgaagggcaacaaaccagggcagctgcaggacgggccactgggtctgcaaacatgacaaagaaaaaagtctcccaaaagaagcagagaggccgaccttcatcccagccccgcaggaacatcgtgggctgcagaatttctcatggatggaaggaaggagatgagcccatcacgcagtggaaaggaaccgttctggatcagcttctagatgattataaggaaggtgacctccgcatcatgccagaatccagtgagtctcctccaacagagagggagccaggaggagttgtagatggcctaataggtaagcatgtggaatataccaaagaagatggctccaaaaggatcggcatggtcattcaccaagtggaagccaaaccctctgtgtatttcatcaagtttgatgatgatttccatatctatgtctacgatttggtgaaaaagtcctaactgttagggtaaaatttggcacatgtgtggaaacaaatgtataatttgtagacatgcaaaaaatgttgcctttcagtgtattgaaagcttatggaatccctgataactaaacatctttgccagcattaactgttgttttgctctaaaaaatacaaacttgtgtgtacatga

SEQ ID NO: 2202 - DNA, 1205 bp, Homo sapiens
ggagactgccgcggcgacagcagggactggtggaatcccgatgtggctgaggggccgccaccgccagcagggaggcggagggctagcgagccaagcggtggggacgccgctgccttcctctttgcctgtctcgccgccctcctagacacgctcctcatctacggatcctaccctccccgctcttgcaagcattcactcggccggtcgcctgctgaccctccttcgccacaggctcgtagcggaggcagcagcgaggcatgaagacccccaacgcacaggaagccgaagggcaacaaaccagggcagctgcaggacgggccactgggtctgcaaacatgacaaagaaaaaagtctcccaaaagaagcagagaggccgaccttcatcccagccccgcaggaacatcgtgggctgcagaatttctcatggatggaaggaaggagatgagcccatcacgcagtggaaaggaaccgttctggatcaggtgcctataaatccctctctttatctggtgaaatatgatggaattgactgtgtctatggactggaacttcacagagatgaaagggttttgtctcttaaaattctttctgacagggtggcatcatctcacattagtgatgccaaccttgcaaataccataattggcaaagcagtggaacatatgtttgagggagagcatggttctaaggatgaatggagggggatggtcttagctcaagcacctatcatgaaagcctggttttatattacctatgagaaagatcctgtcttgtacatgtaccagcttctagatgattataaggaaggtgacctccgcatcatgccagaatccagtgagtctcctccaacagagagggagccaggaggagttgtagatggcctaataggtaagcatgtggaatataccaaagaagatggctccaaaaggatcggcatggtcattcaccaagtggaagccaaaccctctgtgtatttcatcaagtttgatgatgatttccatatctatgtctacgatttggtgaaaaagtcctaactgttagggtaaaatttggcacatgtgtggaaacaaatgtataatttgtagacatgcaaaaaatgttgcctttcagtgtattgaaagcttatggaatccctgataactaaacatctttgccagcattaactgttgttttgctctaaaaaatacaaacttgtgtgtacatga

SEQ ID NO: 2203 - DNA, 1050 bp, Homo sapiens
actgccgcggcgacagcagggactggtggaatcccgatgtggctgaggggccgccaccgccagcagggaggcggagggctagcgagccaagcggtggggacgccgctgccttcctctttgcctgtctcgccgccctcctagacacgctcctcatctacggatcctaccctccccgctcttgcaagcattcactcggccggtcgcctgctgaccctccttcgccacaggctcgtagcggaggcagcagcgaggtgtccgatttgggcacgtgaggcccgcgatccccggcggtggacgccaggcagggcatgaagacccccaacgcacaggaagccgaagggcaacaaaccagggcagctgcaggacgggccactgggtctgcaaacatgacaaagaaaaaagtctcccaaaagaagcagagaggccgaccttcatcccagccccgcaggaacatcgtgggctgcagaatttctcatggatggaaggaaggagatgagcccatcacgcagtggaaaggaaccgttctggatcaggtgcctataaatccctctctttatctggtgaaatatgatggaattgactgtgtctatggactggaacttcacagagatgaaagggttttgtctcttaaaattctttctgacagggtggcatcatctcacattagtgatgccaaccttgcaaataccataattggcaaagcagtggaacatatgtttgagggagagcatggttctaaggatgaatggagggggatggtcttagctcaagcacctatcatgaaagcctggttttatattacctatgagaaagatcctgtcttgtacatgtaccagcttctagatgattataaggaaggtgacctccgcatcatgccagaatccagtgagtctcctccaacagagagggagccaggaggagttgtagatggcctaataggtaagcatgtggaatataccaaagaagatggctccaaaaggatcggcatggtcattcaccaagtggaagccaaaccctctgtgtatttcatcaagtttgatgatgatttcc

SEQ ID NO: 2204 - DNA, 3673 bp, Homo sapiens
gcagttttagtagagacggggtttcaccgtgttagacaggatggtctcaatctcctgatctcgttggatgcacagtattttatttaacatattcgctgccgatagacaagtcgtttctacacgtgaatttcttttttttttttttttttgagactgagtctcattctgtcgcccaggctggagtgcagtggcacgatctcagctgacggcaacctctgcttcccgggttcaagcgattctcctgcctcagcctccggagtagctgggactacaggcgcctgccatcacgcccggctaatttttgtttgtttgtttttagtagagacggggtttcaccatgttagccagcctggtcgtctcgaacctctgacctcaagtgatccgcccgcctcggcctcccaaagtgttgggattacaggcgtgagctaccgcgcccggcctcacatgtgaatttttttaaaaacaccaccagcaaaaccccactattcccattttcctgagaaagacgctgaggtccagagaaagagaaaacgttctcataatttatgctgaaagctgcgtcctcaagttccggtttcccaactcccatccgcactccaactgctcgcgcagtccacacaggatacctgcccgccaagccggccccagcaagccgcaggaagccgtccgctgaacctcaggttcttgggttttcctatgccccctggaggcatctgcgaacctctcggcatcgctccaccacacctcccaccagcaggtggcactgttgccatctccataacatggactggccttccttgtggtgctcctgttttcttaagtcccggggcacttccggcactcgcggaactttggtgcagcctgatgcgcaacgtggggactcaggcgcgctgggcggcaggagttgcttccggccgtgttggtggtctgaattgagaagccgcgactaagggaagatggagacaatactggagcagcagcggcgctatcatgaggagaaggaacggctcatggacgtcatggctaaagagatgctcaccaagaagtccacgctccgggaccagatcaattctgatcaccgcactcgggccatgcaagataggtatatggaggtcagtgggaacctgagggatttgtatgatgataaggatggattacgaaaggaggagctcaatgccatttcaggacccaatgagtttgctgaattctataatagactcaagcaaataaaggaattccaccggaagcacccaaatgagatctgtgtgccaatgtcagtggaatttgaggaactcctgaaggctcgagagaatccaagtgaagaggcacaaaacttggtggagttcacagatgaagagggatatggtcgttatctcgatctccatgactgttacctcaagtacattaacctgaaggcatctgagaagctggattatatcacatacctgtccatctttgaccaattatttgacattcctaaagaaaggaagaatgcagagtataagagatacctagagatgctgcttgagtaccttcaggattacacagatagagtgaagcctctccaagatcagaatgaactttttgggaagattcaggctgagtttgagaagaaatgggagaatgggacctttcctggatggccgaaagagacaagcagtgccctgacccatgctggagcccatcttgacctctctgcattctcctcctgggaggagttggcttctctgggtttggacagattgaaatctgctctcttagctttaggcttgaaatgtggcgggaccctagaagagcgagcccagagactattcagtaccaaaggaaagtccctggagtcacttgatacctctttgtttgccaaaaatcccaagtcaaagggcaccaagcgagacactgaaaggaacaaagacattgcttttctagaagcccagatctatgaatatgtagagattctcggggaacagcgacatctcactcatgaaaatgtacagcgcaagcaagccaggacaggagaagagcgagaagaagaggaagaagagcagatcagtgagagtgagagtgaagatgaagagaacgagatcatttacaaccccaaaaacctgccacttggctgggatggcaaacctattccctactggctgtataagcttcatggcctaaatatcaactacaactgtgagatttgtggaaactacacctaccgagggcccaaagccttccagcgacactttgctgaatggcgtcatgctcatggcatgaggtgtttgggcatcccaaacactgctcactttgctaatgtgacacagattgaagatgctgtctccttgtgggccaaactgaaattgcagaaggcttcagaacgatggcagcctgacactgaggaagaatatgaagactcaagtgggaatgttgtgaataagaagacatacgaggatctgaaaagacaaggactgctctagtgttcagggatgtagctcagcttttgggctagcccaggcttccctaagatctgctttttctatttctcccaaccaaatcctcttaaagaccctttgctatgtagtctcatggtctagcatgcatcttgtagaaacaaggcatgctggcagattgcagggttgagatgtgttttatctgttttatattttaaaagattctgccagaaaataaaaccagaccttgttctaaagcccagggttatggaccaactcagtgcttcaggtcttaacgcctccatacctcttcctcaccaactttactagtagctgagatttaatgggcacctattatgctacatatcatgttaggtaaatctgacctgacctctttccccaccctcctttgttgctgcttccctgaatgagtattaccccaggatgaggtctgccatcagcttagttagccattgatgcaaatactagggaaagactaggaggatgagccagggttgctactaaggactaagtgtcgcaccaaggtttgccttttgtatttgcataaagaaaggagttggagctgggtgcagtggcttgtgcctgtagtcccagctacttgggaggctgaggcaggagggttgcttgagactagcctaggtaacatagtgagaccctgtctcattaaaaaaaaaaaaaaggcatggtggcacgcactgtagtcccagctactcaggagactgaggctagaagatcctttgaacctaggagtttgagaccagcctgggcgatatagtgaggccccatctcaaaaaaaaaaaaaggggggggggggggagttgggctgtgttggaatgggcctgcagcccaacaaacaagggaactaggaccgacagtgacttcaccagcttgctaggtcagaatgagagactggtgggtctgtctacctgtttcttctacaagatccctatttgactgtaaaagtagctaatactcacatgttctccaatcccaggtagccatggtagagttgggtagagttgagcagctgccccaggatccaaatgtggtgtctgaaatggaaagaactaaggcaaccaggaaggcactgatctgccttataagcacagtcatctgaaagtcaggcctgctgcaggacaggatcccccagagaccccatttgcctctcaacactcagaccttcaactgttttttaataaatctactttttaaaaaaa

SEQ ID NO: 2205 - DNA, 1538 bp, Homo sapiens
gagaagccgcgactaagggaagatggagacaatactggagcagcagcggcgctatcatgaggagaaggaacggctcatggacgtcatggctaaagagatgctcaccaagaagtccacgctccgggaccagatcaattctgatcaccgcactcgggccatgcaagatatctgtgtgccaatgtcagtggaatttgaggaactcctgaaggctcgagagaatccaagtgaagaggcacaaaacttggtggagttcacagatgaagagggatatggtcgttatctcgatctccatgactgttacctcaagtacattaacctgaaggcatctgagaagctggattatatcacatacctgtccatctttgaccaattatttgacattcctaaagaaaggaagaatgcagagtataagagatacctagagatgctgcttgagtaccttcaggattacacagatagagtgaagcctctccaagatcagaatgaactttttgggaagattcaggctgagtttgagaagaaatgggagaatgggacctttcctggatggccgaaagagacaagcagtgccctgacccatgctggagcccatcttgacctctctgcattctcctcctgggaggagttggcttctctgggtttggacagattgaaatctgctctcttagctttaggcttgaaatgtggcgggaccctagaagagcgagcccagagactattcagtaccaaaggaaagtccctggagtcacttgatacctctttgtttgccaaaaatcccaagtcaaagggcaccaagcgagacactgaaaggaacaaagacattgcttttctagaagcccagatctatgaatatgtagagattctcggggaacagcgacatctcactcatgaaaatgtacagcgcaagcaagccaggacaggagaagagcgagaagaagaggaagaagagcagatcagtgagagtgagagtgaagatgaagagaacgagatcatttacaaccccaaaaacctgccacttggctgggatggcaaacctattccctactggctgtataagcttcatggcctaaatatcaactacaactgtgagatttgtggaaactacacctaccgagggcccaaagccttccagcgacactttgctgaatggcgtcatgctcatggcatgaggtgtttgggcatcccaaacactgctcactttgctaatgtgacacagattgaagatgctgtctccttgtgggccaaactgaaattgcagaaggcttcagaacgatggcagcctgacactgaggaagaatatgaagactcaagtgggaatgttgtgaataagaagacatacgaggatctgaaaagacaaggactgctctagtgttcagggatgtagctcagcttttgggctagcccaggcttccctaagatctgctttttctatttctcccaaccaaatcctcttaaagaccctttgctatgtagtctcatggtctagcatgcatcttgtagaaacaaggcatgctggcagattgcagggttgagatgtg

SEQ ID NO: 2206 - DNA, 737 bp, Homo sapiens
tcttctgcgacggcgcggacctggagcttccgcgcggtggcttcactctcctgtaaaacgctagagcggcgagttgttacctgcgtcctctgacctgagagcgaaggggaaagcggcgagatgactgaccgctacaccatccatagccagctggagcacctgcagtccaagtacatcggcacgggccacgccgacaccaccaagtgggagtggctggtgaaccaacaccgcgactcgtactgctcctacatgggccacttcgaccttctcaactacttcgccattgcggagaatgagagcaaagcgcgagtccgcttcaacttgatggaaaagatgcttcagccttgtggaccgccagccgacaagcccgaggagaactgagactctgccttaccaccgcagtgcggggcacctctcccagcgtttctccggtttgccaatcctcttaagtattcctgtctccaaaggaccggctctccatggctcctgcgcctcgtgctttccgcgtacagaagtgcttgcccggggagtcccgcctgacctgccttcatgtggacccttagaacagcactgggagaccagcaggactcctgagaactgtgctggtggagaggtcctagagccggcgagcgtttgagaagagggcatggcgctggagtgagatgggatttggcgtctcgtttttggctaattgattgtcattggctttttccataaagtttagaaatcgttcagtc

SEQ ID NO: 2207 - DNA, 3219 bp, Homo sapiens
cggggtctttgactgaaggggtaggccaagtggaggtatcagggacgtcgcgcggcacagaagaggaccagcctggacgccggggacgctgtcatgtacggcgcgagcgggggccgcgccaaacccgagaggaaaagcggcgcgaaggaggaggccgggccaggcggtgccggcggtgggggcagccgagtggagctcttggttttcggctatgcctgcaagctgttccgggacgacgagcgggccctggctcaggaacagggacagcacctcatcccctggatgggggaccacaagatcctcatcgacagatatgatggacgtggtcacctgcatgacctttctgagtacgatgctgagtattccacgtggaacagagattatcagctgtctgaagaggaggcgcgaatagaggccctgtgtgatgaagagaggtatttagccttgcatacggacttgcttgaggaggaggcaaggcaagaggaagaatacaagcgattgagtgaagcactagcagaggatgggagctacaatgccgtggggttcacttacggtagcgactattacgacccgtcagagccgacggaggaggaggagccttccaaacagagagaaaaaaatgaggccgaaaatttagaggaaaatgaagagcccttcgttgcccccttaggattgagcgtcccgtctgacgtggagttgccaccaaccgctaaaatgcacgccatcatcgagcgcacggccagcttcgtgtgcaggcagggagcacagtttgagatcatgctgaaggccaagcaggcccggaactcccagtttgactttctgcgcttcgaccactacctcaacccctactataagttcatccagaaagccatgaaagagggacgctacactgtcctggcagaaaacaaaagtgacgagaaaaaaaaatcaggagtcagctctgacaatgaagatgatgatgatgaagaagatgggaattaccttcatccctctctctttgcctccaagaagtgtaaccgccttgaagagctgatgaagcccttgaaggtagtggacccagatcatcccctcgcagcacttgttcgtaaggcacaggctgacagttccactcccaccccacacaacgcagacggtgcgcctgtgcagccctcccaggtggagtacacggcagactcgaccgtggcagccatgtattacagctactacatgctaccggacggcacttactgcctggcgccgccccctcccggaatcgacgtgactacttactacagcacccttcctgctggcgtgaccgtgtctaactcccctggagtgacgaccaccgccccaccacctcctgggaccacaccactaccgcccccaaccacagcagagactagcagcggggccacctccacaaccaccaccacaagtgcacttgcccccgtggccgccatcatccccccgccccccgacgtccagcccgtgattgacaagctggccgagtatgtcgccaggaacggcctgaagttcgagaccagtgttcgtgccaagaatgatcaaagatttgagttcctgcagccgtggcaccagtataatgcttattatgagtttaagaagcagttcttcctccagaaagaagggggcgatagcatgcaggctgtgtctgcaccagaagaggctcccacagactctgctcccgagaagccaagtgatgctggggaggatggcgcgcctgaagacgcagccgaggtgggagcacgggcaggctcaggcgggaagaaggaggcatcgtccagtaagaccgtcccggacgggaagctggtgaaagcttcctttgctccaataagctttgcaatcaaggccaaagaaaatgatctgcttcccctggaaaaaaatcgtgttaagctagatgatgacagtgatgatgatgaagaaagcaaagaaggccaagaaagttctagtagtgctgcaaacactaacccagcagttgccccaccctgtgtagttgttgaggagaagaagcctcaacttacccaggaggagctagaagcaaagcaagcaaagcaaaagctggaagatcgcctcgcagctgctgcccgggaaaagctggcccaggcgtctaaggagtcaaaagagaaacagcttcaagcagaacgtaaaaggaaagcggcgttatttttacagaccctcaaaaatcctctgccggaagcagaagctgggaaaattgaggagagtcctttcagtgtcgaggaatccagcactacgccctgccctctactgactggaggcaggcctctgcctactttagaagttaaaccacccgataggccttcgagcaaaagcaaagatccaccgagagaagaagagaaagaaaagaaaaagaaaaagcacaaaaaaagatctcgaacaagatcacgttctcccaagtaccattcgtcatccaagtccaggtctagatcacactcaaaagcaaagcattctcttcccagtgcctatcggacagtgcggcggtcgagagtcacagcctccccagggacgctgcgcgcggagccctgtcagagcagcgcgtcagtgacagcggcagccgagccaggaagttatcaggcagcctcgaccaccaccagatttgactccgcgagctcttttgagggaaaacctggtaaaacgtcaaggtcccgctcccggtcccctcggaggagagcccactcccctgagagacggagggaagagaggagtgtgcccactgcctaccgcgtgagccgcagccctggggccagtaggaagcggacccgctccagaagtccccacgagaagaagaagaagaggcggtcccggtcgcggaccaagtccaaggccaggtctcagtcggtgtcacccagcaagcaggcagcgccccggcccgcggcccccgcggcccactcggcgcactcagccagcgtctcccctgtggagagtcggggctccagccaggagcgctccaggggagtctctcaggaaaaagaagcccagatctcttcagcaatcgtttcttccgtgcagagcaaaatcactcaggatctcatggccaaagtcagagcgatgcttgcagcttccaaaaacctgcaaaccagcgcttcctgagacggggccagcggaggcagagccgggaggctgcgtgggcttctgggcaggctcacgcagacgccggccacaccatccacctggccgcctccatggacccttggtggcttttgt

SEQ ID NO: 2208 - DNA, 3246 bp, Homo sapiens
cattttgtggcccgctatggcggcggtgttgaggttgggtacgggatgcggggtctttgactgaaggggtaggccaagtggaggtatcagggacgtcgcgcggcacagaagaggaccagcctggacgccggggacgctgtcatgtacggcgcgagcgggggccgcgccaaacccgagaggaaaagcggcgcgaaggaggaggccgggccaggcggtgccggcggtgggggcagccgagtggagctcttggttttcggctatgcctgcaagctgttccgggacgacgagcgggccctggctcaggaacagggacagcacctcatcccctggatgggggaccacaagatcctcatcgacagatatgatggacgtggtcacctgcatgacctttctgagtacgatgctgagtattccacgtggaacagagattatcagctgtctgaagaggaggcgcgaatagaggccctgtgtgatgaagagaggtatttagccttgcatacggacttgcttgaggaggaggcaaggcaagaggaagaatacaagcgattgagtgaagcactagcagaggatgggagctacaatgccgtggggttcacttacggtagcgactattacgacccgtcagagccgacggaggaggaggagccttccaaacagagagaaaaaaatgaggccgaaaatttagaggaaaatgaagagcccttcgttgcccccttaggattgagcgtcccgtctgacgtggagttgccaccaaccgctaaaatgcacgccatcatcgagcgcacggccagcttcgtgtgcaggcagggagcacagtttgagatcatgctgaaggccaagcaggcccggaactcccagtttgactttctgcgcttcgaccactacctcaacccctactataagttcatccagaaagccatgaaagagggacgctacactgtcctggcagaaaacaaaagtgacgagaaaaaaaaatcaggagtcagctctgacaatgaagatgatgatgatgaagaagatgggaattaccttcatccctctctctttgcctccaagaagtgtaaccgccttgaagagctgatgaagcccttgaaggtagtggacccagatcatcccctcgcagcacttgttcgtaaggcacaggctgacagttccactcccaccccacacaacgcagacggtgcgcctgtgcagccctcccaggtggagtacacggcagactcgaccgtggcagccatgtattacagctactacatgctaccggacggcacttactgcctggcgccgccccctcccggaatcgacgtgactacttactacagcacccttcctgctggcgtgaccgtgtctaactcccctggagtgacgaccaccgccccaccacctcctgggaccacaccactaccgcccccaaccacagcagagactagcagcggggccacctccacaaccaccaccacaagtgcacttgcccccgtggccgccatcatccccccgccccccgacgtccagcccgtgattgacaagctggccgagtatgtcgccaggaacggcctgaagttcgagaccagtgttcgtgccaagaatgatcaaagatttgagttcctgcagccgtggcaccagtataatgcttattatgagtttaagaagcagttcttcctccagaaagaagggggcgatagcatgcaggctgtgtctgcaccagaagaggctcccacagactctgctcccgagaagccaagtgatgctggggaggatggcgcgcctgaagacgcagccgaggtgggagcacgggcaggctcaggcgggaagaaggaggcatcgtccagtaagaccgtcccggacgggaagctggtgaaagcttcctttgctccaataagctttgcaatcaaggccaaagaaaatgatctgcttcccctggaaaaaaatcgtgttaagctagatgatgacagtgatgatgatgaagaaagcaaagaaggccaagaaagttctagtagtgctgcaaacactaacccagcagttgccccaccctgtgtagttgttgaggagaagaagcctcaacttacccaggaggagctagaagcaaagcaagcaaagcaaaagctggaagatcgcctcgcagctgctgcccgggaaaagctggcccaggcgtctaaggagtcaaaagagaaacagcttcaagcagaacgtaaaaggaaagcggcgttatttttacagaccctcaaaaatcctctgccggaagcagaagctgggaaaattgaggagagtcctttcagtgtcgaggaatccagcactacgccctgccctctactgactggaggcaggcctctgcctactttagaagttaaaccacccgataggccttcgagcaaaagcaaagatccaccgagagaagaagagaaagaaaagaaaaagaaaaagcacaaaaaaagatctcgaacaagatcacgttctcccaagtaccattcgtcatccaagtccaggtctagatcacactcaaaagcaaagcattctcttcccagtgcctatcggacagtgcggcggtcgaggtcccgctcccggtcccctcggaggagagcccactcccctgagagacggagggaagagaggagtgtgcccactgcctaccgcgtgagccgcagccctggggccagtaggaagcggacccgctccagaagtccccacgagaagaagaagaagaggcggtcccggtcgcggaccaagtccaaggccaggtctcagtcggtgtcacccagcaagcaggcagcgccccggcccgcggcccccgcggcccactcggcgcactcagccagcgtctcccctgtggagagtcggggctccagccaggagcgctccaggggagtctctcaggaaaaagaagcccagatctcttcagcaatcgtttcttccgtgcagagcaaaatcactcaggatctcatggccaaagtcagagcgatgcttgcagcttccaaaaacctgcaaaccagcgcttcctgagacggggccagcggaggcagagccgggaggctgcgtgggcttctgggcaggctcacgcagacgccggccacaccatccacctggccgcctccatggacccttggtggcttttgtaaattaatttttgatgacattttgagttttaagatttctgaccagcagtctcttacctgtatatttgtaaatatatcatgtttctgtgaaaatgtattatgaaataaaatgggaggaaacaccttttctagctag

SEQ ID NO: 2209 - DNA, 1970 bp, Homo sapiens
attttgtggcccgctatggcggcggtgttgaggttgggtacgggatgcggggtctttgactgaaggggtaggccaagtggaggtatcagggacgtcgcgcggcacagaagaggaccagcctggacgccggggacgctgtcatgtacggcgcgagcgggggccgcgccaaacccgagaggaaaagcggcgcgaaggaggaggccgggccaggcggtgccggcggtgggggcagccgagtggagctcttggttttcggctatgcctgcaagctgttccgggacgacgagcgggccctggctcaggaacagggacagcacctcatcccctggatgggggaccacaagatcctcatcgacagatatgatggacgtggtcacctgcatgacctttctgagtacgatgctgagtattccacgtggaacagagattatcagctgtctgaagaggaggcgcgaatagaggccctgtgtgatgaagagaggtatttagccttgcatacggacttgcttgaggaggaggcaaggcaagaggaagaatacaagcgattgagtgaagcactagcagaggatgggagctacaatgccgtggggttcacttacggtagcgactattacgacccgtcagagccgacggaggaggaggagccttccaaacagagagaaaaaaatgaggccgaaaatttagaggaaaatgaagagcccttcgttgcccccttaggattgagcgtcccgtctgacgtggagttgccaccaaccgctaaaatgcacgccatcatcgagcgcacggccagcttcgtgtgcaggcagggagcacagtttgagatcatgctgaaggccaagcaggcccggaactcccagtttgactttctgcgcttcgaccactacctcaacccctactataagttcatccagaaagccatgaaagagggacgctacactgtcctggcagaaaacaaaagtgacgagaaaaaaaaatcaggagtcagctctgacaatgaagatgatgatgatgaagaagatgggaattaccttcatccctctctctttgcctccaagaagtgtaaccgccttgaagagctgatgaagcccttgaaggtagtggacccagatcatcccctcgcagcacttgttcgtaaggcacaggctgacagttccactcccaccccacacaacgcagacggtgcgcctgtgcagccctcccaggtggagtacacggcagactcgaccgtggcagccatgtattacagctactacatgctaccggacggcacttactgcctggcgccgccccctcccggaatcgacgtgactacttactacagcacccttcctgctggcgtgaccgtgtctaactcccctggagtgacgaccaccgccccaccacctcctgggaccacaccactaccgcccccaaccacagcagagactagcagcggggccacctccacaaccaccaccacaagtgcacttgcccccgtggccgccatcatccccccgccccccgacgtccagcccgtgattgacaagctggccgagtatgtcgccaggaacggcctgaagttcgagaccagtgttcgtgccaagaatgatcaaagatttgagttcctgcagccgtggcaccagtataatgcttattatgagtttaagaagcagttcttcctccagaaagaagggggcgatagcatgcaggctgtgtctgcaccagaagaggctcccacagactctgctcccgagaagccaagtgatgctggggaggatggcgcgcctgaagacgcagccgaggtgggagcacgggcaggctcaggcgggaagaaggaggcatcgtccagtaagaccgtcccggacgggaagctggtgaaagcttcctttgctccaataagctttgcaatcaaggccaaagaaaatgatctgcttcccctggaaaaaaatcgtaagaagagaaagaaaagaaaaagaaaaagcacaaaaaaa

SEQ ID NO: 2210 - DNA, 2472 bp, Homo sapiens
gatctcagctccttttcagctagtgggtggaaccccaggagggaaaactcagggaagcccaggaggaagtgaaaataccccatggagtgaagcttgtgtgctacctgggttccgggccagtgatccagctcctgggggccatcagccacggccaggcaggggggcagctgccaccaaagctggaggttctagaggacttgatggaggtcagctcaccctcacctgcccagaggctcagaaggaagaaaaggcccatggtgcagggccctgctgggtgccaggttttccagccttctccttcaggaggcacagcaggggaccctggtggcctctctgaccccttctaccctccaagaagcggttccctggcccttggcgaccccagctcggaccctgcatgttcccagagtggcccaatggaggctgaagaggattctcttccggagcagccagaggactcagctcagctccaacaggagaagccatccctgtatattggggtgcggggcactgttgtccgttccatgcaggaggtactatggactcgccttcgggagctcccagacccagtgctgagtgaggaggtggtggagggcattgctgctggcattgaggcagccctctgggacctgacacaaggcaccaatggccggtacaagaccaagtatcgcagcctgctgttcaacctgcgggaccccaggaacctggacttgtttctcaaagtggttcatggagatgtcaccccctacgacctggtgcggatgagctcgatgcagctggccccccaggagctggcccgctggcgggaccaggaggagaaaaggggcctgaatatcattgagcagcaacagaaggagccgtgcagacttccagcctccaaaatgacccacaagggcgaagtggagattcagcgggacatggaccagacactgaccctggaggatctggtgggaccgcagatgttcatggactgcagcccacaggccctgcccatcgcatcagaggacaccacggggcagcatgaccaccacttcttagaccccaactgccacatctgcaaggactgggagccctcgaatgagctgctaggctccttcgaagccgccaagagctgcggggacaatatcttccagaaagccctaagccaaactcctatgcctgctccagagatgcccaaaaccagggagttgtctcccacggaaccacaggacagggtccctccatctgggctccatgtgcctgctgcacccacaaaggccctgccctgcctgccaccctgggaaggtgttctggacatgttctccatcaagcggttccgggccagggcccagctggtctcgggacacagctgtcggcttgtccaggctctgcccaccgtgatccgctcggcaggctgcatcccctccaacattgtctgggaccttctggccagcatctgcccagccaaggccaaggacgtctgcgtggtcagactgtgcccacatggggcccgggacacccagaactgccgcctgctctactcatacctcaatgataggcagcgccacgggctggcctctgtggagcacatggggatggtcctgctgcccctgcctgccttccagcccctgcccaccaggctgcgccctttggggggcccaggtctggaggtcactcactcaagtctgttgctggctgtgctgctccccaaggaagggcttccagacacagcagggtccagcccctggttggggaaggttcaaaagatggtctccttcaacagtaaggtggagaagagatactatcagccagatgacaggaggccgaatgtgcccctgaagggcacccctcccccaggaggtgcctggcagcagagccagggcaggggcagtatagctccaaggggaatctctgcttggcagaggccccccagaggcagggggaggctctggccagagcctgaaaactggcagcatcctgggcgagggcagtggcccccagagccaggcttgcgccagtcccagcatccctattcagtagcaccagctggtcatggctttggccgtggccagcacttccacagggactcctgtccccaccaagccctgctccggcacctcgaatccctggcgaccatgagtcaccagctccaagccttactgtgcccccagaccaagagctccatcccccgccctctgcagcgtttgtctagcgcccttgcagctccagagccccctggcccagcccgtgactcctctttggggcctacagatgaagctggctctgagtgtcccttccctagaaaggcctgaccctccttacccaccagaacaggggttttgatgccctcactagtgttgaagcctgttccagagagaggtgggactgcaaggagaggatggtcagccctacccacctgccctgtttgaacttcctgtttgacaatgtttgctgttgattttttgttcaataaagaatttggtaaaattggga

SEQ ID NO: 2211 - DNA, 1676 bp, Homo sapiens
gggactaagtgcctggagagcctcctgggctcagtgcccccgccctgccctggcctccacagccttcgggagctcccagacccagtgctgagtgaggaggtggtggagggcattgctgctggcattgaggcagccctctgggacctgacacaaggcaccaatggccggtacaagaccaagtatcgcagcctgctgttcaacctgcgggaccccaggaacctggacttgtttctcaaagtggttcatggagatgtcaccccctacgacctggtgcggatgagctcgatgcagctggccccccaggagctggcccgctggcgggaccaggaggagaaaaggggcctgaatatcattgagcagcaacagaaggagccgtgcagacttccagcctccaaaatgacccacaagggcgaagtggagattcagcgggacatggaccagacactgaccctggaggatctgggaccgcagatgttcatggactgcagcccacaggccctgcccatcgcatcagaggacaccacggggcagcatgaccaccacttcttagaccccaactgccacatctgcaaggactgggagccctcgaatgagctgctaggctccttcgaagccgccaagagctgcggggacaatatcttccagaaagccctaagccaaactcctatgcctccaccctgggaaggtgttctggacatgttctccatcaagcggttccgggccagggcccagctggtctcgggacacagctgtcggcttgtccaggctctgcccaccgtgatccgctcggcaggctgcatcccctccaacattgtctgggaccttctggccagcatctgcccagccaaggccaaggtctggaggtcactcactcaagtctgttgctggctgtgctgctccccaaggaagggcttccagacacagcagggtccagcccctggttggggaaggttcaaaagatggtctccttcaacagtaaggtggagaagagatactatcagccagatgacaggaggccgaatgtgcccctgaagggcacccctcccccaggaggtgcctggcagcagagccagggcaggggcagtatagctccaaggggaatctctgcttggcagaggccccccagaggcagggggaggctctggccagagcctgaaaactggcagcatcctgggcgagggcagtggcccccagagccaggcttgcgccagtcccagcatccctattcagtagcaccagctggtcatggctttggccgtggccagcacttccacagggactcctgtccccaccaagccctgctccggcacctcgaatccctggcgaccatgagtcaccagctccaagccttactgtgcccccagaccaagagctccatcccccgccctctgcagcgtttgtctagcgcccttgcagctccagagccccctggcccagcccgtgactcctctttggggcctacagatgaagctggctctgagtgtcccttccctagaaaggcctgaccctccttacccaccagaacaggggttttgatgccctcactagtgttgaagcctgttccagagagaggtgggactgcaaggagaggatggtcagccctacccacctgccctgtttgaacttcctgtttgacaatgtttgctgttgattttttgttcaataaagaatttggt

SEQ ID NO: 2212 - DNA, 3960 bp, Homo sapiens
agcaagggcctccctcccccgcatcacgtgatctcagctccttttcagctagtgggtggaaccccaggagggaaaactcagggaagcccagggcccgtgttgtgcttttggcccaggtaggtggacagacatgtcccaggcgggggacgtagaaggccccagcacaggagaccctgtgctcagtccccaacacaactgtgagcttttacagaacatggaaggagccagctccatgccaggcctgtcaccagatgggccgggagcaagctctgggcccggagtcagggctggcagcagaaggaagatccccaggaaggaggcccttcgaggtggcagctcccgggctgcaggtgctgctgaggtccggccaggggtcttggagctgctagctgtggtacagagccggggctcgatgctggctcctgggctccacatgcagctgccctcggtgcctactcaggggagagctctgacctccaagaggctccaggtttctctgtgtgacatcttagatgacagttgccccaggaaactttgtagcaggtctgctggcctcccagagagagctctggcctgcagggagaggcttgcaggagtggaggaggtgagctgcctcaggcccagggaggccagagacggtggaatgagttctccagggtgtgacagaagaagccccacactcagcaaagaggagccccctggaaggcccctgacatcctcaccagacccagtccctgtgagggtaagaaagaaatggaggaggcaaggggctcattcagagtgtgaggaaggggctggtgacttcctgtggcttgatcagagccctcgtggggacaacctcctgtctgtgggagaccctccccaagttgctgacctggagtccttgggaggcccttgcagacctccctctccaaaagacactgggtctgggcctggagagccaggtggaagtggggcaggatgtgcctcagggactgagaaatttggatatttgcccgctacaggggatgggccccagccaggcagcccctgtggccctgtcgggttcccagtgcccagtggaggggagtccctcagttcagctgcacaggctcctccacagagcgcagcactgtgcctgggggcgtcagcacaggcctctgcagagcagcaagaagctgtgtgtgtcgtgcggactggcagcgatgaaggccaggctccagcacaggaccaggaggagctggaggccaaggctcagccagcttccaggggaaggctggagcaaggactcgctgcccccgctgacacctgtgccagctcccgggagcccttgggcggcctcagctcctccctggatactgaagccagcagggcctgctcaggcccattcatggagcagagaagatccaagggcactaagaacctgaagaaaggtccagtgccctgtgcccaagaccggggcacagacagaagctcagacaactcccaccaggacaggccagaggaacccagcccaggaggctgccccagactggaggaagtgaaaataccccatggagtgaagcttgtgtgctacctgggttccgggccagtgatccagctcctgggggccatcagccacggccaggcaggggggcagctgccaccaaagctggaggttctagaggacttgatggaggtcagctcaccctcacctgcccagaggctcagaaggaagaaaaggcccatggtgcagggccctgctgggtgccaggttttccagccttctccttcaggaggcacagcaggggaccctggtggcctctctgaccccttctaccctccaagaagcggttccctggcccttggcgaccccagctcggaccctgcatgttcccagagtggcccaatggaggctgaagaggattctcttccggagcagccagaggactcagctcagctccaacaggagaagccatccctgtatattggggtgcggggcactgttgtccgttccatgcaggaggtactatggactcgccttcgggagctcccagacccagtgctgagtgaggaggtggtggagggcattgctgctggcattgaggcagccctctgggacctgacacaaggcaccaatggccggtacaagaccaagtatcgcagcctgctgttcaacctgcgggaccccaggaacctggacttgtttctcaaagtggttcatggagatgtcaccccctacgacctggtgcggatgagctcgatgcagctggccccccaggagctggcccgctggcgggaccaggaggagaaaaggggcctgaatatcattgagcagcaacagaaggagccgtgcagacttccagcctccaaaatgacccacaagggcgaagtggagattcagcgggacatggaccagacactgaccctggaggatctggtgggaccgcagatgttcatggactgcagcccacaggccctgcccatcgcatcagaggacaccacggggcagcatgaccaccacttcttagaccccaactgccacatctgcaaggactgggagccctcgaatgagctgctaggctccttcgaagccgccaagagctgcggggacaatatcttccagaaagccctaagccaaactcctatgcctgctccagagatgcccaaaaccagggagttgtctcccacggaaccacaggacagggtccctccatctgggctccatgtgcctgctgcacccacaaaggccctgccctgcctgccaccctgggaaggtgttctggacatgttctccatcaagcggttccgggccagggcccagctggtctcgggacacagctgtcggcttgtccaggctctgcccaccgtgatccgctcggcaggctgcatcccctccaacattgtctgggaccttctggccagcatctgcccagccaaggccaaggacgtctgcgtggtcagactgtgcccacatggggcccgggacacccagaactgccgcctgctctactcatacctcaatgataggcagcgccacgggctggcctctgtggagcacatggggatggtcctgctgcccctgcctgccttccagcccctgcccaccaggctgcgccctttggggggcccaggcctttgggctcttcctgtctcccctctcctttccccaggtctggaggtcactcactcaagtctgttgctggctgtgctgctccccaaggaagggcttccagacacagcagggtccagcccctggttggggaaggttcaaaagatggtctccttcaacagtaaggtggagaagagatactatcagccagatgacaggaggccgaatgtgcccctgaagggcacccctcccccaggaggtgcctggcagcagagccagggcaggggcagtatagctccaaggggaatctctgcttggcagaggccccccagaggcagggggaggctctggccagagcctgaaaactggcagcatcctgggcgagggcagtggcccccagagccaggcttgcgccagtcccagcatccctattcagtagcaccagctggtcatggctttggccgtggccagcacttccacagggactcctgtccccaccaagccctgctccggcacctcgaatccctggcgaccatgagtcaccagctccaagccttactgtgcccccagaccaagagctccatcccccgccctctgcagcgtttgtctagcgcccttgcagctccagagccccctggcccagcccgtgactcctctttggggcctacagatgaagctggctctgagtgtcccttccctagaaaggcctgaccctccttacccaccagaacaggggttttgatgccctcactagtgttgaagcctgttccagagagaggtgggactgcaaggagaggatggtcagccctacccacctgccctgtttgaacttcctgtttgacaatgtttgctgttgattttttgttcaataaagaatttggtaaaattgg

SEQ ID NO: 2213 - DNA, 3626 bp, Homo sapiens
aaaactcagggaagcccagggcccgtgttgtgcttttggcccaggtaggtggacagacatgtcccaggcgggggacgtagaaggccccagcacaggagaccctgtgctcagtccccaacacaactgtgagcttttacagaacatggaaggagccagctccatgccaggcctgtcaccagatgggccgggagcaagctctgggcccggagtcagggctggcagcagaaggaagatccccaggaaggaggcccttcgaggtggcagctcccgggctgcaggtgctgctgaggtccggccaggggtcttggagctgctagctgtggtacagagccggggctcgatgctggctcctgggctccacatgcagctgccctcggtgcctactcaggggagagctctgacctccaagaggctccaggtttctctgtgtgacatcttagatgacagttgccccaggaaactttgtagcaggtctgctggcctcccagagagagctctggcctgcagggagaggcttgcaggagtggaggaggtgagctgcctcaggcccagggaggccagagacggtggaatgagttctccagggtgtgacagaagaagccccacactcagcaaagaggagccccctggaaggcccctgacatcctcaccagacccagtccctgtgagggtaagaaagaaatggaggaggcaaggggctcattcagagtgtgaggaaggggctggtgacttcctgtggcttgatcagagccctcgtggggacaacctcctgtctgtgggagaccctccccaagttgctgacctggagtccttgggaggcccttgcagacctccctctccaaaagacactgggtctgggcctggagagccaggtggaagtggggcaggatgtgcctcagggactgagaaatttggatatttgcccgctacaggggatgggccccagccaggcagcccctgtggccctgtcgggttcccagtgcccagtggaggggagtccctcagttcagctgcacaggctcctccacagagcgcagcactgtgcctgggggcgtcagcacaggcctctgcagagcagcaagaagctgtgtgtgtcgtgcggactggcagcgatgaaggccaggctccagcacaggaccaggaggagctggaggccaaggctcagccagcttccaggggaaggctggagcaaggactcgctgcccccgctgacacctgtgccagctcccgggagcccttgggcggcctcagctcctccctggatactgaagccagcagggcctgctcaggcccattcatggagcagagaagatccaagggcactaagaacctgaagaaaggtccagtgccctgtgcccaagaccggggcacagacagaagctcagacaactcccaccaggacaggccagaggaacccagcccaggaggctgccccagactggaggaagtgaaaataccccatggagtgaagcttgtgtgctacgttttccagccttctccttcaggaggcacagcaggggaccctggtggcctctctgaccccttctaccctccaagaagcggttccctggcccttggcgaccccagctcggaccctgcatgttcccagagtggcccaatggaggctgaagaggattctcttccggagcagccagaggactcagccttcgggagctcccagacccagtgctgagtgaggaggtggtggagggcattgctgctggcattgaggcagccctctgggacctgacacaaggcaccaatggccggtacaagaccaagtatcgcagcctgctgttcaacctgcgggaccccaggaacctggacttgtttctcaaagtggttcatggagatgtcaccccctacgacctggtgcggatgagctcgatgcagctggccccccaggagctggcccgctggcgggaccaggaggagaaaaggggcctgaatatcattgagcagcaacagaaggagccgtgcagacttccagcctccaaaatgacccacaagggcgaagtggagattcagcgggacatggaccagacactgaccctggaggatctggtgggaccgcagatgttcatggactgcagcccacaggccctgcccatcgcatcagaggacaccacggggcagcatgaccaccacttcttagaccccaactgccacatctgcaaggactgggagccctcgaatgagctgctaggctccttcgaagccgccaagagctgcggggacaatatcttccagaaagccctaagccaaactcctatgcctgctccagagatgcccaaaaccagggagttgtctcccacggaaccacaggacagggtccctccatctgggctccatgtgcctgctgcacccacaaaggccctgccctgcctgccaccctgggaaggtgttctggacatgttctccatcaagcggttccgggccagggcccagctggtctcgggacacagctgtcggcttgtccaggctctgcccaccgtgatccgctcggcaggctgcatcccctccaacattgtctgggaccttctggccagcatctgcccagccaaggccaaggacgtctgcgtggtcagactgtgcccacatggggcccgggacacccagaactgccgcctgctctactcatacctcaatgataggcagcgccacgggctggcctctgtggagcacatggggatggtcctgctgcccctgcctgccttccagcccctgcccaccaggctgcgccctttggggggcccaggcctttgggctcttcctgtctcccctctcctttccccaggtctggaggtcactcactcaagtctgttgctggctgtgctgctccccaaggaagggcttccagacacagcagggtccagcccctggttggggaaggttcaaaagatggtctccttcaacagtaaggtggagaagagatactatcagccagatgacaggaggccgaatgtgcccctgaagggcacccctcccccaggaggtgcctggcagcagagccagggcaggggcagtatagctccaaggggaatctctgcttggcagaggccccccagaggcagggggaggctctggccagagcctgaaaactggcagcatcctgggcgagggcagtggcccccagagccaggcttgcgccagtcccagcatccctattcagtagcaccagctggtcatggctttggccgtggccagcacttccacagggactcctgtccccaccaagccctgctccggcacctcgaatccctggcgaccatgagtcaccagctccaagccttactgtgcccccagaccaagagctccatcccccgccctctgcagcgtttgtctagcgcccttgcagctccagagccccctggcccagcccgtgactcctctttggggcctacagatgaagctggctctgagtgtcccttccctagaaaggcctgaccctccttacccaccagaacaggggttttgatgccctcactagtgttgaagcctgttccagagagaggtgggactgcaaggagaggatggtcagccctacccacctgccctgtttgaacttcctgtttgacaatgtttgctgttgattttttgttcaataaagaatttggtaaaattgg

SEQ ID NO: 2214 - DNA, 2711 bp, Homo sapiens
aactcagggaagcccagggcccgtgttgtgcttttggcccaggtaggtggacagacatgtcccaggcgggggacgtagaaggccccagcacaggagaccctgtgctcagtccccaacacaactgtgagcttttacagaacatggaaggagccagctccatgccaggcctgtcaccagatgggccgggagcaagctctgggcccggagtcagggctggcagcagaaggaagatccccaggaaggaggcccttcgaggtggcagctcccgggctgcaggtgctgctgaggtccggccaggggtcttggagctgctagctgtggtacagagccggggctcgatgctggctcctgggctccacatgcagctgccctcggtgcctactcaggggagagctctgacctccaagaggctccaggtttctctgtgtgacatcttagatgacagttgccccaggaaactttgtagcaggtctgctggcctcccagagagagctctggcctgcagggagaggcttgcaggagtggaggaggtgagctgcctcaggcccagggaggccagagacggtggaatgagttctccagggtgtgacagaagaagccccacactcagcaaagaggagccccctggaaggcccctgacatcctcaccagacccagtccctgtgagggtaagaaagaaatggaggaggcaaggggctcattcagagtgtgaggaaggggctggtgacttcctgtggcttgatcagagccctcgtggggacaacctcctgtctgtgggagaccctccccaagttgctgacctggagtccttgggaggcccttgcagacctccctctccaaaagacactgggtctgggcctggagagccaggtggaagtggggcaggatgtgcctcagggactgagaaatttggatatttgcccgctacaggggatgggccccagccaggcagcccctgtggccctgtcgggttcccagtgcccagtggaggggagtccctcagttcagctgcacaggctcctccacagagcgcagcactgtgcctgggggcgtcagcacaggcctctgcagagcagcaagaagctgtgtgtgtcgtgcggactggcagcgatgaaggccaggctccagcacaggaccaggaggagctggaggccaaggctcagccagcttccaggggaaggctggagcaaggactcgctgcccccgctgacacctgtgccagctcccgggagcccttgggcggcctcagctcctccctggatactgaagccagcagggcctgctcaggcccattcatggagcagagaagatccaagggcactaagaacctgaagaaaggtccagtgccctgtgcccaagaccggggcacagacagaagctcagacaactcccaccaggacaggccagaggaacccagcccaggaggctgccccagactggaggaagtgaaaataccccatggagtgaagcttgtgtgctacctgggttccgggccagtgatccagctcctgggggccatcagccacggccaggcaggggggcagctgccaccaaagctggaggttctagaggacttgatggaggtcagctcaccctcacctgcccagaggctcagaaggaagaaaaggcccatggtgcagggccctgctgggtgccaggttttccagccttctccttcaggaggcacagcaggggaccctggtggcctctctgaccccttctaccctccaagaagcggttccctggcccttggcgaccccagctcggaccctgcatgttcccagagtggcccaatggaggctgaagaggattctcttccggagcagccagaggactcagctcagctccaacaggagaagccatccctgtatattggggtgcggggcactgttgtccgttccatgcaggaggtactatggactcgccttcgggagctcccagacccagtgctgagtgaggaggtggtggagggcattgctgctggcattgaggcagccctctgggacctgacacaaggcaccaatggccggtacaagaccaagtatcgcagcctgctgttcaacctgcgggaccccaggaacctggacttgtttctcaaagtggttcatggagatgtcaccccctacgacctggtgcggatgagctcgatgcagctggccccccaggagctggcccgctggcgggaccaggaggagaaaaggggaccgcagatgttcatggactgcagcccacaggccctgcccatcgcatcagaggacaccacggggcagcatgaccaccacttcttagaccccaactgccacatctgcaaggactgggagccctcgaatgagctgctaggctccttcgaagccgccaagagctgcggggacaatatcttccagaaagccctaagccaaactcctatgcctgctccagagatgcccaaaaccagggagttgtctcccacggaaccacaggacaggtgtggggttgggagcagggaggtggataacccagcagggttgagggggaggccaccacctggtgcaacagacatagcactggcttttcctgtgtggccttgggcaagtcttccctcccttgggaacctcactttccccatctgtgcaatggaactaatcatcccagcctcctggcagccccctgcacaaggccaagcttgggccagtgttccagtccccacagtagggacacaggatctgctctga

SEQ ID NO: 2215 - DNA, 477 bp, Homo sapiens
tctcagctccttttcagctagtgggtggaaccccaggagggaaaactcagggaagcccaggtgagagcgacgcgaccgatggggcccggatttcttggatgctgggggactgtcccagtaaggcttgggaacctgggtggggcgcctttcagaacgggaccgatgggagagagacgagaagggttatgggcacgaaccccgttcagtatctgctccttgcgcagtgtgagaactgggagagagactcctggcccttccacttcctgtgcttccttgggaggaagtgaaaataccccatggagtgaagcttgtgtgctacctgggttccgggccagtgatccagctcctgggggccatcagccacggccaggcaggggggcagctgccaccaaagctggaggttctagaggacttgatggaggtcagctcaccctcacctgcccagaggctcagaaggaagaaaaggcccatggtgca

SEQ ID NO: 2216 - DNA, 487 bp, Homo sapiens
gatctcagctccttttcagctagtgggtggaaccccaggagggaaaactcagggaagcccagggcccgtgttgtgcttttggcccaggaggaagtgaaaataccccatggagtgaagcttgtgtgctacctgggttccgggccagtgatccagctcctgggggccatcagccacggccaggcaggggggcagctgccaccaaagctggaggttctagaggacttgatggaggtcagctcaccctcacctgcccagaggctcagaaggaagaaaaggcccatggtgcagggccctgctgggtgccaggttttccagccttctccttcaggaggcacagcaggggaccctggtggcctctctgaccccttctaccctccaagaagcggttccctggcccttggcgaccccagctcggaccctgcatgttcccagagtggcccaatggaggctgaagaggattctcttccggagcagccagaggactcag

SEQ ID NO: 2217 - DNA, 3774 bp, Homo sapiens
cagggcccgtgttgtgcttttggcccaggtaggtggacagacatgtcccaggcgggggacgtagaaggccccagcacaggagaccctgtgctcagtccccaacacaactgtgagcttttacagaacatggaaggagccagctccatgccaggcctgtcaccagatgggccgggagcaagctctgggcccggagtcagggctggcagcagaaggaagatccccaggaaggaggcccttcgaggtggcagctcccgggctgcaggtgctgctgaggtccggccaggggtcttggagctgctagctgtggtacagagccggggctcgatgctggctcctgggctccacatgcagctgccctcggtgcctactcaggggagagctctgacctccaagaggctccaggtttctctgtgtgacatcttagatgacagttgccccaggaaactttgtagcaggtctgctggcctcccagagagagctctggcctgcagggagaggcttgcaggagtggaggaggtgagctgcctcaggcccagggaggccagagacggtggaatgagttctccagggtgtgacagaagaagccccacactcagcaaagaggagccccctggaaggcccctgacatcctcaccagacccagtccctgtgagggtaagaaagaaatggaggaggcaaggggctcattcagagtgtgaggaaggggctggtgacttcctgtggcttgatcagagccctcgtggggacaacctcctgtctgtgggagaccctccccaagttgctgacctggagtccttgggaggcccttgcagacctccctctccaaaagacactgggtctgggcctggagagccaggtggaagtggggcaggatgtgcctcagggactgagaaatttggatatttgcccgctacaggggatgggccccagccaggcagcccctgtggccctgtcgggttcccagtgcccagtggaggggagtccctcagttcagctgcacaggctcctccacagagcgcagcactgtgcctgggggcgtcagcacaggcctctgcagagcagcaagaagctgtgtgtgtcgtgcggactggcagcgatgaaggccaggctccagcacaggaccaggaggagctggaggccaaggctcagccagcttccaggggaaggctggagcaaggactcgctgcccccgctgacacctgtgccagctcccgggagcccttgggcggcctcagctcctccctggatactgaagccagcagggcctgctcaggcccattcatggagcagagaagatccaagggcactaagaacctgaagaaaggtccagtgccctgtgcccaagaccggggcacagacagaagctcagacaactcccaccaggacaggccagaggaacccagcccaggaggctgccccagactggaggaagtgaaaataccccatggagtgaagcttgtgtgctacctgggttccgggccagtgatccagctcctgggggccatcagccacggccaggcaggggggcagctgccaccaaagctggaggttctagaggacttgatggaggtcagctcaccctcacctgcccagaggctcagaaggaagaaaaggcccatggtgcagggccctgctgggtgccaggttttccagccttctccttcaggaggcacagcaggggaccctggtggcctctctgaccccttctaccctccaagaagcggttccctggcccttggcgaccccagctcggaccctgcatgttcccagagtggcccaatggaggctgaagaggattctcttccggagcagccagaggactcagctcagctccaacaggagaagccatccctgtatattggggtgcggggcactgttgtccgttccatgcaggaggtactatggactcgccttcgggagctcccagacccagtgctgagtgaggaggtggtggagggcattgctgctggcattgaggcagccctctgggacctgacacaaggcaccaatggccggtacaagaccaagtatcgcagcctgctgttcaacctgcgggaccccaggaacctggacttgtttctcaaagtggttcatggagatgtcaccccctacgacctggtgcggatgagctcgatgcagctggccccccaggagctggcccgctggcgggaccaggaggagaaaaggggcctgaatatcattgagcagcaacagaaggagccgtgcagacttccagcctccaaaatgacccacaagggcgaagtggagattcagcgggacatggaccagacactgaccctggaggatctggtgggaccgcagatgttcatggactgcagcccacaggccctgcccatcgcatcagaggacaccacggggcagcatgaccaccacttcttagaccccaactgccacatctgcaaggactgggagccctcgaatgagctgctaggctccttcgaagccgccaagagctgcggggacaatatcttccagaaagccctaagccaaactcctatgcctgctccagagatgcccaaaaccagggagttgtctcccacggaaccacaggacagggtccctccatctgggctccatgtgcctgctgcacccacaaaggccctgccctgcctgccaccctgggaaggtgttctggacatgttctccatcaagcggttccgggccagggcccagctggtctcgggacacagctgtcggcttgtccaggctctgcccaccgtgatccgctcggcaggctgcatcccctccaacattgtctgggaccttctggccagcatctgcccagccaaggccaaggacgtctgcgtggtcagactgtgcccacatggggcccgggacacccagaactgccgcctgctctactcatacctcaatgataggcagcgccacgggctggcctctgtggagcacatggggatggtcctgctgcccctgcctgccttccagcccctgcccaccaggctgcgccctttggggggcccaggtctggaggtcactcactcaagtctgttgctggctgtgctgctccccaaggaagggcttccagacacagcagggtccagcccctggttggggaaggttcaaaagatggtctccttcaacagtaaggtggagaagagatactatcagccagatgacaggaggccgaatgtgcccctgaagggcacccctcccccaggaggtgcctggcagcagagccagggcaggggcagtatagctccaaggggaatctctgcttggcagaggccccccagaggcagggggaggctctggccagagcctgaaaactggcagcatcctgggcgagggcagtggcccccagagccaggcttgcgccagtcccagcatccctattcagtagcaccagctggtcatggctttggccgtggccagcacttccacagggactcctgtccccaccaagccctgctccggcacctcgaatccctggcgaccatgagtcaccagctccaagccttactgtgcccccagaccaagagctccatcccccgccctctgcagcgtttgtctagcgcccttgcagctccagagccccctggcccagcccgtgactcctctttggggcctacagatgaagctggctctgagtgtcccttccctagaaaggcctgaccctccttacccaccagaacaggggttttgatgccctcactagtgttgaagcctgttccagagagaggtgggactgcaaggagaggatggtcagccctacccacctgccctgtttgaact

SEQ ID NO: 2218 - DNA, 4312 bp, Homo sapiens
tgaaatcccggcaagctcggcggcgctttagctccgcctctctcctcctttgctcacgaaccccgccccagcccgccccgccccgcgccggggccggagccgcagcccgagcggcggggtgaccatggaggaagaagatgagtctcgagggaagacagaggagtcgggggaggatcggggcgatggtccgccagacagagaccccacgctttctccttctgcctttatcctgcgagccatccagcaggctgtgggaagctccctgcagggggacctgcccaatgataaagatggctctcggtgtcatggccttcgatggcggcgctgccggagtccacggtcagagccccgttcccaggaatcagggggcactgacacggctactgtgttggacatggccacggacagcttcctcgcagggctggtgagtgtcctggatcccccggatacctgggttcccagccgcctggacctgcggcctggcgaaagtgaggacatgctggagctggtggctgaggtccgaatcggggacagagatcccatccctctgcctgtgcccagcctgctgccccgtctcagggcctggaggacgggcaaaacggtttctccacagtcgaactcctctaggcccacctgtgcccgtcacctcaccttgggcacgggagacgggggccctgccccaccccctgccccctcctctgcatcctcctccccttccccttctccctcatcttcctccccttcccctcccccacccccaccgccccctgcacccccagccccacctgccccccgattcgatatctatgaccccttccaccccaccgacgaggcctactctccaccgcctgctccggagcaaaagtacgacccttttgagcccaccggctccaaccccagctcatcagcggggaccccctcacctgaggaggaagaggaggaggaagaggaagaagaagaggaagaggaagacgaggaggaggaggaaggcctgtcccagagcatcagccgcatctcggagaccctggcgggcatctacgatgacaacagcctgagccaggacttcccaggtgacgagagcccccgcccggacgcgcagcccacacagccgactcccgcccctggaacgccgccccaggtggactccacccgggctgatggagccatgcgccggcgggtcttcgtggtggggaccgaggcagaggcttgtcgggaaggcaaggtctcggtggaggtggtgaccgctggtggagccgccctcccgccgcccctgctgccgcccggcgactcggagatcgaggaaggggagatcgtccagccggaggaggagcccaggctggcgctgtccctcttccgccccggcggccgggccgcccggcctacaccggccgcctcggccacccccacggcccagccccttcctcagcctcccgctccgcgggcccccgagggggacgacttcttgtccctgcatgcggagtcggacggcgagggcgccctgcaggtggacctaggggagccggctcccgcgccgcccgccgccgactcgcgctggggcggcctggacctgcgccgcaagatcctgacccaacggcgggagcgctaccgccagcgctcgccctccccggcgcccgcgcccgccccggccgccgctgctggtccgcccacgcgcaagaagtccaggcgggaacgcaagcgcagcggcgaggccaaggaggccgcctcgtcctcgtcgggcacccagccagcgccgcccgccccggcctcgccctgggactccaagaagcaccgctcgcgggaccgcaagcccggctcccacgcctcgtcgtccgcccgccgccgctcccgctcccgctcccgctcccgctccacccgccgccgctcgcgcagcaccgaccgccgccgcgggggcagccgcaggtcgcggtcccgggagaagcggcgacggcggcggcgctccgcctccccgcccccggccacttcctcatcgtcgtcctcgaggcgcgagcggcaccgcgggaaacaccgggacggtggcggcagcaagaagaagaagaagcggtcgcggtcccggggtgagaagcggtctggggatggcagcgagaaggccccggcgcccgccccgccgccctctggctccacctcgtgtggtgaccgcgacagccgccgccggggggccgtgccaccctccatccaggacctcacggaccacgacctcttcgccatcaagcggaccatcacggtgggccggcttgacaagtccgacccccgaggaccctctcctgctccggcctcctcacctaagcgggaggtcctgtacgactccgagggactgagcggcgaggagcggggcggcaagagcagccagaaggatcggcgccgctcgggggccgcctcctcctcctcctcttcccgggagaaggggtctcgtcggaaggcgctggacgggggtgaccgggatcgggacagggacagagatagggacagggacaggtcatccaagaaggcccggccccccaaggagtcggcgccttcctcagggcccccgccaaagccaccagtcagcagcggctcaggctcttcatcctcgtcgtcctcctgttcttcccggaaggtgaagctgcagtccaaggtggcggtgctgatccgcgagggtgtcagcagcaccaccccggccaaggatgccgcgtcagccggcctgggctccattggcgtcaaattcagccgtgaccgcgagagtcgctcccccttcctcaaacctgacgagcgggcccccactgagatggccaaagcagctccgggcagcaccaagcccaaaaagaccaaggtcaaggccaaggcaggggccaagaaaaccaaggggaccaagggaaagaccaagccatccaagaccaggaaaaaggtccgcagtggaggtggcagcgggggcagtggtggccaggtgtcgctgaagaagtccaaggcggatagctgcagccaggcggcaggcaccaagggggcggaggagacttcctggtccggggaggagcgggcagccaaggttcctagcaccccgccccccaaggcagccccaccaccccctgccctcactccggactcgcagaccgtggacagcagctgcaagacacctgaggtctccttcctgcccgaggaggccactgaggaggctggggtccgaggtggggcggaggaggaggaggaggaagaagaagaggaggaggaagaggaagaggaggaggagcagcagcctgctaccaccacggccaccagcactgctgcagccgccccaagcactgcccccagcgcggggtccacagccggtgactcgggggcggaggacgggccagcttcccgtgtctcccagctgcccacgttgcccccgcccatgccctggaatctgccagctggtgtggactgcaccaccagcggcgtcctggccttgactgcacttctcttcaagatggaagaagccaacctggcgagccgagcgaaggcccaggagctgatccaggccaccaaccagatcctcagccacagaaagccaccctcaagtctggggatgaccccagctcctgtgcccacctctttgggtctgccccctggcccctccagctacctgcttcctggcagcctccctctggggggctgcggttcgaccccccccacccccaccgggctggctgccacgtctgacaagagagagggcagcagcagctctgagggccgtggggacacagataagtatctgaagaagctgcacacgcaggagcgggcggtggaggaggtgaagctggccatcaagccatactatcagaagaaggacatcaccaaggaggagtacaaggacatcctgaggaaggccgtccacaagatctgccacagcaaaagtggggaaatcaacccagtgaaggtgagcaacctggtgcgggcctacgtccagcgctaccgctacttccgcaagcacggtcgcaagccaggggaccccccagggcccccacggccgcccaaggagccagggcccccagacaagggtggcccgggcctgcccctgccccctctctgagagccctggccagctcttcgcccctcacctctttgaaactctggacgtatttatggctccacctccccacctccctcccccgtcagtgggatgactgggggagggttgctgcagggaagaggagagccccctgccctgccctgccccgtgtccacctcccttgcccccaagcctgtccccagtgcccctcccttctgtttgtgcccctctccccaatttcattaaagatttcatgaaacattacccctg

SEQ ID NO: 2219 - DNA, 684 bp, Homo sapiens
ggtgaccatggaggaagaagatgagtctcgagggaagacagaggagtcgggggaggatcggggcgatggtccgccagacagagaccccacgctttctccttctgcctttatcctgcgagccatccagcaggctgtgggaagctccctgcagggggacctgcccaatgataaagatggctctcggtgtcatggccttcgatggcggcgctgccggagtccacggtcagagccccgttcccaggaatcagggggcactgacacggctactgtgttggacatggccacggacagcttcctcgcagggctggtgagtgtcctggatcccccggatacctgggttcccagccgcctggacctgcggcctggcgaaagtgaggacatgctggagctggtggctgaggtccgaatcggggacagagatcccatccctctgcctgtgcccagcctgctgccccgtctcagggcctggaggacgggcaaaacggtttctccacagtcgaactcctctaggcccacctgtgcccgtcacctcaccttgggcacgggagacgggccctgccccaccccctgccccctcctctgcatcctcctccccttccccttctccctcatcttcctccccttcccctcccccacccccaccgccccctctccccaatttcattaaagatttcatgaaacatt

SEQ ID NO: 2220 - DNA, 4193 bp, Homo sapiens
cgctggagagagggagagagaggcccgcccgctcgccggccgggccagtgtgagccagtgcgtgagggcgcggggggccgtgtcagcgagacgcagagcgcagccgccaccaccaaacggacatgttgaagaccagcgctgccgccgcctccttttcctcatcctgcgaacgggactgagagggggcccgccacctctccgcctctgcctcggccgcccgcctcgccgcttcgggcgcagcctcttcctgcccgggcctcggactccgccgctcgtcgcctccccccggccaccaggcccggctggtttcccagccccgctccgccgcggcgcgaggtctatgtgaccggcgggcccggagcagccgccgccgcagcgcgaacatggacgccgtcaacgccttcaaccaggagctcttttcgcttatggatatgaaacctcccatctctagagccaagatgattctcatcactaaagctgctattaaagctattaagctttataagcatgtagttcaaatagtagaaaagttcatcaaaaagtgtaaaccagaatacaaggttccgggattatatgtaattgactcaattgtgcgacagtctcgtcatcagtttggaactgataaagatgtttttgggccaagattctctaaaaacataactgccacattccaatatttatatctttgtccatctgaagataagagtaaaatagttcgtgtgctgaacctttggcaaaaaaatggagtgttcaaaattgaaattattcaacctcttttggacatggcagcgggaaccagtaatgcagccccagtagcagaaaatgttaccaataatgaaggctcacctccacctccagtaaaagtttcttctgaacctcccacacaagccactccaaactccgtcccagctgtaccacagttgcccagctctgatgcttttgctgctgtggctcagctgtttcagacaactcaaggccaacagcttcagcagatccttcagacttttcaacagcctccaaaaccacagtctcctgcccttgacaatgctgtgatggctcaggttcaggctatcacagctcagttaaagacaactcctacacaaccatctgaacaaaaagctgctttccccccacctgaacagaaaactgcatttgacaagaagttgcttgatagatttgactatgatgatgagccagaagctgtggaagaatcaaagaaagaggataccactgccgtcaccacgacagcacctgctgccgcagtaccccctgcacccaccgccaccgtgcctgctgctgctgcacccgctgctgcctctcctcctcctccacaggcaccatttggctttcctggagatggcatgcagcagccagcatacacacagcatcaaaatatggatcagtttcagccacgaatgatgggaatacaacaggatccaatgcaccatcaggttccacttcctcctaatggacaaatgccaggatttggacttcttcctacacctccatttcctcccatggctcagcctgtgattcctccaactccaccagtgcagcagcctttccaagcttcttttcaggcacaaaatgaaccacttacacagaagccgcatcagcaggaaatggaagtagaacaaccttgtattcaagaggttaagcgacatatgtctgataacagaaagtcaagatctaggtcagcatccaggtcaccaaaaaggaggcgatctagatctggttctagatctcgaaggtctcggcatcgacgttctcgatctcggtccagggatagacgccgacattctccccgatctcgatctcaagaaagacgggatcgagaaaaagagagagaacgtcgacaaaaaggcctccctcaagtgaaaccggaaactgcaagtgtttgcagtactaccctctgggtggggcagctggacaaaagaactactcagcaggatgttgccagtctcttggaagagtttggtccaattgaatcaattaatatgattcctcccaggggttgtgcctatattgttatggttcataggcaagatgcctatcgtgccctgcagaaactgagccgaggaaactataaagtgaaccagaaatccataaagattgcctgggccttaaacaaaggaataaaggcagattataagcagtattgggatgtagaacttggtgttacttatattccatgggacaaagtcaagcctgaggaactggagagtttttgtgaaggaggaatgttggacagtgacacacttaacccagattggaaaggaattcctaagaagcctgaaaatgaagttgctcaaaatggaggtgctgaaacctcacacacagaaccagtatcacccatacctaaaccattacctgtgcctgtccctcctattcctgttcctgcacctataacagtgccacctccacaggtcccaccacatcaaccgggtccacctgtagttggtgctctccagccgcctgctttcacgcctcctctgggaataccgcctccaggctttggtcctggtgttcctcctccccctcctcctccaccatttttgcgcccaggattcaacccaatgcatttaccaccaggttttctgcctcctggacccccacctcctataactccaccagtatccattcctcctcctcacactccaccaataagcatcccaaactctactatcgctggtataaatgaagacactacaaaagacttatctattggaaatcccattccaacagtggtgtctggggctagaggaaacgccgagtctggtgacagcgtgaaaatgtatggctctgccgtgccacctgctgcacccacgaatctgcccacccctcctgtaacccagcctgtttcacttcttggcactcaaggagttgcccctggtcctgtaattggacttcaggcaccatctactggtcttcttggcgcccggcccggtctcatcccactccagcgccctccaggaatgcccccacctcacttacagcggttccctttgatgccgccccgtcccatgccaccgcacatgatgcacagaggcccaccgccaggaccagggggctttgcgatgcctccacctcatggaatgaaaggtcccttcccaccgcatggcccctttgttaggcctggtggaatgccagggctcgggggcccagggccaggcccagggggtcctgaagacagagacggaaggcaacagccgccgcagcagccacagcagcagccacagccgcaggcgccccagcaaccacagcagcagcagcagcagcagccaccaccatcacaacagcctccaccaacacagcagcagccacagcagtttagaaatgataacaggcagcagttcaattcaggtagagaccaagaaaggtttggaagaagatcttttggaaatagggtggaaaatgaccgggaacggtatgggaaccgtaatgatgatagagataatagtaaccgtgacaggagagagtggggaaggaggagccctgaccgggacaggcacagagacttggaagagagaaatagacgctctagtgggcatcgagacagagagagagattctagagatagagagtctcgtagagagaaggaagaagcccgaggaaaggaaaagcctgaggtgacagacagggcaggtggtaacaaaaccgttgaacctcccattagccaagtgggaaatgtagacactgcttcagaacttgagaagggggtgtctgaggctgcagtcctaaagccttctgaagagttacctgctgaggctacctcatccgttgaacccgaaaaggattctggctcagcagcagaggctcctcgttagagactggaatttgtgaaaatgtgacagtgacacttcctggagtgtagagcttgaggtgtacagatgctgtattatatccgctcccgctgtactgcagccccgcgccagctggtggggaactgtaagcaatttgattgcttcccttctatttaaaaatagccacaaaataacaaaaaatactgaaaatatgaataaatattaccctttttgctgtaactttttaaaagttttgactttaaaaagtttacaaatcgtaattagaagtgctctctatttttttttttttttttaatttaagacaaggtaacggtgaaagctcctcaaaacaatagggatgtttttaataaactctattttcgtaacaaa

SEQ ID NO: 2221 - DNA, 4127 bp, Homo sapiens
cgctggagagagggagagagaggcccgcccgctcgccggccgggccagtgtgagccagtgcgtgagggcgcggggggccgtgtcagcgagacgcagagcgcagccgccaccaccaaacggacatgttgaagaccagcgctgccgccgcctccttttcctcatcctgcgaacgggactgagagggggcccgccacctctccgcctctgcctcggccgcccgcctcgccgcttcgggcgcagcctcttcctgcccgggcctcggactccgccgctcgtcgcctccccccggccaccaggcccggctggtttcccagccccgctccgccgcggcgcgaggtctatgtgaccggcgggcccggagcagccgccgccgcagcgcgaacatggacgccgtcaacgccttcaaccaggagctcttttcgcttatggatatgaaacctcccatctctagagccaagatgattctcatcactaaagctgctattaaagctattaagctttataagcatgtagttcaaatagtagaaaagttcatcaaaaagtgtaaaccagaatacaaggttccgggattatatgtaattgactcaattgtgcgacagtctcgtcatcagtttggaactgataaagatgtttttgggccaagattctctaaaaacataactgccacattccaatatttatatctttgtccatctgaagataagagtaaaatagttcgtgtgctgaacctttggcaaaaaaatggagtgttcaaaattgaaattattcaacctcttttggacatggcagcgggaaccagtaatgcagccccagtagcagaaaatgttaccaataatgaaggctcacctccacctccagtaaaagtttcttctgaacctcccacacaagccactccaaactccgtcccagctgtaccacagttgcccagctctgatgcttttgctgctgtggctcagctgtttcagacaactcaaggccaacagcttcagcagatccttcagacttttcaacagcctccaaaaccacagtctcctgcccttgacaatgctgtgatggctcaggttcaggctatcacagctcagttaaagacaactcctacacaaccatctgaacaaaaagctgctttccccccacctgaacagaaaactgcatttgacaagaagttgcttgatagatttgactatgatgatgagccagaagctgtggaagaatcaaagaaagaggataccactgccgtcaccacgacagcacctgctgccgcagtaccccctgcacccaccgccaccgtgcctgctgctgctgcacccgctgctgcctctcctcctcctccacaggcaccatttggctttcctggagatggcatgcagcagccagcatacacacagcatcaaaatatggatcagtttcagccacgaatgatgggaatacaacaggatccaatgcaccatcaggttccacttcctcctaatggacaaatgccaggatttggacttcttcctacacctccatttcctcccatggctcagcctgtgattcctccaactccaccagtgcagcagcctttccaagcttcttttcaggcacaaaatgaaccacttacacagaagccgcatcagcaggaaatggaagtagaacaaccttgtattcaagaggttaagcgacatatgtctgataacagaaagtcaagatctaggtcagcatccaggtcaccaaaaaggaggcgatctagatctggttctagatctcgaaggtctcggcatcgacgttctcgatctcggtccagggatagacgccgacattctccccgatctcgatctcaagaaagacgggatcgagaaaaagagagagaacgtcgacaaaaaggcctccctcaagtgaaaccggaaactgcaagtgtttgcagtactaccctctgggtggggcagctggacaaaagaactactcagcaggatgttgccagtctcttggaagagtttggtccaattgaatcaattaatatgattcctcccaggggttgtgcctatattgttatggttcataggcaagatgcctatcgtgccctgcagaaactgagccgaggaaactataaagtgaaccagaaatccataaagattgcctgggccttaaacaaaggaataaaggcagattataagcagtattgggatgtagaacttggtgttacttatattccatgggacaaagtcaagcctgaggaactggagagtttttgtgaaggaggaatgttggacagtgacacacttaacccagattggaaaggaattcctaagaagcctgaaaatgaagttgctcaaaatggaggtgctgaaacctcacacacagaaccagtatcacccatacctaaaccattacctgtgcctgtccctcctattcctgttcctgcacctataacagtgccacctccacaggtcccaccacatcaaccgggtccacctgtagttggtgctctccagccgcctgctttcacgcctcctctgggaataccgcctccaggctttggtcctggtgttcctcctccccctcctcctccaccatttttgcgcccaggattcaacccaatgcatttaccaccaggttttctgcctcctggacccccacctcctataactccaccagtatccattcctcctcctcacactccaccaataagcatcccaaacttggtgtctggggctagaggaaacgccgagtctggtgacagcgtgaaaatgtatggctctgccgtgccacctgctgcacccacgaatctgcccacccctcctgtaacccagcctgtttcacttcttggcactcaaggagttgcccctggtcctgtaattggacttcaggcaccatctactggtcttcttggcgcccggcccggtctcatcccactccagcgccctccaggaatgcccccacctcacttacagcggttccctttgatgccgccccgtcccatgccaccgcacatgatgcacagaggcccaccgccaggaccagggggctttgcgatgcctccacctcatggaatgaaaggtcccttcccaccgcatggcccctttgttaggcctggtggaatgccagggctcgggggcccagggccaggcccagggggtcctgaagacagagacggaaggcaacagccgccgcagcagccacagcagcagccacagccgcaggcgccccagcaaccacagcagcagcagcagcagcagccaccaccatcacaacagcctccaccaacacagcagcagccacagcagtttagaaatgataacaggcagcagttcaattcaggtagagaccaagaaaggtttggaagaagatcttttggaaatagggtggaaaatgaccgggaacggtatgggaaccgtaatgatgatagagataatagtaaccgtgacaggagagagtggggaaggaggagccctgaccgggacaggcacagagacttggaagagagaaatagacgctctagtgggcatcgagacagagagagagattctagagatagagagtctcgtagagagaaggaagaagcccgaggaaaggaaaagcctgaggtgacagacagggcaggtggtaacaaaaccgttgaacctcccattagccaagtgggaaatgtagacactgcttcagaacttgagaagggggtgtctgaggctgcagtcctaaagccttctgaagagttacctgctgaggctacctcatccgttgaacccgaaaaggattctggctcagcagcagaggctcctcgttagagactggaatttgtgaaaatgtgacagtgacacttcctggagtgtagagcttgaggtgtacagatgctgtattatatccgctcccgctgtactgcagccccgcgccagctggtggggaactgtaagcaatttgattgcttcccttctatttaaaaatagccacaaaataacaaaaaatactgaaaatatgaataaatattaccctttttgctgtaactttttaaaagttttgactttaaaaagtttacaaatcgtaattagaagtgctctctatttttttttttttttttaatttaagacaaggtaacggtgaaagctcctcaaaacaatagggatgtttttaataaactctattttcgtaacaaa

SEQ ID NO: 2222 - DNA, 4224 bp, Homo sapiens
agggtgccccgcgcggcgtggactcgggccgctgccgccatcccgctggagagagggagagagaggcccgcccgctcgccggccgggccagtgtgagccagtgcgtgagggcgcggggggccgtgtcagcgagacgcagagcgcagccgccaccaccaaacggacatgttgaagaccagcgctgccgccgcctccttttcctcatcctgcgaacgggactgagagggggcccgccacctctccgcctctgcctcggccgcccgcctcgccgcttcgggcgcagcctcttcctgcccgggcctcggactccgccgctcgtcgcctccccccggccaccaggcccggctggtttcccagccccgctccgccgcggcgcgaggtctatgtgaccggcgggcccggagcagccgccgccgcagcgcgaacatggacgccgtcaacgccttcaaccaggagctcttttcgcttatggatatgaaacctcccatctctagagccaagatgattctcatcactaaagctgctattaaagctattaagtgtaaaccagaatacaaggttccgggattatatgtaattgactcaattgtgcgacagtctcgtcatcagtttggaactgataaagatgtttttgggccaagattctctaaaaacataactgccacattccaatatttatatctttgtccatctgaagataagagtaaaatagttcgtgtgctgaacctttggcaaaaaaatggagtgttcaaaattgaaattattcaacctcttttggacatggcagcgggaaccagtaatgcagccccagtagcagaaaatgttaccaataatgaaggctcacctccacctccagtaaaagtttcttctgaacctcccacacaagccactccaaactccgtcccagctgtaccacagttgcccagctctgatgcttttgctgctgtggctcagctgtttcagacaactcaaggccaacagcttcagcagatccttcagacttttcaacagcctccaaaaccacagtctcctgcccttgacaatgctgtgatggctcaggttcaggctatcacagctcagttaaagacaactcctacacaaccatctgaacaaaaagctgctttccccccacctgaacagaaaactgcatttgacaagaagttgcttgatagatttgactatgatgatgagccagaagctgtggaagaatcaaagaaagaggataccactgccgtcaccacgacagcacctgctgccgcagtaccccctgcacccaccgccaccgtgcctgctgctgctgcacccgctgctgcctctcctcctcctccacaggcaccatttggctttcctggagatggcatgcagcagccagcatacacacagcatcaaaatatggatcagtttcagccacgaatgatgggaatacaacaggatccaatgcaccatcaggttccacttcctcctaatggacaaatgccaggatttggacttcttcctacacctccatttcctcccatggctcagcctgtgattcctccaactccaccagtgcagcagcctttccaagcttcttttcaggcacaaaatgaaccacttacacagaagccgcatcagcaggaaatggaagtagaacaaccttgtattcaagaggttaagcgacatatgtctgataacagaaagtcaagatctaggtcagcatccaggtcaccaaaaaggaggcgatctagatctggttctagatctcgaaggtctcggcatcgacgttctcgatctcggtccagggatagacgccgacattctccccgatctcgatctcaagaaagacgggatcgagaaaaagagagagaacgtcgacaaaaaggcctccctcaagtgaaaccggaaactgcaagtgtttgcagtactaccctctgggtggggcagctggacaaaagaactactcagcaggatgttgccagtctcttggaagagtttggtccaattgaatcaattaatatgattcctcccaggggttgtgcctatattgttatggttcataggcaagatgcctatcgtgccctgcagaaactgagccgaggaaactataaagtgaaccagaaatccataaagattgcctgggccttaaacaaaggaataaaggcagattataagcagtattgggatgtagaacttggtgttacttatattccatgggacaaagtcaagcctgaggaactggagagtttttgtgaaggaggaatgttggacagtgacacacttaacccagattggaaaggaattcctaagaagcctgaaaatgaagttgctcaaaatggaggtgctgaaacctcacacacagaaccagtatcacccatacctaaaccattacctgtgcctgtccctcctattcctgttcctgcacctataacagtgccacctccacaggtcccaccacatcaaccgggtccacctgtagttggtgctctccagccgcctgctttcacgcctcctctgggaataccgcctccaggctttggtcctggtgttcctcctccccctcctcctccaccatttttgcgcccaggattcaacccaatgcatttaccaccaggttttctgcctcctggacccccacctcctataactccaccagtatccattcctcctcctcacactccaccaataagcatcccaaactctactatcgctggtataaatgaagacactacaaaagacttatctattggaaatcccattccaacagtggtgtctggggctagaggaaacgccgagtctggtgacagcgtgaaaatgtatggctctgccgtgccacctgctgcacccacgaatctgcccacccctcctgtaacccagcctgtttcacttcttggcactcaaggagttgcccctggtcctgtaattggacttcaggcaccatctactggtcttcttggcgcccggcccggtctcatcccactccagcgccctccaggaatgcccccacctcacttacagcggttccctttgatgccgccccgtcccatgccaccgcacatgatgcacagaggcccaccgccaggaccagggggctttgcgatgcctccacctcatggaatgaaaggtcccttcccaccgcatggcccctttgttaggcctggtggaatgccagggctcgggggcccagggccaggcccagggggtcctgaagacagagacggaaggcaacagccgccgcagcagccacagcagcagccacagccgcaggcgccccagcaaccacagcagcagcagcagcagcagccaccaccatcacaacagcctccaccaacacagcagcagccacagcagtttagaaatgataacaggcagcagttcaattcaggtagagaccaagaaaggtttggaagaagatcttttggaaatagggtggaaaatgaccgggaacggtatgggaaccgtaatgatgatagagataatagtaaccgtgacaggagagagtggggaaggaggagccctgaccgggacaggcacagagacttggaagagagaaatagacgctctagtgggcatcgagacagagagagagattctagagatagagagtctcgtagagagaaggaagaagcccgaggaaaggaaaagcctgaggtgacagacagggcaggtggtaacaaaaccgttgaacctcccattagccaagtgggaaatgtagacactgcttcagaacttgagaagggggtgtctgaggctgcagtcctaaagccttctgaagagttacctgctgaggctacctcatccgttgaacccgaaaaggattctggctcagcagcagaggctcctcgttagagactggaatttgtgaaaatgtgacagtgacacttcctggagtgtagagcttgaggtgtacagatgctgtattatatccgctcccgctgtactgcagccccgcgccagctggtggggaactgtaagcaatttgattgcttcccttctatttaaaaatagccacaaaataacaaaaaatactgaaaatatgaataaatattaccctttttgctgtaactttttaaaagttttgactttaaaaagtttacaaatcgtaattagaagtgctctctatttttttttttttttttaatttaagacaaggtaacggtgaaagctcctcaaaacaatagggatgtttttaataaactctattttcgtaacaaactttaatgtgtgctattcttcctacactgcatt

SEQ ID NO: 2223 - DNA, 5055 bp, Homo sapiens
cggccgccggggctcgcacggtccagtcgccagggggcgcgctagccggcgccgcggatccccgaactgcgcggcccgactcgagtccgccatattggatgccgcagccgctgctgccagcgcttcctcctctgtcttcgccgagcggggctggttcctgcggcccgagcggcggggaggtgaaacaggagcccgtcggaggaaggggcagaagggagtggagagtgtaggggaaggggctagagggagggggaccgaaacggagcggggcagagaagagaaggcgccgcggcccagcccctcccccgcccgccgccgacccgccccggcagcgcctctgttccctagaacggcgctccccccgccctagcggccatgccggtgccgctctgccgctgagggagcccttccccgccagcgcgtgcccttccactccgccccgaggtcgcagcggcccgctctcccgccagcgccccctcctcgcggccacgcagcagcccgcgtctcgctctccccacccagtgcagtggccgccgcctcttccgccgccgggctcggggcctccgcagcgacaacatggaggccgtgaagaccttcaatagcgagttgtattccctgaatgactataaaccacccatttcgaaagcgaaaatgacccaaattactaaggcagccatcaaagctattaagttctataaacatgtggtacagagtgttgagaagtttattcagaaatgtaaaccagaatacaaagtacctggactttatgttattgactccattgtgcgacaatcccgacatcagtttggtcaagaaaaggatgtgtttgcacccagatttagtaataacatcattagcactttccagaatttatatcgttgccctggggatgacaagagtaaaatagtgagagtactaaacttatggcagaagaataatgtatttaagagtgagattattcagccccttttggatatggcagccgggattccgcctccagttgtcacacctgttttggccagcactaccactgctatgagcaatactccaggaactcctgtgacacctgttactccggccaatgtggtccaaggcttacctgatccgtgggtatctcagataacaaatacagatacacttgcggctgtagctcagatcttgcaaagtcctcaaggccagcagcttcaacaattaatacaaaccttacagatacaacaacagaagccccagccttccattctgcaggccctagatgctggtcttgttgttcagttgcaagctcttacggcacaacttacagctgcagctgcagctgccaacactcttactcccttagaacagggagtctcctttaacaagaagttgatggataggtttgattttggggaagactctgagcatagtgaagaacccaaaaaggaaattccagcttcacaactttctcacgtttcagaatctgtgaacaattccatttttcatcagatagcagaacaactacaacagcaaaacctagaacatctcagacagcagctcttggagcagcaacagcctcaaaaggccactcctcaggatagtcaggaaggaacctttgggtcagagcattcagcgtcaccatcacaagggagtagtcagcagcattttcttgaacctgaagtcaatttggatgattccatagatattcagcaacaggatatggatatagatgaagggcaagatggagtggaagaggaggtctttgaacaagaagctaagaaagtggcggttcgctcaagatcaagaacacattcacgatctcgttcaagatcaccaagaaaacgaaggtctaggtcacggtctggctctagaaagcgtaaacacagaaagcgatcacgctcccgctcaagagaaagaaagaggaaatcatcacggtcgtattcaagtgaaaggagagccagagaaagggagaaagaacgacagaaaaagggattacctccaattagatctaaaacactaagtgtatgtagtactactctctgggttgggcaagtggacaagaaggcaacacagcaagacttaaccaacctgtttgaagagtttggacagattgaatccattaatatgattcctccccggggctgtgcttatgtctgcatggttcatcgacaagatgcatttcgagctcttcagaaactcagttctggatcatataaaattgggtccaaggtcattaagatcgcttgggctttaaacaaaggtgtaaaaacagaatacaaacaattctgggatgtggatcttggagttacatatataccatgggaaaaagttaaagtggatgacttggaaggttttgcagaaggaggcatgattgatcaggagactgtaaatactgagtgggaaactgtgaaaagctcagaacctgttaaagagacggtccagacaactcagagcccaactccagttgaaaaggagacagtggtcacaacccaggcagaggttttccctcctcctgttgctatgttgcagattccagtggcgccagccgtgcctacagttagtttagtcccaccagcatttcctgtgtcgatgccggttcctcctcctggattcagtccaatccctccacctccttttttaagagcaagttttaacccttcacaaccaccacctggtttcatgccgcctccagttcccccacctgttgtgccaccccctacgattccaccagtagtaccaacatctttagtgcagccgtcattatccatgacaccggaaactgtgaaagatgttggatttggtagccttgttataccaggcggttctgttgccagcaatcttgctacttccgctctgccagctggaaatgtttttaatgctccaactaaacaggcagagcctgaagaaaaagtacctcatcttatagaccaccagatttcttctggtgaaaacaccagatcagtgattccaaatgatatttcaagtaatgctgcaattttaggaggacagccgccaaatgtgacaagcaattctggaattctgggagtccaaagaccaaatgtatcaagtaattctgaaattcttggggtccggccatctaatgtttccagtagttctgggattattgcagcccaaccaccaaatattctaaataactctggaatattgggaatacagccacccagtgtgtcaaatagttctggacttttgggagtgctacccccaaatatacctaacaattctggacttgtaggagtacagccaccaaatgttccaaatactcctggacttctgggaacacagccaccagctggacctcaaaacttaccccctttaagtatccctaatcaaaggatgcccacaatgccaatgttagacattcgtccgggactaataccacaggcacctgggccaagattccctttaatacagcctggaattccaccccaacggggaatcccacccccatcggtacttgattcagctcttcatccaccaccccgtggaccttttcctccaggagatatttttagtcaaccagaaagaccttttttagctcctggaagacaaagcgtagacaatgttactaacccagaaaaaaggataccacttgggaatgataacattcaacaggaaggagatagagattaccggtttcctcctatagaaaccagggaaagcattagtagacctccccctgtggatgttagagatgtggttgggcggcctatagatccaagagaaggtcctggacggcctccactagatggtagggatcattttggaagacctcctgtagatataagagagaatcttgtgaggccaggtatagatcatcttggtcgaagagaccactttggctttaatccagagaagccctgggggcatagaggagattttgatgagagagagcatcgggttctaccggtctatggtggtccaaaaggcttacatgaagaaagaggtagatttcggtctggaaactatcgatttgatcctagaagtggtccttggaaccgaggatttggacaagaagttcacagagattttgatgaccgcagaagaccctgggagaggcaaagggatagggatgacagagattttgatttctgcagagaaatgaatggaaatcgtcttggacgagacagaattcaaaacacttgggttccccctcctcatgctcgggtttttgattattttgaaggggccacttctcaacgaaaaggtgataatgtgcctcaggttaatggtgaaaatacagagagacatgctcagccaccacctataccagtacagaatgatcctgaactttatgaaaaactgacatcttcaaatgaaataaacaaggagaagagtgacacagttgctgatatagaaagtgaaccagtggtagaaagcacagaaactgaggggacataatcatcactcagtaggtaaaagataccttttgtaaagttgtcatctctctgtaatagataatggctgactggaccatagttgttcacttttgtctgccagaattaagttaatctgatgttcatgttcacctttctcttaaaataattgtacaactgacttgtatagacattgttcttaatatgaacatggtaggtaaactttttttttatttttttctgataaaatacaaatgttggccccagattcttttaacgtcaaggaaatgaataacagcttgtcagagacttcctatggaagaaagaattttttagatactatcattaggttggatatggtaatagatatatttcagaatagcaagtggtggtatatcttatccatatctttaggctgctgcagaattttaaggttatagataaagctgtgatattttatgcaaagactggctctaggtatttgaggagcacaatacagagattttaaaaagtgattttgtaaaatctacactacggtctctgtttctccaaagtaagtgtttgtgatttgttcctcatactgcagtgagtaaaaaagaaacaagaaaacaacaacataaatattaaagtacgtttcaatgttgggtgaattttgtttttagatgccaataaaacttatttgtttgat

SEQ ID NO: 2224 - DNA, 4684 bp, Homo sapiens
atattggatgccgcagccgctgctgccagcgcttcctcctctgtcttcgccgagcggggctggttcctgcggcccgagcggcggggagtgcagtggccgccgcctcttccgccgccgggctcggggcctccgcagcgacaacatggaggccgtgaagaccttcaatagcgaggattgtgcctctactcctgcttgtacagactgcttttccagcagcatggacacaagaagcatattgtattccctgaatgactataaaccacccatttcgaaagcgaaaatgacccaaattactaaggcagccatcaaagctattaagttctataaacatgtggtacagagtgttgagaagtttattcagaaatgtaaaccagaatacaaagtacctggactttatgttattgactccattgtgcgacaatcccgacatcagtttggtcaagaaaaggatgtgtttgcacccagatttagtaataacatcattagcactttccagaatttatatcgttgccctggggatgacaagagtaaaatagtgagagtactaaacttatggcagaagaataatgtatttaagagtgagattattcagccccttttggatatggcagccgggattccgcctccagttgtcacacctgttttggccagcactaccactgctatgagcaatactccaggaactcctgtgacacctgttactccggccaatgtggtccaaggcttacctgatccgtgggtatctcagataacaaatacagatacacttgcggctgtagctcagatcttgcaaagtcctcaaggccagcagcttcaacaattaatacaaaccttacagatacaacaacagaagccccagccttccattctgcaggccctagatgctggtcttgttgttcagttgcaagctcttacggcacaacttacagctgcagctgcagctgccaacactcttactcccttagaacagggagtctcctttaacaagaagttgatggataggtttgattttggggaagactctgagcatagtgaagaacccaaaaaggaaattccagcttcacaactttctcacgtttcagaatctgtgaacaattccatttttcatcagatagcagaacaactacaacagcaaaacctagaacatctcagacagcagctcttggagcagcaacagcctcaaaaggccactcctcaggatagtcaggaaggaacctttgggtcagagcattcagcgtcaccatcacaagggagtagtcagcagcattttcttgaacctgaagtcaatttggatgattccatagatattcagcaacaggatatggatatagatgaagggcaagatggagtggaagaggaggtctttgaacaagaagctaagaaagtggcggttcgctcaagatcaagaacacattcacgatctcgttcaagatcaccaagaaaacgaaggtctaggtcacggtctggctctagaaagcgtaaacacagaaagcgatcacgctcccgctcaagagaaagaaagaggaaatcatcacggtcgtattcaagtgaaaggagagccagagaaagggagaaagaacgacagaaaaagggattacctccaattagatctaaaacactaagtgtatgtagtactactctctgggttgggcaagtggacaagaaggcaacacagcaagacttaaccaacctgtttgaagagtttggacagattgaatccattaatatgattcctccccggggctgtgcttatgtctgcatggttcatcgacaagatgcatttcgagctcttcagaaactcagttctggatcatataaaattgggtccaaggtcattaagatcgcttgggctttaaacaaaggtgtaaaaacagaatacaaacaattctgggatgtggatcttggagttacatatataccatgggaaaaagttaaagtggatgacttggaaggttttgcagaaggaggcatgattgatcaggagactgtaaatactgagtgggaaactgtgaaaagctcagaacctgttaaagagacggtccagacaactcagagcccaactccagttgaaaaggagacagtggtcacaacccaggcagaggttttccctcctcctgttgctatgttgcagattccagtggcgccagccgtgcctacagttagtttagtcccaccagcatttcctgtgtcgatgccggttcctcctcctggattcagtccaatccctccacctccttttttaagagcaagttttaacccttcacaaccaccacctggtttcatgccgcctccagttcccccacctgttgtgccaccccctacgattccaccagtagtaccaacatctttagtgcagccgtcattatccatgacaccggaaactgtgaaagatgttggatttggtagccttgttataccaggcggttctgttgccagcaatcttgctacttccgctctgccagctggaaatgtttttaatgctccaactaaacaggcagagcctgaagaaaaagtacctcatcttatagaccaccagatttcttctggtgaaaacaccagatcagtgattccaaatgatatttcaagtaatgctgcaattttaggaggacagccgccaaatgtgacaagcaattctggaattctgggagtccaaagaccaaatgtatcaagtaattctgaaattcttggggtccggccatctaatgtttccagtagttctgggattattgcagcccaaccaccaaatattctaaataactctggaatattgggaatacagccacccagtgtgtcaaatagttctggacttttgggagtgctacccccaaatatacctaacaattctggacttgtaggagtacagccaccaaatgttccaaatactcctggacttctgggaacacagccaccagctggacctcaaaacttaccccctttaagtatccctaatcaaaggatgcccacaatgccaatgttagacattcgtccgggactaataccacaggcacctgggccaagattccctttaatacagcctggaattccaccccaacggggaatcccacccccatcggtacttgattcagctcttcatccaccaccccgtggaccttttcctccaggagatatttttagtcaaccagaaagaccttttttagctcctggaagacaaagcgtagacaatgttactaacccagaaaaaaggataccacttgggaatgataacattcaacaggaaggagatagagattaccggtttcctcctatagaaaccagggaaagcattagtagacctccccctgtggatgttagagatgtggttgggcggcctatagatccaagagaaggtcctggacggcctccactagatggtagggatcattttggaagacctcctgtagatataagagagaatcttgtgaggccaggtatagatcatcttggtcgaagagaccactttggctttaatccagagaagccctgggggcatagaggagattttgatgagagagagcatcgggttctaccggtctatggtggtccaaaaggcttacatgaagaaagaggtagatttcggtctggaaactatcgatttgatcctagaagtggtccttggaaccgaggatttggacaagaagttcacagagattttgatgaccgcagaagaccctgggagaggcaaagggatagggatgacagagattttgatttctgcagagaaatgaatggaaatcgtcttggacgagacagaattcaaaacacttgggttccccctcctcatgctcgggtttttgattattttgaaggggccacttctcaacgaaaaggtgataatgtgcctcaggttaatggtgaaaatacagagagacatgctcagccaccacctataccagtacagaatgatcctgaactttatgaaaaactgacatcttcaaatgaaataaacaaggagaagagtgacacagttgctgatatagaaagtgaaccagtggtagaaagcacagaaactgaggggacataatcatcactcagtaggtaaaagataccttttgtaaagttgtcatctctctgtaatagataatggctgactggaccatagttgttcacttttgtctgccagaattaagttaatctgatgttcatgttcacctttctcttaaaataattgtacaactgacttgtatagacattgttcttaatatgaacatggtaggtaaactttttttttatttttttctgataaaatacaaatgttggccccagattcttttaacgtcaaggaaatgaataacagcttgtcagagacttcctatggaagaaagaattttttagatactatcattaggttggatatggtaatagatatatttcagaatagcaagtggtggtatatcttatccatatctttaggctgctgcagaattttaaggttatagataaagctgtgatattttatgcaaagactggctctaggtatttgaggagcacaatacagagattttaaaaagtgattttgtaaaatctacactacggtctctgtttctccaaagtaagtgtttgtgatttgttcctcatactgcagtgagtaaaaaagaaacaagaaaacaacaacataaatattaaagtacgtttcaatgttgggtgaattttgtttttagatgccaataaaacttatttgtttgat

SEQ ID NO: 2225 - DNA, 4709 bp, Homo sapiens
gcggatccccgaactgcgcggcccgactcgagtccgccatattggatgccgcagccgctgctgccagcgcttcctcctctgtcttcgccgagcggggctggttcctgcggcccgagcggcggggagcgccccctcctcgcggccacgcagcagcccgcgtctcgctctccccacccagtgcagtggccgccgcctcttccgccgccgggctcggggcctccgcagcgacaacatggaggccgtgaagaccttcaatagcgagttgtattccctgaatgactataaaccacccatttcgaaagcgaaaatgacccaaattactaaggcagccatcaaagctattaagttctataaacatgtggtacagagtgttgagaagtttattcagaaatgtaaaccagaatacaaagtacctggactttatgttattgactccattgtgcgacaatcccgacatcagtttggtcaagaaaaggatgtgtttgcacccagatttagtaataacatcattagcactttccagaatttatatcgttgccctggggatgacaagagtaaaatagtgagagtactaaacttatggcagaagaataatgtatttaagagtgagattattcagccccttttggatatggcagccgggattccgcctccagttgtcacacctgttttggccagcactaccactgctatgagcaatactccaggaactcctgtgacacctgttactccggccaatgtggtccaaggcttacctgatccgtgggtatctcagataacaaatacagatacacttgcggctgtagctcagatcttgcaaagtcctcaaggccagcagcttcaacaattaatacaaaccttacagatacaacaacagaagccccagccttccattctgcaggccctagatgctggtcttgttgttcagttgcaagctcttacggcacaacttacagctgcagctgcagctgccaacactcttactcccttagaacagggagtctcctttaacaagaagttgatggataggtttgattttggggaagactctgagcatagtgaagaacccaaaaaggaaattccagcttcacaactttctcacgtttcagaatctgtgaacaattccatttttcatcagatagcagaacaactacaacagcaaaacctagaacatctcagacagcagctcttggagcagcaacagcctcaaaaggccactcctcaggatagtcaggaaggaacctttgggtcagagcattcagcgtcaccatcacaagggagtagtcagcagcattttcttgaacctgaagtcaatttggatgattccatagatattcagcaacaggatatggatatagatgaagggcaagatggagtggaagaggaggtctttgaacaagaagctaagaaagtggcggttcgctcaagatcaagaacacattcacgatctcgttcaagatcaccaagaaaacgaaggtctaggtcacggtctggctctagaaagcgtaaacacagaaagcgatcacgctcccgctcaagagaaagaaagaggaaatcatcacggtcgtattcaagtgaaaggagagccagagaaagggagaaagaacgacagaaaaagggattacctccaattagatctaaaacactaagtgtatgtagtactactctctgggttgggcaagtggacaagaaggcaacacagcaagacttaaccaacctgtttgaagagtttggacagattgaatccattaatatgattcctccccggggctgtgcttatgtctgcatggttcatcgacaagatgcatttcgagctcttcagaaactcagttctggatcatataaaattgggtccaaggtcattaagatcgcttgggctttaaacaaaggtgtaaaaacagaatacaaacaattctgggatgtggatcttggagttacatatataccatgggaaaaagttaaagtggatgacttggaaggttttgcagaaggaggcatgattgatcaggagactgtaaatactgagtgggaaactgtgaaaagctcagaacctgttaaagagacggtccagacaactcagagcccaactccagttgaaaaggagacagtggtcacaacccaggcagaggttttccctcctcctgttgctatgttgcagattccagtggcgccagccgtgcctacagttagtttagtcccaccagcatttcctgtgtcgatgccggttcctcctcctggattcagtccaatccctccacctccttttttaagagcaagttttaacccttcacaaccaccacctggtttcatgccgcctccagttcccccacctgttgtgccaccccctacgattccaccagtagtaccaacatctttagtgcagccgtcattatccatgacaccggaaactgtgaaagatgttggatttggtagccttgttataccaggcggttctgttgccagcaatcttgctacttccgctctgccagctggaaatgtttttaatgctccaactaaacaggcagagcctgaagaaaaagtacctcatcttatagaccaccagatttcttctggtgaaaacaccagatcagtgattccaaatgatatttcaagtaatgctgcaattttaggaggacagccgccaaatgtgacaagcaattctggaattctgggagtccaaagaccaaatgtatcaagtaattctgaaattcttggggtccggccatctaatgtttccagtagttctgggattattgcagcccaaccaccaaatattctaaataactctggaatattgggaatacagccacccagtgtgtcaaatagttctggacttttgggagtgctacccccaaatatacctaacaattctggacttgtaggagtacagccaccaaatgttccaaatactcctggacttctgggaacacagccaccagctggacctcaaaacttaccccctttaagtatccctaatcaaaggatgcccacaatgccaatgttagacattcgtccgggactaataccacaggcacctgggccaagattccctttaatacagcctggaattccaccccaacggggaatcccacccccatcggtacttgattcagctcttcatccaccaccccgtggaccttttcctccaggagatatttttagtcaaccagaaagaccttttttagctcctggaagacaaagcgtagacaatgttactaacccagaaaaaaggataccacttgggaatgataacattcaacaggaaggagatagagattaccggtttcctcctatagaaaccagggaaagcattagtagacctccccctgtggatgttagagatgtggttgggcggcctatagatccaagagaaggtcctggacggcctccactagatggtagggatcattttggaagacctcctgtagatataagagagaatcttgtgaggccaggtatagatcatcttggtcgaagagaccactttggctttaatccagagaagccctgggggcatagaggagattttgatgagagagagcatcgggttctaccggtctatggtggtccaaaaggcttacatgaagaaagaggtagatttcggtctggaaactatcgatttgatcctagaagtggtccttggaaccgaggatttggacaagaagttcacagagattttgatgaccgcagaagaccctgggagaggcaaagggatagggatgacagagattttgatttctgcagagaaatgaatggaaatcgtcttggacgagacagaattcaaaacacttgggttccccctcctcatgctcgggtttttgattattttgaaggggccacttctcaacgaaaaggtgataatgtgcctcaggttaatggtgaaaatacagagagacatgctcagccaccacctataccagtacagaatgatcctgaactttatgaaaaactgacatcttcaaatgaaataaacaaggagaagagtgacacagttgctgatatagaaagtgaaccagtggtagaaagcacagaaactgaggggacataatcatcactcagtaggtaaaagataccttttgtaaagttgtcatctctctgtaatagataatggctgactggaccatagttgttcacttttgtctgccagaattaagttaatctgatgttcatgttcacctttctcttaaaataattgtacaactgacttgtatagacattgttcttaatatgaacatggtaggtaaactttttttttatttttttctgataaaatacaaatgttggccccagattcttttaacgtcaaggaaatgaataacagcttgtcagagacttcctatggaagaaagaattttttagatactatcattaggttggatatggtaatagatatatttcagaatagcaagtggtggtatatcttatccatatctttaggctgctgcagaattttaaggttatagataaagctgtgatattttatgcaaagactggctctaggtatttgaggagcacaatacagagattttaaaaagtgattttgtaaaatctacactacggtctctgtttctccaaagtaagtgtttgtgatttgttcctcatactgcagtgagtaaaaaagaaacaagaaaacaacaacataaatattaaagtacgtttcaatgttgggtgaattttgtttttagatgccaataaaacttatttgtttg

SEQ ID NO: 2226 - DNA, 3265 bp, Homo sapiens
gggggagggatgactaaagacaacggctgtaagagaactccacaagagagtcagaacgaaaatgtgcaacaagtgcggcggctcctaccatggcaggtgattcgaggactcagcacgaggcgagagtagggaccaggaagagccggaaaacccgcctgtgattggccgtccacgggtatcggtcgttgtgattgggtgaggcccagacagacagctgcgttttgaaccgcgtagggttctgggtagcaaaggccttgcaaggctcttaaccgaaagggggagggggaaggtcgccaacaaacggctgagctcacaatcctggccggggcgtccccctcccccatggagagagccagacccgagccgccgcctcagccgcgcccgttgcgtcccgctccgcccccgctgccggtcgagggcacctccttttgggcagcagccatggagccccctccgtcgtctcccacactgagcgcggcagccagtgcgaccttggcctcgtcgtgcggggaggcagtggcgtccggcttacagcccgcggtgcggcggctgctgcaggtgaagccagagcaggtgttgctgctaccacagcctcaggcccagaacgaggaagccgctgcctcgtccgcgcaggcgcggctgttgcagttcaggcccgacctgcggctcctgcagccgccgacagcgtcagacggcgccacctccaggcccgagttgcacccggtgcagcccctggcgctgcatgtcaaggccaagaagcagaagctggggcccagcctggatcagtcagtggggcctcgaggggccgtcgaaaccggtcctagagcctccagggtggtcaagttggaaggccccgggccggccctcggctacttccgaggggacgagaagggcaagctggaggcggaggaggtcatgagagactcgatgcaaggcggggcaggcaaaagcccggcagccatccgagaaggtgtgatcaaaacggaggaacccgagagactcctcgaggactgcaggctcggcgcggagcccgcgtccaatggcctggttcatggcagcgcggaggtcatcttggccccaacgtccggtgcctttgggccgcaccagcaagaccttaggatccctttgacgctccacacggtcccccctggggcccggatccagtttcagggagctccgccttcagagctgataagattgaccaaggtccccctgacaccagtgcctactaaaatgcagtccctactggagccttctgtaaaaattgaaaccaaagatgtcccgctcaccgtgttgccctcagatgcaggcataccagatactcccttcagtaaggacagaaatggtcatgtgaagcgacccatgaacgcatttatggtttgggcaaggatccaccgaccagcactagccaaagctaacccagcagccaacaatgcagaaatcagtgtccagcttgggttagagtggaacaaacttagtgaagaacaaaagaaaccctattacgatgaagcacaaaagattaaggaaaagcacagagaggaatttcctggttgggtttatcagcctcgtccagggaagcgaaaacgattccctctaagtgtttccaatgtattttctggtaccacacagaatatcatctctacaaatcctacaacagtttatccttaccgctcacctacgtactctgtggtaattcccagcctacagaatcccatcactcatccagttggtgaaacctcacctgctatccagctgcccacacctgcagtccagagcccaagccctgtcacacttttccagcccagcgtctccagtgctgctcaggtggctgtccaggatccaagtctacctgtctatccagcactcccaccccaacgctttactgggccttcccaaacagacactcatcagctgcattctgaagccactcacactgtgaagcaacccactcctgtctctctagagagcgccaacaggatttcaagtagtgcaagtactgcccatgccagatttgcaacttcgaccatccaacctcctagggagtattccagcgtttccccttgtcccagaagtgctccaatcccccaggcttctcccattccacacccacatgtctaccagccccctccccttggccatccagccacactgttcgggacaccaccaagattctcttttcatcacccttacttcctacccggacctcactacttcccatcaagtacatgcccttacagtcggcctccctttggctatggaaattttccgagttcaatgccagaatgccttagttattatgaagacaggtacccaaaacatgagggtatcttttcaactttaaatagagactattcttttagagactactcaagtgaatgcacacacagtgaaaattctcggagttgtgagaacatgaatggaacttcttactataacagtcatagccacagtggggaagaaaacttaaaccctgtgcctcagctggacattggaaccttggagaatgtcttcacagccccgacatcaactccttctagcatccagcaagtcaatgtcaccgacagtgatgaggaggaagaagaaaaagtgctcagggatttataattttaaaacaaatatgcacagaaaataaacatttcttaaaatatattctgggtcagttggtatgagaaaaaaaaaagcctagaattctttgttgaaagttttcagtcgtgatttgaggagttaaaaccaaatgcaatttatgtcttcataaaattttgattagtgaaactagagtctggatgtttcattgtaggaatatttaagttattaagtagtttaattttaatggctgaaatttgcatcaacatgtattattattactttatcctggaacatgcaaaatactgaagcctcacagttgtatgtgaggggaaaggggaaataaatctagcatagtgtgatttttattttatctcaggatacattttttaaatgattttttgtttgctttttatgtaatacttatggatgttgtcaatttttgatgtaacattttgaaagtattttgacaactcctagtgaacttggacttggttgctaaatttaacttacactaataaccaattataagttccaaatgtgttttaatggcacctgggtgattcttcagctaaatttagtcatttctgtttctaaatatttttatcattttaaaatattttttttccatttggcatacatcgttctttgttgtaattaaataaacatagataaaattgtt

SEQ ID NO: 2227 - DNA, 2716 bp, Homo sapiens
cgaaaatgtgcaacaagtgcggcggctcctaccatggcaggtgattcgaggactcagcacgaggcgagagtagggaccaggaagagccggaaaacccgcctgtgattggccgtccacgggtatcggtcgttgtgattgggtgaggcccagacagacagctgcgttttgaaccgcgtagggttctgggtagcaaaggccttgcaaggctcttaaccgaaagggggagggggaaggtcgccaacaaacggctgagctcacaatcctggccggggcgtccccctcccccatggagagagccagacccgagccgccgcctcagccgcgcccgttgcgtcccgctccgcccccgctgccggtcgagggcacctccttttgggcagcagccatggagccccctccgtcgtctcccacactgagcgcggcagccagtgcgaccttggcctcgtcgtgcggggaggcagtggcgtccggcttacagcccgcggtgcggcggctgctgcaggtgaagccagagcaggtgttgctgctaccacagcctcaggcccagaacgaggaagccgctgcctcgtccgcgcaggcgcggctgttgcagttcaggcccgacctgcggctcctgcagccgccgacagcgtcagacggcgccacctccaggcccgagttgcacccggtgcagcccctggcgctgcatgtcaaggccaagaagcagaagctggggcccagcctggatcagtcagtggggcctcgaggggccgtcgaaaccggtcctagagcctccagggtggtcaagttggaaggccccgggccggccctcggctacttccgaggggacgagaagggcaagctggaggcggaggaggtcatgagagactcgatgcaaggcggggcaggcaaaagcccggcagccatccgagaaggtgtgatcaaaacggaggaacccgagagactcctcgaggactgcaggctcggcgcggagcccgcgtccaatggcctggttcatggcagcgcggaggtcatcttggccccaacgtccggtgcctttgggccgcaccagcaagaccttaggatccctttgacgctccacacggtcccccctggggcccggatccagtttcagggagctccgccttcagagctgataagattgaccaaggtccccctgacaccagtgcctactaaaatgcagtccctactggagccttctgtaaaaattgaaaccaaagatgtcccgctcaccgtgttgccctcagatgcaggcataccagatactcccttcagtaaggacagaaatggtcatgtgaagcgacccatgaacgcatttatggtttgggcaaggatccaccgaccagcactagccaaagctaacccagcagccaacaatgcagaaatcagtgtccagcttgggttagagtggaacaaacttagtgaagaacaaaagaaaccctattacgatgaagcacaaaagattaaggaaaagcacagagaggaatttcctggttgggtttatcagcctcgtccagggaagcgaaaacgattccctctaagtgtttccaatgtattttctggtaccacacagaatatcatctctacaaatcctacaacagtttatccttaccgctcacctacgtactctgtggtaattcccagcctacagaatcccatcactcatccagttgtacatgcccttacagtcggcctccctttggctatggaaattttccgagttcaatgccagaatgccttagttattatgaagacaggtacccaaaacatgagggtatcttttcaactttaaatagagactattcttttagagactactcaagtgaatgcacacacagtgaaaattctcggagttgtgagaacatgaatggaacttcttactataacagtcatagccacagtggggaagaaaacttaaaccctgtgcctcagctggacattggaaccttggagaatgtcttcacagccccgacatcaactccttctagcatccagcaagtcaatgtcaccgacagtgatgaggaggaagaagaaaaagtgctcagggatttataattttaaaacaaatatgcacagaaaataaacatttcttaaaatatattctgggtcagttggtatgagaaaaaaaaaagcctagaattctttgttgaaagttttcagtcgtgatttgaggagttaaaaccaaatgcaatttatgtcttcataaaattttgattagtgaaactagagtctggatgtttcattgtaggaatatttaagttattaagtagtttaattttaatggctgaaatttgcatcaacatgtattattattactttatcctggaacatgcaaaatactgaagcctcacagttgtatgtgaggggaaaggggaaataaatctagcatagtgtgatttttattttatctcaggatacattttttaaatgattttttgtttgctttttatgtaatacttatggatgttgtcaatttttgatgtaacattttgaaagtattttgacaactcctagtgaacttggacttggttgctaaatttaacttacactaataaccaattataagttccaaatgtgttttaatggcacctgggtgattcttcagctaaatttagtcatttctgtttctaaatatttttatcattttaaaatattttttttccatttggcatacatcgttctttgttgtaattaaataaacatagataaaattgtt

SEQ ID NO: 2228 - DNA, 1290 bp, Homo sapiens
ggcgccgtgacgctcagccgggccttgtggagtgcgggtctctgctgcggacgccgggggccggcgcggcgttggccgcccccggcctcgccgagtgcagcgcgcccgaaggccagtgcctgcgctccgtccgcggcccggcgcccagggtgggcggggaggccgccgcgcagtcgccgcacgctacaccgccggcgccgtcgtttcgcgtcgcccgcttccggccaccgcggccgccattttgttcgcgcggaagcgccgcggtagggtgggaacccaagcgggagagccgcgggatttgcggccgccgccatgccgtcgtccccgctgcgggtggcggtggtgtgctcgagcaaccagaaccggagcatggaggcgcacaacatcctcagcaaacggggattcagcgtccgatcctttggaacagggactcacgtgaagcttccaggaccagctcccgacaagcccaatgtttatgatttcaaaaccacatatgaccagatgtacaatgatcttcttaggaaagacaaagaactctatacacagaatgggattttacatatgctggacagaaataagagaatcaagccccggccagaaagattccagaactgcaaagacctgtttgatctgatcctcacttgcgaagagagagtgtatgaccaggtggtggaagatctgaattccagagaacaggagacctgccagcctgtgcacgtggtcaatgtggacatccaggacaaccacgaggaggccaccctgggggcgtttctcatctgtgagctctgccagtgtatccagcacacggaagacatggagaacgagatcgacgagctgctgcaggagttcgaggagaagagtggccgcacctttctgcacaccgtctgcttctactgagcccagcgcccgcatggagccgcctctggagcttcctgttgttcatactttttccttcctgacatttgtttttacttacaggtgttctgctggtgacggtagcattacccaaataaactgtgcatatgaaatgggagaggagatgccaaaacgccagatgaaagcaatcaagtttcttcttttccacttttacttatgagcaggatattgattacaaagtttttcttctttaaccaaaaaggaaagacaacggtttgtgtgcacttcccgacatacctgtgtcttcgtgtgcctgccttccctccctcctccccaccgggccggactgtacagagccctgctgcggcgtgttaggaatgacctggaattgtcaataaacagatgctgctgtca

SEQ ID NO: 2229 - DNA, 2672 bp, Homo sapiens
agagccgcgggatttgcggccgccgccatgccgtcgtccccgctgcgggtggcggtggtgtgctcgagcaaccagaaccggagcatggaggcgcacaacatcctcagcaaacggggattcagcgtccgatcctttggaacagggactcacgtgaagcttccaggaccagctcccgacaagcccaatgtttatgatttcaaaaccacatatgaccagatgtacaatgatcttcttaggaaagacaaagaactgtatcccagcgggttgccctttaaaaaccccccgtgtggtcctccctggaaggtgttacgtgtggctcgggcacaggaggcgtgtcaccctgtgcagtgcacacactggctcctctgtctttgcgagagcttggtttctattcctggtgcacgtcggatcgtccacgggttagttccagtgccacccatggcagtaggcgtggtgaggcgcacagacacggtgtggggttcaccctgacgtggttcagcagagggtcgtgacatagcgtagaccagggatgcttaggtgaggaggtggaacccacaaaatcccattgcttttcacactgcagggctgccccgttatttcctttgcaggttggtgtgcgtgcgtgtgtgcgtgcgtgcctgatacacatggagccgggctgcttcacacatctggtgaggtcgttagaaggtcagataaagaagagggcggagcttgctaaccaagctgttagaagaaataatgggagagaacattccttcatttcaggaggacacagagcaggctaggtctgccgcgaagactcctatagagagaagagtattcttaaactagattctgatggacgcaacaccagttgcataatggttatgacaatcagtgcccgggtttttgaccaggcatttcatggtcacccccacgctaatggaaagtttctggatcttattttgttatagtgagtgatttgtagttttcagaacggaggccaggccaaacgtattccaaatgaaaagagaataggtgtcaaatgctaaaccttttatcttcgtgttggcactgttgccatccccgccctctcccgacatccccgcccttgaccagcatctctggccttgcccagcattgtctatgtattggcactcttgccatccccgccctttcccagcagagtctcactgtgtcaccccggctggagtgcagtggcgagatcttggctcactgcagactcactgcaacatccacctcccgggttccagtgattctcctgcttcagcctcctgggtagctgggattacaggcacgcgccaccacacctggctaatttttgtatttttagtagtcacagggtttcaccatgttggccaggctggtcttaaactcctgacttcaggtgatccaccctcctcgtcctcccaaagtgctgggattacaggcgtgagccaccatgctcagccctactcttgtatttttttttttttttttttttgagatggagtcagagtctcaccctgttgcccaaggtggagtgtagcggcttgatctcagctcactgcaacctccccctcccaagttcaagcgattctctgcctcagcctcccgaatagctgggattacaggcatccgctgtcatgcctggctaatttttgtatttttagtagagacgggggtttcaccatcttgaccaaactggtcttgaactcttgacctcgtgatccagctgcctcggcctctcagagtgttgggattacaggcgtgagccaccatgcctggcctcttggaatatttaataagctaaaaaattcttatacacaggtagattaattaggtagccaggagtggcccctgaaagtatgtctggcaaaacctagaactgcatcctagccatcactgtaccttctgccctccctgctgtctcctctgccagttacagttaaaaggttgtgggtgaggacgctgggcagagtcccaggcgtctgctgtcagctccccagcccggcctgcctgccgagccatctgggcgtcccacggtggagagtgtggtgcttgtgacgcggtggtgctgggagccatcctggtggcagatgtgggctctcactgcaagtcagtgtaagtccccagggactgtcagcagcacgtcctgctgcccctctctctgcagaagccctggtaacctgcgtttggaaaaatctctaaggatttctgaggagctgtcaggccatgtccttgtccaccctgtgtggggcacggcttcgacatggctctgctcccgtcgtgggctgagaaggagcaggtggggctgtgccttggaaaggaggccctcccgacatgcctttgtgcgaggtccctgtccatgctgtctccatcccggagccttacggcgatgggtggccacagagcctattccaagagtctggtttagggctgggtcttcccatcttcacctctgagtcttaggcgatgcgtgaccacgcagccccttccaggagtctggtttagggctgggtcttcccatcttcacctctgagtcttaggcggtgcatgaccacgcagccccttcccggagtctggtttagggctgcgtgctcaagagtctggtttggggctgggtcttcccatcgccctggaggaggcttttgtctcatctcatgattcacattaaactctgtgccatg

SEQ ID NO: 2230 - DNA, 619 bp, Homo sapiens
gggagagccgcgggatttgcggccgccgccatgccgtcgtccccgctgcgggtggcggtggtgtgctcgagcaaccagaaccggagcatggaggcgcacaacatcctcagcaaacggggattcagcgtccgatcctttggaacagggactcacgtgaagcttccaggaccagctcccgacaagcccaatgtttatgatttcaaaaccacatatgaccagatgtacaatgatcttcttaggaaagacaaagaactctatacacagaatgggattttacatatgctggacagaaataagagaatcaagccccggccagaaagattccagaactgcaaagacctgtttgatctgatcctcacttgcgaagagagagtgtatgaccaggtggtggaaggtgaggaggcggctgcgtgctgggctgggctccagcagctctcacagggtctggggatgcctgcagggccccaccatgaccagtacagcccgtctagagtggcgggggccggggagcagacctgagtgtgaagcaccctggaaggcaggcagggccgctggtcgctgaaccacccatgtgctggctgcagcctcatgggcttcaaggggcctcttttctccttgg

SEQ ID NO: 2231 - DNA, 2238 bp, Homo sapiens
ttgattctcagcggctgaaggactaagttccccagagatggacccgggtgtcatagctgcttccaggggcctcggggacacaggcgggactccaatgtgcaggaggagacacacgtcaggggtgggtgtgtgacttccacgctgctgacagtgacccaaggatgcagctcagggtcagatgccgttagatcaaccacttcaatgtattataaaactattataaaaactatttttgctacccaggaaggtagctgagttcacttagaattcctgtcagctaggctgtttatctgaaagtggttacttgtccctgaccatctggaatggctcaaatgagctcctgcagaccacagagctcatctttgggaacccagtctctctttttggggaagtgagccccttccttgggaacccctgaggccaggcatggccactgtggatggtgggaggatgccccaccctgaggaccccagaggctcctgtggccccttcctgggactgctggggccggtgtgtgtcagcgttcaccccaaggccccctttcagctgggctggacgccaagtgccttcaggcctcatcctgccctccaccatcccatagtcagtgaggctgtggcatctccctcctcgactgtcttgccctcttggtttttgtatcagcgttttccaggctgattgctgctgaaccttctgtttttttttctttttctttttgagacagtcttgctctgttgaccaggctggagtgcagtggcatgatcttggctcactgcaacctcagcctcccgattagctgggattgcaggcatgtgccactatgtccgtctaatttttgtatttttagtagagacggggttttaccgtgttagccaggatggtctcggtctcctgacctcgtgatccgcccacctcggcctccgaaagtgctgggattacaggcataagccactgcgcccggcctggagcttcctttctttgggttttccgatgttcttgactctgttgtagctgagctagactggggactgggtttccgggtttgctttgtctctgctgaagggctgaggtttcagagccagcatgcactgcacagggagcagagggaggaagaaggatccgactgcggagacacagtgactgaggccaagggcagcttgggccgggccagcagtgaggggagaggtctgggtagaaggtgtcatgctgggcgggggcggggggtgtcctgcgggccttgggtctttttgccgagttgggggacagcgaggagcaagcacctgccatcgcccactttgttttctgtgggacctcctaggacagtgaggcccctgcctcaccagggcatggcccactccgctgtccaggccttcgtcccggctgcctctgctgtggggcagggaaggggctgggtgtccaggacacaggcgcttccaggcttcatacacagatgccttttctctgacgttccttaactcccatgtgtagctatacacagaatgggattttacatatgctggacagaaataagagaatcaagccccggccagaaagattccagaactgcaaagacctgtttgatctgatcctcacttgcgaagagagagtgtatgaccaggtggtggaagatctgaattccagagaacaggagacctgccagcctgtgcacgtggtcaatgtggacatccaggacaaccacgaggaggccaccctgggggcgtttctcatctgtgagctctgccagtgtatccagcacacggaagacatggagaacgagatcgacgagctgctgcaggagttcgaggagaagagtggccgcacctttctgcacaccgtctgcttctactgagcccagcgcccgcatggagccgcctctggagcttcctgttgttcatactttttccttcctgacatttgtttttacttacaggtgttctgctggtgacggtagcattacccaaataaactgtgcatatgaaatgggagaggagatgccaaaacgccagatgaaagcaatcaagtttcttcttttccacttttacttatgagcaggatattgattacaaagtttttcttctttaaccaaaaaggaaagacaacggtttgtgtgcacttcccgacatacctgtgtcttcgtgtgcctgccttccctccctcctccccaccgggccggactgtacagagccctgctgcggcgtgttaggaatgacctggaattgtcaataaacagatgctgctgtc

SEQ ID NO: 2232 - DNA, 2181 bp, Homo sapiens
acacagggctcggcggcaggtgcctcgtcgcgcacactcgcgggccgcggggaccggctcgggcgcggggccggctggggcggggcggggcggcggcgcgcgttccccgccggccacaccggccgccctgcactcggcgaggggcgtgtgcgcgggcctggcacccgcgggccccatgttcaccgagctgaggtccaagctgagccccccgcgtggccgcgccggggccgtgcgcgcgggcttcggggagcgccgggatgtggacgccactgcccacttcagcttctgccggaccctcctggagcacacggtgtcagctgagagcatcccctgccacttgcctcggacacctggcaccagcctcacgtggcatgactcccgcagccagagggcggccagcagcaggccaatcaagctcctgcagcagcccggcacagacaccccccagggccggctgtactctgaccactatggcctgtaccatacaagcccctcgctgggtggcctgacccggcccgtggtcctgtggagtcagcaggacgtctgcaagtggctcaagaagcactgtccccacaactacctcgtctacgtggaggccttctcccagcatgccatcaccggccgggcactgctgcggctgaatgcggagaagctgcagcggatggggctggcccaggaggcccagaggcaggaggtgctgcagcaggtgctccgcctgcaggtgcgtgaggaggggcggagcctgcagctgctcagccaagcttccttcgggaaaatgtcctagctgctgctgaggcttgaacccagaccccagcactgtgatgggagtccacggctagggaggaggccaagctggccccgcagcgcctcttggaccctgcgggatgccggggcggccaggctggcccaacggacagacaggaccaggatcacacctccaggcgcctctggttggacattccaggtcgtgccctggggctgggtgggtagggggctgcttgagtgtggccccacctcctgggacctgagcccaagccctcccctggtgcagctggcagcatgtggggcagctgcctggagccagaaccggtttggatgtcccccctagactcccagggagtctgtttatttacattcccctctccacgtgatgtcggtcccccatcgcctgctgagtcacttgtctgtccacccacccagcccagttctaggtcgttccccagcacctccaggttggcccacacaggtaccataagctgcctcggctccctgtggcttgtgcccatgcacctgccagggcccagcaggccaacccatcatctagagtagtggccatcagcacccgcctaacgggcaccatgccaagcactttcatcattatttatacatcgtcaccacaccccctctattcatgagaagtaaagctgagaaaggaccagattgaccaagcgccagagacaaaatgtggcacaacgagaaccccagccctgtccaggtggctccgcgcccagggcccaggcttagcagtgctccctgccctatctttgggaaaatcttgcttttatggtcttcccccctcgccctcaagaacaagggccttgtgcgtgggccttcccattgctgctttcccaagaaggcctggattcaggggagaggccttcccagggccactccccttacaccctcccagaggcctgagcaacccctctctgggtggtttggggctggtgctgcctggcggaaggacagtgagggcggccctagccgcctccaccctcttgcgcctctgccctctcccagtccccctgtggcttctgaaaatctcagggacagatgaggctgagcccctagtcccctctgtgtgctttgagcctccagactcgaggctggtcactgcaggtcccaggtggaatttggacaactggcctggccgctcccatcctgtaagcccccaccacggggagaccctcatccctgcccctgtgtggctgcgcaagtattctgcccgcctcccaccatcagccttcgcccaaggggcccttctgcctctgcttccctcccttctcctctgtcttgccctggcccacgcacgcctgtctcgtcttccttgttttgctgcactcacttttttatactctgacaaaaaaaaaaaatcagaaataaagctggttcccaagtgct

SEQ ID NO: 2233 - DNA, 493 bp, Homo sapiens
acacagggctcggcggcaggtgcctcgtcgcgcacactcgcgggccgcggggaccggctcgggcgcggggccggctggggcggggcggggcggcggcgcgcgttccccgccggccacaccggccgccctgcactcggcgaggggcgtgtgcgcgggcctggcacccgcgggccccatgttcaccgagctgaggtccaagctgagccccccgcgtggccgcgccggggccgtgcgcgcgggcttcggggagcgccgggatgtggacggctctgttcacttgcagataccatacagagccttcattcattcattcattgacaatgaatgtggggtgcccctctgtaaccagacctggatcaagacgcctgcctccccagactcagccactgcccacttcagcttctgccggaccctcctggagcacacggtgtcagctgagagcatcccctgccacttgcctcggacacctggcaccagcctcacgtggcatgac

SEQ ID NO: 2234 - DNA, 2551 bp, Homo sapiens
ccagcagatccctgcggcgttcgcgagggtgggacgggaagcgggctgggaagtcgggccgagggaaaagtctgaagacgcttatgtccaaggggatcctgcaggtgcatcctccgatctgcgactgcccgggctgccgaatatcctccccggtgaaccgggggcggctggcagacaagaggacagtcgccctgcctgccgcccggaacctgaagaaggagcgaactcccagcttctctgccagcgatggtgacagcgacgggagtggccccacctgtgggcggcggccaggcttgaagcaggaggatggtccgcacatccgtatcatgaagagaagagtccacacccactgggacgtgaacatctctttccgagaggcgtcctgcagccaggacggcaaccttcccaccctcatatccagcgtccaccgcagccgccacctcgttatgcccgagcatcagagccgctgtgaattccagagaggcagcctggagattggcctgcgacccgccggtgacctgttgggcaagaggctgggccgctccccccgtatcagcagcgactgcttttcagagaagagggcacgaagcgaatcgcctcaagaggcgctgctgctgccgcgggagctggggcccagcatggccccggaggaccattaccgccggcttgtgtcagcactgagcgaggccagcacctttgaggaccctcagcgcctctaccacctgggcctccccagccacggtgaggacccaccctggcatgatccccctcatcacctccccagccacgatctcctgagggtccggcaggaggtggcggctgcagctctgaggggccccagtggcctggaagcccacctgccctcctccacggcaggtcagcgtcggaagcagggcctggctcagcaccgggagggcgccgccccagctgccgccccgtccttctcggagagggagctgcctcagccgccccccttgctgtcgccgcagaatgcccctcacgtcgccctgggcccccatctcaggccccccttcctgggggtgccctcggctctgtgccagaccccaggctacggcttcctgccccccgcgcaggcggagatgttcgcctggcagcaggagctcctgcggaagcagaacctggcccggctggagctgcccgccgacctcctgcggcagaaggagctggagagcgcgcgcccacagctgctggcgcccgagaccgccctgcgccccaacgacggcgccgaggagctgcagcggcgcggggccctgctggtgctgaaccacggcgcggcgccactgctggccctgcccccccaggggcccccgggctccggaccccccaccccgtcccgggactctgcccggcgagccccccggaaggggggtcccggccctgcctcagcgcggcccagcgagtccaaggagatgacgggggctaggctctgggcacaagatggctcggaagacgagccccccaaagactcggacggagaggaccccgagacggcagctgttgggtgcagggggcccactccgggccaagctccagctggaggggccggcgccgaggggaaggggcttttcccagggtccacactgcccctgggcttcccttatgccgtcagcccctacttccacacaggcgcggtagggggactctccatggatggggaggaggccccagcccctgaggacgtcaccaagtggaccgtggatgacgtctgcagcttcgtggggggcctgtctggctgtggagagtacactcgggtcttcagggagcaggggatcgacggggagaccctgccactgctgacggaggagcacctgctgaccaacatggggctgaagctggggcccgccctcaagatccgggcccaggtggccaggcgcctgggccgagttttctacgtggccagcttccccgtggctctgccactgcagccaccaaccctgcgggccccggagcgagaactcggcacaggagagcagcccttgtcccccacgacggccacgtccccctatggagggggccacgcccttgccggtcaaacttcacccaagcaggagaatgggaccttggctctacttccaggggcccccgacccttcccagcctctgtgttgaggttgccgggggtaggggtggggccacacaaatctccaggagccaccactcaacacaatggccctgcctcccaccgctttatttctttcggtttcggatgcaaaacaaaaaattttaaaagaaaatgtgacttcaaaggaaaggaacaaattttcaaagacttgggggagtgaaggcagagcctggtgcagatggacgaggtctgcagacggagggcagaggtggtggaaggggccaggggcctgcaggcctccccctggaactgggactggtctcggtctgctgacgtcagggtcagctcccccgcggagctgacttcagcagcccacagctgtggggcttcagcagccacaccagcccagcccagcccagctctcgatacgtttggtctttcatgctgaaaaataaataataaagcctgt

SEQ ID NO: 2235 - DNA, 626 bp, Homo sapiens
ccaacgagttccagttcgtcagcggccgcgagacggccaaggactggaagcgcagcatccgccacaaagggaaaagtctgaagacgcttatgtccaaggggatcctgcaggtgcatcctccgatctgcgactgcccgggctgccgaatatcctccccggtgaaccgggggcggctggcagacaagaggacagtcgccctgcctgccgcccggaacctgaagaaggagcgaactcccagcttctctgccagcgatggtgacagcgacgggagtggccccacctgtgggcggcggccaggcttgaagcaggaggatggtccgcacatccgtatcatgaagagaagagtccacacccactgggacgtgaacatctctttccgagaggcgtcctgcagccaggacggcaaccttcccaccctcatatccagcgtccaccgcagccgccacctcgttatgcccgagcatcagagccgctgtgaattccagagaggcagcctggagattggcctgcgacccgccggtgacctgttgggcaagaggctgggccgctccccccgtatcagcagcgactgcttttcagagaagagggcacgaagcgaatcgcctcaagaggcgctgctgctgccg

SEQ ID NO: 2236 - DNA, 387 bp, Homo sapiens
cagcgcttggggctcgcgggccgctccctccgctcggaagggaaaagtctgaagacgcttatgtccaaggggatcctgcaggtgcatcctccgatctgcgactgcccgggctgccgaatatcctccccggtgaaccgggggcggctggcagacaagaggacagtcgccctgcctgccgcccggaacctgaagaaggagcgaactcccagcttctctgccagcgatggtgacagcgacgggagtggccccacctgtgggcggcggccaggcttgaagcaggaggatggtccgcacatccgtatcatgaagagaagagtccacacccactgggacgtgaacatctctttccgagaggcgtcctgcagccaggacggcaaccttcccacc

SEQ ID NO: 2237 - DNA, 2172 bp, Homo sapiens
gcgtgaccgcggcaggttggtcctggagcagataagcgcagaatatttaggcgaaagcgagaggaaggggggagcgcggggcaggaggagtacctcggccaagaaaattatgcatgcgttagggaagctctgagagaatggctgtggaagctctccactgtggtttgaatccacggggtattgatcaccctgcccatgctgaaggtattaaactgcaaattgaaggtgaaggtgtggaatctcaatccattaaaaataaaaatttccagaaggtgcctgaccagaaaggaactcccaagcgactgcaggcagaagctgagacggctaagtcagctacggtgaagctatctaaaccggtggctctatggacccagcaggatgtctgcaagtggttgaagaaacattgtccgaatcagtatcagatctacagtgagtcattcaaacagcatgacataactgggcgagccctgctgagacttactgacaaaaagctcgagcgaatggggattgcccaggagaacctccggcagcacatcttacaacaggtgctccagctgaaggtgcgagaagaagtcagaaatctacagttactcacacaaggtaccctattgcttcctgatgggtggatggatggggagattagaagaaagaccaccttactattaggacagacaggagtcagggagaatttgttattgtttcttcacagaatttccatcatagaaaatagtatacagatttaagattacttccctttgaaaacttttttcatagctcactagggagaaggatgcacaaataagtaatggatgagcaaacagaattacctgagctaacttcaaggtggtcacgtacagttgtatggattgtgtactgcacaaccccagagaataccagtcacatcaatcagggtacgattgcactcactagagttgtataatgtgcagcctgcacaactgtacagtccagctgtagctatcttcacctgcgccaattgtgagggcgctttagcatttgagtgattcaatagttacgatgaccagtgatataagtggagtttttgttgtatttttgttttgcttttcaccggttagtgggagaaaaacattttagatatgtattactatacatgaatgtattatacacacacactttagagattgtaagaaccccatttagcttcttgaaagtggaataatttttataatagactatagtgaatctaaaactacactgttaagagtatataattcttaacaggaattataaataacttcaatatgatgagagcacttaagatctcaataactgtggaagtgacaaaataaagctagaattcgaagaaagccttaagttacactatatgtaactgatatgtctacatgagatttggatgctatcaaccttcattggctataaactttatttgttttattttagcgtccattgtacatcgttttaaatgaaaggatgataaaatatgtgtttttgagagccttgagtatttgtcattctgcagaatattgtaattgcatgcataccgatattggagaaatctgggtcagccaagtttcatgttattgcatttagattaacctagtaatagtccatttgcctagaggaaataatgtgctccctgaaagatgactattctagaaggataaatatagatttcaagtgatcgtaaaatagtattgtttgtctcatatgcattatttgcattttgtcctcagagatttccaatggtgaatttactggtatactaagtgatttaaatttgaatgtgaaatactgataggcttttaagcttcttttaagaagtagatagaaatacgaagattatgataagaaagtctgtcacagtgctatttggaaaacggaaaatttacaagcaacctagaggtccagcaatgtgaaaagaatcaagtaattctgcttaaattcataagattcagtataatgcccagttattaaaattacatctttaaagaatacatgacaacatgggaaattacgtaagtcatacaaggtgggaggaaaggtcatgtgtaaaattgtatgcataatataagcccaattttgtaaaaaccatatattcttatatgtacagaaaaaaaggactgcaagtaaatatgccaaccattttaataaaggatctctctggattgtggg

SEQ ID NO: 2238 - DNA, 8866 bp, Homo sapiens
gcggcaggttggtcctggagcagataagcgcagaatatttaggcgaaagcgagaggaaggggggagcgcggggcaggaggagtacctcggccaagaaaattatgcatgcgttagggaagctctgagagaatggctgtggaagctctccactgtggtttgaatccacggggtattgatcaccctgcccatgctgaaggtattaaactgcaaattgaaggtgaaggtgtggaatctcaatccattaaaaataaaaatttccagaaggtgcctgaccagaaaggaactcccaagcgactgcaggcagaagctgagacggctaagtcagctacggtgaagctatctaaaccggtggctctatggacccagcaggatgtctgcaagtggttgaagaaacattgtccgaatcagtatcagatctacagtgagtcattcaaacagcatgacataactgggcgagccctgctgagacttactgacaaaaagctcgagcgaatggggattgcccaggagaacctccggcagcacatcttacaacaggtgctccagctgaaggtgcgagaagaagtcagaaatctacagttactcacacaagcatcatctgagggttctccataaacacggttagccttccaagctgctgtcctgccagttgatatgaacatggcctgttcctcacagaaagactaacccatggcactgccagaagatatccttggatcgtggacagattaactggattaactgaaaaaagcacccattcagtcaatattatgggttttggaaaaatcttgctttgctgtggatttaaaatgaggtgcataatataatgccaactcattccaagtggtcattggcagaccattagctggaaaattgcttccagttttcatcactgtgcataactcaagttccctttggggagctgtctgtgcccttcactagaagtcctgttttagcatggcaactactggattattttattatgtgtgcagatggcatgatgttttagaaaaaaaaaattacagcaattctgcaatctcagtggaagtgttcacaatattatgccctggtaggaatgtaaacacgtctcgattatgttagttatgatgtctaaaggtatactgtccaactcttaagcactttatatgagaacactacaccaagatgaatcagcacattcagcacatgtgagaaatcaagtattttctttttatttttataaatcttagtggtttttttttttccggctcagactgtccaagacaaactccactactcgcatatccccagttgtttgtggtaggttgatgtaaatatggccacaatactgttagacttcacctccagatactttattgaacaactggtttacttctagcaccaaagggaagaagaagggggtccagtgatggtgatatcttagcttgcttctttgttcacaggcactattgaccacatgaacatacaggtactcaaatacaggaggcttctatttggctcctccaagggaggagttcctccaagggaaaaaaggggatggtattcttttaatcaaagaccatggtggatggatggtaagggcaacagaatgcaattcttttgtgtggtctgacgttaacacttcggaaaaaattctaagtcaagttgaaatcgccattctctcaagagagaaacatcaagagagaaacatcaagtgaccccactatgtgcctagagaaggaaaagggtcaagtcctatactaggttccttacttagggtagaacctactagtcccttgttaatcctttctgggattatacctgtgactaatttttttttttttaactatgtcttacgacaaagcacagtcctgggaaaccagtcaacttaattattgcttgtctttgagcattagagacatgttcatattgacttgctacataacactgtagcatgttttttcctgaaaatatcaagttggttgaatggaaagctcagcaaagtatgttctgtgtgcccactgtcccagcctgggactgacgggcatcagaggctttgctttaaaatatgggtaaccagttctggaagacttccaacgcaagcaagcttggtgttttagggtgtctccagatacataagcattgtctgcctccgctcagggtctcaggaaatacacagcccattggaaaccacccacgcctgagatttggaaacctgacggaaagggaggaaggtccaaatgagtcagcagcaggatgactcaccacaagcctggcaggctgcagagccagagaagggggcttccaacaaggaactcagagaagttgcagtcaccaccaagatctggcccttcggcaggtcagcaccaggactgccaggccctctgcagaccgtaattctcttcacatctataattaggaggccaaactccagctgccaacacccttggacacaatattccagtctccactgcccatctcatgtggttcagttctaatagcaggtcttcttcttcctttcattccttcctttattcagcaagcatttgttgagcatctactatgtgccaagcattgtgcttgggcaacaacagtccacaaagcagactccccacctgcccttatgaaactgtatctcctcctccccaacattatcaccaccccaccatttccacaatgaaaactgaattcagacagcattctccattctgccagagtaacctaggaagaagaacatggcagcagacggatcctcagggaggaggcagcagagtgacagatggtaaactgcatcaggccacatatttgcacctttcagatacagccaactcttccagggcctagactgagctggttggagctccccaaagcagcattcagttgcttttccttgatatccaccctggctacctatattccctttctttatataggcacaaccattcaccactacgctggattatctaacactccaattctataactcatccaggggacacacagttgagtctgatgaagcctaagaactgccaggtgctgagatattgtaactgggaattaagatttagccaaggacattgtgagactactgctgactctcttggaaaactggacatgctttgtagtgcaaatgttcactaaatgatggtggttcattgttacttactttggcctttgcaaaatattctgaacaattcaataagtagagtttcctagtttgtttgtttttttaagtcaaaggaacgctgtgaaattattgaaagatgatgggtgaagagggacctaggagaaggcaaaatgaagaccattaaagagccccattgaagactgtatctctaaaaatgccttaatgcctggcacatattccatatttgcatatgaactactattcttttccaaactgtcaacttctgtttgaaatcattgtgggggatagtttggaaatatggtggcataaaatccaagcagtcaagagctaaaccagcaaaaaagaggaatgacttcattcacaggctttggcttctttattatgtggtggtcctctgtgatctcccatggttaacttcaactgtgctgtactttcttcccaagatgcatgtacggaatgttacctcctagaaatccagaaatagttgtggtgagttttgtttgataggaagcaagaggtggggaagtaaaggatacatatttttatgtctaaggactgtaaactgttgatgcttgacttttccttttacctacacctgtgctacacctttattaaaaggctgacacccagacttgtgcaggaaaggcactcttgggaatgaacagaaatgaataattatgagactttccatggtgccaaggggattcgcttatttccactccagaactgaatatgcagagcattgccagtcctgctagtgtgaaaagcaaattacttcaatagtttgagacgtacctaggggaagagagatcctatcaactttctttgcgggtagtggcgtaccttcaaatccttgctcaggctctgtgaggtgtgcacccgcagatttcacttctacctccggaatcctggcaaacaagccaggaatctctccagagtcacttcgcagttgctcagaaagaggctaacggtccttagtcctgaggaaattctgccatttttaacattcaaggagaaaaggcgtatcagctgtacgtgagaatatcaactaaggataaaaacctctaatggatcccccttgttacttgcaaatgctttctttgtctgcaaatgtcacataattgattttgcataggaacaacaaaagtctcaaggaattgaagtttttaataccccccttagcactttactttcaccaaaacctcctctttctagtacatgagcagttttgttctttgtgatgttttcctctacattctttagaataattttgttacttgacaactagacttgtcaatcgtcttagactcttttgaaaaatctaatctttgaaaatgacacaaattcctttattgctttaaggctgttttcattcacccctcccacagccccctccactgcacttttttgttttttgcggggatttttttctttcatctctcttcttttaacatgatgctgtgggtagttttcaagaattctataaagaactcaacaaaaagtgtatttgttacctttttccccagtcctaatatttcttcttaagcttgatcttggtgaaaatttgttgcccaaaaagcagtgaggtagggattaataacgctgaccagtcatctggaagattaattaatcccagtgcagccctgagatcaggaaggaggacaggccaggagatgtttctactccaggcaccactaaggactctatttcaaaggcagatcctgctccttagtctttttagatctgaatctaatcctgaatccagaaaattatcctatgaattctggtttatcaacgcacatgattcctggcaccattgcatagcttcaaggtaaaagagagccttgtttccattattttgctatggtggcttttgggaagacagagagcattcttttgaaagcgggaaacttaaggaaaagttggccaagtacacaggaaagttctaccacaccttaatataaagaacaaaatagatgcttctcatttggggaaagtagctaaaaggacagtaacagtactgatggccttctgtccatcaccttagctccacagggaaaattctgggtgagagcaagcactgtttctaaaatctaaattttttcaggtgaaatttaccagcaacaaatgtaaaagggaactgccatcaggcatagggctagttttatacttcctgcctaacggcaaaatgactgagacatgacttccatggaacagcagaaaatggatgccaaagatatcataaaactgaagttcaatttgccacgtaaggctatttaaaaaccctgatgcactccaagcattcttccttcagagctttcctcctacaattatatcaagcacaagaaggcaccaacagcatatacttaatgtaatgtaaaagtaaacatatgacttgtgttgaattaccattggctggttgacataataagtgtcatagatatttagacattatttctgatcatacaaaattattttcataatttcatattcttttcaattttcataaattcttttcaattttcataaattggagccaatggtttgggaggttttttgtttgtttgtttgtttggttggttggttatttgttgcgttgttgttttccaaacctcagatattttgagaagccttagaaaggctcttaagcccaggcctttttgcctcatgtgcagagtattaataacagccctactgatgtgaacctcaaggaaggaggctattaaattaatccatcactggagatactaatacctcaaacaattaaaacactgaagactctgctggttgccttccacattgtttataacctttttaaattcagtcatttggatcaagagaaataaatggttggtttcatatggcttttgccacattagcacagacacatctaccaaatgtagaagtccagactgagtggatgcatgagagcaaacagatctgtaatatgattgcatttaatcaccgccaccgcccaaattctgtaaaaatatattcaaatatgtaatgctaaaaaaaatgcaaaacaggagactcttactagatcatgctttcacttagggtaggataactgatcttgaagataacttcatagaaaaatttgctggctgaaatgccccaggcacctcagggttggtcctgtcctattccacaaactgatcatggtcttctcccatcttctcagaggagttagccttgcctctaaaatagcaaaaatgccatgaaattatctttctaacctctatagagacttcttatccaagtataattccaaaaatatgatttgagtttgagcatgcctgtggtccttgattctatgatccctaaatcagttctacttttctcactctctctctctctctctctctctctctctctctctctctatatatatatatatatatatatatatatatatatatatatatatatatatatataatctccagtattttttttcaaccacaatttagtgcatttagcgtgttaatgttgggaactgcctgctggctctatgtctacttttgacaatgcttatgtccagataccatacagtgcatttgagagaggaccaaggttatgttttcccacataccagctgctgcagaggtttcgaagtgcctgacccagttctttttcacatcaaaaaggccttcggttgcagatggaaaccttaaagatgaatgtagagtggggtaggaaattcatgtttgaatgctgaaacccttgtcttttttagttttattcaattcccacctcagatcaccagaaagggaggcctctttggtgggtgttggccctcactgggggtaaaaggggttctatttgcttaaactcatgctcgtaggcaattttagggctctctggggctctgaatggtttctccaccaccacctttcttccaccaatagaaagatgttgtccttacaaggccatgtctgagaagaccatggtttaactagtaaaagaagctcacattgcagagagctgaataataccaggctcttgactttgtactgtgtgtcacagtcatgattgggacagaaggaaccagtctgctgaaaagtcaagccagcacaaatatttggaaactaattccactgaaactcttgtatcattaaatcatactattgtagtttcagttaatgtaattatttaatatcaggcactaaattaaatagctttgcacaaaattttagaaaagatcaatcttgtaacaaaatttaatattaacagtaaaaagcacctgagaaaagaaaatatcgatctgttgtggtttatatacttgagttattcttagaactttgtggagattgacactgctctgataaaaaggaagaaaatgttttgaattcaagaatgctagactaatagaaatagcccagtctctctgggccactgctcttcagtatggggtgctctctgtccctccttagcagatggggttgtttggaggctaaaatgagctaagggaagaagctatactgtgcctccaatatcccttatgtgtaattagagtgccgatctgggctgcaggctttattcaatgattcctttcccttacttgaggctttctctgtagagctgttatttctgagcctccattctgggatttacaaaggaaacagaatgatgaagaagtaacaatcagcattttacacacacgcacacacacacacacacacacactttttctaatatatgaggctagtctgcagagtccacagcccaggtgtccatttatttccacttcttcacctcccaaagatttagagctccatgatctaccaaggtgaagactgccaatcccaggttggagaagacccgtcagagtgtggaggtgccaaactgagaggcacaggaagcagacagccacatcaaacttttttgatgaactactgcaaattggtgtttgttctaggaaagaaagaggaagaaaaattacacaatgtgaattgaacataagagcagtgctctttacagagtatgagaagggaggatgggggagaatctgattaaaaaaatgattcattccttcacagacactaacaaacatggctaaaaagcacatgtcagaacacagaagcctaggtagatggttgacatttttataacttccttaagtgagtagttaaaccagcagtcttaattctgttggtcttccaagagtgtttaattacataagtattacctgtattcatttcccacaactgttgggtttttctttctttttttttttttttttttttttcctctgtgcatcctagaaaaactcccaggactagacttaggaggaggcaatcaagttatgtggtaaaacaagagtgccttttctgttggatatccactttagtttcctggcttccagggcataagatgtttagaaactttttttctctaaacataagaattattgtgtaccacaattttgaaccaccgatttccatatcttcagcagctatcaacttgccaattccctttgggtctcctttgtatattcttatgtttccttctgtttccagttgtcctcaaaaagagttgaggggggcatgactcttataaaatggataaaaatgaaactgtacagatgtttgcctcccttgtatctgtgagcatgatctctatcaggctggaaaatctgctttatcattttgtatatttgactattttgtattcagcattacttgactccttatgtgcatggcaatgtattaaaatgtgggatttctattaccgtgt

SEQ ID NO: 2239 - DNA, 1302 bp, Homo sapiens
atgaggtcttgtctgatgccaggaaatgaaatgagtatgacaagtccagaaggaaccgaaccaaaagggaaacagaggagatggcagagacaaaaaacatttggaggaggaactatgcattctcaggattctcaggaaattgatggaaaatccctgctattgatgacaagaaatgatgtgttgacaggacttcagttaaaattggggcctgctctgaaaatctacgaatatcatgtaaaacctctgcagacaaagcatttaaagaacaactcttcatagtacagtcaaattggggtcttcgacctcaaaaaatacataatgacataatttagtttcatgtaatgaaactttgtaaacagaatacatacatgtgtatatgtaaagaatttcaatcaaatgaaacgttatcctattggatagactaggcaattcatcagctcacctgaaatcagccaggaggagcaaggacaagatgcgcacagggtggttttcctcatggattttgtcaaatagatgatctttgacacgattagacactcctccccacaaaggctttgaaatcataaggattttcctcatctctttatagctttcccaaaatcttttaaaaaagaatttaattaaatgacagtcttttggttacagacttaggatgagtaaaaacaagaaaatttggggagggggagaaagaagaaagggattgctgtctcccttgaattcctctgttccttagagcttgtgttacttggacggaattgccaacacccttttttatagagggttctccacttgaccttattaaggttttattgggatatgctgcagtgtttgaaatgaacatgcatcatggccccttcaggagcagaatcatagctctgaaaagagaagctccgttgtgtactgaggatatccatccatattcagctagctttcaaatggggtaacgatattttctgcatagattttcttttaaattggttctttgtttctgaagaaagaattttttttaacttcatggttttatttataataatttgtttctgaagaaatttgccgagagttacaggtcaaaaagccttgttactagtacagaatatttttatatatattccttcatgatggtgtaattttttttaattgtcctatgctttgttcggttcctgggttaagtacttgtttttaagagcttggaaaaagtgggcttgctacatctctgttcaaagagacatttgttcaatctctgtgtgtcaacgccttgttgaattggtgctttgtggttgcaataaagcattgcttcagttt

SEQ ID NO: 2240 - DNA, 1403 bp, Homo sapiens
ctcacagacgggtttttgaggctttcgttgagaatgtgagttgctgaagtaaaggaaccctgcagccttcccatgctatctgttgacatggaaaacaaggaaaatggctctgtcggtgtaaaaaattccatggaaaatgggagaccacctgatcctgcagactgggccgtgatggatgtcgtcaattatttccgaaccgtgggatttgaggagcaagctagtgcttttcaggaacaggaaattgatggaaaatccctgctattgatgacaagaaatgatgtgttgacaggacttcagttaaaattggggcctgctctgaaaatctacgaatatcatgtaaaacctctgcagacaaagcatttaaagaacaactcttcatagtacagtcaaattggggtcttcgacctcaaaaaatacataatgacataatttagtttcatgtaatgaaactttgtaaacagaatacatacatgtgtatatgtaaagaatttcaatcaaatgaaacgttatcctattggatagactaggcaattcatcagctcacctgaaatcagccaggaggagcaaggacaagatgcgcacagggtggttttcctcatggattttgtcaaatagatgatctttgacacgattagacactcctccccacaaaggctttgaaatcataaggattttcctcatctctttatagctttcccaaaatcttttaaaaaagaatttaattaaatgacagtcttttggttacagacttaggatgagtaaaaacaagaaaatttggggagggggagaaagaagaaagggattgctgtctcccttgaattcctctgttccttagagcttgtgttacttggacggaattgccaacacccttttttatagagggttctccacttgaccttattaaggttttattgggatatgctgcagtgtttgaaatgaacatgcatcatggccccttcaggagcagaatcatagctctgaaaagagaagctccgttgtgtactgaggatatccatccatattcagctagctttcaaatggggtaacgatattttctgcatagattttcttttaaattggttctttgtttctgaagaaagaattttttttaacttcatggttttatttataataatttgtttctgaagaaatttgccgagagttacaggtcaaaaagccttgttactagtacagaatatttttatatatattccttcatgatggtgtaattttttttaattgtcctatgctttgttcggttcctgggttaagtacttgtttttaagagcttggaaaaagtgggcttgctacatctctgttcaaagagacatttgttcaatctctgtgtgtcaacgccttgttgaattggtgctttgtggttgcaataaagcattgcttcagtt

SEQ ID NO: 2241 - DNA, 856 bp, Homo sapiens
tactttgtgaaagaaaacattggggtttctttggctgttcttgataagcctataaaaaatgatattttttagttgcttataggtaggttttctttttactcttccacagaaaagaaaataatagtaataataataagacaatgtagtgtggtgttgcagagtatcattgtgagtgttttgttttgttttctgagatgcttagaaaatggtgaatgtgtaacagtttccaactgaagtgaaatcatattctgttagcatggagcagcagcactatcttcctgtctactctctaacgttgctgaagtaaaggaaccctgcagccttcccatgctatctgttgacatggaaaacaaggaaaatggctctgtcggtgtaaaaaattccatggaaaatgggagaccacctgatcctgcagactgggccgtgatggatgtcgtcaattatttccgaaccgtgggatttgaggagcaagctagtgcttttcaggaacaggaaattgatggaaaatccctgctattgatgacaagaaatgatgtgttgacaggacttcagttaaaattggggcctgctctgaaaatctacgaatatcatgtaaaacctctgcagacaaagcatttaaagaacaactcttcatagtacagtcaaattggggtcttcgacctcaaaaaatacataatgacataatttagtttcatgtaatgaaactttgtaaacagaatacatacatgtgtatatgtaaagaatttcaatcaaatgaaacgttatcctattggatagactaggcaattcatcagctcacctgaaatcagccaggaggagcaaggacaagatgcgcacagggtggttttcctcatgg

SEQ ID NO: 2242 - DNA, 565 bp, Homo sapiens
ctttaggtttaatcacatctctccaatcgccgagggaactggagatttaaacaaacatacgtgaactgttgctgaagtaaaggaaccctgcagccttcccatgctatctgttgacatggaaaacaaggaaaatggctctgtcggtgtaaaaaattccatggaaaatgggagaccacctgatcctgcagactgggccgtgatggatgtcgtcaattatttccgaaccgtgggatttgaggagcaagctagtgcttttcaggaacaggaaattgatggaaaatccctgctattgatgacaagaaatgatgtgttgacaggacttcagttaaaattggggcctgctctgaaaatctacgaatatcatgtaaaacctctgcagacaaagcatttaaagaacaactcttcatagtacagtcaaattggggtcttcgacctcaaaaaatacataatgacataatttagtttcatgtaatgaaactttgtaaacagaatacatacatgtgtatatgtaaagaatttcaatcaaatgaaacgttatcctattggatagactaggcaattcatc

SEQ ID NO: 2243 - DNA, 724 bp, Homo sapiens
cacactcacatactttatgctacatactacacacacaactttttatcagcagaggattgatggcaaacagtttgttggagggagtgtttgctgaagtaaaggaaccctgcagccttcccatgctatctgttgacatggaaaacaaggaaaatggctctgtcggtgtaaaaaattccatggaaaatgggagaccacctgatcctgcagactgggccgtgatggatgtcgtcaattatttccgaaccgtgggatttgaggagcaagctagtgcttttcaggaacaggaaattgatggaaaatccctgctattgatgacaagaaatgatgtgttgacaggacttcagttaaaattggggcctgctctgaaaatctacgaatatcatgtaaaacctctgcagacaaagcatttaaagaacaactcttcatagtacagtcaaattggggtcttcgacctcaaaaaatacataatgacataatttagtttcatgtaatgaaactttgtaaacagaatacatacatgtgtatatgtaaagaatttcaatcaaatgaaacgttatcctattggatagactaggcaattcatcagctcacctgaaatcagccaggaggagcaaggacaagatgcgcacagggtggttttcctcatggattttgtcaaatagatgatctttgacacgattagacactcctccccacaaaggctttgaaatcataaggattttcc

SEQ ID NO: 2244 - DNA, 1565 bp, Homo sapiens
ccttgtcctgcccagatcttgtcccttctagtactggccttccccattcctgggggcccccgcccctccgacccccgccgaccggcgctggactacaactcccggcgtgccgcgcgcgtccggccggctgcaccggggctttgcgcgtggcggccgccgagctccgcgcggggcaaacctcccggcgcggccatgcggggagttgctgaagtaaaggaaccctgcagccttcccatgctatctgttgacatggaaaacaaggaaaatggctctgtcggtgtaaaaaattccatggaaaatgggagaccacctgatcctgcagactgggccgtgatggatgtcgtcaattatttccgaaccgtgggatttgaggagcaagctagtgcttttcaggaacaggaaattgatggaaaatccctgctattgatgacaagaaatgatgtgttgacaggacttcagttaaaattggggcctgctctgaaaatctacgaatatcatgtaaaacctctgcagacaaagcatttaaagaacaactcttcatagtacagtcaaattggggtcttcgacctcaaaaaatacataatgacataatttagtttcatgtaatgaaactttgtaaacagaatacatacatgtgtatatgtaaagaatttcaatcaaatgaaacgttatcctattggatagactaggcaattcatcagctcacctgaaatcagccaggaggagcaaggacaagatgcgcacagggtggttttcctcatggattttgtcaaatagatgatctttgacacgattagacactcctccccacaaaggctttgaaatcataaggattttcctcatctctttatagctttcccaaaatcttttaaaaaagaatttaattaaatgacagtcttttggttacagacttaggatgagtaaaaacaagaaaatttggggagggggagaaagaagaaagggattgctgtctcccttgaattcctctgttccttagagcttgtgttacttggacggaattgccaacacccttttttatagagggttctccacttgaccttattaaggttttattgggatatgctgcagtgtttgaaatgaacatgcatcatggccccttcaggagcagaatcatagctctgaaaagagaagctccgttgtgtactgaggatatccatccatattcagctagctttcaaatggggtaacgatattttctgcatagattttcttttaaattggttctttgtttctgaagaaagaattttttttaacttcatggttttatttataataatttgtttctgaagaaatttgccgagagttacaggtcaaaaagccttgttactagtacagaatatttttatatatattccttcatgatggtgtaattttttttaattgtcctatgctttgttcggttcctgggttaagtacttgtttttaagagcttggaaaaagtgggcttgctacatctctgttcaaagagacatttgttcaatctctgtgtgtcaacgccttgttgaattggtgctttgtggttgcaataaagcattgcttcagtt

SEQ ID NO: 2245 - DNA, 785 bp, Homo sapiens
gaaggcagttggtgcagcttgtgtgtgattcctaacgtcatgttggctgagagccagcctggttttatttcactgtgtcaaattgtacctccttattgaattcctttgccagcctactttgtgaaagaaaacattggggtttctttggctgttcttgataagcctataaaaaatgatattttttagttgcttatagttgctgaagtaaaggaaccctgcagccttcccatgctatctgttgacatggaaaacaaggaaaatggctctgtcggtgtaaaaaattccatggaaaatgggagaccacctgatcctgcagactgggccgtgatggatgtcgtcaattatttccgaaccgtgggatttgaggagcaagctagtgcttttcaggaacaggaaattgatggaaaatccctgctattgatgacaagaaatgatgtgttgacaggacttcagttaaaattggggcctgctctgaaaatctacgaatatcatgtaaaacctctgcagacaaagcatttaaagaacaactcttcatagtacagtcaaattggggtcttcgacctcaaaaaatacataatgacataatttagtttcatgtaatgaaactttgtaaacagaatacatacatgtgtatatgtaaagaatttcaatcaaatgaaacgttatcctattggatagactaggcaattcatcagctcacctgaaatcagccaggaggagcaaggacaagatgcgcacagggtggttttcctcatggattttgtcaaatagatgatctttgacac

SEQ ID NO: 2246 - DNA, 5951 bp, Homo sapiens
attggcgtgtggaaaatgccaccagatggcgggttaggattgcagctccgttgaaggcgcggcccccgctcccgaacccccggcgaccaccccgtaacaacccccccacatcgggaataacacaccggagacttttggggggaaactaggtcgatggtcggcggcgcccggatgggcagctgaggattgcctttgaggttattttaaaagttttgagttgtacagcacttgattattttgctgcattgtgaaaggacctctccagcaatgattacttcagaattaccagtgttacaggattcaactaatgaaactactgcccattccgatgctggcagcgagcttgaagaaacagaggtcaaaggaaaaagaaaaaggggtcgtcctggccggcctccatctacaaataagaaacctcgaaaatctccaggtgagaagagcagaattgaagctggaattagaggagcaggccgtggaagagctaatggacaccctcaacagaatggggaaggggagcctgtcacattatttgaggtggtgaaactggggaaaagtgcaatgcagtccgtggtggatgactggattgaatcatataaacaagacagggacatcgcacttctggatttaatcaacttttttatccagtgttcaggatgtcgaggtactgtgagaatagagatgtttcgaaatatgcagaatgcagaaatcatcagaaaaatgactgaagaatttgatgaggacagtggtgattatcctcttaccatgcctggacctcagtggaaaaaatttcgttcaaacttttgtgaatttattggagtcctgattcgacagtgtcagtatagcataatttatgatgagtatatgatggacacagtaatctcccttttgacgggtttgtcagactcccaggtcagagcttttaggcatacaagtaccctggctgccatgaagctcatgactgctctggtgaatgttgccttaaacctcagtattcatcaggataatacccagagacaatatgaagccgagagaaataaaatgattgggaagagagccaatgaaaggttggagttactacttcagaaacgcaaagagctgcaagaaaatcaggatgaaatcgaaaatatgatgaactctatttttaagggtatatttgttcatagataccgtgatgctattgctgagattagagccatttgtattgaagaaattggagtatggatgaaaatgtatagtgatgccttcctaaatgacagttacctaaaatatgttggctggactcttcatgacaggcaaggggaagtcaggctgaagtgtttgaaagctctgcagagtctatataccaatagagaattattccccaaattggaactattcactaaccgattcaaggatcgcattgtatcaatgacacttgataaagaatatgatgttgctgtggaagctattcgattggttactctgatacttcatggaagtgaagaagctctttccaatgaagactgtgaaaatgtttaccacttggtgtactcggcacatcgccctgttgctgtggcagctggagagttccttcacaaaaagctatttagcagacatgacccacaagcagaagaagcattagcaaagaggaggggaagaaacagcccgaatggaaacctcattaggatgctggttcttttctttcttgaaagtgagttacatgaacatgcagcctacttggtggacagtttatgggagagctctcaagaactgttgaaagactgggaatgtatgacagagttgctattagaagaacctgttcaaggagaggaagcaatgtctgatcgtcaagagagtgctcttatagagctaatggtttgtacaattcgtcaagctgctgaggcacatcctccagtgggaaggggtaccggcaagagagtgctaactgccaaagaaaggaaaactcaaattgatgatagaaacaaattgactgaacattttattattacacttcctatgttactgtcaaagtattctgcagatgcagagaaggtagcaaacttgctacaaatcccacagtattttgatttagaaatctacagcacaggtagaatggaaaagcatctggatgctttattaaaacagattaagtttgttgtggagaaacacgtagaatcagatgttctagaagcctgcagtaaaacctatagtatcttatgcagtgaagaatataccatccagaacagagttgacatagctcgaagccagctgattgatgagtttgtagatcgattcaatcattctgtggaagacctattgcaagagggagaagaagctgatgatgatgacatttacaatgttctttctacattaaagcggttaacttcttttcacaatgcacatgatctcacaaaatgggatctctttggtaattgctacagattattgaagactggaattgaacatggagccatgccagaacagatagtcgtgcaagcactgcagtgttcccattattcgattctttggcagttggtgaaaattactgatggctctccttccaaagaggatttgttggtattgaggaaaacggtgaaatcctttttggctgtttgccagcagtgcctgtctaatgttaatactccagtgaaagaacaggctttcatgttactctgtgatcttctgatgattttcagccaccaattaatgacaggtggcagagagggccttcagcctttggtgttcaatccagatactggactccaatctgaactcctcagttttgtgatggatcacgtttttattgaccaagacgaggagaaccagagcatggagggtgatgaagaagatgaagctaataaaattgaggccttacataaaagaaggaatctacttgctgctttcagcaaacttatcatttatgacattgttgacatgcatgcagctgcagacatcttcaaacactacatgaagtattacaatgactatggtgatattattaaggaaacactgagtaaaaccaggcagattgataaaattcagtgtgccaagactctcattctcagtttgcaacagttatttaatgaacttgttcaagagcaaggtcccaacctagataggacatctgcccatgtcagtggcattaaagaactggcacgtcgctttgcccttacatttggattggaccagattaagacacgagaagcagttgccacacttcacaaggatggcatagagtttgcatttaaataccaaaatcagaaaggacaagagtatccacctcctaatctggcttttcttgaagtactaagtgaattttcttctaaacttcttcgacaggacaaaaagacagttcattcatacctagagaaattccttaccgagcagatgatggaaaggagggaggatgtatggcttccactcatctcctatagaaattcattagtcactgggggtgaagatgatagaatgtctgtgaacagtggaagtagcagcagcaaaacctcatcagtaaggaataagaaaggacgacctccacttcataaaaaacgagtagaagatgagagtctggataacacatggctaaacaggactgacaccatgattcagactcctggccccctgccagcaccacaactcacatccactgtactgcgggagaacagtcggcccatgggagaccagattcaagaacctgagtctgaacatggttctgaaccagactttttacacaatcggggtctaatggaggaagatgctgagcccatctttgaagatgtgatgatgtcatcccgaagccagttagaagatatgaatgaagaatttgaggacaccatggttattgatctgcctccatcaagaaatcggcgagagagagctgagctaaggccagacttctttgactctgcagctatcatagaagatgattcaggatttggaatgcctatgttctgaagtctgaagaaaatttacaaatctggaactctattatttagagctagaggcctatatactgtgatagcttgtatggggaaaaacacttttgatgtgatctgatttgttttttaatcaaatgattaaggtcaatccctttttgcagtgacagaagaggagcatgtaaattacccaagggaatgttggtgaatgtcaactcagaaagactgacctgaaaatcatttgtgtcctactattggacttatcccaatacagatgtgtgtgtttttctggagggaggaagaaattttaaatttttaaaacagctgtcaagataaacactgttatacacctgttttatgaaaactcaacattgagtaaaaaaaaacatatttttaactttattttcctgttgtacaatttaaaaaccgttttaacattttgcctttttatgttttaaaagctaaccatttttattaaacctatgagtaagcagctcatcctaattgcgaagagtgttttggagttcactggatttggttgacctttgtggaacacaaataatgaaggagcagaacattgacaagctaagatgaaattctgacatagtacatctctgccaaaaaccacacaccctctgtggatatggatatgaattcccagattttatatactcttgaataaaaggtttatttttatttataagtgggcataaaataagaaatgtccatgcagccatttttccaacagatgctgtacaccgttcattttatatagactagggagattcaaatacagtgcattttctattggtatttgttctgtgcatttttagcaacttctaccagcaaataaagtattctcagtaaaacgaaaatgattctcaagttatcagtttgctgtttttaccacttatttcatgccctgccaaattcaagttacacagacttccattttcttaagataatcaatcatgaagaaatcctttatcaatcattcaaaagtaattttaagtgtaacataactgtgtttacttcccatgcacttaatacccttatgcgctaattttgtgaattaagtttactgattatagaagtatgtgctgcatagaagtctgtgcttagagggtgaagttcctaagcttaccttgaattacagctacatttcagtgttaaatgtgcatattaagaataattcttttggggaaagaaattatgaatcttcaggacagtctacaatggtttagagttacattctgcctagacttttatgacttgctgctattgttttaaaaaccccacttagtctctctcttcctttctgatttctaaagtaagcctcagaatttccaaaccaattcatccacagctgtttctgggctggtttttaaagtagctgcaacagaatcatgaggctttccctttttatcaaatacgaaaaacattttttaaaattctgcacacccagtgatcatcttttgtgcgggaaagcaagatgatgatggatgattttattcatccttttagtaaagacacaaaacatttttctcaacatttgtacagttctgaaaaaaacctggtcaccaaaaatatcttctctgctaattcagcaattcttgggctccagttaggggagctggggcctcactttctcccagaattgtgggcttcactggaagtgaaggtgcaggaatgactggactgtccaccccagccctgcctgcctgtggttttggccagggagcaagccatgaggtgccctggcacatgcacaaattgatcctttgcgtgacagtcttgtatggaaaacagatgctgacagaattgtagactaccatgccacacaaaaaggctaaatatctactccaatgggtttccagttcagtttgaagtcaatcaaatttttgtattttcggtgtctccttgattggttttgctagtaattctgtaaattgtacatttgcaatatgaggttttttttccttttgtacaatttgaaactgatgcttcacctttcctttaataaactattcaaaatca

SEQ ID NO: 2247 - DNA, 6053 bp, Homo sapiens
ggaaaatgccaccagatggcgggttaggattgcagctccgttgaaggcgcggcccccgctcccgaacccccggcgaccaccccgtaacaacccccccacatcgggaataacacaccggagacttttggggggaaactaggtcgatggtcggcggcgcccggatgggcagctgaggattgcctttgaggttattttaaaagttttgagttgtacagcacttgattattttgctgcattgtgaaaggacctctccagcaatgattacttcagaattaccagtgttacaggattcaactaatgaaactactgcccattccgatgctggcagcgagcttgaagaaacagaggtcaaaggaaaaagaaaaaggggtcgtcctggccggcctccatctacaaataagaaacctcgaaaatctccaggtgagaagagcagaattgaagctggaattagaggagcaggccgtggaagagctaatggacaccctcaacagaatggggaaggggagcctgtcacattatttgaggtggtgaaactggggaaaagtgcaatgcagtccgtggtggatgactggattgaatcatataaacaagacagggacatcgcacttctggatttaatcaacttttttatccagtgttcaggatgtcgaggtactgtgagaatagagatgtttcgaaatatgcagaatgcagaaatcatcagaaaaatgactgaagaatttgatgaggacagtggtgattatcctcttaccatgcctggacctcagtggaaaaaatttcgttcaaacttttgtgaatttattggagtcctgattcgacagtgtcagtatagcataatttatgatgagtatatgatggacacagtaatctcccttttgacgggtttgtcagactcccaggtcagagcttttaggcatacaagtaccctggctgccatgaagctcatgactgctctggtgaatgttgccttaaacctcagtattcatcaggataatacccagagacaatatgaagccgagagaaataaaatgattgggaagagagccaatgaaaggttggagttactacttcagaaacgcaaagagctgcaagaaaatcaggatgaaatcgaaaatatgatgaactctatttttaagggtatatttgttcatagataccgtgatgctattgctgagattagagccatttgtattgaagaaattggagtatggatgaaaatgtatagtgatgccttcctaaatgacagttacctaaaatatgttggctggactcttcatgacaggcaaggggaagtcaggctgaagtgtttgaaagctctgcagagtctatataccaatagagaattattccccaaattggaactattcactaaccgattcaaggatcgcattgtatcaatgacacttgataaagaatatgatgttgctgtggaagctattcgattggttactctgatacttcatggaagtgaagaagctctttccaatgaagactgtgaaaatgtttaccacttggtgtactcggcacatcgccctgttgctgtggcagctggagagttccttcacaaaaagctatttagcagacatgacccacaagcagaagaagcattagcaaagaggaggggaagaaacagcccgaatggaaacctcattaggatgctggttcttttctttcttgaaagtgagttacatgaacatgcagcctacttggtggacagtttatgggagagctctcaagaactgttgaaagactgggaatgtatgacagagttgctattagaagaacctgttcaaggagaggaagcaatgtctgatcgtcaagagagtgctcttatagagctaatggtttgtacaattcgtcaagctgctgaggcacatcctccagtgggaaggggtaccggcaagagagtgctaactgccaaagaaaggaaaactcaaattgatgatagaaacaaattgactgaacattttattattacacttcctatgttactgtcaaagtattctgcagatgcagagaaggtagcaaacttgctacaaatcccacagtattttgatttagaaatctacagcacaggtagaatggaaaagcatctggatgctttattaaaacagattaagtttgttgtggagaaacacgtagaatcagatgttctagaagcctgcagtaaaacctatagtatcttatgcagtgaagaatataccatccagaacagagttgacatagctcgaagccagctgattgatgagtttgtagatcgattcaatcattctgtggaagacctattgcaagagggagaagaagctgatgatgatgacatttacaatgttctttctacattaaagcggttaacttcttttcacaatgcacatgatctcacaaaatgggatctctttggtaattgctacagattattgaagactggaattgaacatggagccatgccagaacagatagtcgtgcaagcactgcagtgttcccattattcgattctttggcagttggtgaaaattactgatggctctccttccaaagaggatttgttggtattgaggaaaacggtgaaatcctttttggctgtttgccagcagtgcctgtctaatgttaatactccagtgaaagaacaggctttcatgttactctgtgatcttctgatgattttcagccaccaattaatgacaggtggcagagagggccttcagcctttggtgttcaatccagatactggactccaatctgaactcctcagttttgtgatggatcacgtttttattgaccaagacgaggagaaccagagcatggagggtgatgaagaagatgaagctaataaaattgaggccttacataaaagaaggaatctacttgctgctttcagcaaacttatcatttatgacattgttgacatgcatgcagctgcagacatcttcaaacactacatgaagtattacaatgactatggtgatattattaaggaaacactgagtaaaaccaggcagattgataaaattcagtgtgccaagactctcattctcagtttgcaacagttatttaatgaacttgttcaagagcaaggtcccaacctagataggacatctgcccatgtcagtggcattaaagaactggcacgtcgctttgcccttacatttggattggaccagattaagacacgagaagcagttgccacacttcacaaggatggcatagagtttgcatttaaataccaaaatcagaaaggacaagagtatccacctcctaatctggcttttcttgaagtactaagtgaattttcttctaaacttcttcgacaggacaaaaagacagttcattcatacctagagaaattccttaccgagcagatgatggaaaggagggaggatgtatggcttccactcatctcctatagaaattcattagtcactgggggtgaagatgatagaatgtctgtgaacagtggaagtagcagcagcaaaacctcatcagtaaggaataagaaaggacgacctccacttcataaaaaacgagtagaagatgagagtctggataacacatggctaaacaggactgacaccatgattcagactcctggccccctgccagcaccacaactcacatccactgtactgcgggagaacagtcggcccatgggagaccagattcaagaacctgagtctgaacatggttctgaaccagactttttacacaatcctcagatgcagatctcttggttaggccagccgaagttagaagacttaaatcggaaggacagaacaggaatgaactacatgaaagtgagaactggagtgaggcatgctgttcggggtctaatggaggaagatgctgagcccatctttgaagatgtgatgatgtcatcccgaagccagttagaagatatgaatgaagaatttgaggacaccatggttattgatctgcctccatcaagaaatcggcgagagagagctgagctaaggccagacttctttgactctgcagctatcatagaagatgattcaggatttggaatgcctatgttctgaagtctgaagaaaatttacaaatctggaactctattatttagagctagaggcctatatactgtgatagcttgtatggggaaaaacacttttgatgtgatctgatttgttttttaatcaaatgattaaggtcaatccctttttgcagtgacagaagaggagcatgtaaattacccaagggaatgttggtgaatgtcaactcagaaagactgacctgaaaatcatttgtgtcctactattggacttatcccaatacagatgtgtgtgtttttctggagggaggaagaaattttaaatttttaaaacagctgtcaagataaacactgttatacacctgttttatgaaaactcaacattgagtaaaaaaaaacatatttttaactttattttcctgttgtacaatttaaaaaccgttttaacattttgcctttttatgttttaaaagctaaccatttttattaaacctatgagtaagcagctcatcctaattgcgaagagtgttttggagttcactggatttggttgacctttgtggaacacaaataatgaaggagcagaacattgacaagctaagatgaaattctgacatagtacatctctgccaaaaaccacacaccctctgtggatatggatatgaattcccagattttatatactcttgaataaaaggtttatttttatttataagtgggcataaaataagaaatgtccatgcagccatttttccaacagatgctgtacaccgttcattttatatagactagggagattcaaatacagtgcattttctattggtatttgttctgtgcatttttagcaacttctaccagcaaataaagtattctcagtaaaacgaaaatgattctcaagttatcagtttgctgtttttaccacttatttcatgccctgccaaattcaagttacacagacttccattttcttaagataatcaatcatgaagaaatcctttatcaatcattcaaaagtaattttaagtgtaacataactgtgtttacttcccatgcacttaatacccttatgcgctaattttgtgaattaagtttactgattatagaagtatgtgctgcatagaagtctgtgcttagagggtgaagttcctaagcttaccttgaattacagctacatttcagtgttaaatgtgcatattaagaataattcttttggggaaagaaattatgaatcttcaggacagtctacaatggtttagagttacattctgcctagacttttatgacttgctgctattgttttaaaaaccccacttagtctctctcttcctttctgatttctaaagtaagcctcagaatttccaaaccaattcatccacagctgtttctgggctggtttttaaagtagctgcaacagaatcatgaggctttccctttttatcaaatacgaaaaacattttttaaaattctgcacacccagtgatcatcttttgtgcgggaaagcaagatgatgatggatgattttattcatccttttagtaaagacacaaaacatttttctcaacatttgtacagttctgaaaaaaacctggtcaccaaaaatatcttctctgctaattcagcaattcttgggctccagttaggggagctggggcctcactttctcccagaattgtgggcttcactggaagtgaaggtgcaggaatgactggactgtccaccccagccctgcctgcctgtggttttggccagggagcaagccatgaggtgccctggcacatgcacaaattgatcctttgcgtgacagtcttgtatggaaaacagatgctgacagaattgtagactaccatgccacacaaaaaggctaaatatctactccaatgggtttccagttcagtttgaagtcaatcaaatttttgtattttcggtgtctccttgattggttttgctagtaattctgtaaattgtacatttgcaatatgaggttttttttccttttgtacaatttgaaactgatgcttcacctttcctttaataaactattcaaaatcag

SEQ ID NO: 2248 - DNA, 5204 bp, Homo sapiens
attggcgtgtggaaaatgccaccagatggcgggttaggattgcagctccgttgaaggcgcggcccccgctcccgaacccccggcgaccaccccgtaacaacccccccacatcgggaataacacaccggagacttttggggggaaactaggtcgatggtcggcggcgcccggatgggcagctgaggattgcctttgaggttattttaaaagttttgagttgtacagcacttgattattttgctgcattgtgaaaggacctctccagcaatgattacttcagaattaccagtgttacaggattcaactaatgaaactactgcccattccgatgctggcagcgagcttgaagaaacagaggtcaaaggaaaaagaaaaaggggtcgtcctggccggcctccatctacaaataagaaacctcgaaaatctccaggtgagaagagcagaattgaagctggaattagaggagcaggccgtggaagagctaatggacaccctcaacagaatggggaaggggagcctgtcacattatttgaggtggtgaaactggggaaaagtgcaatgcagagatgttgacctttcaaataggtcagtgttgtccaggctgacctcgaacttctgggcccaagtgatcctccccggcctgagcctctcgagtagctgggactacagagccttcatgttgtttgcattcacttggttggaaggggagagagaaagagaagcagtgtctacttcttagaagcctttggcccctctatttacattccattgatgggaacttaccacatactcagtccgtggtggatgactggattgaatcatataaacaagacagggacatcgcacttctggatttaatcaacttttttatccagtgttcaggatgtcgaggtactgtgagaatagagatgtttcgaaatatgcagaatgcagaaatcatcagaaaaatgactgaagaatttgatgaggacagtggtgattatcctcttaccatgcctggacctcagtggaaaaaatttcgttcaaacttttgtgaatttattggagtcctgattcgacagtgtcagtatagcataatttatgatgagtatatgatggacacagtaatctcccttttgacgggtttgtcagactcccaggtcagagcttttaggcatacaagtaccctggctggacaagtcttggggactagataaaatgggcaggaacatttaatcctctgcttcaaagactatgtgcatggacagttacaaggcagttatggccagatatgattatcggctttggaataaaatgctccttgacattgcttaaatcttagctgagaagagagacaatcagccatgaagctcatgactgctctggtgaatgttgccttaaacctcagtattcatcaggataatacccagagacaatatgaagccgagagaaataaaatgattgggaagagagccaatgaaaggttggagttactacttcagaaacgcaaagagctgcaagaaaatcaggatgaaatcgaaaatatgatgaactctatttttaagggtatatttgttcatagataccgtgatgctattgctgagattagagccatttgtattgaagaaattggagtatggatgaaaatgtatagtgatgccttcctaaatgacagttacctaaaatatgttggctggactcttcatgacaggcaaggggaagtcaggctgaagtgtttgaaagctctgcagagtctatataccaatagagaattattccccaaattggaactattcactaaccgattcaaggatcgcattgtatcaatgacacttgataaagaatatgatgttgctgtggaagctattcgattggttactctgatacttcatggaagtgaagaagctctttccaatgaagactgtgaaaatgtttaccacttggtgtactcggcacatcgccctgttgctgtggcagctggagagttccttcacaaaaagctatttagcagacatgacccacaagcagaagaagcattagcaaagaggaggggaagaaacagcccgaatggaaacctcattaggatgctggttcttttctttcttgaaagtgagttacatgaacatgcagcctacttggtggacagtttatgggagagctctcaagaactgttgaaagactgggaatgtatgacagagttgctattagaagaacctgttcaaggagaggaagcaatgtctgatcgtcaagagagtgctcttatagagctaatggtttgtacaattcgtcaagctgctgaggcacatcctccagtgggaaggggtaccggcaagagagtgctaactgccaaagaaaggaaaactcaaattgatgatagaaacaaattgactgaacattttattattacacttcctatgttactgtcaaagtattctgcagatgcagagaaggtagcaaacttgctacaaatcccacagtattttgatttagaaatctacagcacaggtagaatggaaaagcatctggatgctttattaaaacagattaagtttgttgtggagaaacacgtagaatcagatgttctagaagcctgcagtaaaacctatagtatcttatgcagtgaagaatataccatccagaacagagttgacatagctcgaagccagctgattgatgagtttgtagatcgattcaatcattctgtggaagacctattgcaagagggagaagaagctgatgatgatgacatttacaatgttctttctacattaaagcggttaacttcttttcacaatgcacatgatctcacaaaatgggatctctttggtaattgctacagattattgaagactggaattgaacatggagccatgccagaacagatagtcgtgcaagcactgcagtgttcccattattcgattctttggcagttggtgaaaattactgatggctctccttccaaagaggatttgttggtattgaggaaaacggtgaaatcctttttggctgtttgccagcagtgcctgtctaatgttaatactccagtgaaagaacaggctttcatgttactctgtgatcttctgatgattttcagccaccaattaatgacaggtggcagagagggccttcagcctttggtgttcaatccagatactggactccaatctgaactcctcagttttgtgatggatcacgtttttattgaccaagacgaggagaaccagagcatggagggtgatgaagaagatgaagctaataaaattgaggccttacataaaagaaggaatctacttgctgctttcagcaaacttatcatttatgacattgttgacatgcatgcagctgcagacatcttcaaacactacatgaagttatttaatgaacttgttcaagagcaaggtcccaacctagataggacatctgcccatgtcagtggcattaaagaactggcacgtcgctttgcccttacatttggattggaccagattaagacacgagaagcagttgccacacttcacaaggatggcatagagtttgcatttaaataccaaaatcagaaaggacaagagtatccacctcctaatctggcttttcttgaagtactaagtgaattttcttctaaacttcttcgacaggacaaaaagacagttcattcatacctagagaaattccttaccgagcagatgatggaaaggagggaggatgtatggcttccactcatctcctatagaaattcattagtcactgggggtgaagatgatagaatgtctgtgaacagtggaagtagcagcagcaaaacctcatcagtaaggaataagaaaggacgacctccacttcataaaaaacgagtagaagatgagagtctggataacacatggctaaacaggactgacaccatgattcagactcctggccccctgccagcaccacaactcacatccactgtactgcgggagaacagtcggcccatgggagaccagattcaagaacctgagtctgaacatggttctgaaccagactttttacacaatcctcagatgcagatctcttggttaggccagccgaagttagaagacttaaatcggaaggacagaacaggaatgaactacatgaaagtgagaactggagtgaggcatgctgttcggggtctaatggaggaagatgctgagcccatctttgaagatgtgatgatgtcatcccgaagccagttagaagatatgaatgaagaatttgaggacaccatggttattgatctgcctccatcaagaaatcggcgagagagagctgagctaaggccagacttctttgactctgcagctatcatagaagatgattcaggatttggaatgcctatgttctgaagtctgaagaaaatttacaaatctggaactctattatttagagctagaggcctatatactgtgatagcttgtatggggaaaaacacttttgatgtgatctgatttgttttttaatcaaatgattaaggtcaatccctttttgcagtgacagaagaggagcatgtaaattacccaagggaatgttggtgaatgtcaactcagaaagactgacctgaaaatcatttgtgtcctactattggacttatcccaatacagatgtgtgtgtttttctggagggaggaagaaattttaaatttttaaaacagctgtcaagataaacactgttatacacctgttttatgaaaactcaacattgagtaaaaaaaaacatatttttaactttattttcctgttgtacaatttaaaaaccgttttaacattttgcctttttatgttttaaaagctaaccatttttattaaacctatgagtaagcagctcatcctaattgcgaagagtgttttggagttcactggatttggttgacctttgtggaacacaaataatgaaggagcagaacattgacaagctaagatgaaattctgacatagtacatctctgccaaaaaccacacaccctctgtggatatggatatgaattcccagattttatatactcttgaataaaaggtttatttttatttataagtgggcataaaataagaaatgtccatgcagccatttttccaacagatgctgtacaccgttcattttatatagactagggagattcaaatacagtgcattttctattggtatttgttctgtgcatttttagcaacttctaccagcaaataaagtattctcagtaaaacgaaaatgattctc

SEQ ID NO: 2249 - DNA, 2883 bp, Homo sapiens
tgcagagtctatataccaatagagaattattccccaaattggaactattcactaaccgattcaaggatcgcattgtatcaatgacacttgataaagaatatgatgttgctgtggaagctattcgattggttactctgatacttcagctatttagcagacatgacccacaagcagaagaagcattagcaaagaggaggggaagaaacagcccgaatggaaacctcattaggatgctggttcttttctttcttgaaagtgagttacatgaacatgcagcctacttggtggacagtttatgggagagctctcaagaactgttgaaagactgggaatgtatgacagagttgctattagaagaacctgttcaaggagaggaagcaatgtctgatcgtcaagagagtgctcttatagagctaatggtttgtacaattcgtcaagctgctgaggcacatcctccagtgggaaggggtaccggcaagagagtgctaactgccaaagaaaggaaaactcaaattgatgatagaaacaaattgactgaacattttattattacacttcctatgttactgtcaaagtattctgcagatgcagagaaggtagcaaacttgctacaaatcccacagtattttgatttagaaatctacagcacaggtagaatggaaaagcatctggatgctttattaaaacagattaagtttgttgtggagaaacacgtagaatcagatgttctagaagcctgcagtaaaacctatagtatcttatgcagtgaagaatataccatccagaacagagttgacatagctcgaagccagctgattgatgagtttgtagatcgattcaatcattctgtggaagacctattgcaagagggagaagaagctgatgatgatgacatttacaatgttctttctacattaaagcggttaacttcttttcacaatgcacatgatctcacaaaatgggatctctttggtaattgctacagattattgaagactggaattgaacatggagccatgccagaacagatagtcgtgcaagcactgcagtgttcccattattcgattctttggcagttggtgaaaattactgatggctctccttccaaagaggatttgttggtattgaggaaaacggtgaaatcctttttggctgtttgccagcagtgcctgtctaatgttaatactccagtgaaagaacaggctttcatgttactctgtgatcttctgatgattttcagccaccaattaatgacaggtggcagagagggccttcagcctttggtgttcaatccagatactggactccaatctgaactcctcagttttgtgatggatcacgtttttattgaccaagacgaggagaaccagagcatggagggtgatgaagaagatgaagctaataaaattgaggccttacataaaagaaggaatctacttgctgctttcagcaaacttatcatttatgacattgttgacatgcatgcagctgcagacatcttcaaacactacatgaagtattacaatgactatggtgatattattaaggaaacactgagtaaaaccaggcagattgataaaattcagtgtgccaagactctcattctcagtttgcaacagttatttaatgaacttgttcaagagcaaggtcccaacctagataggacatctgcccatgtcagtggcattaaagaactggcacgtcgctttgcccttacatttggattggaccagattaagacacgagaagcagttgccacacttcacaaggatggcatagagtttgcatttaaataccaaaatcagaaaggacaagagtatccacctcctaatctggcttttcttgaagtactaagtgaattttcttctaaacttcttcgacaggacaaaaagacagttcattcatacctagagaaattccttaccgagcagatgatggaaaggagggaggatgtatggcttccactcatctcctatagaaattcattagtcactgggggtgaagatgatagaatgtctgtgaacagtggaagtagcagcagcaaaacctcatcagtaaggaataagaaaggacgacctccacttcataaaaaacgagtagaagatgagagtctggataacacatggctaaacaggactgacaccatgattcagactcctggccccctgccagcaccacaactcacatccactgtactgcgggagaacagtcggcccatgggagaccagattcaagaacctgagtctgaacatggttctgaaccagactttttacacaatcctcagatgcagatctcttggttaggccagccgaagttagaagacttaaatcggaaggacagaacaggaatgaactacatgaaagtgagaactggagtgaggcatgctgttcggggtctaatggaggaagatgctgagcccatctttgaagatgtgatgatgtcatcccgaagccagttagaagatatgaatgaagaatttgaggacaccatggttattgatctgcctccatcaagaaatcggcgagagagagctgagctaaggccagacttctttgactctgcagctatcatagaagatgattcaggatttggaatgcctatgttctgaagtctgaagaaaatttacaaatctggaactctattatttagagctagaggcctatatactgtgatagcttgtatggggaaaaacacttttgatgtgatctgatttgttttttaatcaaatgattaaggtcaatccctttttgcagtgacagaagaggagcatgtaaattacccaagggaatgttggtgaatgtcaactcagaaagactgacctgaaaatcatttgtgtcctactattggacttatcccaatacagatgtgtgtgtttttctgga

SEQ ID NO: 2250 - DNA, 788 bp, Homo sapiens
ccgaacgcccgcagcagggtcagaagggaggtggtcgccctccgtcgtggtctggcgtgtattccgagccttggtgtctggcggtttccgagcgttggtgtctggcggtttccgagcgttggtgtctggcggtttccgaccgttggtgtctggcggtttccgaccgttggtgtctggcacgcgccaccctctcttgctttggttgcgccatgccgatgtaccagacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatcttttcaatgctgcgaaagctgccaaaagtgacatgcagggatgtccttcctgagatccgtgctatctgcattgaggaaattgggtgttggatgcaaagctacagcacgtctttcctcaccgacagctatttaaaatatattggttggactctgcatgataagcaccgagaagtccgcgtgaagtgcgtgaaggctctgaaagggctgtacggtaaccgggacctgaccgcacgcctggagctcttcactggccgcttcaaggactggatggtttccatgatcgtggacagagagtacagtgtggcagtggaggccgtcagattactgatacttatccttaagaacatggaaggggtgctgatggacgtggactgtgagagcgtctaccccattgtgtag

SEQ ID NO: 2251 - DNA, 1768 bp, Homo sapiens
agagcacaccggactgcgttttttttccgaacgcccgcagcagggtcagaagggaggtggtcgccctccgtcgtggtctggcgtgtattccgagccttggtgtctggcggtttccgagcgttggtgtctggcggtttccgagcgttggtgtctggcggtttccgaccgttggtgtctggcggtttccgaccgttggtgtctggcacgcgccaccctctcttgctttggttgcgccatgccgatgtaccagacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatcttttcaatgctgcgaaagctgccaaaagtgacatgcagggatgtccttcctgagatccgtgctatctgcattgaggaaattgggtgttggatgcaaagctacagcacgtctttcctcaccgacagctatttaaaatatattggttggactctgcatgataagcaccgagaagtccgcgtgaagtgcgtgaaggctctgaaagggctgtacggtaaccgggacctgaccgcacgcctggagctcttcactggccgcttcaaggactggatggtttccatgatcgtggacagagagtacagtgtggcagtggaggccgtcagattactgatacttatccttaaacttttctaccctgagtgcgagataagaacgatgggtggaagagagcaacgccagagcccaggtgcccagaggactttcttccagcttctgctgtccttctttgtggagagcaagctccacgaccacgctgcttacttagtagacaacctgtgggactgtgcagggactcagctgaaggactgggagggtctgacaagcctgctgctggagaaggaccagagcacgtgccacatggagccagggccagggaccttccacctcctagggtgaaaccaggagagattgcttgcttcacttgtacaaggcaggaacggtggcatggggtgggggaaacttggagttggaaggtggctaatctttgattctatgtttttgatcctcctggcactccagacctgggtgatgtgcaggagagcacactgatagaaatccttgtgtccagtgcccagcaactcctgcctcagcctcccgagcagctgggactacaggcgcccgccaccacgcctggctaacttttttgtatttttagtagagacgggttttcaccgtgttagccaggatggtcttgatctcttgaccttgtgatccacctgcctcatcatcccaaagtgctgggattacaggcgtgagccactgcgcccagcatgttagacaatttttaattcatcctctctgtgctgttgttttctcagctgtgaaaggaatattctggtggggacaaggttacagagttgctgagagggtctcatgacatgaaggtactggccttggcacagtgcctgggggggcggggactccgcacatgcctgtgatgtcacagttactgtcagttcacagtgaaccttccctccttttcctgttgactttcccacactcctgtaaccctccctccctcccttcttcctctctctctctctcactcacgcacacgcacacacacacacacacacacacacacacactccattcactgtctccatgactctggagtaaactaacgtctcgagttgc

SEQ ID NO: 2252 - DNA, 921 bp, Homo sapiens
gttttttttccgaacgcccgcagcagggtcagaagggaggtggtcgccctccgtcgtggtctggcgtgtattccgagccttggtgtctggcggtttccgagcgttggtgtctggcggtttccgagcgttggtgtctggcggtttccgaccgttggtgtctggcggtttccgaccgttggtgtctggcacgcgccaccctctcttgctttggttgcgccatgccgatgtaccagacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatcttttcaatgctgcgaaagctgccaaaagtgacatgcagcaccgagaagtccgcgtgaagtgcgtgaaggctctgaaagggctgtacggtaaccgggacctgaccgcacgcctggagctcttcactggccgcttcaaggactggatggtttccatgatcgtggacagagagtacagtgtggcagtggaggccgtcagattactgatacttatccttaaacttttctaccctgagtgcgagataagaacgatgggtggaagagagcaacgccagagcccaggtgcccagaggactttcttccagcttctgctgtccttctttgtggagagcaagctccacgaccacgctgcttacttagtagacaacctgtgggactgtgcagggactcagctgaaggactgggagggtctgacaagcctgctgctggagaaggaccagagcacgtgccacatggagccagggccagggaccttccacctcctagggtgaaaccaggagagattgcttgcttcacttgtacaagg

SEQ ID NO: 2253 - DNA, 1200 bp, Homo sapiens
ccgaacgcccgcagcagggtcagaagggaggtggtcgccctccgtcgtggtctggcgtgtattccgagccttggtgtctggcggtttccgagcgttggtgtctggcggtttccgagcgttggtgtctggcggtttccgaccgttggtgtctggcggtttccgaccgttggtgtctggcacgcgccaccctctcttgctttggttgcgccatgccgatgtaccagacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatcttttcaatgctgcgaaagctgccaaaagtgacatgcagggatgtccttcctgagatccgtgctatctgcattgaggaaattgggtgttggatgcaaagctacagcacgtctttcctcaccgacagctatttaaaatatattggttggactctgcatgataagcaccgagaagtccgcgtgaagtgcgtgaaggctctgaaagggctgtacggtaaccgggacctgaccgcacgcctggagctcttcactggccgcttcaaggactggatggtttccatgatcgtggacagagagtacagtgtggcagtggaggccgtcagattactgatacttatccttaaaatcggctcccagacacctgccactcgtgaatgcatctgataaactcactcacactgaggccttggggactgagagtgcgatgacatggatcctgcggacaaaccgccccagggcgtacctagcaccgaagcatcaggcgccactaggtctccagctccttctcggatgacgtccttcagcacgccccggtcccccgagatgtccagcatcctctgacttaaccgctcgtacagggactgatggagaatgaaagccaggcctcagagccgcagacccacccggccacccctcagcgtctacgcccccgaaacgtctgggccctcacctggccgggggcgtcgtccccttccaggactccctggtttaacgcgcttccccccatgtcctagctgccctccctgtggcgtgagccttcggcctggtgcgccccgctgcccttcctggctgtgactctggtggggttccgaag

SEQ ID NO: 2254 - DNA, 1031 bp, Homo sapiens
agaagggaggtggtcgccctccgtcgtggtctggcgtgtattccgagcgttggtgtctggcggtttccgagcgttggtgtctggcggtttccgaccgttggtgtctggcggtttccgaccgttggtgtctggcacgcgccaccctctcttgctttggttgcgccatgccgatgtaccagacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatattttcaatgctgcgaaagctgccaaaagtgacatgcagcaccgagaagtccgcgtgaagtgcgtgaaggctctgaaagggctgtacggtaaccgggacctgaccgcacgcctggagctcttcactggccgcttcaaggactggatggtttccatgatcgtggacagagagtacagtgtggcagtggaggccgtcagattactgatacttatccttaaacttttctaccctgagtgcgagataagaacgatgggtggaagagagcaacgccagagcccaggcgcccagaggactttcttccagcttctgctgtccttctttgtggagagcaaggtgacatacacagagagaactctggctgttgtgcataggacctacaagtgggctggggttggtggctcacgcctgtaagcccagcactttgggaggctgaggtgggaggatcctttgagcccaggagtttgagaccagcttgggcaacatagtgagaccctgtctctaccaaaaaaaaaaaaaaaaaagacaaatggagaaggatgggggtgtacactgtaggaaggagagcgatatttaatcagtaaccacttcctagggtattttaacatgccatcactaaatccccatgcacctccttccccagctccacgaccacgctgcttacttagtagacaacctgtgggactgtgca

SEQ ID NO: 2255 - DNA, 1340 bp, Homo sapiens
gtcgccctccgtcgtggtctggcgtgtattccgagcgttggtgtctggcggtttccgagcgttggtgtctggcggtttccgaccgttggtgtctggcggtttccgaccgttggtgtctggcacgcgccaccctctcttgctttggttgcgccatgccgatgtaccagacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatattttcaatgctgcgaaagctgccaaaagtgacatgcagcaccgagaagtccgcgtgaagtgcgtgaaggctctgaaagggctgtacggtaaccgggacctgaccgcacgcctggagctcttcactggccgcttcaaggactggatggtttccatgatcgtggacagagagtacagtgtggcagtggaggccgtcagattactgatacttatccttaagaacatggaaggggtgctgatggacgtggactgtgagagcgtctaccccattgtgtaggcctctaattgaggcctggcctctgctgtgggtgaatttctgtactggaaacttttctaccctgagtgcgagataagaacgatgggtggaagagagcaacgccagagcccaggcgcccagaggactttcttccagcttctgctgtccttctttgtggagagcaagctccacgaccacgctgcttacttagtagacaacctgtgggactgtgcagggactcagctgaaggactgggagggtctgacaagcctgctgctggagaaggaccagagcacgtgccacatggagccagggccagggaccttccacctcctagggtgaaaccaggagagattgcttgcttcacttgtacaaggcaggaacggtggcatggcgtgggggaaacttggagttggaaggtggctaatctttgattctatgtttttgatcctcctggcactccagacctgggtgatatgcaggagagcacactgatagaaatccttgtgtccagtgcccagcaactcctgcctcagcctcccgagcagctgggactacaggtgcccgccaccacgcccgtctctactaaaaatacaaaaaaaattagccaggcatggtggcgggcgcctatatggtcccagctactcaggaggctggggcaagagaatggcgtgagcccgggaggtggagcttgcagcgagcggaaattgcgccactgcactccagcctgggcgacagagtgagactccgtctc

SEQ ID NO: 2256 - DNA, 983 bp, Homo sapiens
agaagggaggtggtcgccctccgtcgtggtctggcgtgtattccgagcgttggtgtctggcggtttccgagcgttggtgtctggcggtttccgaccgttggtgtctggcggtttccgaccgttggtgtctggcacgcgccaccctctcttgctttggttgcgccatgccgatgtaccagagacggggttttgccatgttgaccaggctggtcttgaactcctgacctcaggcgatccgcccgccttgaactcccaaagtgctggattacaggtgtgagccaccgtgcccggcacctaaacaacatagttttgatatagacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatattttcaatgctgcgaaagctgccaaaagtgacatgcagggatgtccttcctgagatccgtgctatctgcattgaggaaattgggtgttggatgcaaagctacagcacgtctttcctcaccgacagctatttaaaatatattggttggactctgcatgataagcaccgagaagtccgcgtgaagtgcgtgaaggctctgaaagggctgtacggtaaccgggacctgaccgcacgcctggagctcttcactggccgcttcaaggactggatggtttccatgatcgtggacagagagtacagtgtggcagtggaggccgtcagattactgatacttatccttaagaacatggaaggggtgctgatggacgtggactgtgagagcgtctaccccattgtgtaggcctctaattgaggcctggcctctgctgtgggtgaatttctgtactggaaacttttctaccctgagtgcgagataagaacgatgggtggaagagagcaacg

SEQ ID NO: 2257 - DNA, 1016 bp, Homo sapiens
gggtctgcgcccctctccgtgtggagcccacctgcatgtactggctccccaacatgcacggcaggagcggcggcccagcacttggcactggccacttgcagacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatattttcaatgctgcgaaagctgccaaaagtgacatgcagggatgtccttcctgagatccgtgctatctgcattgaggaaattgggtgttggatgcaaagctacagcacgtctttcctcaccgacagctatttaaaatatattggttggactctgcatgataagcaccgagaagtccgcgtgaagtgcgtgaaggctctgaaagggctgtacggtaaccgggacctgaccgcacgcctggagctcttcactggccgcttcaaggactggatggtttccatgatcgtggacagagagtacagtgtggcagtggaggccgtcagattactgatacttatccttaagaacatggaaggggtgctgatggacgtggactgtgagagcgtctaccccattgtgtaggcctctaattgaggcctggcctctgctgtgggtgaatttctgtactggaaacttttctaccctgagtgcgagataagaacgatgggtggaagagagcaacgccagagcccaggcgcccagaggactttcttccagcttctgctgtccttctttgtggagagcaaggtgacatacacagagagaactctggctgttgtgcataggacctacaagtgggctggggttggtggctcacgcctgtaagcccagcactttgggaggctgaggtgggaggatcctttgagcccaggagtttgagaccagcttgggcaacatagtgagaccctgtctctaccaaaaaaaaaaaaaaaa

SEQ ID NO: 2258 - DNA, 2140 bp, Homo sapiens
acaccggactgcgttttttttccgaacgcccgcagcagggtcagaagggaggtggtcgccctccgtcgtggtctggcgtgtattccgagcgttggtgtctggcggtttccgagcgttggtgtctggcggtttccgaccgttggtgtctggcggtttccgaccgttggtgtctggcacgcgccaccctctcttgctttggttgcgccatgccgatgtaccagacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatattttcaatgctgcgaaagctgccaaaagtgacatgcagggatgtccttcctgagatccgtgctatctgcattgaggaaattgggtgttggatgcaaagctacagcacgtctttcctcaccgacagctatttaaaatatattggttggactctgcatgataagcaccgagaagtccgcgtgaagtgcgtgaaggctctgaaagggctgtacggtaaccgggacctgaccgcacgcctggagctcttcactggccgcttcaaggactggatggtttccatgatcgtggacagagagtacagtgtggcagtggaggccgtcagattactgatacttatccttaagaacatggaaggggtgctgatggacgtggactgtgagagcgtctaccccattgtgtaggcctctaattgaggcctggcctctgctgtgggtgaatttctgtactggaaacttttctaccctgagtgcgagataagaacgatgggtggaagagagcaacgccagagcccaggcgcccagaggactttcttccagcttctgctgtccttctttgtggagagcaaggtgacatacacagagagaactctggctgttgtgcataggacctacaagtgggctggggttggtggctcacgcctgtaagcccagcactttgggaggctgaggtgggaggatcctttgagcccaggagtttgagaccagcttgggcaacatagtgagaccctgtctctaccaaaaaaaaaaaaaaaaaagacaaatggagaaggatgggggtgtacactgtaggaaggagagcgatatttaatcagtaaccacttcctagggtattttaacatgccatcactaaatccccatgcacctccttccccagctccacgaccacgctgcttacttagtagacaacctgtgggactgtgcagggactcagctgaaggactgggagggtctgacaagcctgctgctggagaaggaccagagcacgtgccacatggagccagggccagggaccttccacctcctagggtgaaaccaggagagattgcttgcttcacttgtacaaggcaggaacggtggcatggcgtgggggaaacttggagttggaaggtggctaatctttgattctatgtttttgatcctcctggcactccagacctgggtgatatgcaggagagcacactgatagaaatccttgtgtccagtgcccagcaactcctgcctcagcctcccgagcagctgggactacaggtgcccgccaccacgcccggctaacttttttgtatttttagtagagacgggttttcaccgtgttagccaggatggtcttgatctcttgaccttgtgatccacctgcctcatcatcccaaagtgctgggattacaggcgtgagccactgcgcccagcatgttagacaatttttaattcatcctctctgtgctgttgttttctcagctgtgaaaggaatattctggtggggacaaggttacagagttgctgagagggtctcatgacatgaaggtactggccttggcacagtgcctgggggggcggggactccgcacatgcctgtgatgtcacagttactgtcagttcacagcgaaccttccctccttttcctgttgactttcccacactcctgtaaccatccctccctcccttcttcctctctctctctctcactcacgcacacgcacacacacacacacacactccattcactgtctccatgactctggagtaaactaacgtctcgagtt

SEQ ID NO: 2259 - DNA, 1821 bp, Homo sapiens
ccgaacgcccgcagcagggtcagaagggaggtggtcgccctccgtcgtggtctggcgtgtattccgagccttggtgtctggcggtttccgagcgttggtgtctggcggtttccgagcgttggtgtcttggcggtttccgaccgttggtgtctggcggtttccgaccgttggtgtctggcacgcgccaccctctcttgctttggttgcgccatgccgatgtaccagacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatcttttcaatgctgcgaaagctgccaaaagtgacatgcagggatgtccttcctgagatccgtgctatctgcattgaggaaattgggtgttggatgcaaagctacagcacgtctttcctcaccgacagctatttaaaatatattggttggactctgcatgataagcaccgagaagtccgcgtgaagtgcgtgaaggctctgaaagggctgtacggtaaccgggacctgaccgcacgcctggagctcttcactggctgcttcaaggactggatggtttccatgatcatggacagagagtacagtgtggcagtggaggccgtcagattactgatacttatccttaaacttttctaccctgagtgcgagataagaacgatgggtggaagagagcaacgccagagcccaggtgcccagaggactttcttccagcttctgctgtccttctttgtggagagcaagctccacgaccacgctgcttacttagtagacaacctgtgggactgtgcagggactcagctgaaggactgggagggtctgacaagcctgctgctggagaaggaccagagcacgtgccacatggagccagggccagggaccttccacctcctagggtgaaaccaggagagattgcttgcttcacttgtacaaggcaggaacggtggcatggggtgggggaaacttggagttggaaggtggctaatctttgattctatgtttttgatcctcctggcactccagacctgggtgatgtgcaggagagcacactgatagaaatccttgtgtccagtgcccagcaactcctgcctcagcctcccgagcagctgggactacaggcgcccgccaccacgcctggctaacttttttgtatttttagtagagacgggttttcaccgtgttagccaggatggtcttgatctcttgaccttgtgatccacctgcctcatcatcccaaagtgctgggattacaggcgtgagccactgcgcccagcatgttagacaatttttaattcatcctctctgtgctgttgttttctcagctgtgaaaggaatattctggtggggacaaggttacagagttgctgagagggtctcatgacatgaaggtactggccttggcacagtgcctgggggggcggggactccgcacatgcctgtgatgtcacagttactgtcagttcacagcgaaccttccctccttttcctgttgactttcccacactcctgtaaccctccctccctcccttcttcctctctctctctctcactcacgcacacgcacacacacacacacacacacacacacacacactccattctctgtctccatgactctggagtaaactaacgtctcgagttgccattggaagccccattgtcctcattttgttttgttttgtttgtttgagacggggtctcgctctgtcccccaggctg

SEQ ID NO: 2260 - DNA, 1262 bp, Homo sapiens
tttttccgaacgcccgcagcagggtcagaagggaggtggtcgccctccgtcgtggtctggcgtgtattccgagccttggtgtctggcggtttccgagcgttggtgtctggcggtttccgagcgttggtgtcttggcggtttccgaccgttggtgtctggcggtttccgaccgttggtgtctggcacgcgccaccctctcttgctttggttgcgccatgccgatgtaccaggtaaagccctatcaccgggtctgcgcccctctccgtgtggagcccacctgcatgtactggctccccaacatgcacggcaggagcggcggcccagcacttggcactggccacttgcagacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatcttttcaatgctgcgaaagctgccaaaagtgacatgcagggatgtccttcctgagatccgtgctatctgcattgaggaaattgggtgttggatgcaaagctacagcacgtctttcctcaccgacagctatttaaaatatattggttggactctgcatgataagcaccgagaagtccgcgtgaagtgcgtgaaggctctgaaagggctgtacggtaaccgggacctgaccgcacgcctggagctcttcactggctgcttcaaggactggatggtttccatgatcatggacagagagtacagtgtggcagtggaggccgtcagattactgatacttatccttaagaacatggaaggggtgctgatggacgtggactgtgagagcgtctaccccattgtgtaggcctctaattgaggcctggcctctgctgtgggtgaatttctgtactggaaacttttctaccctgagtgcgagataagaacgatgggtggaagagagcaacgccagagcccaggtgcccagaggactttcttccagcttctgctgtccttctttgtggagagcaaggtgacatacacagagataactctggctgttgtgcataggacctacaagtgggctggggttggtggttcacgcctgtaagcccaacactttgggaggctgaggtgggaggatcctttgagcccaggagtttgagaccagcttgggcaacatagtgagaccctgtctctaccaaaaaaaaaaaaaaaa

SEQ ID NO: 2261 - DNA, 1697 bp, Homo sapiens
ccgaacgcccgcagcagggtcagaagggaggtggtcgccctccgtcgtggtctggcgtgtattccgagccttggtgtctggcggtttccgagcgttggtgtctggcggtttccgagcgttggtgtcttggcggtttccgaccgttggtgtctggcggtttccgaccgttggtgtctggcacgcgccaccctctcttgctttggttgcgccatgccgatgtaccagacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatcttttcaatgctgcgaaagctgccaaaagtgacatgcagcaccgagaagtccgcgtgaagtgcgtgaaggctctgaaagggctgtacggtaaccgggacctgaccgcacgcctggagctcttcactggctgcttcaaggactggatggtttccatgatcatggacagagagtacagtgtggcagtggaggccgtcagattactgatacttatccttaaacttttctaccctgagtgcgagataagaacgatgggtggaagagagcaacgccagagcccaggtgcccagaggactttcttccagcttctgctgtccttctttgtggagagcaagctccacgaccacgctgcttacttagtagacaacctgtgggactgtgcagggactcagctgaaggactgggagggtctgacaagcctgctgctggagaaggaccagagcacgtgccacatggagccagggccagggaccttccacctcctagggtgaaaccaggagagattgcttgcttcacttgtacaaggcaggaacggtggcatggggtgggggaaacttggagttggaaggtggctaatctttgattctatgtttttgatcctcctggcactccagacctgggtgatgtgcaggagagcacactgatagaaatccttgtgtccagtgcccagcaactcctgcctcagcctcccgagcagctgggactacaggcgcccgccaccacgcctggctaacttttttgtatttttagtagagacgggttttcaccgtgttagccaggatggtcttgatctcttgaccttgtgatccacctgcctcatcatcccaaagtgctgggattacaggcgtgagccactgcgcccagcatgttagacaatttttaattcatcctctctgtgctgttgttttctcagctgtgaaaggaatattctggtggggacaaggttacagagttgctgagagggtctcatgacatgaaggtactggccttggcacagtgcctgggggggcggggactccgcacatgcctgtgatgtcacagttactgtcagttcacagcgaaccttccctccttttcctgttgactttcccacactcctgtaaccctccctccctcccttcttcctctctctctctctcactcacgcacacgcacacacacacacacacacacacacacacacactccattctctgtctccatgactctggagtaaactaacgtctcgagttgccattggaagccccattgtcctcattttgttttgttttgtttgtttgagacggggtctcgctctgtcccccaggctg

SEQ ID NO: 2262 - DNA, 1716 bp, Homo sapiens
gaacgcccgcagcagggtcagaagggaggtggtcgccctccgtcgtggtctggcgtgtattccgagccttggtgtctggcggtttccgagcgttggtgtctggcggtttccgagcgttggtgtcttggcggtttccgaccgttggtgtctggcggtttccgaccgttggtgtctggcacgcgccaccctctcttgctttggttgcgccatgccgatgtaccagacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatcttttcaatgctgcgaaagctgccaaaagtgacatgcagggatgtccttcctgagatccgtgctatctgcattgaggaaattgggtgttggatgcaaagctacagcacgtctttcctcaccgacagctatttaaaatatattggttggactctgcatgataagcaccgagaagtccgcgtgaagtgcgtgaaggctctgaaagggctgtacggtaaccgggacctgaccgcacgcctggagctcttcactggctgcttcaaggactggatggtttccatgatcatggacagagagtacagtgtggcagtggaggccgtcagattactgatacttatccttaagtgagtcctgggaagaggggaggccagtgtctcagacctttgcccttccagggtcatctccctccacctgtcacagctgactcttccatctgtgcaggttgactgaggtcattcctgagttgcagtatgttgagagggtaatatttctgtcttctctaactccccatactcccttgtcttccactctccatttaggagttttttgtgagttatgtccttgttgcttttgcctctttttctttctagccttgattgtgccagaagacaatgtccctattcacacactctttctgcttttctgtgggcaggaacatggaaggggtgctgatggacgtggactgtgagagcgtctaccccattgtgtaggcctctaattgaggcctggcctctgctgtgggtgaatttctgtactggaagtgagtggggctccttttacgtttctttaacaccaccctctcggtttctctcccacatgtgctgctgccctacttaaggcctccccatctccgtggaagtctctctgctgtctcttttcctctctcagctccttggggctttccttagctctgcacctccttttcctttatcatctccttgggccatctcctccctctgtggtcatcattacacctccttgtttcctcctgtgctgagccctttccttgtgtccattccaccagacttttctaccctgagtgcgagataagaacgatgggtggaagagagcaacgccagagcccaggtgcccagaggactttcttccagcttctgctgtccttctttgtggagagcaaggtgacatacacagagataactctggctgttgtgcataggacctacaagtgggctggggttggtggttcacgcctgtaagcccaacactttgggaggctgaggtgggaggatcctttgagcccaggagtttgagaccagcttgggcaacatagtgagaccctgtctctaccaaaaaaaaaaaaaaaaaaaaaa

SEQ ID NO: 2263 - DNA, 4201 bp, Homo sapiens
atggcccacctggagctgctgcttgtggaaaatttcaagtcgtggcggggccgccaggtcattggccccttccggaggttcacctgcatcatcggccccaacggctctggaaaatctaatgtaatggatgcacttagttttgtaatgggagagaaaatagctaatttaagagtgaaaaatattcaagaactcattcatggagcacatattggaaaacctatttcttcttctgcaagtgtaaaaattatatatgtggaggaaagtggcgaagagaaaacatttgcaaggattatccgagggggatgctcagaatttcgctttaatgataatcttgtgagtcgttctgtttacattgcagagttggaaaagataggcataatagtcaaagcacaaaattgtttggtttttcagggaactgtagagtcaatttcagtgaagaaacccaaagaaaggacccagttttttgaggaaatcagcacttcaggagagcttataggagaatatgaagaaaagaaaagaaagttacaaaaagccgaagaggatgcacagtttaactttaataagaaaaaaaatatagcggcagagcgcagacaagcaaaattagagaaggaagaggcagaacgttaccagagtctccttgaagaactgaaaatgaacaagatacaactgcagctttttcaactataccataatgagaaaaagattcatctcctgaacaccaagttagagcatgtgaatagggatttgagtgtcaaaagagagtctttgtctcatcatgaaaacatagttaaagccaggaaaaaggaacatggaatgctaactagacaactacaacaaacagaaaaagaattaaaatcggttgaaacccttttaaatcagaagaggcctcagtacattaaagccaaagaaaacacttctcaccaccttaagaaattagatgtggctaagaaatcaataaaggacagcgaaaaacaatgttctaaacaggaagatgatataaaagccctggagacagagctggctgatttagatgctgcatggagaagttttgaaaagcagattgaggaagaaattttacataaaaagcgagacattgaactggaagccagtcagctggatcgttataaagaacttaaggaacaagtaagaaagaaagtagctacaatgactcaacaactggaaaaactgcagtgggaacagaagacagatgaagaaagactggcatttgaaaagaggaggcatggagaagttcagggaaatctaaaacaaataaaagaacaaatagaagatcataaaaaacgaatagagaagttagaggagtatacaaagacatgcatggattgcttgaaagagaaaaaacagcaagaggaaaccctagtggatgaaattgaaaaaacaaaatcaagaatgtctgaatttaatgaagaattgaatcttattagaagtgaattgcagaatgctgggattgatacccatgagggaaaacgtcagcaaaagagagcagaggttctggaacaccttaaaagactgtacccagattctgtgtttggaagactatttgacctgtgtcatcctattcataagaaataccagctggctgttactaaggtttttggccggttcatcactgccattgttgtagcctctgaaaaggtagcaaaagattgtattcgatttctgaaggaggaaagagctgaacctgagacattcctcgctctagattaccttgatatcaagccaatcaatgaaagactaagggagcttaaaggctgtaaaatggtgattgatgtcataaagactcagtttcctcagctgaagaaagtgattcagtttgtgtgtggaaatggtcttgtttgtgagactatggaagaagcaaggcatattgcactcagtggacctgaaagacagaaaacagtagctcttgatggaacattatttttaaaatctggagtgatctctggagggtcaagtgacttaaaatacaaggctagatgctgggatgagaaagagttaaagaatctaagagacagacgaagccagaaaatccaagagctaaagggtttaatgaagacactccgcaaagaaacagatttgaaacaaatacagaccctgatacagggaactcaaacacgactcaaatattcacaaaatgaactagagatgattaagaagaagcaccttgttgctttttaccaggaacaatctcagttacaaagtgaactactaaatattgagtctcaatgtattatgttgagtgaaggaatcaaggaacgacaacgaagaattaaagaatttcaagaaaagatagataaggtagaagacgatatcttccaacacttctgtgaagaaattggcgtggaaaatattcgtgaatttgagaacaaacatgttaaacggcaacaagaaattgatcaaaaaagattagaatttgaaaaacaaaaaactcggcttaatgttcaacttgagtatagtcgcagtcaccttaagaagaaactgaataagatcaacacattaaaagaaactatccagaaaggtagtgaagatattgatcacctaaagaaggctgaagaaaactgtctgcagacagtgaatgaactcatggcaaagcagcagcaacttaaggacatacgtgtcactcagaactccagtgccgagaaagttcaaactcaaattgaagaggaacggaagaagtttctggctgttgatagggaagtggggaaattgcaaaaagaagttgtaagtattcaaacttctctggaacagaaacgattagagaagcataacttgctgcttgattgcaaagtgcaagacattgagataatccttttgtcggggtcactggatgacatcattgaagtggagatgggaactgaagcagaaagtacccaggcaacaattgatatctatgaaaaagaagaagcctttgaaatagactacagctctctaaaagaggatttgaaggctctacagtctgatcaagaaatcgaggcccaccttaggctcttattgcagcaagtagcatcccaggaagatatcttactgaaaacagcagccccaaacctacgagcactggagaacttaaagactgtcagagacaagtttcaagagtccacagatgcttttgaggccagcagaaaggaagccagactgtgtaggcaagagttcgagcaagtgaaaaaaaggagatacgatcttttcacccagtgttttgagcatgtctcaatctcaattgatcaaatctacaagaagctctgcagaaacaacagcgcccaagcatttcttagcccagagaaccctgaagaaccttacttggagggaattagctataactgtgtggccccaggcaaacggtttatgccaatggacaatttgtcagggggagaaaagtgtgtggcagccttggctctcctgtttgctgtgcacagttttcgtcctgccccattctttgttttagatgaagtggatgcagccctagacaatactaacataggcaaagtgtcaagttacatcaaagagcaaactcaagaccagtttcagatgatagtcatctccctaaaagaagagttctattccagagccgacgcgctgatcggcatctatcctgagtacgatgactgcatgttcagccgagttttgaccctagatctttctcagtatccagacactgaaggccaagaaagcagcaagagacacggagagtcccgctaggggcagtcctgcagcagtcacctgatcactgttcagttcccactctaatactcacacagctcctccacaggagacttctggagcaagcaggaccagcctggtgcaccctttaagagaaaccttagtcgttctagccaaagaggctgtggctcactttagttgagtgttcagacctcattctagtagggaaagttttcagtgagagctggtgtcaaatgagtttttaaaaaacaaacaaaaggtacaattttgtactataattctaacttctattttgaaataagctagtttggttggaaaaattttgaattcagcttcatcttcactctgatcttgccttgcacccaagtaatcttgaagggaacttctcttggtttttaaacatactagttataagattgttaataaactgttgaacctggcttttgggaaattgtttcagagaaactatgttagtattgaaaatatcaataaaaaatgttctaatttcaaa

SEQ ID NO: 2264 - DNA, 3636 bp, Homo sapiens
cgctttttccgcgggcgcttgataacgcgggtgaggcgtggagggcggcgccatggcccacctggagctgctgcttgtggaaaatttcaagtcgtggcggggccgccaggtcattggccccttccggaggttcacctgcatcatcggccccaacggctctggaaaatctaatgtaatggatgcacttagttttgtaatgggagagaaaatagctaatttaagagtgaaaaatattcaagaactcattcatggagcacatattggaaaacctatttcttcttctgcaagtgtaaaaattatatatgtggaggaaagtggcgaagagaaaacatttgcaaggattatccgagggggatgctcagaatttcgctttaatgataatcttgtgagtcgttctgtttacattgcagagttggaaaagataggcataatagtcaaagcacaaaattgtttggtttttcagggaactgtagagtcaatttcagtgaagaaacccaaagaaaggacccagttttttgaggaaatcagcacttcaggagagcttataggagaatatgaagaaaagaaaagaaagttacaaaaagccgaagaggatgcacagtttaactttaataagaaaaaaaatatagcggcagagcgcagacaagcaaaattagagaaggaagaggcagaacgttaccagagtctccttgaagaactgaaaatgaacaagatacaactgcagctttttcaactataccataatgagaaaaagattcatctcctgaacaccaagttagagcatgtgaatagggatttgagtgtcaaaagagagtctttgtctcatcatgaaaacatagttaaagccaggaaaaaggaacatggaatgctaactagacaactacaacaaacagaaaaagaattaaaatcggttgaaacccttttaaatcagaagaggcctcagtacattaaagccaaagaaaacacttctcaccaccttaagaaattagatgtggctaagaaatcaataaaggacagcgaaaaacaatgttctaaacaggaagatgatataaaagccctggagacagagctggctgatttagatgctgcatggagaagttttgaaaagcagattgaggaagaaattttacataaaaagcgagacattgaactggaagccagtcagctggatcgttataaagaacttaaggaacaagtaagaaagaaagtagctacaatgactcaacaactggaaaaactgcagtgggaacagaagacagatgaagaaagactggcatttgaaaagaggaggcatggagaagttcagggaaatctaaaacaaataaaagaacaaatagaagatcataaaaaacgaatagagaagttagaggagtatacaaagacatgcatggattgcttgaaagagaaaaaacagcaagaggaaaccctagtggatgaaattgaaaaaacaaaatcaagaatgtctgaatttaatgaagaattgaatcttattagaagtgaattgcagaatgctgggattgatacccatgagggaaaacgtcagcaaaagagagcagaggttctggaacaccttaaaagactgtacccagattctgtgtttggaagactatttgacctgtgtcatcctattcataagaaataccagctggctgttactaaggtttttggccggttcatcactgccattgttgtagcctctgaaaaggtagcaaaagattgtattcgatttctgaaggaggaaagagctgaacctgagacattcctcgctctagattaccttgatatcaagccaatcaatgaaagactaagggagcttaaaggctgtaaaatggtgattgatgtcataaagactcagtttcctcagctgaagaaagtgattcagtttgtgtgtggaaatggtcttgtttgtgagactatggaagaagcaaggcatattgcactcagtggacctgaaagacagaaaacagtagctcttgatggaacattatttttaaaatctggagtgatctctggagggtcaagtgacttaaaatacaaggctagatgctgggatgagaaagagttaaagaatctaagagacagacgaagccagaaaatccaagagctaaagggtttaatgaagacactccgcaaagaaacagatttgaaacaaatacagaccctgatacagggaactcaaacacgactcaaatattcacaaaatgaactagagatgattaagaagaagcaccttgttgctttttaccaggaacaatctcagttacaaagtgaactactaaatattgagtctcaatgtattatgttgagtgaaggaatcaaggaacgacaacgaagaattaaagaatttcaagaaaagatagataaggtagaagacgatatcttccaacacttctgtgaagaaattggcgtggaaaatattcgtgaatttgagaacaaacatgttaaacggcaacaagaaattgatcaaaaaagattagaatttgaaaaacaaaaaactcggcttaatgttcaacttgagtatagtcgcagtcaccttaagaagaaactgaataagatcaacacattaaaagaaactatccagaaaggtagtgaagatattgatcacctaaagaaggctgaagaaaactgtctgcagacagtgaatgaactcatggcaaagcagcagcaacttaaggacatacgtgtcactcagaactccagtgccgagaaagttcaaactcaaattgaagaggaacggaagaagtttctggctgttgatagggaagtggggaaattgcaaaaagaagttgtaagtattcaaacttctctggaacagaaacgattagagaagcataacttgctgcttgattgcaaagtgcaagacattgagataatccttttgtcggggtcactggatgacatcattgaagtggagatgggaactgaagcagaaagtacccaggcaacaattgatatctatgaaaaagaagaagcctttgaaatagactacagctctctaaaagaggatttgaaggctctacagtctgatcaagaaatcgaggcccaccttaggctcttattgcagcaagtagcatcccaggaagatatcttactgaaaacagcagccccaaacctacgagcactggagaacttaaagactgtcagagacaagtttcaagagtccacagatgcttttgaggccagcagaaaggaagccagactgtgtaggcaagagttcgagcaagtgaaaaaaaggagatacgatcttttcacccagtgttttgagcatgtctcaatctcaattgatcaaatctacaagaagctctgcagaaacaacagcgcccaagtgtcaagttacatcaaagagcaaactcaagaccagtttcagatgatagtcatctccctaaaagaagagttctattccagagccgacgcgctgatcggcatctatcctgagtacgatgactgcatgttcagccgagttttgaccctagatctttctcagtatccagacactgaaggccaagaaagcagcaagagacacggagagtcccgctaggggcagtcctgcagcagtcacctgatcactgttcagttcccactctaatactcacacagctcctccacaggagacttctggagcaagcaggaccagcc

SEQ ID NO: 2265 - DNA, 5943 bp, Homo sapiens
gaatcggttcccgggtgatcctcgcgcctgccgctgctcggccgccgccgctgacgaggagctgcagcgcgccgggccgaggcctcgagccgccccgggagctggagctgaaggcgccgcgcggagcgcgcacctcagccctgagcccggcggcggcaggcgtcgctgtcttttctccttttccccaatatggcagcggcggacggcggcgggcctggtggggcctctgtggggactgaggaggatggcggaggcgtcggccacaggacggtgtacttgtttgatcggcgcgaaaaggagtccgagctcggggaccggcctctgcaggtcggggagcgctcggactacgcgggatttcgcgcgtgtgtgtgtcagacacttggcatttcacctgaagaaaaatttgttattacaacaacaagtaggaaagaaattacctgtgataattttgatgaaactgttaaagatggagtcaccttatacctgctacagtcggtcaatcagttactactgacagctacgaaagaacgaattgacttcttacctcactatgacacactggttaaaagtggcatgtatgaatattatgccagtgaaggacaaaatcctttgccatttgctcttgcggaattaattgacaattcattgtctgctacttctcgtaacattggggttagaagaatacagatcaaattgctttttgatgaaacacaaggaaaacctgctgttgcagtgatagataatggaagaggaatgacctctaaacagcttaacaactgggccgtgtataggttgtcaaaattcacaaggcaaggtgactttgaaagtgatcattcaggatatgttcgtccagtaccagtgccacgcagtttaaatagtgatatttcctattttggtgttgggggcaagcaagctgtcttctttgttggacaatcagccagaatgataagcaaacctgcagattcccaagatgttcacgagcttgtgctttctaaagaagattttgagaagaaggagaaaaataaagaggcaatatatagtggatatattagaaacagaaagccctctgattctgttcacattacaaatgatgatgaaagatttctacatcatcttatcatagaggagaaggaaaaagatagctttactgctgtggttatcacaggggtacaaccagaacacatacagtacttgaaaaattatttccacctttggacacgacagttagcgcatatttatcactactatattcatggcccaaaaggaaatgaaatacgaacatcaaaagaagttgaacctttcaacaatattgatattgaaatttctatgtttgaaaaagggaaggtacctaagattgtcaacctaagggaaatacaagacgacatgcagacgttgtatgtaaacacagcagctgatagttttgaattcaaagctcatgttgaaggagatggtgtagtggaagggattatccgttatcatccattcttatatgatagagaaacttaccctgatgatccatgctttccatcaaaattaaaagatgaagatgatgaagatgattgtttcatacttgagaaagcagctagagggaaaaggcctatttttgaatgtttttggaatggacgattaataccatatacatcagttgaagactttgactggtgtactcctcctaagaagagagggcttgcaccaattgaatgctacaataggatatctggtgcattattcactaatgacaaattccaggtcagcacaaataaattgacgtttatggatcttgagctaaaattgaaagataagaacaccctttttacaaggattttaaatggacaggaacagcgaatgaaaattgacagagaatttgctttgtggctgaaggactgtcatgagaagtatgataaacaaataaaatttacactttttaagggagtaattacacgtcctgatcttccttctaaaaagcaaggtccctgggcaacatatgcagcaatagaatgggatggaaagatatacaaagcaggacagctggtcaagacaatcaagacacttcccctcttttatggaagcatagtaagattttttctttatggcgatcatgatggagaagtatatgctacaggaggagaggttcaaattgcaatggaacctcaggcactatatgatgaagtaagaactgtgccaattgcaaagctggataggacagttgctgagaaagctgttaaaaaatatgtagaagatgaaatggcaaggctccctgatagattgtcagtaacttggcctgaaggagatgaattattgcctaatgaggttaggcctgctggaacccctattggtgcgttaagaattgaaatactgaataaaaaaggggaagcaatgcaaaagcttccaggaacaagccatggagggtcaaagaaactcctggttgagctcaaagttattttacattcttcaagtggaaataaagagattatttcgcatattagtcaacatggaggaaaatggccttactggtttaaaaaaatggaaaatattcagaagttggggaattataccttgaaattacaagttgtgttgaatgaaagtaatgcagacacttatgcaggaagaccactaccatctaaagcaattaagttttctgttaaagagggtaagccagagaaattttcatttggtcttctggatcttccttttcgtgttggagttccatttaatatccctctggagtttcaggatgaatttggtcataccagtcaactagtaactgatattcagccagttcttgaagcaagtggtttatctttacattatgaagaaataaccaaaggaccaaattgtgtaattcgaggtgttacagccaagggccctgtaaactcttgtcaaggcaagaattataatctgaaggttactctgcctggcttaaaagaagactcacagattttgaaaattagattactacctggtcaccctcgtcgactgaaagtgaaacctgattctgaaattttagttatagaaaatggaacagctttcccatttcaggtggaagttttagatgaatcagacaacataacagcacaaccaaaattgattgttcattgtaagttttcaggtgctccaaaccttccagtctatgttgtagattgcagtagttctggaaccagtattttaacaggatctgcaattcaagttcagaatattaaaaaagaccagacgcttaaagcaagaattgaaatacctagttgtaaagatgtggcacctgtggagaagactattaagttgcttcccagtagccatgttgcaagactacaaatattcagtgtagaaggacaaaaggcaattcagatcaaacatcaggatgaggttaattggatagcgggtgatattatgcataatcttatttttcaaatgtatgatgaaggagaaagagaaatcaatataacatcagctttagcagaaaaaattaaagttaattggactcctgagattaacaaagaacacttgctacagggtctgcttcctgatgtgcaagtaccaacatctgtaaaagatatgcgctattgccaggtttcattccaagatgatcatgtgtctttggaaagtgcgtttacagtaagaccacttcctgatgaacctaaacatttaaaatgtgaaatgaaaggaggaaaaacagtacagatgggccaagagcttcaaggagaagtagttataataattacagatcagtacggaaatcagattcaagcattttcaccaagttctttatcttctttgtcaattgctggggttggacttgatagctcaaatttgaaaacaacctttcaggaaaacacacagagtataagtgtaagaggcatcaaatttattccaggtcctcctggaaataaggatctttgttttacttggcgtgagttttctgactttattcgagtgcaactaatttctggacctcctgctaaacttctccttatagactggccagaactaaaggagtccattccagtgattaatggaagagatttacagaaccctattattgttcaactttgtgatcagtgggataatccagcaccggtacaacatgttaaaataagtcttacaaaagctagcaatttaaagctcatgccttcaaaccaacagcataaaacagatgagaaaggcagggctaatttgggagtattcagtgtttttgcccctaggggagagcatactcttcaggttaaagccatctataacaaaagtatcatagaaggacctataattaagttaatgattcttccagacccagaaaaacccgttcgtctcaatgttaaatatgacaaagatgcatccttcttagcagggggtcttttcactgattttatgattagtgttatttctgaagatgacagtatcattaaaaacattaatccagcacgtatttccatgaaaatgtggaagctgtctaccagtgggaaccgacccccagcaaatgcagaaacatttagttgtaataaaataaaagataatgacaaagaagatggctgcttctatttcagggataaagtaattcctaataaagtggggacatattgtatccagtttggttttatgatggataaaacaaatattctcaacagtgaacaggttatagttgaagtcctgcctaatcaacctgtgaagttagtacctaaaattaaaccacctacaccagctgtttcaaatgttcgctcagttgccagtaggaccttggtcagagatctacatcttagtatcacggatgactacgacaaccatactggaattgatttggttggcactataatagccaccattaaaggctctaatgaggaagatactgataccccactttttattgggaaagttagaacacttgaattccccttcgtgaatggttcggctgaaatcatgagtctggtgctggcagaaagtagtcctggaagggatagtactgaatattttattgtatttgagccccggctaccacttttatcaagaaccttagaaccatatatcctaccgttcatgttttacaatgatgttaagaagcagcaacaaatggcagcacttacaaaagaaaaggaccaattatctcagtctattgttatgtataaaagtttatttgaagccagccaacagcttcttaatgaaatgaaatgtcaagttgaagaagcaagattaaaagaggcccaattgcgaaatgaactaaaaatacataatattgacattcctacaacacaacaggtgccacacattgaagcacttctgaaaagaaagctatcagaacaagaagaactgaagaaaaaacctagaagatcgtgtactcttccaaactatactaaaggcagtggagatgttttgggaaagattgcacatctagcacaaattgaagatgatagagctgcgatggttatttcttggcatctggcaagtgacatggactgtgtagtcaccctaaccactgacgctgcacgtcgtatctatgatgaaacccaaggtcgtcagcaggtgttgccccttgattctatttacaagaagactcttccagattggaaaagatctctacctcatttccgaaatggaaaattgtattttaaacccattggagatccagtctttgctcgagacttgttaacatttccagataatgtagaacattgtgaaacagtatttggtatgctgttaggagacaccattattttggataatctggatgcggccaatcattatagaaaagaggttgttaaaattacacactgtcctacactgctgaccagagatggagatcgaattcgaagtaatggaaagtttgggggccttcagaataaagctcctccaatggataaacttcggggaatggtatttggagctccagttccaaaacagtgtctgatcttaggggaacaaatagtgcatgcctgtgttcccagctactcaggaggctaa

SEQ ID NO: 2266 - DNA, 8672 bp, Homo sapiens
gaatcggttcccgggtgatcctcgcgcctgccgctgctcggccgccgccgctgacgaggagctgcagcgcgccgggccgaggcctcgagccgccccgggagctggagctgaaggcgccgcgcggagcgcgcacctcagccctgagcccggcggcggcaggcgtcgctgtcttttctccttttccccaatatggcagcggcggacggcggcgggcctggtggggcctctgtggggactgaggaggatggcggaggcgtcggccacaggacggtgtacttgtttgatcggcgcgaaaaggagtccgagctcggggaccggcctctgcaggtcggggagcgctcggactacgcgggatttcgcgcgtgtgtgtgtcagacacttggcatttcacctgaagaaaaatttgttattacaacaacaagtaggaaagaaattacctgtgataattttgatgaaactgttaaagatggagtcaccttatacctgctacagtcggtcaatcagttactactgacagctacgaaagaacgaattgacttcttacctcactatgacacactggttaaaagtggcatgtatgaatattatgccagtgaaggacaaaatcctttgccatttgctcttgcggaattaattgacaattcattgtctgctacttctcgtaacattggggttagaagaatacagatcaaattgctttttgatgaaacacaaggaaaacctgctgttgcagtgatagataatggaagaggaatgacctctaaacagcttaacaactgggccgtgtataggttgtcaaaattcacaaggcaaggtgactttgaaagtgatcattcaggatatgttcgtccagtaccagtgccacgcagtttaaatagtgatatttcctattttggtgttgggggcaagcaagctgtcttctttgttggacaatcagccagaatgataagcaaacctgcagattcccaagatgttcacgagcttgtgctttctaaagaagattttgagaagaaggagaaaaataaagaggcaatatatagtggatatattagaaacagaaagccctctgattctgttcacattacaaatgatgatgaaagatttctacatcatcttatcatagaggagaaggaaaaagatagctttactgctgtggttatcacaggggtacaaccagaacacatacagtacttgaaaaattatttccacctttggacacgacagttagcgcatatttatcactactatattcatggcccaaaaggaaatgaaatacgaacatcaaaagaagttgaacctttcaacaatattgatattgaaatttctatgtttgaaaaagggaaggtacctaagattgtcaacctaagggaaatacaagacgacatgcagacgttgtatgtaaacacagcagctgatagttttgaattcaaagctcatgttgaaggagatggtgtagtggaagggattatccgttatcatccattcttatatgatagagaaacttaccctgatgatccatgctttccatcaaaattaaaagatgaagatgatgaagatgattgtttcatacttgagaaagcagctagagggaaaaggcctatttttgaatgtttttggaatggacgattaataccatatacatcagttgaagactttgactggtgtactcctcctaagaagagagggcttgcaccaattgaatgctacaataggatatctggtgcattattcactaatgacaaattccaggtcagcacaaataaattgacgtttatggatcttgagctaaaattgaaagataagaacaccctttttacaaggattttaaatggacaggaacagcgaatgaaaattgacagagaatttgctttgtggctgaaggactgtcatgagaagtatgataaacaaataaaatttacactttttaagggagtaattacacgtcctgatcttccttctaaaaagcaaggtccctgggcaacatatgcagcaatagaatgggatggaaagatatacaaagcaggacagctggtcaagacaatcaagacacttcccctcttttatggaagcatagtaagattttttctttatggcgatcatgatggagaagtatatgctacaggaggagaggttcaaattgcaatggaacctcaggcactatatgatgaagtaagaactgtgccaattgcaaagctggataggacagttgctgagaaagctgttaaaaaatatgtagaagatgaaatggcaaggctccctgatagattgtcagtaacttggcctgaaggagatgaattattgcctaatgaggttaggcctgctggaacccctattggtgcgttaagaattgaaatactgaataaaaaaggggaagcaatgcaaaagcttccaggaacaagccatggagggtcaaagaaactcctggttgagctcaaagttattttacattcttcaagtggaaataaagagattatttcgcatattagtcaacatggaggaaaatggccttactggtttaaaaaaatggaaaatattcagaagttggggaattataccttgaaattacaagttgtgttgaatgaaagtaatgcagacacttatgcaggaagaccactaccatctaaagcaattaagttttctgttaaagagggtaagccagagaaattttcatttggtcttctggatcttccttttcgtgttggagttccatttaatatccctctggagtttcaggatgaatttggtcataccagtcaactagtaactgatattcagccagttcttgaagcaagtggtttatctttacattatgaagaaataaccaaaggaccaaattgtgtaattcgaggtgttacagccaagggccctgtaaactcttgtcaaggcaagaattataatctgaaggttactctgcctggcttaaaagaagactcacagattttgaaaattagattactacctggtcaccctcgtcgactgaaagtgaaacctgattctgaaattttagttatagaaaatggaacagctttcccatttcaggtggaagttttagatgaatcagacaacataacagcacaaccaaaattgattgttcattgtaagttttcaggtgctccaaaccttccagtctatgttgtagattgcagtagttctggaaccagtattttaacaggatctgcaattcaagttcagaatattaaaaaagaccagacgcttaaagcaagaattgaaatacctagttgtaaagatgtggcacctgtggagaagactattaagttgcttcccagtagccatgttgcaagactacaaatattcagtgtagaaggacaaaaggcaattcagatcaaacatcaggatgaggttaattggatagcgggtgatattatgcataatcttatttttcaaatgtatgatgaaggagaaagagaaatcaatataacatcagctttagcagaaaaaattaaagttaattggactcctgagattaacaaagaacacttgctacagggtctgcttcctgatgtgcaagtaccaacatctgtaaaagatatgcgctattgccaggtttcattccaagatgatcatgtgtctttggaaagtgcgtttacagtaagaccacttcctgatgaacctaaacatttaaaatgtgaaatgaaaggaggaaaaacagtacagatgggccaagagcttcaaggagaagtagttataataattacagatcagtacggaaatcagattcaagcattttcaccaagttctttatcttctttgtcaattgctggggttggacttgatagctcaaatttgaaaacaacctttcaggaaaacacacagagtataagtgtaagaggcatcaaatttattccaggtcctcctggaaataaggatctttgttttacttggcgtgagttttctgactttattcgagtgcaactaatttctggacctcctgctaaacttctccttatagactggccagaactaaaggagtccattccagtgattaatggaagagatttacagaaccctattattgttcaactttgtgatcagtgggataatccagcaccggtacaacatgttaaaataagtcttacaaaagctagcaatttaaagctcatgccttcaaaccaacagcataaaacagatgagaaaggcagggctaatttgggagtattcagtgtttttgcccctaggggagagcatactcttcaggttaaagccatctataacaaaagtatcatagaaggacctataattaagttaatgattcttccagacccagaaaaacccgttcgtctcaatgttaaatatgacaaagatgcatccttcttagcagggggtcttttcactgattttatgattagtgttatttctgaagatgacagtatcattaaaaacattaatccagcacgtatttccatgaaaatgtggaagctgtctaccagtgggaaccgacccccagcaaatgcagaaacatttagttgtaataaaataaaagataatgacaaagaagatggctgcttctatttcagggataaagtaattcctaataaagtggggacatattgtatccagtttggttttatgatggataaaacaaatattctcaacagtgaacaggttatagttgaagtcctgcctaatcaacctgtgaagttagtacctaaaattaaaccacctacaccagctgtttcaaatgttcgctcagttgccagtaggaccttggtcagagatctacatcttagtatcacggatgactacgacaaccatactggaattgatttggttggcactataatagccaccattaaaggctctaatgaggaagatactgataccccactttttattgggaaagttagaacacttgaattccccttcgtgaatggttcggctgaaatcatgagtctggtgctggcagaaagtagtcctggaagggatagtactgaatattttattgtatttgagccccggctaccacttttatcaagaaccttagaaccatatatcctaccgttcatgttttacaatgatgttaagaagcagcaacaaatggcagcacttacaaaagaaaaggaccaattatctcagtctattgttatgtataaaagtttatttgaagccagccaacagcttcttaatgaaatgaaatgtcaagttgaagaagcaagattaaaagaggcccaattgcgaaatgaactaaaaatacataatattgacattcctacaacacaacaggtgccacacattgaagcacttctgaaaagaaagctatcagaacaagaagaactgaagaaaaaacctagaagatcgtgtactcttccaaactatactaaaggcagtggagatgttttgggaaagattgcacatctagcacaaattgaagatgatagagctgcgatggttatttcttggcatctggcaagtgacatggactgtgtagtcaccctaaccactgacgctgcacgtcgtatctatgatgaaacccaaggtcgtcagcaggtgttgccccttgattctatttacaagaagactcttccagattggaaaagatctctacctcatttccgaaatggaaaattgtattttaaacccattggagatccagtctttgctcgagacttgttaacatttccagataatgtagaacattgtgaaacagtatttggtatgctgttaggagacaccattattttggataatctggatgcggccaatcattatagaaaagaggttgttaaaattacacactgtcctacactgctgaccagagatggagatcgaattcgaagtaatggaaagtttgggggccttcagaataaagctcctccaatggataaacttcggggaatggtatttggagctccagttccaaaacagtgtctgatcttaggggaacaaatagatcttcttcagcagtatcgttctgctgtgtgcaaactagacagtgtgaataaggatcttaacagtcaattagagtaccttcgcactccggatatgaggaagaaaaagcaagaacttgatgaacatgagaaaaatctcaaactaatagaggaaaaactaggtatgactcccatacgtaagtgtaatgactcattgcgtcattcaccaaaggttgagacgacagattgtccagttcctcctaaaagaatgagacgagaagctacaagacaaaataggattataaccaaaacagatgtatgagaggtgacagagagaagaggccattggtctcagtaagaatgccctgctttctgcatctctgtttcagaagaccaagagggtgacttaccagactgagtatttctggggacaatacaagtacctgggcatgaatttccatttcgattcagatgggactggaaacaaccattcaattttatgaatcttactggacattatggatttactggaattattccagacattatgccctttggttgtcactaccttgcaaatgtgtaagaggaaaatgtgctaatgtggcagtgactgtaaaactggcacatggcatttattaatcctgaagaaaagtacatgtactatttttcagtataaatataatgaacatgtcagaactatttcttgaaaacctttttattacttttgcgtgaatttatttaacaaagatgttttgtcttttgtgtaagggaggttctagaggctagatgtttaattgtaaatatgtgaggaaactcaatgcagaattcaggataaaaattttaaaagcacaggtatttgggaattgaaatgttaagatacccagaacaacattaaatcaatgagtgaacttgtgacagtggtagcatttcaaatttcaaaagacttatcctgtgtgtgtgtgtgtgtgtatatatatatatatatataaatatatatatataaaatattcagcagcaccaagttttataactattgtttgtttgactttattaatactagaatatgtagtctcagccttaattttacatttacattattttgtaattttttattactatttttaaggggttaaagagaacatacattctcacattagtgtactttctggtagaaagttgctgcaaaaacatttgaaatgtatattaacctaatgtatgtcatatatatgtctttgtgtaagttcaagactattgatctgtgaagttattttgtaaggacatacatttggtaagtaagtttgtgtcccaggaaatgtatgtgtttttaaaccctttctaaatatgcaggccattaataaataagattgtttcttccctactgaatagataagtgtttttcttttttaaaattggaagcttcataaaagttatcttgttaaaaaacgatgatgatgttaacctatctatctttataattggaaattatttaaactgtttgttgttacagaagaaacaaaatggtaattacagaattagctgtggggaagattggctcccatggtactacaggttgagtatcccttattcaaaatggttgggacctgaagtgttttggattttggttttttgtggggtttttaaattattattttggaatatttgcattatatttaccaatttagcatccctaatccaaaaatctttcattagaaattggaaatgcttcaatgagcatttcccttatgtgtcatatctgcgctcaaatgttttgaattttggaacatttcttgtttctgacttttagattagggatactcaccccgtaccaatatttggagtccttagacattagattatatgaaaatgattgattgataggtaagaaaggttaaagagaaatgactttttaggaactagacttgaacgtataattaatatgtggaactagtttgcttttataattcattgtatcaagaaggagtcatgttttaaatccaaggcattgagactatctagaagcaaaaaagttggttttaaaaattctttttattagaagtgtgtttaaaaacatgtctttttttcccttgagcgacagtggcctcactacattgcccaggctagtcttgaactcctgggttcaagcagtcttcctgccttggcctcctaagtagcagggattacaggcatgcacccacatgccaatttttattgcttaaaatggcgagttctatggatattatctagccccaagcccatatctgtacacttttgttcattttataataccagaaagaatgttctatcagtaaaagaaggtttttaagtatgaatctccatttttgtggagtttttctaccctgtaaaaattaactttgtggttcccagtaattacagtaaggagtttttctatattttcacagttggatttatctaaggatatttctcagcatattaaggaatccttttctacatttgagcaaatactgaggttcatgttgtaccaaataataataaattgcttttgtgtttaatatgtaacacgtaagaacaattgaaattttcttctaagatttaatactagtcttttagtataaaggaatgtaactggagaaaaaaattaatgctacagccatttatcctgtgttatgtgttatataatctgaaatttgtcacaatgttacaatcaggaagttttttttctggtttcttcttccaaaggaaaataatagcctacttgtattttgaagtaactgaaataaaactctctccaagcctttttgcacatta

SEQ ID NO: 2267 - DNA, 3507 bp, Homo sapiens
gccccatcacgtgaccgcagccccagcgcggcggggccggcgtctcctggctgccgtcacttccggttctctgtcagtcgcgagcgaacgaccaagagggtgttcgactgctagagccgagcgaagcgatgcctaaatcaaaggaacttgtttcttcaagctcttctggcagtgattctgacagtgaggttgacaaaaagttaaagaggaaaaagcaagttgctccagaaaaacctgtaaagaaacaaaagacaggtgagacttcgagagccctgtcatcttctaaacagagcagcagcagcagagatgataacatgtttcagattgggaaaatgaggtacgttagtgttcgcgattttaaaggcaaagtgctaattgatattagagaatattggatggatcctgaaggtgaaatgaaaccaggaagaaaaggtatttctttaaatccagaacaatggagccagctgaaggaacagatttctgacattgatgatgcagtaagaaaactgtaaaattcgagccatataaataaaacctgtactgttctagttgttttaatctgtctttttacattggcttttgttttctaaatgttctccaagctattgtatgtttggattgcagaagaatttgtaagatgaatacttttttttaatgtgcattattaaaaatattgagtgaagctaattgtcaactttattaaggattactttgtctgcccaccacctagtgtaaaataaaatcaagtaatacaatcttaactgttgtggccttttttgatcataagagttggtactgtttaaggccaaaagtaacagtttttatagatcttttagtttcaactcagcttttacaataaaaaggatttgtattgcattgagtttataaacttttggtttgtgaacttcatatttgatcttttctcttccaatcaaatgtctaggcttgtttgacttccacccccaatggtttttcactctttttatttacttcattttcctttaataacttaatctcttcatgttcagtttttacttcactctttattcttttctttgattatggtatgcttatttggaaagtcagtgaaactgtcaaaatgttatctcaataagatacttatatgagaactacaatcaccgaatctactgtattcaatattagcagatctaatttgataaacaacatggcttgtgtgaaaactgagcaggtgtttgtttacccatagtgttctgtgtagttattgcttagtctgcagaaaataatgacttagatgagatgtctgacttgctttcacttattaaacatgttcaccatgggatgatgtctgtaacatcagatattgttcaactagactaggatttaataaaaattgtgaaagcttactggcctaacattttattttataatattgggtatgaattatatgtagccagagatgtcattaagctttactgttatagtaggtaatatggttagtttgtagggaaaagagcatatgagcacatgcttgtgtattttggcctttgccccagtagaacagaccaatggcattctagacttgatgatactaagttttagcagacactagtaagtggtttgtatttaaccatactgatgaagcagacagattgaggcacagattttagtggctttgtggcaataaatagggcatggtgtgccttaggaaaagaatgtttataaagggaattataactgaaattaaaggaggcggcagtgaagaggaaataattctcttctatctaaatgatatacatatgatattttgagatttttataacagcagtggaacacaattctaggtagagtagaaaaaggaaagttttaaagacatataaaagattcttgttgacaaattatttttggtagcaaatctcaaatggttacctgctattaaggtctgccatattagagttttgcactattttgctaccaagtttgattcatacatctaaaacattttgtagttacttgtcaaggacttaatttgaaaatcatttgccaggccacatagttatcaatttttttttctatcagctattctgttgtatttctaaaacattttttagatgactttttaaagtatatttagcagtaaccttatgaggttcaaattggtaaatctcttgtaatttagccttcatcgaataataggtaccagtgtattaaaaatgtgtattttttgcagccccttgaaccagagtaggttcagagaaactcccaaagtttgtactttagacacatcatgcttgattggtaacttccctccttttttggggaacatgtttgtgtcctattaacttaattggatagatttttaaatatttcttatttttggcacacggaaagggtagttcgagtacagaactttgatttttggtgtagatgcagagggaatgatgggtaaatttcctaggtttatgtgaatttagggggtgtatgcattttgaaacaatctactaacagatggtgctgaaatctattacctacatgttttctagttgttcagcattatgttaatgaagcctccatataaggagtgtttctctggcacagttggtaagttgactgctaacttcatttaaatgtgttactggatatgcagtatactgaaattattaatcagtttgtgtataggaaaagagaactgggttaaaagcaaattaacttgttctgaaaagaaagtatagattaattttgttttctgtttaaattttatctccttggtaaagatttttttttcctgggcagaaaacttggcatttttaggcgtagataccttaccttacaatgccaaaatgaatttaattccagtactcaggtttttccctttaacagactctatgtgtatcagggctttctaatgggtttttcctcttcgtttttaaaatgtgagtagcatttgaccaatttccagtgctcttagcattttacttaaagaacaaccactacaaaagaaaatctttgtaatttgattgtcttttgctttgcttcattaatgcctaagaacttaagaatactcctacctcattagctactcaagatgctgtgacgatcaaatctattctacataatgcgtttagaaacaaagacttgggtgaaaaatgaaataagtatattctgacttggctattgaggggaaaattcagtattaagtgttcctcacaggagatatgttagcagaatactataaaagtttgaaatttttaaaaagtaaaagtacttaaatttaggtatctctcctgaaattctttgcagttcattttttatggcagttaatccagtgaaacactcaaaagtttttttttttttaaaagtgtttttccagataaactgtagggtgaacattcacataatcacaaatatgtaattctgtaattgtggaatgcttgtatgctttgttttcgtacatcttccatggagatgtctgaatataatactccatctgtgaatattttaaatgttgaaataaaagtaagaaatgtg

SEQ ID NO: 2268 - DNA, 562 bp, Homo sapiens
gaccaagagggtgttcgactgctagagccgagcgaagctggtttcagtatcagttacttgaattacaagctgcttctccccccacccccacattggaacaggctcattaaggatgcctaaatcaaaggaacttgtttcttcaagctcttctggcagtgattctgacagtgaggttgacaaaaagttaaagaggaaaaagcaagttgctccagaaaaacctgtaaagaaacaaaagacaggtgagacttcgagagccctgtcatcttctaaacagagcagcagcagcagagatgataacatgtttcagattgggaaaatgaggtacgttagtgttcgcgattttaaaggcaaagtgctaattgatattagagaatattggatggatcctgaaggtgaaatgaaaccaggaagaaaaggtatttctttaaatccagaacaatggagccagctgaaggaacagatttctgacattgatgatgcagtaagaaaactgtaaaattcgagccatataaataaaacctgtactgttctagttgttttaatctgtctttttacattggct

SEQ ID NO: 2269 - DNA, 908 bp, Homo sapiens
aaaacagtcctcttagtgcaccagaagggaccttttggcaagtggcatcttgccagaaaattaactcaaaacaaatccctaacagctcagagatggtggaggggaatttcagaaacagtcagcagggcagggccatgcaactgcttacaggaattgcctcactcacactttgatgttgattctctgcagagcttccgctgcttcaaaacggcgtgcaggagtcagagacattacatcaggaagatactgcagagatattctactccatctcattcattgtacaggatgcctaaatcaaaggaacttgtttcttcaagctcttctggcagtgattctgacagtgaggttgacaaaaagttaaagaggaaaaagcaagttgctccagaaaaacctgtaaagaaacaaaagacaggtgagacttcgagagccctgtcatcttctaaacagagcagcagcagcagagatgataacatgtttcagattgggaaaatgaggtacgttagtgttcgcgattttaaaggcaaagtgctaattgatattagagaatattggatggatcctgaaggtgaaatgaaaccaggaagaaaaggtatttctttaaatccagaacaatggagccagctgaaggaacagatttctgacattgatgatgcagtaagaaaactgtaaaattcgagccatataaataaaacctgtactgttctagttgttttaatctgtctttttacattggcttttgttttctaaatgttctccaagctattgtatgtttggattgcagaagaatttgtaagatgaatacttttttttaatgtgcattattaaaaatattgagtgaagctaattgtcaactttattaaggattactttgtctgcccaccacctagtgtaaaataaaatcaagtaat

SEQ ID NO: 2270 - DNA, 580 bp, Homo sapiens
gttcgactgctagagccgagcgaagcgtgagtgcgcgggaccccctacccctactcctcggggcccccaccctcccagccgggccgtgagctgccttcggccctccactcctctcgccggcaatggccgcgggaaatggcggctctgccttacctcccccttcccctcggcgtccccggcccccttctccgtttctgactccacgcctgacgcgctgtgggcccttccgcggtagactcctgtccccggggagccgagtcgaggcggcgggcgctgcggcccggggcggtagattgagggcggccggggagtgaggagtcgcggggagagagtcgcggcgtccccgggacaatgcggcggcggcctgcctaggctcattaaggatgcctaaatcaaaggaacttgtttcttcaagctcttctggcagtgattctgacagtgaggttgacaaaaagttaaagaggaaaaagcaagttgctccagaaaaacctgtaaagaaacaaaagacaggtgagacttcgagagccctgtcatcttctaaacagagcagcagcagcagagatgataacatgtttcaggt

SEQ ID NO: 2271 - DNA, 684 bp, Homo sapiens
gcagagcttccgctgcttcaaaacggcgtgcaggagtcagagacattacatcaggaagatactgcagagatattctactccatctcattcattgtacagattctaaactccctgaaggagacaaattaccagtggacaagaacacagcctctggagtccaataggcctggtgcattcattagggatgcctaaatcaaaggaacttgtttcttcaagctcttctggcagtgattctgacagtgaggttgacaaaaagttaaagaggaaaaagcaagttgctccagaaaaacctgtaaagaaacaaaagacaggtgagacttcgagagccctgtcatcttctaaacagagcagcagcagcagagatgataacatgtttcagattgggaaaatgaggtacgttagtgttcgcgattttaaaggcaaagtgctaattgatattagagaatattggatggatcctgaaggtgaaatgaaaccaggaagaaaaggtatttctttaaatccagaacaatggagccagctgaaggaacagatttctgacattgatgatgcagtaagaaaactgtaaaattcgagccatataaataaaacctgtactgttctagttgttttaatctgtctttttacattggcttttgttttctaaatgttctccaagctattgtatgtttggattgcagaaga

SEQ ID NO: 2272 - DNA, 771 bp, Homo sapiens
gtcagtcgcgagcgaacgaccaagagggtgttcgactgctagagccgagcgaagccaaaggctgaagatttcgtttctctttttaaagttgcgttttgtataaattctacaatagtggtttcagtatcagttacttgaattacaagctgcttctccccccacccccacattggaacaggctcattaaggatgcctaaatcaaaggaacttgtttcttcaagctcttctggcagtgattctgacagtgaggttgacaaaaagttaaagaggaaaaagcaagttgctccagaaaaacctgtaaagaaacaaaagacaggtgagacttcgagagccctgtcatcttctaaacagagcagcagcagcagagatgataacatgtttcagattgggaaaatgaggtacgttagtgttcgcgattttaaaggcaaagtgctaattgatattagagaatattggatggatcctgaaggtgaaatgaaaccaggaagaaaaggtatttctttaaatccagaacaatggagccagctgaaggaacagatttctgacattgatgatgcagtaagaaaactgtaaaattcgagccatataaataaaacctgtactgttctagttgttttaatctgtctttttacattggcttttgttttctaaatgttctccaagctattgtatgtttggattgcagaagaatttgtaagatgaatacttttttttaatgtgcattattaaaaatattgagtgaagctaattgtcaactttattaaggattac

SEQ ID NO: 2273 - DNA, 1424 bp, Homo sapiens
acttccggttctctgtcagtcgcgagcgaacgaccaagagggtgttcgactgctagagccgagcgaagcgatgcctaaatcaaaggaacttgtttcttcaagctcttctggcagtgattctgacagtgaggttgacaaaaagttaaagaggaaaaagcaagttgctccagaaaaacctgtaaagaaacaaaagacaggtgagacttcgagagccctgtcatcttctaaacagagcagcagcagcagagatgataacatgtttcagattgggaaaatgaggtacgttagtgttcgcgattttaaaggcaaagtgctaattgatattagagaatattggatggatcctgaaggtgaaatgaaaccaggaagaaaaggtatttctttaaatccagaacaatggagccagctgaaggaacagattttagtggctttgtggcaataaatagggcatggtgtgccttaggaaaagaatgtttataaagggaattataactgaaattaaaggaggcggcagtgaagaggaaataattctcttctatctaaatgatatacatatgatattttgagatttttataacagcagtggaacacaattctaggtagagtagaaaaaggaaagttttaaagacatataaaagattcttgttgacaaattatttttggtagcaaatctcaaatggttacctgctattaaggtctgccatattagagttttgcactattttgctaccaagtttgattcatacatctaaaacattttgtagttacttgtcaaggacttaatttgaaaatcatttgccaggccacatagttatcaatttttttttctatcagctattctgttgtatttctaaaacattttttagatgactttttaaagtatatttagcagtaaccttatgaggttcaaattggtaaatctcttgtaatttagccttcatcgaataataggtaccagtgtattaaaaatgtgtattttttgcagccccttgaaccagagtaggttcagagaaactcccaaagtttgtactttagacacatcatgcttgattggtaacttccctccttttttggggaacatgtttgtgtcctattaacttaattggatagatttttaaatatttcttatttttggcacacggaaagggtagttcgagtacagaactttgatttttggtgtagatgcagagggaatgatgggtaaatttcctaggtttatgtgaatttagggggtgtatgcattttgaaacaatctactaacagatggtgctgaaatctattacctacatgttttctagttgttcagcattatgttaatgaagcctccatataaggagtgtttctctggcacagttggtaagttgactgctaacttcatttaaatgtgttactggatatgcagtatactgaaattattaatcagt

SEQ ID NO: 2274 - DNA, 4192 bp, Homo sapiens
gctgcctgccacacgccaggcgccacgcgccgccctcgctctttatccactgagcagcttatccactttaggtcggaaaggaaaggaaagaaaagcaggaaaaaaaaaaaaagtcaggggaacatttttgtcggctgcgcgactcgactacttttgtctcctgcgggccactgttgagccttcacgagacgtcactgtcttcggtcgcggggcatcgtgggtaggagggagatttgctctcactgctcccaaaaatggcggacgcattcggagatgagctgttcagcgtgttcgagggcgactcgaccactgcggcgggaaccaaaaaagacaaggaaaaggacaaggggaaatggaaggggcctccagggtctgcagacaaggcagggaaacgttttgatggtaaattacaatcagaatcaactaataatggaaaaaataagagagatgtagatttcgaaggtacagatgaacccatttttggaaagaagcccaggatagaagagtcaataactgaagacttaagtttggcagacctgatgcccagagtcaaggtacaatcagttgaaactgttgaagggtgtacacatgaggttgcacttcctgcagaagaggattatttaccacttaaaccacgagttggaaaagctgctaaggaatacccgttcattcttgatgcttttcaaagagaggccattcagtgtgttgacaataatcagtctgttctagtatctgcacatacctcagcgggaaaaacagtatgcgccgagtatgccattgcattggccttaagggaaaagcagcgtgtaatatttaccagcccaattaaggctctgagtaaccaaaaataccgtgaaatgtatgaagaatttcaagatgttggtttgatgactggtgatgttactattaatcctacggcatcttgtcttgttatgaccacagagattttgagaagtatgctttacagaggttccgaagttatgagagaagttgcttgggttatatttgatgaaattcattatatgagagattcagaacgtggtgtagtatgggaagaaactattattttgcttcctgataacgtccactatgtctttctttcggctactattccaaatgcccgacagtttgctgaatggatttgccatttacataaacagccttgtcatgttatttacacagattatcggcccactccattgcaacactacatttttccagcagggggagatggcctgcatcttgtggttgatgaaaatggtgacttcagagaagataattttaatactgcaatgcaagtgcttcgagatgcaggtgatttggccaaaggagaccagaaagggcggaaaggaggaacaaaaggaccatcaaatgttttcaaaattgtgaagatgattatggaaagaaatttccaacctgtgattattttcagttttagtaagaaagattgtgaagcctatgcacttcaaatgaccaaattagatttcaacacagatgaagaaaagaagatggttgaagaagtattcagtaatgcaattgattgcttatccgatgaagataaaaaactccctcaggtagaacatgtacttcctcttttgaagaggggaattggtattcaccatggtggtttacttcctattttgaaagaaactatagaaattctcttttctgaaggattgataaaggccttatttgccacggagacctttgctatgggaattaacatgccagctagaactgttttatttacaaatgcccgcaaatttgatgggaaggatttccgatggatttcttctggtgaatacattcagatgtctggtcgtgctggaaggagaggaatggatgatagaggaattgtaattcttatggtagatgaaaagatgagcccaacaattggaaaacaattacttaagggctccgctgatcctctaaatagtgctttccatttgacctacaacatggttttgaacttactacgtgtagaagaaattaatcctgagtacatgttggaaaaatccttctaccagtttcagcattatagagcaattccaggagtagtagagaaggtaaagaattcagaagaacagtataataaaatagtaattcccaatgaagaaagtgtggttatctattataagattagacagcagcttgccaaattgggtaaagaaattgaagaatatattcacaaaccaaaatactgcttaccttttctacaaccaggtcgtttggtaaaggtaaagaatgaaggagatgactttggctggggagtagtggtgaatttctcaaaaaagtcaaatgttaagcctaactctggtgaactggatcctttgtatgtagtagaagtacttctgcgctgtagcaaagagagcttgaaaaattcagctacagaagctgcaaaaccagctaaacctgatgagaaaggagagatgcaggttgtcccagttttggtgcatctcctgtctgctatcagcagtgttaggctttacattcctaaagaccttcggccggtggacaatagacagagtgttttaaaatcaatacaggaagttcagaaacgttttcctgacggcatccccttattagaccctattgatgatatgggcattcaagatcaagggctgaaaaaagtcattcagaaagtagaagcttttgagcatcgaatgtattctcatccacttcacaatgatccaaatttggaaactgtgtatacgctttgtgaaaaaaaagcacagattgcaatagatattaaatctgcaaagcgagaactgaagaaagcaagaacagtcctacaaatggatgaactcaaatgtcgcaaacgtgttttaagaaggttgggatttgctacttcttctgatgtaatagagatgaaaggacgagtggcttgtgagataagcagtgctgatgagctccttctaactgagatgatgtttaatggccttttcaatgacctttctgcagaacaggcaacagcattattaagctgctttgtgtttcaagagaattctagtgagatgcccaaattaacagaacaattagcaggaccacttcgtcaaatgcaggaatgtgctaaaagaattgcaaaagtttcagcagaagccaaattggaaattgatgaggaaacttatctaagctcatttaaacctcacttaatggatgtagtatatacctgggcaactggagctacatttgcccatatctgcaaaatgacagatgtctttgaaggcagcataattcgttgtatgaggcgcctggaagaattgcttcgacaaatgtgtcaagcagcaaaagccattggaaacactgagctggaaaataaatttgcagaaggaatcaccaaaatcaagagagatattgtgtttgctgccagcctctacttgtagagtcagctaaaggaatgtgagattttaaattattgaccacctgtttgattacagttgactacaaatgcctgcaagtgtggatttggttctcccatacattttaatatgtattatatttaaatcaaacatcattcatagaaagcatattacatacatgtttatacataagcattacatttttttaataaaaatgtatacaggtggggcactgttttggtggaaggcttggagtttttttaatgagtttagagctattagataaccactgagttaaaggtaactatgtacacacaaagtgtgcatccaagaggcatagcagcagcagaagtctttaaaggcttgtacaccaggaagaaagatgcatcctcttgccttgtggcaatcattttcctttagaaaacaggccagcttcacctgggcaccctgctgcctttcaaggctggtgattgctcggatagtgattcccagttgttggtgtttcatgcagagttgtatgagagtcctcctcttttctttctttaaaagaagttctttctttgaagaaatccgatacatatacagcctacagtgcaaaatatttaatggtataatttagatcaagttaaaaactacatacaaagttgtgatcaacagcatcctaagataaatataaacaaaaggatatactttgaggtgtacagattaagcatataaaaaattagagactaactgggattttttaaagattattccaaattaagagttgctttgttatgccttcagcaaatagcttcattttgccaatactgaataaaagagttatttctaca

SEQ ID NO: 2275 - DNA, 3271 bp, Homo sapiens
actgctcccaaaaatggcggacgcattcggagatgagctgttcagcgtgttcgagggcgactcgaccactgcggcgggaaccaaaaaagacaaggaaaaggacaaggggaaatggaaggggcctccagggtctgcagacaaggcagggttgcacttcctgcagaagaggattatttaccacttaaaccacgagttggaaaagctgctaaggaatacccgttcattcttgatgcttttcaaagagaggccattcagtgtgttgacaataatcagtctgttctagtatctgcacatacctcagcgggaaaaacagtatgcgccgagtatgccattgcattggccttaagggaaaagcagcgtgtaatatttaccagcccaattaaggctctgagtaaccaaaaataccgtgaaatgtatgaagaatttcaagatgttggtttgatgactggtgatgttactattaatcctacggcatcttgtcttgttatgaccacagagattttgagaagtatgctttacagaggttccgaagttatgagagaagttgcttgggttatatttgatgaaattcattatatgagagattcagaacgtggtgtagtatgggaagaaactattattttgcttcctgataacgtccactatgtctttctttcggctactattccaaatgcccgacagtttgctgaatggatttgccatttacataaacagccttgtcatgttatttacacagattatcggcccactccattgcaacactacatttttccagcagggggagatggcctgcatcttgtggttgatgaaaatggtgacttcagagaagataattttaatactgcaatgcaagtgcttcgagatgcaggtgatttggccaaaggagaccagaaagggcggaaaggaggaacaaaaggaccatcaaatgttttcaaaattgtgaagatgattatggaaagaaatttccaacctgtgattattttcagttttagtaagaaagattgtgaagcctatgcacttcaaatgaccaaattagatttcaacacagatgaagaaaagaagatggttgaagaagtattcagtaatgcaattgattgcttatccgatgaagataaaaaactccctcaggtagaacatgtacttcctcttttgaagaggggaattggtattcaccatggtggtttacttcctattttgaaagaaactatagaaattctcttttctgaaggattgataaaggccttatttgccacggagacctttgctatgggaattaacatgccagctagaactgttttatttacaaatgcccgcaaatttgatgggaaggatttccgatggatttcttctggtgaatacattcagatgtctggtcgtgctggaaggagaggaatggatgatagaggaattgtaattcttatggtagatgaaaagatgagcccaacaattggaaaacaattacttaagggctccgctgatcctctaaatagtgctttccatttgacctacaacatggttttgaacttactacgtgtagaagaaattaatcctgagtacatgttggaaaaatccttctaccagtttcagcattatagagcaattccaggagtagtagagaaggtaaagaattcagaagaacagtataataaaatagtaattcccaatgaagaaagtgtggttatctattataagattagacagcagcttgccaaattgggtaaagaaattgaagaatatattcacaaaccaaaatactgcttaccttttctacaaccaggtcgtttggtaaaggtaaagaatgaaggagatgactttggctggggagtagtggtgaatttctcaaaaaagtcaaatgttaagcctaactctggtgaactggatcctttgtatgtagtagaagtacttctgcgctgtagcaaagagagcttgaaaaattcagctacagaagctgcaaaaccagctaaacctgatgagaaaggagagatgcaggttgtcccagttttggtgcatctcctgtctgctatcagcagtgttaggctttacattcctaaagaccttcggccggtggacaatagacagagtgttttaaaatcaatacaggaagttcagaaacgttttcctgacggcatccccttattagaccctattgatgatatgggcattcaagatcaagggctgaaaaaagtcattcagaaagtagaagcttttgagcatcgaatgtattctcatccacttcacaatgatccaaatttggaaactgtgtatacgctttgtgaaaaaaaagcacagattgcaatagatattaaatctgcaaagcgagaactgaagaaagcaagaacagtcctacaaatggatgaactcaaatgtcgcaaacgtgttttaagaaggttgggatttgctacttcttctgatgtaatagagatgaaaggacgagtggcttgtgagataagcagtgctgatgagctccttctaactgagatgatgtttaatggccttttcaatgacctttctgcagaacaggcaacagcattattaagctgctttgtgtttcaagagaattctagtgagatgcccaaattaacagaacaattagcaggaccacttcgtcaaatgcaggaatgtgctaaaagaattgcaaaagtttcagcagaagccaaattggaaattgatgaggaaacttatctaagctcatttaaacctcacttaatggatgtagtatatacctgggcaactggagctacatttgcccatatctgcaaaatgacagatgtctttgaaggcagcataattcgttgtatgaggcgcctggaagaattgcttcgacaaatgtgtcaagcagcaaaagccattggaaacactgagctggaaaataaatttgcagaaggaatcaccaaaatcaagagagatattgtgtttgctgccagcctctacttgtagagtcagctaaaggaatgtgagattttaaattattgaccacctgtttgattacagttgactacaaatgcctgcaagtgtggatttggttctcccatacattttaatatgtattatatttaaatcaaacatcattcatagaaagcatattacatacatgtttatacataagcattacatttttttaataaaaatgtatacaggtggggcactgttttggtggaaggcttggagtttttttaatgagtttagagctattagataaccactgagttaaaggtaactatgtacacacaaagtgtgcatccaagaggcatagcagcagcagaagtcttta

SEQ ID NO: 2276 - DNA, 6187 bp, Homo sapiens
ctttttgtagggagaagggcaggatgtttttaactgaatgtgacctcaggggaatactagagaaaataataaaatttctgaatggggcagcgtggagaaatcctaagagaaatagcataagagcattttggaacacatccaggaaaagataactttcgacacacctgtagacgttcgccaggtaaaggagtgatggaaactctccagttcagatccagtagcttttagggaaggaactacagttgctgacttaagttgaagaagcatctatttaatgtctggtcaaatcctacaagaaacacagaaatctatgattaaaaagctgagcactttgatatactgcaaagggtagagaaggcaggacggtagaaattttctgcaagaaagaatgaatttcaggatttatcactaaataagacaaagtcatttatttagtccccctgacacagcagggcaaactgagttgacatacaagttacctggagaaaaagagagcaattccaggacttcctcttcagcctaaaagaaggtaccagatctgtgcactggggcgatgtggaagagacctgcttattgcccctgatgtaagctccagtaagaaaagacgtcaagtacaagtactaggaaatcactttatacatctgtttataggaatgacctcaggactttgtgttcatgttatagatggatgcagaggctgaagataaaacgctgcgtactcgctctaaaggaaccgaggtgccaatggattcactaatccaggagctcagtgttgcctatgattgctccatggcaaagaagagaacagctgaagatcaggctttgggggttccagtcaacaaaaggaaatccctgctaatgaagccccgacactacagcccaaaagcagactgccaagaagaccgcagtgacaggacagaggacgatggccccttggaaacacatggtcactctaccgcagaggaaatcatgataaaacctatggatgaaagtcttctttcaactgcacaagaaaactccagtaggaaggaagacagatactcttgttatcaagagctcatggtcaagtctttaatgcacttggggaaatttgaaaaaaatgtatctgttcagactgtaagtgaaaatttaaatgacagtggcatccagtctttaaaagcagagagcgatgaagcagacgagtgctttctgattcattctgatgatggaagagacaagattgatgattctcagccacccttctgctcctctgatgacaatgaaagtaactctgaaagtgcagaaaatggctgggacagtggctccaacttctcagaagaaaccaaaccacctagagtcccaaagtatgttttaacagatcataaaaaagacctattggaagttcctgaaataaaaactgaaggtgacaaatttatcccttgtgagaacaggtgtgattctgaaacagaaaggaaagacccgcagaatgctctcgcagaacccctggatggcaatgcccagccctcattccctgacgttgaggaggaagatagcgagagcctggcagtaatgacggaagagggtagtgacctggaaaaggccaaggggaatttaagtttgctggagcaggcaattgctctgcaggctgagcgaggttgtgttttccataacacctacaaagagctggataggttcctgctggagcacctagcaggggaaaggaggcaaaccaaagttatcgacatgggtggaagacaaatctttaacaataaacattcaccaaggcctgaaaagagggagaccaagtgcccgatccctggatgtgatggcacgggacacgtgacagggctctacccgcaccaccgcagcctttcggggtgcccccacaaagtgcgggttcccctggaaattcttgccatgcatgaaaatgtgctcaagtgtcccacgccgggatgcacaggaaggggtcatgtgaacagcaaccgcaacacccacaggagtctttctggttgtccaattgctgcagctgaaaaattggcaatgtcccaggataaaaatcagcttgattctccccaaactgggcagtgtcctgaccaggcccacaggacaagtttggtgaagcaaattgaattcaatttcccgtcacaagccatcacctctcccagagccacagtgtcaaaagaacaagagaagtttggaaaagtaccatttgattatgccagttttgatgcccaagttttcggtaaacgccctctcatacaaacagtgcaaggacgaaaaacaccaccatttcctgaatcaaagcattttccaaatccagtgaaatttcctaatcgactgcctagtgcaggcgcccacacccagagccctggccgtgccagctcttatagctacggtcaatgtagtgaagacacccacatagcagcagctgctgccatcctgaacctttccacccgctgcagggaagccacagacatcctctccaacaagccacagagtctgcatgccaagggagccgaaatagaagtggatgaaaatggcacattggacttaagcatgaaaaaaaatcgaatcctggacaagtctgcacccctaacttcctctaacacttctattccaactccttcctcttccccattcaaaacaagcagcattctggtcaatgcagcattctatcaggctctttgtgaccaagagggctgggacactcctatcaactatagcaaaactcacgggaagacagaggaggagaaagagaaagacccagtgagctctctagaaaatttagaggaaaaaaagtttcctggagaggcctctataccaagccctaaacccaagcttcatgcaagagatctcaaaaaggaactaatcacctgtccaacaccaggatgtgatggaagtggccacgtgacaggaaactatgcatctcatcgcagtgtttctggatgtcctttagcagataagactctaaaatccctcatggctgccaactctcaggagcttaagtgtccaaccccaggctgcgatggctcggggcacgtgactggaaactatgcttcccacagaagcttgtccggatgccctcgtgcaaggaaaggtggtgtcaaaatgacccctaccaaggaagaaaaagaagaccctgaactgaaatgtcctgtgatagggtgtgatggccaaggtcacatatcaggtaaatacacatcacaccgcacagcttctggctgtcctctggctgccaagagacagaaggagaatcctctcaatggagcctccctctcctggaaactgaacaaacaagagctaccacattgtcccttgccaggctgcaatgggctgggccatgtaaataatgtttttgtcacccaccgaagcttatctggatgtcctctcaatgcacaagttatcaaaaagggcaaggtttctgaagaactcatgaccatcaagctcaaagcaactgggggaatagagagtgatgaagaaattaggcatttggatgaagaaataaaggaactgaatgaatccaaccttaaaattgaagcagatatgatgaaacttcagacccagatcacatctatggagagcaacttaaagacgatagaggaggagaacaaactcatagaacagaacaatgaaagtctgctgaaagagctggcaggtctaagccaagctctcatttcaagccttgctgacatccagcttccacagatgggacctatcagtgagcagaattttgaagcatatgtaaatacactcacagatatgtacagcaatctggaacgggactattccccggaatgcaaagctctactggaaagtatcaaacaggcagtgaagggtatccatgtgtaggatcacagcgctgccgggcaacagaagttaccaacagcagtaaactccagatggatctgttagaggttcatgtactgctaaggcgtggaggttgccgtactgcatttacaatttgcaacattgcactaattttattttccccagctgatataaaaaggaaagaaaaactatgatagacttcttggattaaaagcaatgcagtcaattattagatcttatttattttcatatgtttttcttttatttcttcattgtactctttttttttttgtaaagtatatgtaaaataaatgtgacatttttataatttatttattactaatcaaagagttttttatcttttaactgcattttgaagtctgccgtatttttacaagtgtgtttattaatttattttccaataggatttaaatagaaatgctattctcaagtcatctttcttgctgggttttaatgaggaaacaggaaagggtgaaggaaatccttgtctaaggactgcactatagttgagtttgatttttattgcacacttcttcccccacctttcactgatttttgtatttataaatgaatttgcggtaaggtgagctgcacggaaggaataagaagacaaatggcgcccactagtggggaatccgcactcacaaaagcacaggatgctggaaaacagcctgctcagaatttgttagcaataattaaatatagcaatcagcaaagtattcgacttggctggacggttttcgttaatatgaattatttatttgaaatgttttaaagaaacataagcctttttagtgatgcagatttgtctgtttgtttttcaagtcatatcagatcgttggcaactcgtatcccaagatgaaaaataagacttggtgtgaccagccaggctttcctgccatatgttggtacaatatacaagtgacaatattggtgtagatttgtacttagcaaatacaaacacatccaaatgaaaaattttgtagataccatatcccctgaaatagcatttatcttactgggttgactggaaaggaatggaaaatatagtaacacatgaaaaaatgctactccaatctgaatgattacttcaaacactggcaccttgggtctcacccaccataggaaacaagacaacattcaatttgatagaaatcttgccacaaaacttcaaatgctacaaaatatacacacacactcacacacacaggcatactcacacacagacacacacacacacacacacacagactcatccacacttcaaattgagcccacaatcttgaatttctgaacggatcagagtttcatagtttctatagtaaaggcaatgtctatttcagggattgtaaagtagttaagcattgtttcaaaagtttttttatatttattttttttaaggaaaaggtatagacaaccagctaaactgcctttttggtgtgcacacacatttcatgtgcagacgtgcctctgtgtaaatgtacacatgaacttcatgtgggcttaattttctgtgctataaacaaaagtgtttattttttattaacctcatggatatttagatggaaagtgatggcattcacaggcttgatgtattccactgttattactgttacctgcacaaatgaaaaacaatactcaacagtaattccactcccatgaaactttggtcattgttatgcattaagtggggcttatctttggtttggagttcatttgaactcttgaaccttagtttagtgaagatgaactgtctgttcttaggtagaaacggtgtttatttaaaaatcagttttaaaaaatgagctaccatatgtgctgtctattataaatgggacaccaaacaaaattttctattacagttgtgtacttgcaaacattttgctatacagtacttcatagatgcatacaaatgagctcacttattacaaagacaaacgtttaatttgctaaatattttaacaagtttgttatatattttatttaatttaaaagaaatctcttaccaacctacatatttattactataatttgctatgacttcaggttaatttatttgtgtttgcatagtttgagcaggatgttttgtgaagtatgtttgtatttatttgcctactttgtacttgatgtgttttgtaatgtgcactgaatttgttttcttttcaactatgttaatgatcaatactgtaaattgggtcttttgtaaacaaaaaggcaatgatgtatgcattttttttaatttgaggtagtttgtttgtatactgtttctccaaacacttaatatttcttacatcaaagcaacaaaattgtgttcagtgctgtacatttggtgtatggtaggaaataaaaattgataacg

SEQ ID NO: 2277 - DNA, 2579 bp, Homo sapiens
ggtaaataacacagagcaaagttagcaagttgcagcgcctctgcgttctgattctatggaacctttttgtagggagaagggcaggatgtttttaactgaatgtgacctcaggggaatactagagaaaataataaaatttctgaatggggcagcgtggagaaatcctaagagaaatagcataagagcattttggaacacatccaggaaaagataactttcgacacacctgtagacgttcgccaggtaaaggagtgatggaaactctccagttcagatccagtagcttttagggaaggaactacagttgctgacttaagttgaagaagcatctatttaatgtctggtcaaatcctacaagaaacacagaaatctatgattaaaaagctgagcactttgatatactgcaaagggtagagaaggcaggacggtagaaattttctgcaagaaagaatgaatttcaggatttatcactaaataagacaaagtcatttatttagtccccctgacacagcagggcaaactgagttgacatacaagttacctggagaaaaagagagcaattccaggacttcctcttcagcctaaaagaaggtaccagatctgtgcactggggcgatgtggaagagacctgcttattgcccctgatgtaagctccagtaagaaaagacgtcaagtacaagtactaggaaatcactttatacatctgtttataggtttatggatgcagaggctgaagataaaacgctgcgtactcgctctaaaggaaccgaggtgccaatggattcactaatccaggagctcagtgttgcctatgattgctccatggcaaagaagagaacagctgaagatcaggctttgggggttccagtcaacaaaaggaaatccctgctaatgaagccccgacactacagcccaaaagcagactgccaagaagaccgcagtgacaggacagaggacgatggccccttggaaacacatggtcactctaccgcagaggaaatcatgataaaacctatggatgaaagtcttctttcaactgcacaagaaaactccagtaggaaggaagacagatactcttgttatcaagagctcatggtcaagtctttaatgcacttggggaaatttgaaaaaaatgtatctgttcagactgtaagtgaaaatttaaatgacagtggcatccagtctttaaaagcagagagcgatgaagcagacgagtgctttctgattcattctgatgatggaagagacaagattgatgattctcagccacccttctgctcctctgatgacaatgaaagtaactctgaaagtgcagaaaatggctgggacagtggctccaacttctcagaagaaaccaaaccacctagagtcccaaagtatgttttaacagatcataaaaaagacctattggaagttcctgaaataaaaactgaaggtgacaaatttatcccttgtgagaacaggtgtgattctgaaacagaaaggaaagacccgcagaatgctctcgcagaacccctggatggcaatgcccagccctcattccctgacgttgaggaggaagatagcgagagcctggcagtaatgacggaagagggtagtgacctggaaaaggccaaggggaatttaagtttgctggagcaggcaattgctctgcaggctgagcgaggttgtgttttccataacacctacaaagagctggataggttcctgctggagcacctagcaggggaaaggaggcaaaccaaagttatcgacatgggtggaagacaaatctttaacaataaacattcaccaaggcctgaaaagagggagaccaagtgcccgatccctggatgtgatggcacgggacacgtgacagggctctacccgcaccaccgcagcctttcggggtgcccccacaaagtgcgggttcccctggaaattcttgccatgcatgaaaatgtgctcaagtgtcccacgccgggatgcacaggaaggggtcatgtgaacagcaaccgcaacacccacaggagtctttctggttgtccaattgctgcagctgaaaaattggcaatgtcccaggataaaaatcagcttgattctccccaaactgggcagtgtcctgaccaggcccacaggacaagtttggtgaagcaaattgaattcaatttcccgtcacaagccatcacctctcccagagccacagtgtcaaaagaacaagagaagtttggaaaagtaccatttgattatgccagttttgatgcccaagttttcggtaaacgccctctcatacaaacagtgcaaggacgaaaaacaccaccatttcctgaatcaaagcattttccaaatccagtgaaatttcctaatcgactgcctagtgcaggcgcccacacccagagccctggccgtgccagctcttatagctacggtcaatgtagtgaagacacccacatagcagcagctgctgccatcctgaacctttccacccgctgcagggaagccacagacatcctctccaacaagccacagagtctgcatgccaagggagccgaaatagaagtggatgaaaatggcacattggacttaagcatgaaaaaaaa

SEQ ID NO: 2278 - DNA, 629 bp, Homo sapiens
agaggatgtttagttcaagagaggatgatattgttacaagacattcagagcccccaattttgtgagtgtccctgaagcattgtgacaattccattttatgtgtctgcgtgctcatatcaagactaaggagtgatggaaactctccagttcagatccagtagcttttagggaaggaactacagttgctgacttaagttgaagaagcatctatttaatgtctggtcaaatcctacaagaaacacagaaatctatgattaaaaagctgagcactttgatatactgcaaagggtagagaaggcaggacggtagaaattttctgcaagaaagaatgaatttcaggatttatcactaaataagacaaagtcatttatttagtccccctgacacagcagggcaaactgagttgacatacaagttacctggagaaaaagagagcaattccaggacttcctcttcagcctaaaagaaggtaccagatctgtgcactggggcgatgtggaagagacctgcttattgcccctgatgtaagctccagtaagaaaagacgtcaagtacaagtactaggaaatcactttatacatctgtttatagatggatgcagaggctgaagataaaacgctgcgtactcg

SEQ ID NO: 2279 - DNA, 4731 bp, Homo sapiens
gcggagacggggaaggggtcgccgtggctgccggtcctcgagttgggggctgccgcggacactgctaggcagacggcgagtaccgagcgcgggtggccgcggtgtccgtgggccacgctcagctgcggtcagaggcgacatgagtgccgcggggctgctggccccggccccggcccaggctggagcgccgccggcccccgagtactaccccgaggaggatgaagagctggagagcgccgaggacgacgagcgcagctgtcggggccgcgagtcggacgaagacactgaggatgctagtgaaactgacctggcaaagcatgatgaagaagactatgtagaaatgaaggaacagatgtatcaggacaaactggcttctctcaagaggcagttgcaacaactgcaagaaggtacattacaggaatatcagaagagaatgaaaaaactagatcagcagtacaaagagaggatacggaatgcagacacactgttactgcaagctcagactgaacaagtggaacgaaattacattaaagaaaagaaggcagcagtgaaagaatttgaagacaagaaggttgagctgaaagagaacctgattgctgagctagaagaaaagaagaaaatgattgaaaatgaaaagctgacaatggaactgactggagattctatggaggtgaaacctatcatgaccagaaagttgcggaggcgaccaaatgatcccgtccccatcccagacaagaggaggaaacctgctccagcccagctaaactatttgttaacagatgaacagatcatggaggatctgagaacattaaataagcttaagtcacccaagagaccagcatctccatcctctcctgagcacttgcctgcaacacccgcggaatctccagcccagaggttcgaagctcggatagaagatggcaaactgtactatgacaaaagatggtaccacaagagccaggccatctatctggagtcaaaggacaaccagaaactgagctgcgtgatcagttctgtaggagccaatgagatctgggtgaggaagacaagtgacagcaccaagatgaggatctacctgggccagcttcagcgcgggctcttcgtgatccgccggcgctcagctgcttgactttctacagtgctcttctcttgaccctttttctggagtgggttttatttttgttttgtttcgttttctccttaatagaaaaatgttaacttactgggaatagctactcagccttggaaatggagagcactgcagtgaattctttagggcacttttgtggccggatgcttccaactttgtcagtcttttctgcctcaacttcttccagacatcagtcaccatgagactgttttactttcaggcgtattggggggtttgatttactttccttttatttctttattttttgcttatacttgtttttgaaaacctcctctgagtttgaagggacagctatttttattgattatctttaagtctctctaccatggagaagagcaggaagggatacactctccagtgcattttcatgttttgaatctgattagtggatcacgtagctactttccctgtcgcgtccaattcactatttgcccagaagcttggggcagaggtcctagcaggagatgatgaattctcgtggctctcggccttctcagagaaataaatgctttgtgtaacatctgtgcacaccatccattccgctcgctgagcgatggaaaagcttgcctggaagactatgtgcactgaagtaaatggggttgggggaggggacatttcatatttataatgtgctgaaggtaccatattttaaatgttatttaatgcaggtgatttattcaaacatttgttctagcttaagctggaataagcagtggtcatttcagaagttttcatttgtaattccttcctctcccttgttcccaagtaggtagtagtaagtatgtgccacaggctgattatctgggtaatcttttacgggtgggaggtgagattgatagtgcaataatcagtgatctatagaccctcatgcacgattcaagtttcactcttgtggctgatgccattattgcacattggccattccaaacctgtggagaactttgttgtcaggccctgagcgctcacagcttcatttggcccaggttgaagacaaggaaagctctgctgtggctgcctctggactgacaccctccctaatgagtcctgatgaaacagcctttcctacatccttccctcactcccatgattggagaaatgattcattgggtgatgagtgttggggttttctatactcatgttgccatcttgagatgttcaaaaaatttggggttagagcaactgttagcgtctctatgagcaatcagtagaacttacacatcctaggaaatctttctttgtaagtaattcttttggtctcaagtgattctcttcatgttgtctcttgatgtacatacccccaagcaagttggggggactgtgatgacaattaaatcaccttctctgaagttctggctctgcagagaccaaaccttactgacttgtacagacttgtacaagtaaagacttatacagatagatttttgttttaacttacaatccgttttttcctcttttttttttttttttctggtgttggagtcttatttagaaaacaggataaatgacgctgttatcaaaagttgcctggggttctgtatttcttctctgccctccaatccccgactgctatgatgtttactacagtgaacccagcccatggtaaacacaggcttcacctgttcttgtttgttagccttgactgtgaggcaggacttccctcgcttgaactgttacacatacgatgtgtgtgtcacatcacatattgtgcagctgttggttttcatgtagtgccctgcgatggaaattagatatatttcatgtatttttccattgaaggtggagtttttcaatgatcatgtgttttgtcctcctaaacagtataccaaagtttgtttttatagttgaggattgtattgataaccactggggttccgcattgaagcaggaacaaattgcctctttttctggccttctctgtgggacctctgcttttgtgaagcaactatttatttgaagaccagggtatgggcacttttgccttctctcctctctgacttttgagggtattgagggcgcccttagtcatagtctcgactccgccattgccttctcctcggcgtcctcacaactcttaattgggcctagtgaaaatgggggcaggtgagaagtccattttgagaatcagcatagtaaattacatttctaatcccagaggacttaatattttcttttgtcaccccagaggtgaaaaatcagcagttgaagcctgacaggcctcagtggtgaccaggaacagaagcagccttcctgttagtagatgggggtacttctgtggtgggcagaagccttactaaaggggaagacagactttgaagtttctagacgagaaggaggctagcttctagcctgggtggccattattccaaaaggtcattgtttctcactagaccccagggcaccagatgaatttccaagtttaaactctttcctgcaggtgattactttgaaaaaggttggtccagaccattttgatcaagaacctgtatatgtgttgtgttagaggcatctgcctcaagtctatgtacagtgtttgctgcgggtgtgttccaatattcattttacctctgcttgggggttttgtgtgttcccctccccccatgccctgcctacccccttttccctgaaccacgtccttttgaataatttccagatggatttctgtagccataccaaagccagggtgttttcattcatgcggatactagtatttatagatgtctgactacctaacttaatttttgtttttgaacttctaattggggccagtgtaaggtcgatcccagaggctgatctgcaaatcaagctacatgtatttgtgtataagaccctgtgttcaggactgggtgacttttctaagaaatatggggtttagaatggggttgactgtattttttaacctaattctggagagaagattgtattttttacagttttttgggtttggcttccttctcacatttctttagctttgaatttttactaaataaatttcctcctgattaattttttttttctcatctgggaatttgaaatctcggtgcttactgttacaccaatttgtccaaagagttgaaatcactttaatgccagaacatggtaaatttgcagccatttcaagcaggtgatggtctttttttataacatcgttaacgggtaccattaaatattctgagaggtgaatgtaaaatataaaaggtataggtttttttttttttttaaagaaaacaataaactttcaaagagaaaaccagcatgaagtctgtattgtatccattgacttgataagtgatagaaatttattttaggtttttgatccattgcttatggggaaaggaagttagggcagaggaagggatattctagacatttaattcttagtgaagactaagatacagaatgatgtcaggctaatactcagttttgtaaagagcaatctggggtgttgacccttaaatgtttgtgcactcttcttgttgcagataaaagtcattaaaaatcaagtgaatagaatggatcttgggtggaaaaacaatcttgaaataaacttgtgattgaggata

SEQ ID NO: 2280 - DNA, 4897 bp, Homo sapiens
ggattttaagacggcgatgaaagggctgaggttgtggcgacgggggcgtccagcggcatctccactcccccaaggatggcggaatcaggccgttgtcgggcagctctcgacccggaagtcgctcgcggcgcgaggcccccgttgccgagcgcgggcgcggggggcggagctcggcggagacggggaaggggtcgccgtggctgccggtcctcgagttgggggctgccgcggacactgctaggcagacggcgagtaccgagcgcgggtggccgcggtgtccgtgggccacgctcagctgcggtcagaggcgacatgagtgccgcggggctgctggccccggccccggcccaggctggagcgccgccggcccccgagtactaccccgaggaggatgaagagctggagagcgccgaggacgacgagcgcagctgtcggggccgcgagtcggacgaagacactgaggatgctagtgaaactgacctggcaaagcatgatgaagaagactatgtagaaatgaaggaacagatgtatcaggacaaactggcttctctcaagaggcagttgcaacaactgcaagaaggtacattacaggaatatcagaagagaatgaaaaaactagatcagcagtacaaagagaggatacggaatgcagaactcttcctccagctggaaactgaacaagtggaacgaaattacattaaagaaaagaaggcagcagtgaaagaatttgaagacaagaaggttgagctgaaagagaacctgattgctgagctagaagaaaagaagaaaatgattgaaaatgaaaagctgacaatggaactgactggagattctatggaggtgaaacctatcatgaccagaaagttgcggaggcgaccaaatgatcccgtccccatcccagacaagaggaggaaacctgctccagcccagctaaactatttgttaacagatgaacagatcatggaggatctgagaacattaaataagcttaagtcacccaagagaccagcatctccatcctctcctgagcacttgcctgcaacacccgcggaatctccagcccagaggttcgaagctcggatagaagatggcaaactgtactatgacaaaagatggtaccacaagagccaggccatctatctggagtcaaaggacaaccagaaactgagctgcgtgatcagttctgtaggagccaatgagatctgggtgaggaagacaagtgacagcaccaagatgaggatctacctgggccagcttcagcgcgggctcttcgtgatccgccggcgctcagctgcttgactttctacagtgctcttctcttgaccctttttctggagtgggttttatttttgttttgtttcgttttctccttaatagaaaaatgttaacttactgggaatagctactcagccttggaaatggagagcactgcagtgaattctttagggcacttttgtggccggatgcttccaactttgtcagtcttttctgcctcaacttcttccagacatcagtcaccatgagactgttttactttcaggcgtattggggggtttgatttactttccttttatttctttattttttgcttatacttgtttttgaaaacctcctctgagtttgaagggacagctatttttattgattatctttaagtctctctaccatggagaagagcaggaagggatacactctccagtgcattttcatgttttgaatctgattagtggatcacgtagctactttccctgtcgcgtccaattcactatttgcccagaagcttggggcagaggtcctagcaggagatgatgaattctcgtggctctcggccttctcagagaaataaatgctttgtgtaacatctgtgcacaccatccattccgctcgctgagcgatggaaaagcttgcctggaagactatgtgcactgaagtaaatggggttgggggaggggacatttcatatttataatgtgctgaaggtaccatattttaaatgttatttaatgcaggtgatttattcaaacatttgttctagcttaagctggaataagcagtggtcatttcagaagttttcatttgtaattccttcctctcccttgttcccaagtaggtagtagtaagtatgtgccacaggctgattatctgggtaatcttttacgggtgggaggtgagattgatagtgcaataatcagtgatctatagaccctcatgcacgattcaagtttcactcttgtggctgatgccattattgcacattggccattccaaacctgtggagaactttgttgtcaggccctgagcgctcacagcttcatttggcccaggttgaagacaaggaaagctctgctgtggctgcctctggactgacaccctccctaatgagtcctgatgaaacagcctttcctacatccttccctcactcccatgattggagaaatgattcattgggtgatgagtgttggggttttctatactcatgttgccatcttgagatgttcaaaaaatttggggttagagcaactgttagcgtctctatgagcaatcagtagaacttacacatcctaggaaatctttctttgtaagtaattcttttggtctcaagtgattctcttcatgttgtctcttgatgtacatacccccaagcaagttggggggactgtgatgacaattaaatcaccttctctgaagttctggctctgcagagaccaaaccttactgacttgtacagacttgtacaagtaaagacttatacagatagatttttgttttaacttacaatccgttttttcctcttttttttttttttttctggtgttggagtcttatttagaaaacaggataaatgacgctgttatcaaaagttgcctggggttctgtatttcttctctgccctccaatccccgactgctatgatgtttactacagtgaacccagcccatggtaaacacaggcttcacctgttcttgtttgttagccttgactgtgaggcaggacttccctcgcttgaactgttacacatacgatgtgtgtgtcacatcacatattgtgcagctgttggttttcatgtagtgccctgcgatggaaattagatatatttcatgtatttttccattgaaggtggagtttttcaatgatcatgtgttttgtcctcctaaacagtataccaaagtttgtttttatagttgaggattgtattgataaccactggggttccgcattgaagcaggaacaaattgcctctttttctggccttctctgtgggacctctgcttttgtgaagcaactatttatttgaagaccagggtatgggcacttttgccttctctcctctctgacttttgagggtattgagggcgcccttagtcatagtctcgactccgccattgccttctcctcggcgtcctcacaactcttaattgggcctagtgaaaatgggggcaggtgagaagtccattttgagaatcagcatagtaaattacatttctaatcccagaggacttaatattttcttttgtcaccccagaggtgaaaaatcagcagttgaagcctgacaggcctcagtggtgaccaggaacagaagcagccttcctgttagtagatgggggtacttctgtggtgggcagaagccttactaaaggggaagacagactttgaagtttctagacgagaaggaggctagcttctagcctgggtggccattattccaaaaggtcattgtttctcactagaccccagggcaccagatgaatttccaagtttaaactctttcctgcaggtgattactttgaaaaaggttggtccagaccattttgatcaagaacctgtatatgtgttgtgttagaggcatctgcctcaagtctatgtacagtgtttgctgcgggtgtgttccaatattcattttacctctgcttgggggttttgtgtgttcccctccccccatgccctgcctacccccttttccctgaaccacgtccttttgaataatttccagatggatttctgtagccataccaaagccagggtgttttcattcatgcggatactagtatttatagatgtctgactacctaacttaatttttgtttttgaacttctaattggggccagtgtaaggtcgatcccagaggctgatctgcaaatcaagctacatgtatttgtgtataagaccctgtgttcaggactgggtgacttttctaagaaatatggggtttagaatggggttgactgtattttttaacctaattctggagagaagattgtattttttacagttttttgggtttggcttccttctcacatttctttagctttgaatttttactaaataaatttcctcctgattaattttttttttctcatctgggaatttgaaatctcggtgcttactgttacaccaatttgtccaaagagttgaaatcactttaatgccagaacatggtaaatttgcagccatttcaagcaggtgatggtctttttttataacatcgttaacgggtaccattaaatattctgagaggtgaatgtaaaatataaaaggtataggtttttttttttttttaaagaaaacaataaactttcaaagagaaaaccagcatgaagtctgtattgtatccattgacttgataagtgatagaaatttattttaggtttttgatccattgcttatggggaaaggaagttagggcagaggaagggatattctagacatttaattcttagtgaagactaagatacagaatgatgtcaggctaatactcagttttgtaaagagcaatctggggtgttgacccttaaatgtttgtgcactcttcttgttgcagataaaagtcattaaaaatcaagtgaatagaatggatcttgggtggaaaaacaatcttgaaataaacttgtgattgag

SEQ ID NO: 2281 - DNA, 4684 bp, Homo sapiens
ggcagaccgtcacgtgacgacgtcgattcgcgtgcggcagtggcgaagttgacaaaccccgcgaaaatcgactctttgcatcgcacattttgttgattttccctcgtttttctttctctctttcccccgtccatccgaaagagggttggaaaaaaacaaaacaaacaaacaaacaaaaaaaaaacctaacgctgttgggacccggaagcggaaagggcatctttgaggtcgatacttccgggtcattgggagagtgcgggattcctgggccgagagcgggtggctgagccgggacctcgcgtgattctcggaacccgaggagaagcggcgtccggggctatggctgtgactctggacaaagacgcttattatcggcgagtgaagagactgtacagcaattggcggaaaggagaagatgagtatgccaacgttgatgccattgttgtatcagtgggtgttgatgaagaaattgtttatgccaaatcaactgccttacagacatggctctttggttatgaactaactgatactatcatggtcttttgtgatgacaaaatcatctttatggccagcaagaaaaaagtggagttcttgaaacagattgccaacactaagggcaatgagaatgctaatggagcccctgccatcacactgctaatacgagaaaagaatgaaagtaataagagtagctttgacaaaatgattgaagccattaaagaaagcaagaatggcaagaagattggagtgttcagcaaagacaaattccctggagagttcatgaagagctggaatgactgcctcaacaaagaaggctttgacaaaatagatatcagtgcagttgtggcatataccatcgctgtaaaggaggatggggagctcaacctaatgaagaaagcagccagcatcacttctgaagtcttcaacaaattcttcaaggaaagagtcatggaaatagttgatgcagatgagaaagttcgacacagcaaactggctgagtctgtggaaaaggccattgaagagaaaaaataccttgctggggcagacccttctactgtggaaatgtgttaccctcctatcattcagagtggtggcaactataatctcaagttcagtgtggtgagtgacaagaatcatatgcactttggggctatcacttgtgccatgggtattcgcttcaagtcttactgctccaaccttgttcgcactttgatggttgatccttctcaagaagttcaagaaaattataactttttgctccagcttcaagaggagctgctgaaggaattaagacatggtgtgaagatatgtgacgtgtataacgctgtcatggacgtggttaaaaagcagaagccagaactgctgaacaaaattaccaaaaacctagggtttgggatgggaattgaattccgtgaaggctccctagtaatcaatagcaaaaatcaatacaaactgaagaaaggaatggttttcagcatcaatttaggattctcagacctgactaacaaggaggggaaaaagccagaagagaaaacctatgccctgttcattggtgacacagtgcttgtggatgaggatggcccagctactgttctcacttctgtgaagaagaaagtgaagaatgtggggattttcctaaagaatgaagatgaggaagaagaggaggaggagaaagatgaggcagaggaccttttgggaagaggttctcgggcagcattacttacagaaagaacaagaaatgaaatgactgcagaagagaagcgaagagcacatcagaaagaactagcggctcaactcaatgaagaagcaaagaggcgattgactgaacaaaagggagaacagcagattcagaaagctcgcaagtctaatgtgtcctataaaaacccatctctgatgcctaaggaaccacatattcgggaaatgaagatctacatcgataagaaatatgagactgtaataatgcccgtgtttggcattgcaacaccgtttcacattgccacaatcaagaatataagtatgtccgtggaaggagattatacttacttgcgaatcaacttttattgcccaggcagtgctctgggcaggaatgaaggcaacatctttcctaaccctgaagcgacttttgtcaaggaaattacataccgagcatcaaatattaaggcacccggagaacagacagtaccagccttgaaccttcagaatgctttccgaattattaaagaagtacagaaacgttataaaactcgagaagctgaagagaaagagaaggaggggattgtaaaacaagactcactggtgatcaatctaaaccggagtaatccgaaactgaaagatctatacattcgcccaaatattgcccaaaagaggatgcaaggctcactggaggcccatgtcaatggcttccgcttcacatctgttcgaggagacaaagtggatattttgtacaataatattaagcatgctttgttccagccctgtgatggagaaatgattattgtcttgcactttcacctcaagaatgccatcatgtttgggaagaagcggcacacggatgtgcagttctacacagaagtgggagagataaccacggacttggggaaacatcagcatatgcatgaccgagatgacctctatgctgagcagatggaacgagaaatgaggcacaaactgaaaacagcctttaaaaatttcattgagaaagtagaggctctaactaaggaggaactggaatttgaagtgccttttagggacttgggatttaacggagctccctataggagtacctgcctccttcagcccactagtagtgcgctggtaaatgctacggaatggccaccttttgtggtgacattggatgaggtagagctgatccactttgagcgggtccagtttcacctgaagaactttgatatggtaatcgtctacaaggactacagcaagaaagtgaccatgatcaacgccattcctgtagcctctcttgaccccatcaaggaatggttgaattcctgcgacctgaaatacacagaaggagtacagtccctcaactggactaaaatcatgaagaccattgttgatgaccctgagggcttcttcgaacaaggtggctggtctttcctggagcctgagggtgaggggagtgatgctgaagaaggggattcagagtctgaaattgaagatgagacttttaatccttcagaagatgactatgaagaggaagaggaggacagtgatgaagattattcatcagaagcagaagagtcagactattctaaggagtcattgggtagtgaagaagagagtggaaaggattgggatgaactggaggaagaagcccgaaaagcggaccgagaaagtcgttacgaggaagaagaagaacaaagtcgaagtatgagccggaagaggaaggcatctgtgcacagttcgggccgtggctctaaccgtggttccagacacagctctgcaccccccaagaaaaagaggaagtaacttctgaactttggccctgagctccattcttcctccagccaacccctgaaaattttacatgacatagaaactgtatttttcctttcgttttcatttgaagttttgccatttgtgtttatgggtttagggggccatttgtgtggaccaatctactcggggaattccaggcccaccaggacacgtgccaatggccccattcagatggcaagggaggaggtgttcttgaagacaggaggaggctcccgctgttaataaatattgtttcattcttctctcttcctgtcaccttctgccaagacattgatggcttctgacatcttatttggtgtctcaaagctgtatttccaagacagtggtacaaggtgacccttaattacccgtatcatggttcttgaccagcacattcaatcctccaacctaccctactgccatgaccttccgcacatctctaagttttatctttgcaatactcaaggttctcggaaatttgctaatggttgtgataaaccatacagcttgagccagtgaggcagattgggctggtgccttcgtctgagttttcctgctttcctgcctcgtgcagattctgaggtatatctgctgccttggaagacataagaagcagtgatactccctggctcggttattttctccatacaatgcacacatggtacaatgatagaaggcaaaattgccactgtcttcttttttttctcatatatctaaggaagatatatcaggttgtgcctcatgtaccgcttctagtgaaatgtagaggaaggctcaaaggagtcaacatttatatctggaagggacaagtcatgccttgggcctagaataccctgatgagaaaagagaagaggaagggaggccatatctacaacacagcctctcggcactgctgctccttattttaactttgtcttgcattgtcctgtatttatcacagtttctgttgaacagcttttcaagtatttggggagtttatcttgccatcctccccttctggttctctgcacccacctgtcccactgcagttccttccgtgctctgtgactttaagagaagaaggggggaggggtcccggattttatgtttgtttgttttttctccttagcagtaggacttgatattttcaattttggaagaactaaaagatgaataaactgggttttttttgttgtttgtttttgtaaattca

SEQ ID NO: 2282 - DNA, 1536 bp, Homo sapiens
ggcagaccgtcacgtgacgacgtcgattcgcgtgcggcagtggcgaagttgacaaaccccgcgaaaatcgactctttgcatcgcacattttgttgattttccctcgtttttctttctctctttcccccgtccatccgaaagagggttggaaaaaaacaaaacaaacaaacaaacaaaaaaaaaacctaacgctgttgggacccggaagcggaaagggcatctttgaggtcgatacttccgggtcattgggagagtgcgggattcctgggccgagagcgggtggctgagccgggacctcgcgtgattctcggaacccgaggagaagcggcgtccggggctatggctgtgactctggacaaagacgcttattatcggcgagtgaagagactgtacagcaattggcggaaaggagaagatgagtatgccaacgttgatgccattgttgtatcagtgggtgttgatgaagaaattgtttatgccaaatcaactgccttacagacatggctctttggttatgaactaactgatactatcatggtcttttgtgatgacaaaatcatctttatggccagcaagaaaaaagtggagttcttgaaacagattgccaacactaagggcaatgagaatgctaatggagcccctgccatcacactgctaatacgagaaaagaatgaaagtaataagagtagctttgacaaaatgattgaagccattaaagaaagcaagaatggcaagaagattggagtgttcagcaaagacaaattccctggagagttcatgaagagctggaatgactgcctcaacaaagaaggctttgacaaaatagatatcagtgcagttgtggcatataccatcgctgtaaaggaggatggggagctcaacctaatgaagaaagcagccagcatcacttctgaagtcttcaacaaattcttcaaggaaagagtcatggaaatagttgatgcagatgagaaagttcgacacagcaaactggctgagtctgtggaaaaggccattgaagagaaaaaataccttgctggggcagacccttctactgtggaaatgtgttaccctcctatcattcagagtggtggcaactataatctcaagttcagtgtggtgagtgacaagaatcatatgcactttggggctatcacttgtgccatgggtattcgcttcaagtcttactgctccaaccttgttcgcactttgatggttgatccttctcaagaagttcaagaaaattataactttttgctccagcttcaagaggagctgctgaaggaattaagacatggtgtgaagatatgtgacgtgtataacgctgtcatggacgtggttaaaaagcagaagccagaactgctgaacaaaattaccaaaaacctagggtttgggatgggaattgaattccgtgaaggctccctagtaatcaatagcaaaaatcaatacaaactgaagaaaggaatggttttcagcatcaatttaggattctcagacctgactaacaagaaaaaaaaaaaaaaaaaaaaagcaaagtag

SEQ ID NO: 2283 - DNA, 954 bp, Homo sapiens
atgaataatacggcagctagtccaatgtctactgcaacttcaagtagtggaaggagtacagggaagtctataagctttgcaacagaattacagagtatgatgtattctttaggtgatgctagaaggcctcttcatgaaacagcagttttggtagaagatgtggtacacactcagttaattaatctgttacagcaagctgctgaagtttctcagctgcggggagcaagggtaatcactcctgaagatcttctgtttttgatgcgcaaagataagaaaaaacttagaagactgctaaaatacatgtttatccgagactacaaatcaaagattgtcaaaggcatcgatgaggatgatcttctcgaagacaaattgagtggcagcaataatgcgaacaaaagacaaaagattgctcaggacttcctcaactctattgaccagacaggagaacttttagcaatgtttgaagatgacgaaattgatgaagttaaacaagaaagaatggagagagcagaaagacaaactcgaattatggattcagctcaatatgcagaattctgtgaaagtcgacaattaagtttctccaaaaaagcttccaaatttcgagactggttggactgcagcagtatggagataaaacccaatgttgtcgcaatggaaatcttagcatatttagcgtatgaaactgtggcacagttagtggatctggctcttcttgtgaggcaagacatggtaaccaaggcaggggaccccttcagccatgccatttctgcaaccttcattcagtatcacaactctgctgagagcactgcagcctgtggtgttgaggctcacagcgatgccatccagccctgccacatcagagaggccattcgacgctacagccacaggattggcccactttccccattcacaaatgcctaccgcaggaatgggatggcttttctagcctgctga

SEQ ID NO: 2284 - DNA, 728 bp, Homo sapiens
ggggcattatggctgcctctgttgccccacgcaggtcgccagggaagtgggggaaagccagcagccgcaggcctcacccagctcccatgcagcccacagcccgaaaggccggtctcactccaccatgccctctgcccgtaacagcaccaactttatttccaggcagctggtgagcagggctgagaactttccccaggctaccggcttcctagctgagaaagcaagcctactcacagttcctctgcgtcccacagagcctgcagtggtgatccacctccttcaagggccaaaaaagcttccaaatttcgagactggttggactgcagcagtatggagataaaacccaatgttgtcgcaatggaaatcttagcatatttagcgtatgaaactgtggcacagttagtggatctggctcttcttgtgaggcaagacatggtaaccaaggcaggggaccccttcagccatgccatttctgcaaccttcattcagtatcacaactctgctgagagcactgcagcctgtggtgttgaggctcacagcgatgccatccagccctgccacatcagagaggccattcgacgctacagccacaggattggcccactttccccattcacaatttctttttctttgacagaatgcctaccgcaggaatgggatggcttttctagcctgctgatgtgacaactgtgatgtgcctgcaacaacaggaaaggcaatgttatatt

SEQ ID NO: 2285 - DNA, 2091 bp, Homo sapiens
cacagccgagtcaccttttccctttctacactccacactctcagtcccccaccccgcccctttccaagcgtgtcccgggccgcagcagcagaaaccgcaccatctccacccccacattctcctcgcgggaagcgcagcagtgcctccaagggttcttaaagcagagatgaataatacggcagctagtccaatgtctactgcaacttcaagtagtggaaggagtacagggaagtctataagctttgcaacagaattacagagtatgatgtattctttaggtgatgctagaaggcctcttcatgaaacagcagttttggtagaagatgtggtacacactcagttaattaatctgttacagcaagctgctgaagtttctcagctgcggggagcaagggtaatcactcctgaagatcttctgtttttgatgcgcaaagataagaaaaaacttagaagactgctaaaatacatgtttatccgagactacaaatcaaagattgtcaaaggcatcgatgaggatgatcttctcgaagacaaattgagtggcagcaataatgcgaacaaaagacaaaagattgctcaggacttcctcaactctattgaccagacaggagaacttttagcaatgtttgaagatgacgaaattgatgaagttaaacaagaaagaatggagagagcagaaagacaaactcgaattatggattcagctcaatatgcagaattctgtgaaagtcgacaattaagtttctccaaaaaagcttccaaatttcgagactggttggactgcagcagtatggagataaaacccaatgttgtcgcaatggaaatcttagcatatttagcgtatgaaactgtggcacagttagtggatctggctcttcttgtgaggcaagacatggtaaccaaggcaggggaccccttcagccatgccatttctgcaaccttcattcagtatcacaactctgctgagagcactgcagcctgtggtgttgaggctcacagcgatgccatccagccctgccacatcagagaggccattcgacgctacagccacaggattggcccactttccccattcacaaatgcctaccgcaggaatgggatggcttttctagcctgctgatgtgacaactgtgatgtgcctgcaacaacaggaaaggcaatgttatattaaggtgatttcttgtgaacaaaataaaatacaaatttacctttcttttatctgagggagtgggctggtctgttgtgactttcaacttgctgactcctcctcttttccagcccctcaaccatcggtcttgtttactagatgggctgttcagctaattaatggcaggatgtttaggatagtctgtaggtggacaagaatgcagatcacacagttttgaaattttaatttgagtagatttactgccctcagctcacataccttaaaagcagtggttgcccccgtccagcgttttgtctgcattttatttgatatattttataatccaggtttggaacaaggaaacaaaattaaaaggacagtgagttttcgccttcccttacaccaccaactttactttccaacatttgttgacatgtgttttagtgacagctatccattttataaacttacagtaatcaaagatctaacagacctgataaatcacctgttcccacctcctttccccttcactccacttatagtatgtgtcattttcaatgcctgcttcccaacttcctgccatctgcctttcatgtgtgtttttcctcacacagaacctcttcctccatcttcatttccctccttttcctgttcctccaatccccagatccaccactcctgcacatgccatacacatttagaagccaagtattcagaatcagtagaaggggagcagagtgatttcttgcttcctcccttcaaagcactaccacacctagactggaaatgtgggctgggtaatttcttgctgttagcagccgagctacccttctggcatctatactttctccagtaaatgaggaaccgtaactctttggaacaaaccaaaatatagcagatgtaattgtacagttcctgattaaacttcagttgcaaaaaagaaa

SEQ ID NO: 2286 - DNA, 2389 bp, Homo sapiens
cacagccgagtcaccttttccctttctacactccacactctcagtcccccaccccgcccctttccaagcgtgtcccgggccgcagcagcagaaaccgcaccatctccacccccacattctcctcgcgggaagcgcagcagtgcctccaagggttcttaaagcagagatgaataatacggcagctagtccaatgtctactgcaacttcaagtagtggaaggagtacagggaagtctataagctttgcaacagaattacagagtatgataaactgcttatcaataacagctgtagcactgtggcttttctccatggactcatggtggtctttggaacaacgttcttcaactttgacagcttcatagggaaaacagattctatagaaataattggaaaatcagtttttccctattgttatcacaatatccttccactgctgaatgattctggcaggtattctttaggtgatgctagaaggcctcttcatgaaacagcagttttggtagaagatgtggtacacactcagttaattaatctgttacagcaagctgctgaagtttctcagctgcggggagcaagggtaatcactcctgaagatcttctgtttttgatgcgcaaagataagaaaaaacttagaagactgctaaaatacatgtttatccgagactacaaatcaaagattgtcaaaggcatcgatgaggatgatcttctcgaagacaaattgagtggcagcaataatgcgaacaaaagacaaaagattgctcaggacttcctcaactctattgaccagacaggagaacttttagcaatgtttgaagatgacgaaattgatgaagttaaacaagaaagaatggagagagcagaaagacaaactcgaattatggattcagctcaatatgcagaattctgtgaaagtcgacaattaagtttctccaaaaaagcttccaaatttcgagactggttggactgcagcagtatggagataaaacccaatgttgtcgcaatggaaatcttagcatatttagcgtatgaaactgtggcacagttagtggatctggctcttcttgtgaggcaagacatggtaaccaaggcaggggaccccttcagccatgccatttctgcaaccttcattcagtatcacaactctgctgagagcactgcagcctgtggtgttgaggctcacagcgatgccatccagccctgccacatcagagaggccattcgacgctacagccacaggattggcccactttccccattcacaaatgcctaccgcaggaatgggatggcttttctagcctgctgatgtgacaactgtgatgtgcctgcaacaacaggaaaggcaatgttatattaaggtgatttcttgtgaacaaaataaaatacaaatttacctttcttttatctgagggagtgggctggtctgttgtgactttcaacttgctgactcctcctcttttccagcccctcaaccatcggtcttgtttactagatgggctgttcagctaattaatggcaggatgtttaggatagtctgtaggtggacaagaatgcagatcacacagttttgaaattttaatttgagtagatttactgccctcagctcacataccttaaaagcagtggttgcccccgtccagcgttttgtctgcattttatttgatatattttataatccaggtttggaacaaggaaacaaaattaaaaggacagtgagttttcgccttcccttacaccaccaactttactttccaacatttgttgacatgtgttttagtgacagctatccattttataaacttacagtaatcaaagatctaacagacctgataaatcacctgttcccacctcctttccccttcactccacttatagtatgtgtcattttcaatgcctgcttcccaacttcctgccatctgcctttcatgtgtgtttttcctcacacagaacctcttcctccatcttcatttccctccttttcctgttcctccaatccccagatccaccactcctgcacatgccatacacatttagaagccaagtattcagaatcagtagaaggggagcagagtgatttcttgcttcctcccttcaaagcactaccacacctagactggaaatgtgggctgggtaatttcttgctgttagcagccgagctacccttctggcatctatactttctccagtaaatgaggaaccgtaactctttggaacaaaccaaaatatagcagatgtaattgtacagttcctgattaaacttcagttgcaaaaaagaaagttatttctttaattctgtgggagttttgtataattttacttttatggtttttacacatacttgaaacactctttctaaagaattaataaaaacagaaatgagaaacatgaaa

SEQ ID NO: 2287 - DNA, 987 bp, Homo sapiens
atggtggtctttggaacaacgttcttcaactttgacagcttcatagggaaaacagattctatagaaataattggaaaatcagtttttccctattgttatcacaatatccttccactgctgaatgattctggcaggtattctttaggtgatgctagaaggcctcttcatgaaacagcagttttggtagaagatgtggtacacactcagttaattaatctgttacagcaagctgctgaagtttctcagctgcggggagcaagggtaatcactcctgaagatcttctgtttttgatgcgcaaagataagaaaaaacttagaagactgctaaaatacatgtttatccgagactacaaatcaaagattgtcaaaggcatcgatgaggatgatcttctcgaagacaaattgagtggcagcaataatgcgaacaaaagacaaaagattgctcaggacttcctcaactctattgaccagacaggagaacttttagcaatgtttgaagatgacgaaattgatgaagttaaacaagaaagaatggagagagcagaaagacaaactcgaattatggattcagctcaatatgcagaattctgtgaaagtcgacaattaagtttctccaaaaaagcttccaaatttcgagactggttggactgcagcagtatggagataaaacccaatgttgtcgcaatggaaatcttagcatatttagcgtatgaaactgtggcacagttagtggatctggctcttcttgtgaggcaagacatggtaaccaaggcaggggaccccttcagccatgccatttctgcaaccttcattcagtatcacaactctgctgagagcactgcagcctgtggtgttgaggctcacagcgatgccatccagccctgccacatcagagaggccattcgacgctacagccacaggattggcccactttccccattcacaaatgcctaccgcaggaatgggatggcttttctagcctgctga

SEQ ID NO: 2288 - DNA, 1377 bp, Homo sapiens
ccccccccatcgccccgtcacacagccgagtcaccttttccctttctacactccacactctcagtcccccaccccgcccctttccaagcgtgtcccgggccgcagcagcagaaaccgcaccatctccacccccacattctcctcgcgggaagcgcagcagtgcctccaagggttcttaaagcagagatgaataatacggcagctagtccaatgtctactgcaacttcaagtagtggaaggagtacagggaagtctataagctttgcaacagaattacagagtatgatgtattctttaggtgatgctagaaggcctcttcatgaaacagcagttttggtagaagatgtggtacacactcagttaattaatctgttacagcaagctgctgaagtttctcagctgcggggagcaagggtaatcactcctgaagatcttctgtttttgatgcgcaaagataagaaaaaacttagaagactgctaaaatacatgtttatccgagactacaaatcaaagattgtcaaaggcatcgatgaggatgatcttctcgaagacaaattgagtggcagcaataatgcgaacaaaagacaaaagattgctcaggacttcctcaactctattgaccagacaggagaacttttagcaatgtttgaagatgacgaaattgatgaagttaaacaagaaagaatggagagagcagaaagacaaactcgaattatggattcagctcaatatgcagaattctgtgaaagtcgacaattaagtttctccaaaaaagcttccaaatttcgagactggttggactgcagcagtatggagataaaacccaatgttgtcgcaatggaaatcttagcatatttagcgtatgaaactgtggcacagttagtggatctggctcttcttgtgaggcaagacatggtaaccaaggcaggggaccccttcagccatgccatttctgcaaccttcattcagtatcacaactctgctgagagcactgcagcctgtggtgttgaggctcacagcgatgccatccagccctgccacatcagagaggccattcgacgctacagccacaggattggcccactttccccattcacaaatgcctaccgcaggaatgggatggcttttctagcctgctgatgtgacaactgtgatgtgcctgcaacaacaggaaaggcaatgttatattaaggagtaaaccaagccaattcagcacttcctgtttacttccttgtcatatgtaccatagatggtgacagacctgctctcaaaacaagcttccttcgtttaattctgcattttctgcttaggcaaccaccctatcaatatacttgaacaatgaaacaatttggctacggaagcactgtctctgaattc

SEQ ID NO: 2289 - DNA, 1489 bp, Homo sapiens
tatttacttcctgcgggtgcacaggctgtggtcgtctatctccctgttgttcttcccatcggcgaagatggccctggagacggtgccgaaggacctgcggcatctgcgggcctgtttgctgtgttcgctggtcaagactatagaccagtttgaatatgatggttgtgacaattgtgatgcatatctacaaatgaagggtaaccgagagatggtatatgactgcactagctcttcctttgatggaatcattgcgatgatgagtccagaggacagctgggtctccaagtggcagcgagtcagtaactttaagccaggtgtatatgcggtgtcagtcactggtcgcctgccccaaggaatcgtgcgggagctgaaaagtcgaggagtggcctacaaatccagagacacagctataaagacctagcaagatgcaaggctgccagcatctttgctctccacctcctgcctctgcttatttcttgttctggaactaaatgaacagaacttcaaatacttcctaccctccaattcagactcagctgactgttgagagagcagcacatcattttatcattttatcttctttggactacaggtggggtgggagggatttgggttggtggattaacagatggaattgaggagagagtaggatgctgattttcctacccgtggcccaggtctgtgccttccccatgccaaggactctaggtcaaatgtcaataaatatgaacctcgagaaagttctgaaggccatgacacctgccttgcctccctcttccattctcttaggcacagtaatagcttatttgccctataagaaccttcccagagcagcagaggcccttctactccctcttgactgtctcagcctctgggattgcagcctttgtagtgtgcttccttgcttcctatcggagggtgctgatccagaggctcagtaaccccatcaacttggtggccctggtgtctcacacttgtatccttctgccctcgagacctggcacagcagtatcccttgaagaaatcctgaggctttgtagagtgctccttgaccatgtttaataattcttccctcccctgcttgtctattttcttctcttcacggctcttcctataccttaggccagtctcaagcactcactggagacccttgggccttgggcgaccattgagtcctagtctcccttgtttgtgcccctgtaggaggtaggtccttttctcctccggcctagtaggggaccttgggtaacatcccatttttcggccaaggtgagttgttttaggataaaaaaatttaccacaaattctcatttaaatttccacagaaatcctgttcgtatccccattttgatttccctaagttccttgttctccctctaaaaagagaatgattgcaccctgcctgtttacctcaggattgttgtgattgtagaaacgaagctatgtgaaaattatataagtattataaaggtgaaatacttttgctctc

SEQ ID NO: 2290 - DNA, 4472 bp, Homo sapiens
ccgaagcggagcggggctctgaggagacactttttttttcctccctccttccctcctctcctcctcccttcccttcccctctcctcccctctctcctccttcccccctcggtccgccggagcctgctggggcgagcggttggtattgcaggcgcttgctctccggggccgcccggcgggtagctggcggggggaggaggcaggaaccgcgatggcgcctcagaagcacggcggtgggggagggggcggctcggggcccagcgcggggtccgggggaggcggcttcgggggttcggcggcggtggcggcggcgacggcttcgggcggcaaatccggcggcgggagctgtggagggggtggcagttactcggcctcctcctcctcctccgcggcggcagcggcgggggctgcggtgttaccggtgaagaagccgaaaatggagcacgtccaggctgaccacgagcttttcctccaggcctttgagaagccaacacagatctatagatttcttcgaactcggaatctcatagcaccaatatttttgcacagaactcttacttacatgtctcatcgaaactccagaacaaacatcaaaaggaaaacatttaaagttgatgatatgttatcaaaagtagagaaaatgaaaggagagcaagaatctcatagcttgtcagctcatttgcagcttacgtttactggtttcttccacaaaaatgataagccatcaccaaactcagaaaatgaacaaaattctgttaccctggaagtcctgcttgtgaaagtttgccacaaaaaaagaaaggatgtaagttgtccaataaggcaagttcccacaggtaaaaagcaggtgcctttgaatcctgacctcaatcaaacaaaacccggaaatttcccgtcccttgcagtttccagtaatgaatttgaacctagtaacagccatatggtgaagtcttactcgttgctatttagagtgactcgtccaggaagaagagagtttaatggaatgattaatggagaaaccaatgaaaatattgatgtcaatgaagagcttccagccagaagaaaacgaaatcgtgaggatggggaaaagacatttgttgcacaaatgacagtatttgataaaaacaggcgcttacagcttttagatggggaatatgaagtagccatgcaggaaatggaagaatgtccaataagcaagaaaagagcaacatgggagactattcttgatgggaagaggctgcctccattcgaaacattttctcagggacctacgttgcagttcactcttcgttggacaggagagaccaatgataaatctacggctcctattgccaaacctcttgccactagaaattcagagagtctccatcaggaaaacaagcctggttcagttaaacctactcaaactattgctgttaaagaatcattgactacagatctacaaacaagaaaagaaaaggatactccaaatgaaaaccgacaaaaattaagaatattttatcagtttctctataacaacaatacaaggcaacaaactgaagcaagagatgacctgcattgcccttggtgtactctgaactgccgcaaactttatagtttactcaagcatcttaaactctgccatagcagatttatcttcaactatgtttatcatccaaaaggtgctaggatagatgtttctatcaatgagtgttatgatggctcctatgcaggaaatcctcaggatattcatcgccaacctggatttgcttttagtcgcaacggaccagttaagagaacacctatcacacatattcttgtgtgcaggccaaaacgaacaaaagcaagcatgtctgaatttcttgaatctgaagatggggaagtagaacagcaaagaacatatagtagtggccacaatcgtctgtatttccatagtgatacctgcttacctctccgtccacaagaaatggaagtagatagtgaagatgaaaaggatcctgaatggctaagagaaaaaaccattacacaaattgaagagttttctgatgttaatgaaggagagaaagaagtgatgaaactctggaatctccatgtcatgaagcatgggtttattgctgacaatcaaatgaatcatgcctgtatgctgtttgtagaaaattatggacagaaaataattaagaagaatttatgtcgaaacttcatgcttcatctagtcagcatgcatgactttaatcttattagcataatgtcaatagataaagctgttaccaagctccgtgaaatgcagcaaaaattagaaaagggggaatctgcttcccctgcaaacgaagaaataactgaagaacaaaatgggacagcaaatggatttagtgaaattaactcaaaagagaaagctttggaaacagatagtgtctcaggggtttcaaaacagagcaaaaaacaaaaactctgaaaagctctaaccccatgttatggacaaacactgaaattacattttagggaattcatcctctaagaattatgtttttgtttttaatcatatgttccaaacaggcactgttagatgaagtaaatgatttcaacaaggatatttgtatcagggttctacttcacttcattatgcagcattacatgtatatcacttttattgatgtcattaaaacattctgtactttaagcatgaaaagcaatatttcaaagtatttttaaactcaacaaatgtcatcaaatatgttgaattgatctagaaattatttcatatataaatcagaatttttttgcatttatgaacggctgtttttctactttgtaattgtgagacattttcttggggagggaaaattggaatggttcccttttttagaaattgaagtggtcttcatatgtcaactacagaaaaggaaaaaaatagaaattgaaggatttttatgaaattatattgcattactatttgcagtcaaactttgatccttgtttttgaaatcatttgtcaattcggaatgaaaaattataatgtaattttacattacataagttccttttacaattaaaaaatagcacttcttcatcttatgcctgtttgagaagatattaaattttcacattgttgacagtgaaatgctatgttggtttataagattacagaccatttgttttcatgtggataattttagtgcattgctcacccggtatgttttttttttttaacttgaacattttgcttgttttgtttttcttttttaattagataatcacacggaaaattaagctgttcatatctttaaattaggattgcaaaccaaggaaagaacgcatttgagattttaagatgtcacttataaggggagaagtgttcttaaaaagtcaaccagaaaactgttatgccttttatttgtttgcaaggatgtctttgtaatgtgtttcatgaatagaatatccaatagagataagctgacttgaatcattttgagcaattttgccctgtgttatatgtgtttcacgcacatatttgcagttggattttctccaacagaaagtggattcactactggcacattaacaagcaccaataggtttttattccaactccgagcactgtggttgagtaacatcacctcaattttttattatccttaaagatattgcattttcatattctttatttataaaggatcaatgctgctgtaaatacaggtatttttaattttaaaatttcattccaccaccatcagatgcagttccctattttgtttaatgaagggatatataagctttctaatggtgtcttcagaaatttataaaatgtaaatactgatttgactggtctttaagatgtgtttaactgtgaggctatttaacgaatagtgtggatgtgatttgtcatccagtattaagttcttagtcattgatttttgtgtttaaaaaaaaataggaaagagggaaactgcagctttcattacagattccttgattggtaagctctccaaatgatgagttctagtaaactctgatttttgcctctggatagtagatctcgagcgtttatctcgggctttaatttgctaaagctgtgcacatatgtaaaaaaaaaaaaaaaaagattattttaggggagatgtaggtgtagaattattgcttatgtcatttcttaagcagttatgctcttaatgcttaaaagaaggctagcattgtttgcacaaaaagttggtgattcccaccccaaatagtaataaaattacttctgttgagtaaactttttatgtcatcgtaaaagctgaaaaaatccctttgtttctatttataaaaaaagtgcttttctatatgtacccttgataacagattttgaagaaatcctgtaagatgataaagcatttgaatggtacagtagatgtaaaaaaaattcagtttaaaagaacatttgtttttacattaaatgtttatttgaaatcaaatgattttgtacataaagttcaataatataaaagctgtattctg

SEQ ID NO: 2291 - DNA, 2085 bp, Homo sapiens
attgtgggattggatgagtctcaagatggacaaccgggatgttgcaggaaaggctaaccggtggtttggggttgctccccctaaatctggaaaaatgaacatgaacatccttcaccaggaagagctcatcgctcagaagaaacgggaaattgaagccaaaatggaacagaaagccaagcagaatcaggtggccagccctcagcccccacatcctggcgaaatcacaaatgcacacaactcttcctgcatttccaacaagtttgccaacgatggtagcttcttgcagcagtttctgaagttgcagaaggcacagaccagcacagacgccccgaccagtgcgcccagcgcccctcccagcacacccacccccagcgctgggaagaggtccctgctcatcagcaggcggacaggcctggggctggccagcctgccgggccctgtgaagagctactcccacgccaagcagctgcccgtggcgcaccgcccgagtgtcttccagtcccctgacgaggacgaggaggaggactatgagcagtggctggagatcaaagtttcacccccagagggagccgagactcggaaagtgatagagaaattggcccgctttgtggcagaaggaggccccgagttagaaaaagtagctatggaggactacaaggataacccagcatttgcatttttgcacgataagaatagcagggaattcctctactacaggaagaaggtggctgagataagaaaggaagcacagaagtcgcaggcagcctctcagaaagtttcacccccagaggacgaagaggtcaagaaccttgcagaaaagttggccaggttcatagcggacgggggtcccgaggtggaaaccattgccctccagaacaaccgtgagaaccaggcattcagctttctgtatgagcccaatagccaagggtacaagtactaccgacagaagctggaggagttccggaaagccaaggccagctccacaggcagcttcacagcacctgatcccggcctgaagcgcaagtcccctcctgaggccctgtcagggtccttacccccagccaccacctgccccgcctcgtccacgcctgcgcccactatcatccctgctccagctgcccccgggaagccagcctccgcagccaccgtgaagaggaagcggaagagccggtgggggcctgaagaggataaggtagagctcccacctgctgaactggtgcagagggacgtggatgcctctccctcgcctctgtcagttcaggacctcaaggggctcggctatgagaaggggaagcctgtgggtctagtgggcgtcacagagctttcagacgcccagaagaagcagctgaaggagcagcaggagatgcagcagatgtacgacatgatcatgcagcacaagcgggccatgcaggacatgcagctgctgtgggagaaggcagtccaacagcaccagcacggctatgacagtgatgaggaggtggacagcgagctgggcacctgggagcaccagctgcggcgcatggagatggataagaccagggaatgggccgagcagctgacaaagatgggccggggcaagcacttcatcggagacttcctgcctccagacgagctggaaaagtttatggagaccttcaaggccctgaaggagggccgtgagcctgactactcagagtacaaggagttcaagctgactgtggagaacatcggctaccagatgctgatgaagatgggctggaaggagggcgaggggctgggctcagagggccagggcatcaagaacccagtgaacaagggcaccaccacagtggacggcgctggcttcggcattgaccggccggcggagctctccaaggaggacgacgagtatgaggcgttccgcaagaggatgatgctggcctaccgcttccggcccaaccccctgaacaatcccagacggccttactactgagtgttctggaaatacatactttctgaatgaccaaccgtccctggactgtggaatgttccggcctgcatttctgcccaccccttccgttgtcacgagtgccgtgccgtgtaataaagtcccagtgctcatccacc

SEQ ID NO: 2292 - DNA, 682 bp, Homo sapiens
attgtgggattggatgagtctcaagatggacaaccgggatgttgcaggaaaggctaaccggtggtttggggttgctccccctaaatctggaaaaatgaacatgaacatccttcaccaggaagagctcatcgctcagaagaaacgggaaattgaagccaaaatggaacagaaagccaagcagaatcaggtggccagccctcagcccccacatcctggcgaaatcacaaatgcacacaactcttcctgcatttccaacaagtttgccaacgatggtagcttcttgcagcagtttctgaagttgcagaaggcacagaccagcacagacgccccgaccagtgcgcccagcgcccctcccagcacacccacccccagcgctgggaagaggtccctgctcatcagcaggcggacaggcctggggctggccagcctgccgggccctgtgaagagctactcccacgccaagcagctgcccgtggcgcaccgcccgagtgtcttccagtcccctgacgaggacgaggaggaggactatgagcagtggctggagatcaaagtgtgtctcaccaagacagtgagaccgactcccccctcgtcatggtgttttgtgcctggactcgggacgcccgacagcctcctgcatctcacactcttctccccccaccccctctgtcgttgtggtccatag

SEQ ID NO: 2293 - DNA, 1094 bp, Homo sapiens
attgtgggattggatgagtctcaagatggacaaccgggatgttgcaggaaaggctaaccggtggtttggggttgctccccctaaatctggaaaaatgaacatgaacatccttcaccaggaagagctcatcgctcagaagaaacgggaaattgaagccaaaatggaacagaaagccaagcagaatcaggtggccagccctcagcccccacatcctggcgaaatcacaaatgcacacaactcttcctgcatttccaacaagtttgccaacgatggtagcttcttgcagcagtttctgaagttgcagaaggcacagaccagcacagacgccccgaccagtgcgcccagcgcccctcccagcacacccacccccagcgctgggaagaggtccctgctcatcagcaggcggacaggcctggggctggccagcctgccgggccctgtgaagagctactcccacgccaagcagctgcccgtggcgcaccgcccgagtgtcttccagtcccctgacgaggacgaggaggaggactatgagcagtggctggagatcaaaggaagaaggtggctgagataagaaaggaagcacagaagtcgcaggcagcctctcagaaagtttcacccccagaggacgaagaggtcaagaaccttgcagaaaagttggccaggttcatagcggacgggggtcccgaggtggaaaccattgccctccagaacaaccgtgagaaccaggcattcaggtgcctcatggagaaagtctctagcacttgcccagttgcctttgggacacacagcagcccttggccgggggcaagtcaggctctcaagtggaaattcacagtactgttcagtttatgttgtgtacgttctcagggtctcccctttatgatgagggaaatggcagggaatggggaactttaggatctgtggagggggaacacccagcctgtgtgcgagttccacagaagggtgggtgtgtgacaagcagcctagcctccctgccatccccggccatgcggtcgtaccctagccccagtggctgggtctgtgttcactggctcatccattcattgggtgggtttggcacttgctctgtgccc

SEQ ID NO: 2294 - DNA, 3628 bp, Homo sapiens
gggtgaggagcctgaggcggcggcgggggtggctccgcgcgcggtggtctcgggggcaaaataacatggcagccagacgaattacacaggagacttttgatgctgtattacaagaaaaagccaaacgatatcacatggatgccagtggtgaggctgtaagcgaaactcttcagtttaaagctcaagatctcttaagggcagtcccaagatccagagcagagatgtatgatgacgtccacagcgatggcagatactccctcagtggatctgtagctcactctagagatgccggaagagaaggcctgagaagtgacgtatttccagggccttccttcagatcaagcaacccttccatcagtgatgacagctactttcgcaaagaatgtggccgggatctggaattttctcactctgattctcgggaccaggtcattggccaccggaaattggggcatttccgttctcaggactggaaatttgcgctccgtggttcttgggaacaagactttggccatccagtttctcaagagtcctcttggtcacaggagtatagttttggtccctctgcagttttgggggactttggatcttccaggctgattgagaaagagtgtttggagaaggagagtcgggattatgacgtggaccatcctggggaggctgactctgtgcttaggggcggcagtcaagtccaggccagaggtcgagctctaaacatcgttgaccaggaaggttccctcctaggaaagggggagactcagggcctgctcacagctaaggggggtgttgggaaacttgtcacattgagaaatgtgagcacaaaaaaaatacccaccgtgaatcgtattactcccaaaactcagggcactaaccaaatccagaaaaacactccaagtcctgatgtgaccctggggacaaacccagggacagaagatatccagttccccattcagaagatccctctggggctggatctgaagaatcttcggctccccagaagaaagatgagctttgacatcatagataagtctgatgttttttcaagatttgggatagaaataatcaaatgggcaggattccacaccataaaagatgatattaaattttcccaacttttccagactctctttgaacttgaaacagaaacctgtgctaaaatgcttgcctcattcaaatgttccttaaaaccagagcacagagatttttgcttttttactatcaaatttttaaagcactctgctttgaaaacacccagagttgataatgagtttttaaacatgcttttagacaaaggtgctgtgaagaccaaaaattgcttttttgaaatcataaagccttttgacaagtacataatgagacttcaagaccggcttctgaagagtgtcacacctttgcttatggcctgcaatgcctacgagctaagtgtcaagatgaagaccctcagtaaccccctggacttggctcttgccctagaaaccaccaactctctctgccggaagtctttggcccttttgggacagacattttccttggcctcttctttccggcaggagaaaatcttagaagctgtcggcctgcaagatatagctccctcacctgctgcgtttccaaacttcgaagactccactttgtttgggcgagagtacatagaccacctgaaggcctggctagtcagcagcggatgtcccctccaggttaagaaagccgaaccagagccgatgcgagaggaggagaaaatgattcctcctacgaaacctgaaattcaggccaaggctccaagtagtctgagtgatgctgtcccccagcgagcagatcacagggtagtgggcaccatcgaccagcttgtgaaacgtgtcatcgaaggcagcctgtctcccaaagagagaactcttctcaaagaggaccctgcttactggtttttgtctgatgaaaatagtctggagtataaatattacaagctgaagttggcagaaatgcagcggatgagcgagaacttgcgaggagccgaccagaagccgacctcagcagactgtgcagtgagggccatgctgtactcccgggctgtccgcaacctcaagaagaaactccttccgtggcagcggcgggggctcctccgtgctcaagggctccggggctggaaggcgaggagagcgaccaccgggacccagaccctcctatcctcaggcaccaggctgaaacaccacggccggcaggctccaggcctctcacaggcaaaaccatccctgccagacagaaatgatgctgccaaggactgcccgccagacccagttggaccttctcctcaggaccccagcttagaagcctcaggcccatcccccaagccagcaggagtggacatctctgaagcacctcagacctcttctccctgcccatctgctgacattgacatgaagacaatggagactgcagagaaactggctagatttgttgctcaggtgggaccagagatcgaacaattcagcatagaaaacagcaccgataaccctgacctgtggtttctacatgaccaaaatagttctgctttcaaattctatcgaaagaaagtgtttgaactatgtccatcaatttgtttcacgtcatctccgcacaaccttcacactggtggtggtgacaccacgggttctcaggagagccccgtggacctcatggaaggggaagcagagtttgaagacgagccccctccgcgggaggctgagctggagagcccagaggcctcctcaggtacctgcttccctcggaagaggatcagcagcaagtcattgaaggttggcatgattccagctcccaagagagtgtgtctcatccaggagccaaaagtccatgaaccagttcgaattgcctatgacaggcctcggggtcgtcccatgtccaaaaagaagaaacccaaggacttggacttcgcccagcagaagctgaccgataagaacctgggcttccagatgctgcagaagatgggctggaaggagggccatggcctgggctccctcggaaagggcatcagggagccggtcagcgtgggaaccccctcggaaggggaagggttgggtgctgacgggcaggagcacaaagaagacacattcgatgtgttccgacagaggatgatgcagatgtacagacacaagcgggccaacaaatagttaaatgctttaggaatctgtggcgtgtggccactgaccgccccccacctcctgccgctcctccaagtttgagctgagatggttctgtgagtccttggcaggggtcaaagggcacatctccttgaacctagaaagccccctacactctcagaggacacctctcctgtggattcagcgctggggcagtgaaggtgtcgggagccagcagagcatgttccagggtcacccccgagaggacaacaggcatctggaagtgctctctcgccactctgggtgctttactgtctctggcttgtttccatcactggaaatcacttagagaattgtagtgtttttggtccttgataaagcctagaagacatttgtgatgttacaaaatggaagttttcttttgtttctgttttttaagatctaagaagttgtgaatgttgttaatcatttagccgttgcaataaatgtagaggaaatgc

SEQ ID NO: 2295 - DNA, 3657 bp, Homo sapiens
ggcggcttgcgcctgcgcggcgcggcgctgcggagaccgttggttcatttgcatgtccccgcctcgcgcggcggcggcggcgggtgaggagcctgaggcggcggcgggggtggctccgcgcgcggtggtctcgggggcaaaataacatggcagccagacgaattacacaggagacttttgatgctgtattacaagaaaaagccaaacgatatcacatggatgccagtggtgaggctgtaagcgaaactcttcagtttaaagctcaagatctcttaagggcagtcccaagatccagagcagagatgtatgatgacgtccacagcgatggcagatactccctcagtggatctgtagctcactctagagatgccggaagagaaggcctgagaagtgacgtatttccagggccttccttcagatcaagcaacccttccatcagtgatgacagctactttcgcaaagaatgtggccgggatctggaattttctcactctgattctcgggaccaggtcattggccaccggaaattggggcatttccgttctcaggactggaaatttgcgctccgtggttcttgggaacaagactttggccatccagtttctcaagagtcctcttggtcacaggagtatagttttggtccctctgcagttttgggggactttggatcttccaggctgattgagaaagagtgtttggagaaggagagtcgggattatgacgtggaccatcctggggaggctgactctgtgcttaggggcggcagtcaagtccaggccagaggtcgagctctaaacatcgttgaccaggaaggttccctcctaggaaagggggagactcagggcctgctcacagctaaggggggtgttgggaaacttgtcacattgagaaatgtgagcacaaaaaaaatacccaccgtgaatcgtattactcccaaaactcagggcactaaccaaatccagaaaaacactccaagtcctgatgtgaccctggggacaaacccagggacagaagatatccagttccccattcagaagatccctctggggctggatctgaagaatcttcggctccccagaagaaagatgagctttgacatcatagataagtctgatgttttttcaagatttgggatagaaataatcaaatgggcaggattccacaccataaaagatgatattaaattttcccaacttttccagactctctttgaacttgaaacagaaacctgtgctaaaatgcttgcctcattcaaatgttccttaaaaccagagcacagagatttttgcttttttactatcaaatttttaaagcactctgctttgaaaacacccagagttgataatgagtttttaaacatgcttttagacaaaggtgctgtgaagaccaaaaattgcttttttgaaatcataaagccttttgacaagtacataatgagacttcaagaccggcttctgaagagtgtcacacctttgcttatggcctgcaatgcctacgagctaagtgtcaagatgaagaccctcagtaaccccctggacttggctcttgccctagaaaccaccaactctctctgccggaagtctttggcccttttgggacagacattttccttggcctcttctttccggcaggagaaaatcttagaagctgtcggcctgcaagatatagctccctcacctgctgcgtttccaaacttcgaagactccactttgtttgggcgagagtacatagaccacctgaaggcctggctagtcagcagcggatgtcccctccaggttaagaaagccgaaccagagccgatgcgagaggaggagaaaatgattcctcctacgaaacctgaaattcaggccaaggctccaagtagtctgagtgatgctgtcccccagcgagcagatcacagggtagtgggcaccatcgaccagcttgtgaaacgtgtcatcgaaggcagcctgtctcccaaagagagaactcttctcaaagaggaccctgcttactggtttttgtctgatgaaaatagtctggagtataaatattacaagctgaagttggcagaaatgcagcggatgagcgagaacttgcgaggagccgaccagaagccgacctcagcagactgtgcagtgagggccatgctgtactcccgggctgtccgcaacctcaagaagaaactccttccgtggcagcggcgggggctcctccgtgctcaagggctccggggctggaaggcgaggagagcgaccaccgggacccagaccctcctatcctcaggcaccaggctgaaacaccacggccggcaggctccaggcctctcacaggcaaaaccatccctgccagacagaaatgatgctgccaaggactgcccgccagacccagttggaccttctcctcaggaccccagcttagaagcctcaggcccatcccccaagccagcaggagtggacatctctgaagcacctcagacctcttctccctgcccatctgctgacattgacatgaagacaatggagactgcagagaaactggctagatttgttgctcaggtgggaccagagatcgaacaattcagcatagaaaacagcaccgataaccctgacctgtggtttctacatgaccaaaatagttctgctttcaaattctatcgaaagaaagtgtttgaactatgtccatcaatttgtttcacgtcatctccgcacaaccttcacactggtggtggtgacaccacgggttctcaggagagccccgtggacctcatggaaggggaagcagagtttgaagacgagccccctccgcgggaggctgagctggagagcccagaggtgatgcctgaggaggaggacgaggacgatgaggatgggggagaggaggcccccgctcctggaggggcgggcaagtctgagggcagcacccctgccgacggccttcccggcgaggctgccgaggacgacctggctggagcacctgccttgtcacaggcctcctcaggtacctgcttccctcggaagaggatcagcagcaagtcattgaaggttggcatgattccagctcccaagagagtgtgtctcatccaggagccaaaagtccatgaaccagttcgaattgcctatgacaggcctcggggtcgtcccatgtccaaaaagaagaaacccaaggacttggacttcgcccagcagaagctgaccgataagaacctgggcttccagatgctgcagaagatgggctggaaggagggccatggcctgggctccctcggaaagggcatcagggagccggtcagcgtgggaaccccctcggaaggggaagggttgggtgctgacgggcaggagcacaaagaagacacattcgatgtgttccgacagaggatgatgcagatgtacagacacaagcgggccaacaaatagttccagggtcacccccgagaggacaacaggcatctggaagtgctctctcgccactctgggtgctttactgtctctggcttgtttccatcactggaaatcacttagagaattgtagtgtttttggtccttgataaagcctagaagacatttgtgatgttacaaaatggaagttttcttttgtttctgttttttaagatctaagaagttgtgaatgttgttaatcatttagccgttgcaataaatgtagaggaaatgcagtgtg

SEQ ID NO: 2296 - DNA, 4768 bp, Homo sapiens
ggcggcttgcgcctgcgcggcgcggcgctgcggagaccgttggttcatttgcatgtccccgcctcgcgcggcggcggcggcgggtgaggagcctgaggcggcggcgggggtggctccgcgcgcggtggtctcgggggcaaaataacatggcagccagacgaattacacaggagacttttgatgctgtattacaagaaaaagccaaacgatatcacatggatgccagtggtgaggctgtaagcgaaactcttcagtttaaagctcaagatctcttaagggcagtcccaagatccagagcagagatgtatgatgacgtccacagcgatggcagatactccctcagtggatctgtagctcactctagagatgccggaagagaaggcctgagaagtgacgtatttccagggccttccttcagatcaagcaacccttccatcagtgatgacagctactttcgcaaagaatgtggccgggatctggaattttctcactctgattctcgggaccaggtcattggccaccggaaattggggcatttccgttctcaggactggaaatttgcgctccgtggttcttgggaacaagactttggccatccagtttctcaagagtcctcttggtcacaggagtatagttttggtccctctgcagttttgggggactttggatcttccaggctgattgagaaagagtgtttggagaaggagagtcgggattatgacgtggaccatcctggggaggctgactctgtgcttaggggcggcagtcaagtccaggccagaggtcgagctctaaacatcgttgaccaggaaggttccctcctaggaaagggggagactcagggcctgctcacagctaaggggggtgttgggaaacttgtcacattgagaaatgtgagcacaaaaaaaatacccaccgtgaatcgtattactcccaaaactcagggcactaaccaaatccagaaaaacactccaagtcctgatgtgaccctggggacaaacccagggacagaagatatccagttccccattcagaagatccctctggggctggatctgaagaatcttcggctccccagaagaaagatgagctttgacatcatagataagtctgatgttttttcaagatttgggatagaaataatcaaatgggcaggattccacaccataaaagatgatattaaattttcccaacttttccagactctctttgaacttgaaacagaaacctgtgctaaaatgcttgcctcattcaaatgttccttaaaaccagagcacagagatttttgcttttttactatcaaatttttaaagcactctgctttgaaaacacccagagttgataatgagtttttaaacatgcttttagacaaaggtgctgtgaagaccaaaaattgcttttttgaaatcataaagccttttgacaagtacataatgagacttcaagaccggcttctgaagagtgtcacacctttgcttatggcctgcaatgcctacgagctaagtgtcaagatgaagaccctcagtaaccccctggacttggctcttgccctagaaaccaccaactctctctgccggaagtctttggcccttttgggacagacattttccttggcctcttctttccggcaggagaaaatcttagaagctgtcggcctgcaagatatagctccctcacctgctgcgtttccaaacttcgaagactccactttgtttgggcgagagtacatagaccacctgaaggcctggctagtcagcagcggatgtcccctccaggttaagaaagccgaaccagagccgatgcgagaggaggagaaaatgattcctcctacgaaacctgaaattcaggccaaggctccaagtagtctgagtgatgctgtcccccagcgagcagatcacagggtagtgggcaccatcgaccagcttgtgaaacgtgtcatcgaaggcagcctgtctcccaaagagagaactcttctcaaagaggaccctgcttactggtttttgtctgatgaaaatagtctggagtataaatattacaagctgaagttggcagaaatgcagcggatgagcgagaacttgcgaggagccgaccagaagccgacctcagcagactgtgcagtgagggccatgctgtactcccgggctgtccgcaacctcaagaagaaactccttccgtggcagcggcgggggctcctccgtgctcaagggctccggggctggaaggcgaggagagcgaccaccgggacccagaccctcctatcctcaggcaccaggctgaaacaccacggccggcaggctccaggcctctcacaggcaaaaccatccctgccagacagaaatgatgctgccaaggactgcccgccagacccagttggaccttctcctcaggaccccagcttagaagcctcaggcccatcccccaagccagcaggagtggacatctctgaagcacctcagacctcttctccctgcccatctgctgacattgacatgaagacaatggagactgcagagaaactggctagatttgttgctcaggtgggaccagagatcgaacaattcagcatagaaaacagcaccgataaccctgacctgtggtttctacatgaccaaaatagttctgctttcaaattctatcgaaagaaagtgtttgaactatgtccatcaatttgtttcacgtcatctccgcacaaccttcacactggtggtggtgacaccacgggttctcaggagagccccgtggacctcatggaaggggaagcagagtttgaagacgagccccctccgcgggaggctgagctggagagcccagaggtgatgcctgaggaggaggacgaggacgatgaggatgggggagaggaggcccccgctcctggaggggcgggcaagtctgagggcagcacccctgccgacggccttcccggcgaggctgccgaggacgacctggctggagcacctgccttgtcacaggcctcctcaggtacctgcttccctcggaagaggatcagcagcaagtcattgaaggttggcatgattccagctcccaagagagtgtgtctcatccaggagccaaaagtccatgaaccagttcgaattgcctatgacaggcctcggggtcgtcccatgtccaaaaagaagaaacccaaggacttggacttcgcccagcagaagctgaccgataagaacctgggcttccagatgctgcagaagatgggctggaaggagggccatggcctgggctccctcggaaagggcatcagggagccggtcagcgtgggaaccccctcggaaggggaagggttgggtgctgacgggcaggagcacaaagaagacacattcgatgtgttccgacagaggatgatgcagatgtacagacacaagcgggccaacaaatagatcaaaaccactgatgtgaaagataagccttgaagcagcaattgcccttaaaacatcatccctgccctggatcggcctggagccagtgcccaagtacggtttggtgtgtacatgaaaacaaacgtctctgcagtctctggggcggaggtttcgctggcttttctttctctcaaagaaaaaaacatgcaccattttcaatgtgcttttgcctctcctctctgttcacatgcttttagcagcaagtcccctccaaatctgtcttggttccccttcagaaggtggcgctgcccccgaaaggcacctcagcctgtgagtgctgaggaaccagctcctctggctgattttccagttggactggccattgctctccagaagtgctctgttagcaaacgtgatgtggaaacgatcacagatggtgttttctcgttgttcgccagaatttatacgggggagacaaattcccggtaattaccaagtctgcactcgggtaccaaagctctgaagctctctgaacagttgccatacttgagttgatgaatgtgttattcatggtgtctcatctcatcaatgcatcttgagagacttaatgaaattttagcaacagtatagaatagctctatcgggtggggagtaatcattaaacagatgaaatcggccccagatttacatgtctctttagaatccacagtgtaagcaaactacagttacaaagggatgggggttgtaaaccctctgagactctgcacttttcgcacgtatggcatcgtcaagtgctgtcttattacagcctttgtaaggagaggcaggctcctcctggggtgggctctgcagctgctctatttccaggcatgtgatcgcccccgctctccagattccccagcactctgctgcgtgtaactccactcaattctccactcatccttccttgtgaagcaggatcgttgaagttttaagtatgggcaaaaatctggaaaacttaggatccctctgacaccccaggattaggggacacagcagtggctagggcatcagccacagaactgagcgggaaatgccacttgtattggctgtaaagaaatcctggctttgggccaggcacagtggctcaagcctgtaatcccagcactttaggaggttgaggcggatggatcacctgaggtcaggagtttgagaccagcctggccaacatggtgtaaccccgtctctactaaaaatacaaaaaaattagccaggcgtggtagcgggcacctgtaatcccagctactcaggaggctgaggcaggagaatcacttgaaccggggaggcagaggttgcagtgagctgagatcatgccactccactccagcctgggcgacagagcaagactccatctc

SEQ ID NO: 2297 - DNA, 3235 bp, Homo sapiens
attacaagaaaaagccaaacgatatcacatggatgccagtggtgaggctgtaagcgaaactcttcagtttaaagctcaagatctcttaagggcagtcccaagatccagagcagagatgtatgatgacgtccacagcgatggcagatactccctcagtggatctgtagctcactctagagatgccggaagagaaggcctgagaagtgacgtatttccagggccttccttcagatcaagcaacccttccatcagtgatgacagctactttcgcaaagaatgtggccgggatctggaattttctcactctgattctcgggaccaggtcattggccaccggaaattggggcatttccgttctcaggactggaaatttgcgctccgtggttcttgggaacaagactttggccatccagtttctcaagagtcctcttggtcacaggagtatagttttgatccctctggggctggatctgaagaatcttcggctccccagaagaaagatgagctttgacatcatagataagtctgatgttttttcaagatttgggatagaaataatcaaatgggcaggattccacaccataaaagatgatattaaattttcccaacttttccagactctctttgaacttgaaacagaaacctgtgctaaaatgcttgcctcattcaaatgttccttaaaaccagagcacagagatttttgcttttttactatcaaatttttaaagcactctgctttgaaaacacccagagttgataatgagtttttaaacatgcttttagacaaaggtgctgtgaagaccaaaaattgcttttttgaaatcataaagccttttgacaagtacataatgagacttcaagaccggcttctgaagagtgtcacacctttgcttatggcctgcaatgcctacgagctaagtgtcaagatgaagaccctcagtaaccccctggacttggctcttgccctagaaaccaccaactctctctgccggaagtctttggcccttttgggacagacattttccttggcctcttctttccggcaggagaaaatcttagaagctgtcggcctgcaagatatagctccctcacctgctgcgtttccaaacttcgaagactccactttgtttgggcgagagtacatagaccacctgaaggcctggctagtcagcagcggatgtcccctccaggttaagaaagccgaaccagagccgatgcgagaggaggagaaaatgattcctcctacgaaacctgaaattcaggccaaggctccaagtagtctgagtgatgctgtcccccagcgagcagatcacagggtagtgggcaccatcgaccagcttgtgaaacgtgtcatcgaaggcagcctgtctcccaaagagagaactcttctcaaagaggaccctgcttactggtttttgtctgatgaaaatagtctggagtataaatattacaagctgaagttggcagaaatgcagcggatgagcgagaacttgcgaggagccgaccagaagccgacctcagcagactgtgcagtgagggccatgctgtactcccgggctgtccgcaacctcaagaagaaactccttccgtggcagcggcgggggctcctccgtgctcaagggctccggggctggaaggcgaggagagcgaccaccgggacccagaccctcctatcctcaggcaccaggctgaaacaccacggccggcaggctccaggcctctcacaggcaaaaccatccctgccagacagaaatgatgctgccaaggactgcccgccagacccagttggaccttctcctcaggaccccagcttagaagcctcaggcccatcccccaagccagcaggagtggacatctctgaagcacctcagacctcttctccctgcccatctgctgacattgacatgaagacaatggagactgcagagaaactggctagatttgttgctcaggtgggaccagagatcgaacaattcagcatagaaaacagcaccgataaccctgacctgtggtttctacatgaccaaaatagttctgctttcaaattctatcgaaagaaagtgtttgaactatgtccatcaatttgtttcacgtcatctccgcacaaccttcacactggtggtggtgacaccacgggttctcaggagagccccgtggacctcatggaaggggaagcagagtttgaagacgagccccctccgcgggaggctgagctggagagcccagaggtgatgcctgaggaggaggacgaggacgatgaggatgggggagaggaggcccccgctcctggaggggcgggcaagtctgagggcagcacccctgccgacggccttcccggcgaggctgccgaggacgacctggctggagcacctgccttgtcacaggcctcctcaggtacctgcttccctcggaagaggatcagcagcaagtcattgaaggttggcatgattccagctcccaagagagtgtgtctcatccaggagccaaaagtccatgaaccagttcgaattgcctatgacaggcctcggggtcgtcccatgtccaaaaagaagaaacccaaggacttggacttcgcccagcagaagctgaccgataagaacctgggcttccagatgctgcagaagatgggctggaaggagggccatggcctgggctccctcggaaagggcatcagggagccggtcagcgtgtacgcagcaggcagcctggggtgggagtgggtggggcctcagtccttccacctgcagcctgccgcttggctccttcacagccaagatggcttacagctggcagttgatttttgttttttaaacagaaggcatcttcagatgagaagctgatcatttacatgtgcaggtgtttacagggctcctttctgtcctggtgtagattttttaaccagcttgttggccctggtcattttggccacatttgtgaccatcataaaagctaagtggtatttctgtgtagtttccgtctggaactgctttcccattcccgggaacccatagccgggccagccagggtcccgaacacaggcccaaagtttattaaaccccgatcataacctccagcaggcatttcatttaatactgagcttagttcctgctgggtaaggcattccgaggtaaccagggccctctgggcaccccctcaaaagccagctcttcgagggtgagtactccttgtttctactgtgagtcgcgtcttgattttccctttctttgatgtctca

SEQ ID NO: 2298 - DNA, 631 bp, Homo sapiens
aatgaagcatacagccaccgcccgtttccagagaaaccaccgcctcatcagtgaaattcttagtgagagtgtggtgccagacgttcggtcagttgtcacaacagctagaatgcaggtcctcaaacggcaggtccagtccttaatggttcatcagcgaaaactagaagctgaacttcttcaaatagaggaacgacaccaggagaagaagaggaaattcctggaaagcacagattcatttaacaatgaacttaaaaggttgtgcggtctgaaagtagaagtggatatggagaaaattgcagctgagattgcacaggcagaggaacaggcccgcaaaaggcaggaggaaagggagaaggaggccgcagagcaagctgagcgcagtcagagcagcatcgttcctgaggaagaacaagcagctaacaaaggcgaggagaagaaagacgacgagaacattccgatggagacagaaaaaaattgccagctctgtcctagaaaaacccttacttctaggtatactgattttcctgattaaaagcatccctcaaggaaacagcccagcatgactttaaacaaagtgtctaaaagaccaaccttatattatttctacaactgctttctcctcgtttaatcc

SEQ ID NO: 2299 - DNA, 5840 bp, Homo sapiens
tggcttagaaacctgggacgattacaccctaaaagcgcttggaaaaactgcagaactcgtgctgattttcgccaaagctactcccccgccgtgagggcaggaagccctgcgaggcgcctgcgaggacgcaaacgccgcgaagcaagtcctccacgcctccatcccaggtttagtgaagtgtagactctgacccacagcctaaaggaaagcaagaccggagtcggggagggcccctccaggagcgggctcagcgggagtctggccgaactgcttgctgccacagtggttccgcggcctcgcgctgagcgccatccgccgtctcccaccgcggcccccaccgcccctccgcaaggctcggcacctcccgccacttcctcggtcgctgcggcggctccggctcctcacagccgctaaacccaggcctattctgtgttaggtcgggcctcctcggccctcttcgccgtgacgaatcagcgcccggctgggaaagtatcaaaattcggggagttttgaggatccaatgggtcctgaaaaaaatccctgagtgtgctaagcatcaccgcatcttcactagaaggttagtttttctaaagagggtcgggtggggcccggaaaaaaaaaaaaattaagaagagtgtggaaagtgcgagtgcggaagctccggacgcgaggggcggggcgagcgcgggacaaagggaagcgaagccggagctgcgggcgctttttctgcccgcggtgtctcagattcattcttaaggaactgagaacttaatcttccaaaatgtcaaaaagaccatcttatgccccacctcccaccccagctcctgcaacacaaatgcccagcacaccagggtttgtgggatacaatccatacagtcatctcgcctacaacaactacaggctgggagggaacccgggcaccaacagccgggtcacggcatcctctggtatcacgattccaaaacccccaaagccaccagataagccgctgatgccctacatgaggtacagcagaaaggtctgggaccaagtaaaggcttccaaccctgacctaaagttgtgggagattggcaagattattggtggcatgtggcgagatctcactgatgaagaaaaacaagaatatttaaacgaatacgaagcagaaaagatagagtacaatgaatctatgaaggcctatcataattcccccgcgtaccttgcttacataaatgcaaaaagtcgtgcagaagctgctttagaggaagaaagtcgacagagacaatctcgcatggagaaaggagaaccgtacatgagcattcagcctgctgaagatccagatgattatgatgatggcttttcaatgaagcatacagccaccgcccgtttccagagaaaccaccgcctcatcagtgaaattcttagtgagagtgtggtgccagacgttcggtcagttgtcacaacagctagaatgcaggtcctcaaacggcaggtccagtccttaatggttcatcagcgaaaactagaagctgaacttcttcaaatagaggaacgacaccaggagaagaagaggaaattcctggaaagcacagattcatttaacaatgaacttaaaaggttgtgcggtctgaaagtagaagtggatatggagaaaattgcagctgagattgcacaggcagaggaacaggcccgcaaaaggcaggaggaaagggagaaggaggccgcagagcaagctgagcgcagtcagagcagcatcgttcctgaggaagaacaagcagctaacaaaggcgaggagaagaaagacgacgagaacattccgatggagacagaggagacacaccttgaagaaacaacagagagccaacagaatggtgaagaaggcacgtctactcctgaggacaaggagagtgggcaggagggggtcgacagtatggcagaggaaggaaccagtgatagtaacactggctcggagagcaacagtgcaacagtggaggagccaccaacagatcccataccagaagatgagaaaaaagaataagtgttgccttgttttgtgtgttctaaatactttttttaatgaaaaaatgttttttggttttaatggtgttacgtggtttgtgtattaattttttttcttgtccatatcacaccaccaaaggcttttggaccatttagcatcatgagcctaatggctcagtcagtcacctttcttaagtgttgtgaagatggctcttttctttggatcttgtttctagccctcaactgctgaaagcctcagaatttagattaattgagaaaacacccacctcttttagagaattatcctttgatgctgcagaatctactcttacaatgccttcctacagctcactggggtgcttaccaaagccatagctttaaaccttcccagtccccatcagtagcttcctgaaagtctcctctcttgtttacttctgcaaagggtagcttcttaaaaacgtgatcatgtatgagtatgtatttgttcacttacccttttttacttttaatcaatgtcagataccaagagttgtgttaagctgagtgtagtgtgtaactaactacacttggatcttactgatccagaaatagtccccatagttagagtagttacttatgaagtggttattaaagtgaacacagcacatatacattatctatactgctttttgttatgattaatactgggtatgttctggtaaatccatccttattgtatagaaaaaaaattacttttttaccaggttttccaaagacagaatagatcacaaagctcaaggaatttaatattcttgtaatggactagataattcaaactgattagcccattccagaagaaaaacagctgggaattaagttaatccacttgaaattgttttacaataatcagaacatccaaacctcaaggctcaggatcccatagaccagagcccacctttttgataaacttagtaaagtcttggagactagaagcaagatagtttgtgacacataagcttcccaaaaactagaatagatttttactgaatagtggtatatctgatggtatatgtttcttaaaggtccaaatgtaataaaaaaaaaaatgaaaaaaaggtctcagtgtttttaatgcactacatatttgtatgcaagacaagcatccagtttttttctgtaatgcagtgacagtgtggaatgaccactcagccattataaatttgtgtactcagggcccttgtctcacccaactatctctataaactgctgcagtagcttatttgtacaagacacttgtgaaaatcagttttcttacattatagtcattgtcacatatggaagttggtctttgattccaaaagtaaagggaatatgtttctacattaacaggaatatggagaaatctgtaacgtttgaattatctttgaaagaatggctaaatgataaatgttaagtcctgtgcctatatggagaggactctgtaccagcatgagttaatttaagtggattcactgctattcagttcatagcacattagtgactaggaatgtgtgttcagcctcctgagagaggaggggaggaagcttgatactgggtggaaacaactcttgacatctgtttccttgtgtgtcaaagaacgaatttgtatcaaatagatctgttttgagctttggccattatttggctaagaacttcagccatctcatctcagacaaattggacagcctctttgatacattttctagtagtcaaaatggggcagatgtagtttaatatgggtggaaaactgccccagcaagataccaggttatttactgtggtatcgaaagctctaagagaatggaagtggttcttttgcccggctggaaatagcagtgggaagacaagtctatccagaccaagcctgtccatacaacactggcaatcagttgatgagggaattaagtcagatgggagacgtctcaatctgtcgcccaggttggagtgcagtggtggcgatctcagctcactgcaacctccacctcccaggttcaagcaattctctctgcctcagcctctagagcagctgggattacaggctctcgccaccatgcccggttaatttttgtattttttagtagagatggggtttcaccatgttagccaggctgatcttgaactcgtgacctcaggtgatccgcctgcctcagtctcccaaagtgctgggattacaggcgtgagccactgtgcccggcctcagttgggatttgacagctctgaacctcagcaggggaagattgatgtaaaaatccacttggtcagagtgatatatgtagacttgatgtttgagatggttctcagtttagagaatgtgggatatggtagaggtctttgtttttttcccatgtcccaaaaggtgctgggcaagtagcttgaactcgagcctgttttaattataaaatagatcaaactgctctttcttggtgcccttactgctccttgatttttagtgcatttattttgagtatgaatgcataaagtctgagggcctaaattttgttaattttttttaacaaatgggagaggggaatcctcgatagtcacccaattttcctttttttttgagacagtctgactgttgcccaggctggagtgtaatggcgccatctcggctcactgcaacatccagctcctgggtttcagcaattctcctgcctcagcctcctgagtagctgggattacaggcgcccgccaccacgcccggctaatttttgtatttttagtagagacaggattttgccatgtttgccagcctggtctcgaactcttgacctcctgatccaccctcctctgcctcccaaagtgctgggattacaggcgtgagccaccgcgcccagccccatagtcccccaattttctaacagttttaaattctgtaacttctcctgtctgtaaacaaggctgtcttttcaaatggctctcctacaggatgtgataattatctattctataaagccgaggtttggagaggtaaatagctatttcacattaacacaataatgtcaatgccctatggaaaagataaaatacttggactatattttaaaggggaatctggggtcatgcatattgaagtttaactagatccctccagatttttggttttgatcctacacatttagatactagttttggattttagacagttggtgctgacagtgtgaaactcctattgcctgcagttaaattgaagctttggtttctcgtgaacaggcagtgaagctggtattatactttaagtcctcatttcagaaatagtttccctccacccccaagcactaccacacatggtctccccacctggtttcagctagtgcattagttttatcttgttttttaccgctgggcaaaccttgctggaacaacaactgacttcatgatttgcacatttggagggcttaacgtctttgcaaatgaaaaatccactgtacaataacaagctcaaaggaactcggagcctttttagaagaaatcgtgctgaattataatgtggcttactgcaataatgtttctttgatcaggatggaaaggaaaatactgagtttagcagaaaacgatgtctaaatgtatttgtaatgatacaattgtttataaatgttttactattaggttgaaccataagaaattgccagtgtacaatttcatctacaaaatgactggcttaacctaaattctgcattttatactccaagaataagctcttcgtggcagctttctaagtgtgaaatgatggaactttctatttgccagaatgacctacacttctctaatagtttatctcatattgttagccaaacgctgattaaaatgcaaatttcaaacta

SEQ ID NO: 2300 - DNA, 1307 bp, Homo sapiens
caaagggaagcgaagccggagctgcgggcgctttttctgcccgcggtgtctcagattcattcttaaggaactgagaacttaatcttccaaaatgtcaaaaagaccatcttatgccccacctcccaccccagctcctgcaacagcatcctctggtatcacgattccaaaacccccaaagccaccagataagccgctgatgccctacatgaggtacagcagaaaggtctgggaccaagtaaaggcttccaaccctgacctaaagttgtgggagattggcaagattattggtggcatgtggcgagatctcactgatgaagaaaaacaagaatatttaaacgaatacgaagcagaaaagatagagtacaatgaatctatgaaggcctatcataattcccccgcgtaccttgcttacataaatgcaaaaagtcgtgcagaagctgctttagaggaagaaagtcgacagagacaatctcgcatggagaaaggagaaccgtacatgagcattcagcctgctgaagatccagatgattatgatgatggcttttcaatgaagcatacagccaccgcccgtttccagagaaaccaccgcctcatcagtgaaattcttagtgagagtgtggtgccagacgttcggtcagttgtcacaacagctagaatgcaggtcctcaaacggcaggtccagtccttaatggttcatcagcgaaaactagaagctgaacttcttcaaatagaggaacgacaccaggagaagaagaggaaattcctggaaagcacagattcatttaacaatgaacttaaaaggttgtgcggtctgaaagtagaagtggatatggagaaaattgcagctgagattgcacaggcagaggaacaggcccgcaaaaggcaggaggaaagggagaaggaggccgcagagcaagctgagcgcagtcagagcagcatcgttcctgaggaagaacaagcagctaacaaaggcgaggagaagaaagacgacgagaacattccgatggagacagaaaaaaattgccagctctgtcctagaaaaacccttacttctaggtatactgattttcctgattaaaagcatccctcaagaggagacacaccttgaagaaacaacagagagccaacagaatggtgaagaaggcacgtctactcctgaggacaaggagagtgggcaggagggggtcgacagtatggcagaggaaggaaccagtgatagtaacactggctcggagagcaacagtgcaacagtggaggagccaccaacagatcccataccagaagatgagaaaaaagaataagtgttg

SEQ ID NO: 2301 - DNA, 943 bp, Homo sapiens
ctgctgaagatccagatgattatgatgatggcttttcaatgaagcatacagccaccgcccgtttccagagaaaccaccgcctcatcagtgaaattcttagtgagagtgtggtgccagacgttcggtcagttgtcacaacagctagaatgcaggtcctcaaacggcaggtccagtccttaatggttcatcagcgaaaactagaagctgaacttcttcaaatagaggaacgacaccaggagaagaagaggaaattcctggaaagcacagattcatttaacaatgaacttaaaaggttgtgcggtctgaaagtagaagtggatatggagaaaattgcagctgagattgcacaggcagaggaacaggcccgcaaaaggcaggaggaaagggagaaggaggccgcagagcaagctgagcgcagtcagagcagcatcgttcctgaggaagaacaagcagctaacaaaggcgaggagaagaaagacgacgagaacattccgatggagacagaaaaaaattgccagctctgtcctagaaaaacccttacttctaggtatactgattttcctgattaaaagcatccctcaagaggagacacaccttgaagaaacaacagagagccaacagaatggtgaagaaggcacgtctactcctgaggacaaggagagtgggcaggagggggtcgacagtatggcagaggaaggaaccagtgatagtaacactggctcggagagcaacagtgcaacagtggaggagccaccaacagatcccataccagaagatgagaaaaaagaataagtgttgccttgttttgtgtgttctaaatactttttttaatgaaaaaatgttttttggttttaatggtgttacgtggtttgtgtattaattttttttcttgtccatatcacaccaccaaaggcttttggaccatttagcatcatgagcctaa

SEQ ID NO: 2302 - DNA, 1569 bp, Homo sapiens
aggggcggggcgagcgcgggacaaagggaagcgaagccggagctgcgggcgctttttctgcccgcggcaaatgcccagcacaccagggtttgtgggatacaatccatacagtcatctcgcctacaacaactacaggctgggagggaacccgggcaccaacagccgggtcacggcatcctctggtatcacgattccaaaacccccaaagccaccagataagccgctgatgccctacatgaggtacagcagaaaggtctgggaccaagtaaaggcttccaaccctgacctaaagttgtgggagattggcaagattattggtggcatgtggcgagatctcactgatgaagaaaaacaagaatatttaaacgaatacgaagcagaaaagatagagtacaatgaatctatgaaggcctatcataattcccccgcgtaccttgcttacataaatgcaaaaagtcgtgcagaagctgctttagaggaagaaagtcgacagagacaatctcgcatggagaaaggagaaccgtacatgagcattcagcctgctgaagatccagatgattatgatgatggcttttcaatgaagcatacagccaccgcccgtttccagagaaaccaccgcctcatcagtgaaattcttagtgagagtgtggtgccagacgttcggtcagttgtcacaacagctagaatgcaggtcctcaaacggcaggtccagtccttaatggttcatcagcgaaaactagaagctgaacttcttcaaatagaggaacgacaccaggagaagaagaggaaattcctggaaagcacagattcatttaacaatgaacttaaaaggttgtgcggtctgaaagtagaagtggatatggagaaaattgcagctgagattgcacaggcagaggaacaggcccgcaaaaggcaggaggaaagggagaaggaggccgcagagcaagctgagcgcagtcagagcagcatcgttcctgaggaagaacaagcagctaacaaaggcgaggagaagaaagacgacgagaacattccgatggagacagaggagacacaccttgaagaaacaacagagagccaacagaatggtgaagaaggcacgtctactcctgaggacaaggagagtgggcaggagggggtcgacagtatggcagaggaaggaaccagtgatagtaacactggctcggagagcaacagtgcaacagtggaggagccaccaacagatcccataccagaagatgagaaaaaagaataagtgttgccttgttttgtgtgttctaaatactttttttaatgaaaaaatgttttttggttttaatggtgttacgtggtttgtgtattaattttttttcttgtccatatcacaccaccaaaggcttttggaccatttagcatcatgagcctaatggctcagtcagtcacctttcttaagtgttgtgaagatggctcttttctttggatcttgtttctagccctcaactgctgaaagcctcagaatttagattaattgagaaaacacccacctcttttagagaattatcctttgatgctgcagaatctactcttacaatg

SEQ ID NO: 2303 - DNA, 536 bp, Homo sapiens
cttagtgagagtgtggtgccagacgttcggtcagttgtcacaacagctagaatgcaggtcctcaaacggcaggtccagtccttaatggttcatcagcgaaaactagaagctgaacttcttcaaatagaggaacgacaccaggagaagaagaggaaattcctggaaagcacagattcatttaacaatgaacttaaaaggttgtgcggtctgaaagtagaagtggatatggagaaaattgcagctgagattgcacaggcagaggaacaggcccgcaaaaggcaggaggaaagggagaaggaggccgcagagcaagctgagcgcagtcagagcagcatcgttcctgaggaagaacaagcagctaacaaaggcgaggagaagaaagacgacgagaacattccgatggagacagaaaaaaattgccagctctgtcctagaaaaacccttacttctaggtatactgattttcctgattaaaagcatccctcaaggtaaaaaataataataataacttgtataaataaaacttacataaagta

SEQ ID NO: 2304 - DNA, 1644 bp, Homo sapiens
gtgtctcagattcattcttaaggaactgagaacttaatcttccaaaatgtcaagcatcctctggtatcacgattccaaaacccccaaagccaccagataagccgctgatgccctacatgaggtacagcagaaaggtctgggaccaagtaaaggcttccaaccctgacctaaagttgtgggagattggcaagattattggtggcatgtggcgagatctcactgatgaagaaaaacaagaatatttaaacgaatacgaagcagaaaagatagagtacaatgaatctatgaaggcctatcataattcccccgcgtaccttgcttacataaatgcaaaaagtcgtgcagaagctgctttagaggaagaaagtcgacagagacaatctcgcatggagaaaggagaaccgtacatgagcattcagcctgctgaagatccagatgattatgatgatggcttttcaatgaagcatacagccaccgcccgtttccagagaaaccaccgcctcatcagtgaaattcttagtgagagtgtggtgccagacgttcggtcagttgtcacaacagctagaatgcaggtcctcaaacggcaggtccagtccttaatggttcatcagcgaaaactagaagctgaacttcttcaaatagaggaacgacaccaggagaagaagaggaaattcctggaaagcacagattcatttaacaatgaacttaaaaggttgtgcggtctgaaagtagaagtggatatggagaaaattgcagctgagattgcacaggcagaggaacaggcccgcaaaaggcaggaggaaagggagaaggaggccgcagagcaagctgagcgcagtcagagcagcatcgttcctgaggaagaacaagcagctaacaaaggcgaggagaagaaagacgacgagaacattccgatggagacagaggagacacaccttgaagaaacaacagagagccaacagaatggtgaagaaggcacgtctactcctgaggacaaggagagtgggcaggagggggtcgacagtatggcagaggaaggaaccagtgatagtaacactggctcggagagcaacagtgcaacagtggaggagccaccaacagatcccataccagaagatgagaaaaaagaataagtgttgccttgttttgtgtgttctaaatactttttttaatgaaaaaatgttttttggttttaatggtgttacgtggtttgtgtattaattttttttcttgtccatatcacaccaccaaaggcttttggaccatttagcatcatgagcctaatggctcagtcagtcacctttcttaagtgttgtgaagatggctcttttctttggatcttgtttctagccctcaactgctgaaagcctcagaatttagattaattgagaaaacacccacctcttttagagaattatcctttgatgctgcagaatctactcttacaatgccttcctacagctcactggggtgcttaccaaagccatagctttaaaccttcccagtccccatcagtagcttcctgaaagtctcctctcttgtttacttctgcaaagggtagcttcttaaaaacgtgatcatgtatgagtatgtatttgttcacttacccttttttacttttaatcaatgtcagataccaagagt

SEQ ID NO: 2305 - DNA, 982 bp, Homo sapiens
atgcagcggcgtggccagagggacctgtggcgtcacaacaaaagctgcgcacgcaaccgctgtccccgcccacctcgggagaggggcggggccggctttccttgggtgcgcgcgcagctttctgtgcgccagttcacactccgggtcagagttcctggcccggtgcacctgagaggtcgctctccgactcccgcgctggaccctcttgcgccattgaaccccctgatccgggggcctcggaccccagggctcaggagatggatccagtccctggcgctcctacttcccaactgctcctcctcccgcatccccacagtaccccgtcctcacagcgggctgtgggtccaatcagactttcccctcggattcctctctaggactgaaccaagacttacccgaagttgccgcggggccttccgatcccctaggccattgcccaagtctggccaggctgatgggaccagcgaggagtctctgcaccttgacattcagaaactgaaggagaagagggacatgctggacaaggagatctcccagttcgtatctgaaggctacagtgtggatgaactggaggaccacattacccagcttcacgagtacaatgacatcaaggatgtggggcagatgctgatgggcaaactagctgtgatccgaggtgtcaccaccaaagagttgtatccagagtttgggctggacatgaatgactgagcaggctcatcgccccttgtccacagctcccagggacagaagggtgtggacatgataaacactgagagcccaaccagcacacctacagagtttccagcgagacaatgccagaagcacttttctagagagcccaagcccaatcaggaggaggctagagaagaggcgggcagggaggaaggggcgttcccagctccaaggttcctgaaatgtcgcagtgatacttgtgtaggggtacatgtactttatttgtcaataaacgtatctgtacactgat

SEQ ID NO: 2306 - DNA, 1583 bp, Homo sapiens
agtcggctgtggagtcgagttgagctccctttccgggtctggggaactcaacctcaccttatgcctggggtctccggggaactagtgggctttctgcaacggggggaaggaggggacgactcccgcccctagtttacccctcaaaagttaatgcctttgtcggaggaagcaatttcagtccactctccttttcagtccctgttggccgcttaaactaaaaggctacagacgggcttaaatgcgtctccgctgtgtttcttatgcctcgggccggcagggtaacgggttctagtcacagcttgtagagttcaggatgggtgacattcaggtcctattgtttttgagtcaaggtttcggctatagcttcttgaattatgaagctgtcataataaagaattcctgattatctaaagctgttattcttccctacttccaaggcagaatttgaatatattttggtggatgaaacgaaaacaaggagagtcttgtgactatgagatactagctggttgatgtatcatgaaaaacttagtggtccctatgtgggaaggtaaatggaaaactgcaaaaagagcaagaatgaattacaaagtgaaattagaagaaatatctggcttacttgtggatgctttgtacaccaatacaatatattatttgataaaagtcgactatagagaggtgtggttaattcgattattttataatttttcttttttagagaaaaaccaagatttcactttcaagatggaaagtccgtcagactcagctgtggttttacctagcactcctcaggcctctgcgaatccatcatctccctatacaaatagttcccgaaaacaacctatgagtgcaacacttagagaaagattaaggaaaacaagattttcatttaattcctcttacaatgtggtgaaacgtcttaaagtagagagtgaagaaaatgatcagaccttttcagagaaaccagcatcttccacagaggaaaactgtttggaatttcaagaaagttttaaacatatagacagtgaatttgaagaaaatacaaatttgaaaaatactttgaagaatctcaatgtctgtgaatctcagtcacttgattctggatcatgcagtgctctccaaaatgagtttgtgagtgagaagcttcctaaacaaagattaaacgctgaaaaagccaaattggtgaagcaggttcaggagaaagaagaccttcttcggaggctaaaactagtcaaaatgtatagatcaaagaatgatctgtctcagttacagttgttaataaagaagtggagaagctgtagccagctcttgctttatgagttgcagtcagctgtgtctgaagagaacaagaaactaagccttactcaattgatagaccactatgggttagatgataaattactacactataacagaagtgaagaagaatttatagatgtttaattcctgatttttgctccagaatatctttgagaatgacaacttaattaaaagatacttaggcactttttttttttttttgagactgagtttcgctcttgtcatcctggctggagtgtgatggtgcgatcttgactcactgc

SEQ ID NO: 2307 - DNA, 1438 bp, Homo sapiens
ttttttgctctcgctgggaatggcggagggagagaaaaaccaagatttcactttcaagatggaaagtccgtcagactcagctgtggttttacctagcactcctcaggcctctgcgaatccatcatctccctatacaaatagttcccgaaaacaacctatgagtgcaacacttagagaaagattaaggaaaacaagattttcatttaattcctcttacaatgtggtgaaacgtcttaaagtagagagtgaagaaaatgatcagaccttttcagagaaaccagcatcttccacagaggaaaactgtttggaatttcaagaaagttttaaacatatagacagtgaatttgaagaaaatacaaatttgaaaaatactttgaagaatctcaatgtctgtgaatctcagtcacttgattctggatcatgcagtgctctccaaaatgagtttgtgagtgagaagcttcctaaacaaagattaaacgctgaaaaagccaaattggtgaagcaggttcaggagaaagaagaccttcttcggaggctaaaactagtcaaaatgtatagatcaaagaatgatctgtctcagttacagttgttaataaagaagtggagaagctgtagccagctcttgctttatgagttgcagtcagctgtgtctgaagagaacaagaaactaagccttactcaattgatagaccactatgggttagatgataaattactacactataacagaagtgaagaagaatttatagatgtttaattcctgatttttgctccagaatatctttgagaatgacaacttaattaaaagatacttaggcactttttttttttttttgagactgagtttcgctcttgtcatcctggctggagtgtgatggtgcgatcttgactcactgcaacctctgcctctcgggttccagcaattctcctgcctcagcctcccgagtagctgagattacaggcgcccgccaccatgcccggctaatttttgcatttttagtagagactgggtttcaccacgttggccaggctggtctcgaactcctgacctcaggtgatccaccgcctaggcctcccaaaaccattagggctcagaggaaggtatcccaatgaatatcaattaagggcactttaatatataaattataaactaagttctaaaaggaaaattagtattttggatagatttgtcaaaacgacatttaagtcatgtttaaaaagtcatttgggcagttctggaaactagttttaatacatttgttttttatgacaaaaagttttattttaaatgttaaaaattgtccaatctggtgaatgtctaaccctaaagtttaaaaatttctgcctcctaagtttatgtaccttgtttccatccatttaccacatatttccatctgatagtctagcaggtaattaaacttatatgtccaaaaccata

SEQ ID NO: 2308 - DNA, 1503 bp, Homo sapiens
agcggcgcctcgcgcgtcaggcaatctggccaattgcgcatcttttccgcctaccgcacggccccgcccctgccacaggatcgatttacggccgcagagaaaaaccaagatttcactttcaagatggaaagtccgtcagactcagctgtggttttacctagcactcctcaggcctctgcgaatccatcatctccctatacaaatagttcccgaaaacaacctatgagtgcaacacttagagaaagattaaggaaaacaagattttcatttaattcctcttacaatgtggtgaaacgtcttaaagtagagagtgaagaaaatgatcagaccttttcagagaaaccagcatcttccacagaggaaaactgtttggaatttcaagaaagttttaaacatatagacagtgaatttgaagaaaatacaaatttgaaaaatactttgaagaatctcaatgtctgtgaatctcagtcacttgattctggatcatgcagtgctctccaaaatgagtttgtgagtgagaagcttcctaaacaaagattaaacgctgaaaaagccaaattggtgaagcaggttcaggagaaagaagaccttcttcggaggctaaaactagtcaaaatgtatagatcaaagaatgatctgtctcagttacagttgttaataaagaagtggagaagctgtagccagctcttgctttatgagttgcagtcagctgtgtctgaagagaacaagaaactaagccttactcaattgatagaccactatgggttagatgataaattactacactataacagaagtgaagaagaatttatagatgtttaattcctgatttttgctccagaatatctttgagaatgacaacttaattaaaagatacttaggcactttttttttttttttgagactgagtttcgctcttgtcatcctggctggagtgtgatggtgcgatcttgactcactgcaacctctgcctctcgggttccagcaattctcctgcctcagcctcccgagtagctgagattacaggcgcccgccaccatgcccggctaatttttgcatttttagtagagactgggtttcaccacgttggccaggctggtctcgaactcctgacctcaggtgatccaccgcctaggcctcccaaaaccattagggctcagaggaaggtatcccaatgaatatcaattaagggcactttaatatataaattataaactaagttctaaaaggaaaattagtattttggatagatttgtcaaaacgacatttaagtcatgtttaaaaagtcatttgggcagttctggaaactagttttaatacatttgttttttatgacaaaaagttttattttaaatgttaaaaattgtccaatctggtgaatgtctaaccctaaagtttaaaaatttctgcctcctaagtttatgtaccttgtttccatccatttaccacatatttccatctgatagtctagcaggtaattaaacttatatgtccaaaaccata

SEQ ID NO: 2309 - DNA, 6129 bp, Homo sapiens
tctccctgggagtcgcgcagagtggagtcaaaggcaaccagtgctcgctgcggtctctggggatcgggaccgcggcggcggcccgcgagcgggatgttccggggcttgagcagttggttgggcttgcagcagccggtggcaggcggtgggcagcccaatggagatgctccacccgagcagccgtccgagacggtggctgagtctgcggaggaggagctgcagcaagcgggagaccaggagctcctccaccaggccaaagacttcggcaactatttatttaactttgcatctgctgccacaaaaaagataactgaatcagttgctgaaacagcacaaacaataaagaaatccgtagaagaaggaaaaatagatggcatcattgacaagacaattataggagattttcagaaggaacagaaaaaatttgttgaagagcaacatacaaagaagtcagaagcagctgtgcccccatgggttgacactaacgatgaagaaacaattcaacaacaaattttggccttatcagctgacaagaggaatttccttcgtgaccctccggctggcgtgcaatttaatttcgactttgatcagatgtaccccgtggccctggtcatgctccaggaggatgagctgctaagcaagatgagatttgccctcgttcctaaacttgtgaaggaagaagtgttctggaggaactacttttaccgcgtctccctgattaagcagtcagcccagctcacggccctggctgcccaacagcaggccgcagggaaggaggagaagagcaatggcagagagcaagatttgccgctggcagaggcagtacggcccaaaacgccacccgttgtaatcaaatctcagcttaaaactcaagaggatgaggaagaaatttctactagcccaggtgtttctgagtttgtcagtgatgccttcgatgcctgtaacctaaatcaggaagatctaaggaaagaaatggagcaactagtgcttgacaaaaagcaagaggagacagccgtactggaagaggattctgcagattgggaaaaagaactgcagcaggaacttcaagaatatgaagtggtgacagaatctgaaaaacgagatgaaaactgggataaggaaatagagaaaatgcttcaagaggaaaattagctgttcctgaaatagaagaataatccttaacagtctgcaaactgacattaaattctagatgttgacaattactgaatcagaaggcatgaaagagtataattttatgaaattcaaaattattcttttttcaagttgaaacttgcctcttctactttaaaaaagtatatagaacagttacttctaataatcagaaagagatgttttatagaacatttctttaatataaagttagagatgtcttcataggcagtatggctatctttgccacagaaacataagtaaaattttagagttctgttttccatgaggtcaaaaatataatttattcctcagtcatggttttctaaatatctgtactccacattccattttaattgatatgagggtgttaaagtacctacttaatgggttgattactatcaaaatgaccaaattataccaaagaacttaagaggaagcactttcagaactattcacttgccaggtattttctaaaattccacctgaaagccaaaagataaaataaataagttgattttaatgatataagcatcacacaattttacattaagaaatactgtgcaggccatgcgtggtggctcaggcctgtaatcccagcactttgggaggccgaggtgggcagatcaccggaggtcaggagttcgagaccagccttgccaacatagtgaaaccctgtctctactaaaaatacaaaaattagccgggcatggtggcaggcacctgtaatcccagctactagggaggcttttgaacccaggaggcagaggttgcagcgagctgagatcgcgccactgcactccagcctgggtgatagagtgagattcagtctcaaaaaaaaaaaaaaaaaaaagctgtgcgaaaatatttgtttttctctggggccttttctttcttttctttttaaactataccagaaattttacatcacagtttttatacaaagtgggaccttccatactttttgtattacaataaccttcagaagcccattccccttaaagtctgttgttcttgttttaatcatcaccacatataaatgttttagctttgtcttaaactgtgagtcttcataaaattgtgttcctccgagttcaccttctaggactttattgattaatccttctctttctgctataccagcagacacatattcatagaatatgattatttttaaagaacaaggtgaggaggctgaggcaggagaattgcttgaacctgggagatggaggttgcagtgagctgagatcacgccactgcactccagcctgggtgacagagtgagagactccgtctcaaaaatgaatgaatgaatgaatgaatgaatgaacgaacgaacaaggtggtttaatgtcagaaaacttcctaagcatttgctccccaaacctttcatgtttttcaagaagcctttattacataaaggggaatagaattaaaatgtttctttataagaaaaatatacatatttgtgttcttggccccattaaaactagtcagtagtcctttggcaaagatatagtcaacaagagaactgggtatgagtccaggcattactcctgttcatagttgtggatgcatgtgtctgagccagactgtctcaactggagtctcttgggttatagcagtaaacccgtgtattccatgaaaccactgggcccatcatcaaaaggtttccacttgtggtgccacagttgcttattactgagtttgggttccaagatgactggcaacttctgaaataatctcattgaaggaaagagtttcattttttttttaaaagagtttgctggaggaaaagaagcatgttaaatgtttttaagcagctaaaagtcctagatggaagcatatcaggatgtgtcggtgcttggctcttagtgaatgcactaaaattcttattgataaatgttgaataaacacacacaaaaaagtatcagagaaagagaaaaaccctacaatggcaatagaggtgtgtgacagttattgctatcaattttacataatatctcatttaaaaacaacctaattatgcattgcctgtgaaaataaaaggataaaataagattttgtacatactgtaagaatacagttgtgctgtatttttatggattcatcaaggagtaaaatgttctgctttagtaaattatataggtaactgaagtgttattcctttaaagagcaaaataatttatcaccatgtttggtggaaaatttctaagtatttattacatgcctaggggttagccaacaagatataccaagcatgaaaacctgtaaaacttaataaaatgctaaaatatgaacatcacactatggagattatgcctcactactcaaagagtgtggctcaggaaccagtgtagcttggccatgccctggcagtatgttggaaatgcctgccccagaccagttgatgttactaagaacgcccaggggatgagaatggactttatttacagtttgggaagcactggtctaatatgctctcagggaagctgaggtttctactgctttttactttttacccttccactagatgtcctttgcagcagtgtttttctagttggcattacaggtgtctcctctgaggttccagttatttctatactaccaaaattaaaaagacccaagggctgggcatggtggttcacacctgtaatcccagcactttgggaggctgaggcaggcagattgcttgagctcaggagttcaagaccagcctgggcaacatagggagacccctgcctctacaaaaatacaaatgagccaggtgtggtagcccacacctgtggtcctagctacttggaaggctgaggcaggaggatcgcttgagcccaggagatccaggctgcagtaagccatgatcatgccactgcacttcagcctgggtgacagagactctgtttcaaaaaagggagggggggcaagtttttagggggatgagaaatattcttggtaaatcgggcatttctttttttgtttgtttttttttcttggagacagaatcttgctctgtcacccaggctggagtgcagtggcttgatctcagctcacggcaacctccgcctcccaagttcaagcgattctcccacctcagcctccagagtagctgggattacaggcaaccgccaccatgcccagctaatttttttgtatttttagcagagatggggtttcaccgtgttggccaggctggtctcaagctcctgatctcaaatgatccgcacgccttgacctcccaaagtgttgggattacaggcatgagccacagccttaattggtaatttttgaaaaaaaaactagagaaacattgtttcagagataaagcagcaattacacttgtactcccagtgatttaagatgcactattgtaatcaagatgatttgctttaatcaaaatattgttaaaaataggatttcaggacatttaaaaggtttcagcagaaatcttatgattatgtctgacttgcagtattttatttgcctctttgacggctttttttttttttttttttttgagacagagtctcacactgttgcctgggctggaatgcaatggcgcagtctcagctcactgcaaacctccggctcccgggttcaggcagttctcctgcctcagcctccctagtagctgggattataggcatgtgccaccacacccggctaatttttgtatttttagtagagacagggtttcgccatgttggtcaggctggtcttgaactcccaacctcaggtgatccgcccgcctcggcctcccaaagtgctgggattacaggcgtgagccactgcgcccaaccttaatggctttttggtattaaaaaccaggactctgaatgtgcatcaataattcaaataattttatatagttactctttctagtaatagatacccccctccatttttaagtaaagataaacattttttaattaggaaaattaggcacatttaattttagcaaatttagtttttcaacttttttttttttctttttttttttttttgagatggaggctcactctgttgccctggctggagtgcagtggccgcaacctcggctcactgcaacctccgcctcctgggttcaagtgattctcctgcctcagcctcccgagtagctgggattacaggcgtgtgccaccacacctggctaatttttgtatttttagtagagacggggtttcaccatgttggccaggctggtcttgaacgactggcctcaggtgatccgcccacctcggcctctcaaagtgctgggattacaggcatgagccaccatgcccagccagtttttcaacttttaaaaataaaagtggtagaatttttttttttctttttgagacagggtcttgctctgtcactcaggctagagtgcagtggtgggatctcagctcactgcagcctccgcctcccaggcttaagggatcctccctcctcagcctcccgagtagctgggaccacaggcatgcaccaccacgcctggctaatttttgtattttttgtagagatgggtgtctccccatgttgctcaggctgttcttgaacttctgagctcaggtgatctatctgcctcggccttccaaagtgctgggattacaggcatgatgagccactgcacctggccaaaagtggcagaaattttgatatggtttataatcagttttattgtggggaagatgggccattttaatgaatgattatttctattggctaaactaccgagtcacgacatgacaaatacacatgaagctttaatcacatgcagttatatacttctcacaaatcatcaaattatttatctggtcttcacactaagggatttacttagataagccatcgatgatttcagttgttaaaagtgtggctttttaaacagcatttattcagtgcatcctgatttatttcaaaatgaaaaattgttacctttttttctgaataaataaagcttacttttagtggcaa

SEQ ID NO: 2310 - DNA, 3130 bp, Homo sapiens
gagtgctggctttctcttaaagggtgagtgcgtgcgcccaggtggtttggcctgtgtgcgctagttacttgcacgcgcttcttgagtctcaaaacacagagctctagtaaacttcagggggcggattcgtcaattacagttgcggaagaagactcgactcgaagagcggtccgccaccagggctctttcggcagcgcccccagcgggcggggctcttgggcggggaagcaggagagggccgaccgagcgcaacaaagctgagcggcgcgtcgcttcaggaacgaagaagcctcgttatgcaagcgaaaaacaaagatgctttgcagcctattaaggaagacaggactgggaaggcccaggatgatgctttctggcttcaatcacttattacggatgcattccatgataaaggatttcagaaaataaaagaatactttcaacagaaagagagccactttcctcaaaaatataatcgtcttctattataccgtcttgacagatcaataaataaggaactagataaaaatgaatttcagtctgtgtcactgttgctgaaatgtattcagcgattcctcgtagatggcctgaaagaagatgaacctctgctaattcggcagggactgatcccaaagctagtttcctggtttgaaagaacaacaggaattctgacctcggaaggcctagcctcagacacgtcgctgatttgtgttatagaagatttctttgacactgcattgattatttccaggagtagtagtgaagggaaaattcagatgttggattccttcctacttagcttaggattcctggtgacagaaaagactgtaaatcatttgcttcaacaggagggcttgaagacttttaactgcattttgcacgctgtccctcgagaagagagaaaaaaattccctttgtcagaaggcatgtgtcatcttatgaaagaccttgcaaggacactcttgactgtgggtgattatgaccagcaggttgctatttctgaagcgctgtgtagactgacgattaaaaaatcaagggatgaacttgtccataaatggtttgatgatgaagtcattgctgaagctttcaaagaaattaaggatcgagaatttgagacggacagtagacgttttctcaatcacctaaacaacagacttggtgaccaaagaagggtgtattcatttccgtgtattgctgcttttgctgatgagcatgagatgagaaaaccagcggatgaaaaattagagaaattttggatcgacttcaacctaggaagtcagagtgtcactttttatatagacaatgctgagaatactctatgggactcagtgacacttccgaaggaagcggtgatgaatttcagcataacagaaacggagaagataaagatatttatcatttacctgaagaagcccatgattatcagctacaaagaagtcatgaaaatagaaatccattttgatttgcagttcaacatatcacaagtttccattcaagctttaggagaagacaaacagatgttgcctgaccagacgaaaatctcctcagaactttttagtaagtctgataaagaagacagggagagtcccagtggccttgaaagagaaacagagcaggcagaagaatccactaacatggtggagtttatgagtgctgaagatgaccgctgcctaataactctccacttaaatgaccaatctgagccacctgttattggggaacctgcctctgatagtcaccttcagccggtccctccgttcggggtccctgacttcccgcaacaacctaagtctcattacagaaaacatctcttctctgagagtaatcaagattcaagtaccagtgaactatcttggaccagtaaccagaaaaagaaatccctaaaatcatattccagtagaaagaagacaagaaccagaagtaatttgagaatcttgccagttttccctcccagtagtggcagtggccatgagaaagaccaagctaagcttctatcaccatcagagaaagaaatacccgagcaaaataacaccacatctccaaagacttctgaacaaaaattccaagatagttttgcttttttgactgctgaagattctgcccagaaaacagagcttcaagatcctcactcactgagtgagctctcttccttgaagcactcagaagatgaagaaaaacctaagattgtgaaccaagaatcactaacagaaagtactagcttgaaacataagctgagaaacttggaagacaaagacataccagaaggtagttttgctaagtcacaacaatcaagattggaagaagaggttgctccgggatcccctttctcaataacagaagaaagagagttgccagaaggaatttccacttcatccctagaagttgtgccagagaacttgaacggttctgccattctcccaacctttgaaaacttcactaaaaaacggaaaagaaaatatgagcttaggtacagaaagcgtccgtttaattcagaaaatgcaaagaaagcaccggattgcctaataaaacttttaaaccagatgcaactgttcagactcaataaactagagcgctttcaaaatttggttcttcaagagttgagcagtcttaagcaggatattcaggccctggaacaccttgagaaggaggttctggaattctgggggaaacagtctgctgatctgcaatctttctgtgatctgcaagtgctgaggttcaattcaactcagacttcataagaaagccaaagcctggttttatgattgcagccctcagcctgggctgcctgaagacgaagagaaagagcaaggttattgttggctcaggccttgttagccagacttcgtgctctgtacgcattcaatttcctcccctccaaacatcatccctgggaactgctgagttcagatagaatatatgttggtagtttgcagttgggttattatccatttgttcataaaaattaaccttttgtattaaaatttggtcagatagtattaatagaaagttcaggatgttaaacaacttggagtggtgttgctttttttttataaaagtaaaatggacttttttttgtttgagaaatgtcttcaagttttgtgtgaataaaacactttagcagcatctgtataaa

SEQ ID NO: 2311 - DNA, 1589 bp, Homo sapiens
agcgcgcacgcaatcgcgtttccggagagacctggctgctgtgtcccgcggcttgcgctccgtagtggactccgcgggccttcggcagatgcaggcctggggtagtctcctttctggactgagaagagaagaatggagaagcccctcttcccattagtgcctttgcattggtttggctttggctacacagcactggttgtttctggtgggatcgttggctatgtaaaaacagaaaaacaaagatgctttgcagcctattaaggaagacaggactgggaaggcccaggatgatgctttctggcttcaatcacttattacggatgcattccatgataaaggatttcagaaaataaaagaatactttcaacagaaagagagccactttcctcaaaaatataatcgtcttctattataccgtcttgacagatcaataaataaggaactagataaaaatgaatttcagtctgtgtcactgttgctgaaatgtattcagcgattcctcgtagatggcctgaaagaagatgaacctctgctaattcggcagggactgatcccaaagctagtttcctggtttgaaagaacaacaggaattctgacctcggaaggcctagcctcagacacgtcgctgatttgtgttatagaagatttctttgacactgcattgattatttccaggagtagtagtgaagggaaaattcagatgttggattccttcctacttagcttaggattcctggtgacagaaaagactgtaaatcatttgcttcaacaggagggcttgaagacttttaactgcattttgcacgctgtccctcgagaagagagaaaaaaattccctttgtcagaaggcatgtgtcatcttatgaaagaccttgcaaggacactcttgactgtgggtgattatgaccagcaggttgctatttctgaagcgctgtgtagactgacgattaaaaaatcaagggatgaacttgtccataaatggtttgatgatgaagtcattgctgaagctttcaaagaaattaaggatcgagaatttgagacggacagtagacgttttctcaatcacctaaacaacagacttggtgaccaaagaagggtgtattcatttccgtgtattgctgcttttgctgatgagcatgagatgagaaaaccagcggatgaaaaattagagaaattttggatcgacttcaacctaggaagtcagagtgtcactttttatatagacaatgctgagaatactctatgggactcagtgacacttccgaaggaagcggtgatgaatttcagcataacagaaacggagaagataaagatatttatcatttacctgaagaagcccatgattatcagctacaaagaagtcatgaaaatagaaatccattttgatttgcagttcaacatatcacaagtttccattcaagctttaggagaagacaaacagatgttgcctgaccagacgaaaatctcctcagaactttttagtaagtctgataaagaagacagggagagtcccagtggccttgaaagagaaacagaagtctcattacagaaaacatctcttctctgagagtaatcaagattcaagtacc

SEQ ID NO: 2312 - DNA, 5835 bp, Homo sapiens
cctcggaaacctgcggaggccgggaggcggctgcaaggggcggggaaggcgggagcccgcagcggaggaggggccgcgggcgggaggcgctgcgaggcgctgctggccctcgggctgcgggagccgggctaggacgccgagcggtgactccccgccgctcccgggggccgtgacggagatgcctacatagaagagtgacagcagctagactaaatgtttaactgctgaactagttcctcaggtatcctggctctagagattgctatgggagattggatgactgttacagatccaggtctgtcttcagaaagcaaaactatctctcaatatacctcagaaacaaagatgtctccatcaagtttatactcacagcaagtgctatgttcttcaatacctttatcgaaaaatgtgcacagttttttcagtgccttctgcacagaagataatattgaacagagtatctcatatcttgatcaggaattgactacttttggttttccttcattatatgaagaatccaaaggtaaagagacaaagagagagttaaatatagtagctgtactaaattgtatgaatgagctgcttgtgcttcagcggaagaaccttctagctcaggaaaatgtggagacacagaatttgaagctgggaagtgatatggaccatctacagagctgctactcaaaacttaaggaacaactggaaacctccaggagggaaatgattgggcttcaggaaagagacagacagttacaatgtaagaacaggaatttgcatcagctactaaagaatgagaaagatgaggtgcaaaaattacaaaatatcattgcaagtcgagctactcagtataatcatgatatgaagagaaaagagcgtgaatataataaactgaaggaacgtctacatcaacttgttatgaacaagaaagataagaaaatagctatggacattttgaattatgtcgggagagctgatggaaaaagaggctcctggaggactggtaaaactgaagccaggaatgaagatgaaatgtataaaattctcttgaatgattatgaatatcgtcagaaacaaatcctaatggaaaatgcagaacttaagaaggttcttcaacaaatgaaaaaggaaatgatttctcttctttctccccaaaagaagaaacctagagaaagagtagatgatagtacaggaactgttatttccgatgttgaagaagatgccggggaactaagcagagagagtatgtgggacctttcctgtgaaactgtgagagagcagcttacaaacagcatcagaaaacagtggagaattttgaaaagtcatgtagaaaagcttgataaccaagtttcaaaggtacacctggaaggttttaatgatgaagatgtaatctcacgacaagaccatgaacaagaaactgaaaaactcgagttagaaattcagcagtgtaaagaaatgattaaaactcagcaacagcttttacagcagcagctcgctactgcatatgatgatgataccacttcactattacgagactgttatttgttggaagaaaaggaacgtctcaaagaagaatggtccctttttaaagagcagaaaaagaattttgagagggagagacgaagctttacagaagccgctattcgcctgggattggagagaaaggcatttgaagaagaaagagccagttggttaaagcagcagtttctaaatatgactacctttgaccaccagaactcagaaaatgtgaaacttttcagtgccttctcaggaagttctgattgggacaatcttatagtgcactcgaggcagccgcaaaagaagcctcacagtgtgtctaatgggtctccagtttgcatgtctaaacttactaaatctcttcctgcttcaccttccacttcagacttttgccagacacgttcctgcatatctgaacatagttcaatcaatgtactgaatataactgctgaagaaattaaaccaaatcaggttggaggagaatgtacaaatcaaaaatggagtgtggcatcaagacctggatcacaggaaggttgctatagtggatgctccttgagctacacaaattctcatgtagaaaaagatgacttaccttagacatgtggactggaatttttttcattaatgtgttcatcaagtttcacatctaagttgaaacagggtgtgtcataaagtcagttatctctaataacttaagatggtctgagttgtttgtttggacttccctgtcttcccccaaagagttgaaatcttaaatctatttaaaaggatataaaagctttggatatgtatttttagtaacagaagcatctggttctgtgaataaaggaatgtatagatgtttggatggaaacaaaagcactagactgagtttcctcttataggtattaaaaatagcacttttaggaaactgattattgtaaatgtttaattttgtctcaaatatagttggcattggaagtttagcctttacttgaatgtatactgtagatttttaacaaagcgagttctatatttattatgtttagtgtggtttgaaattacctctttcatatgttttaaataaagtgaaatttatgtatgttttgtacatagatacacatgattatgttaagaggctttaagatttaaaagtttcacacaaccataagtatagtatttcatgccagtaaaatttttttagtggtattctgtttacagatgtattaggaccattgatgcattacatttaagaattctctttaatacatctgggcaataaatattgaaaggtattccatgaagctgagttctttagataatcaacactactaacattacatttttgagatttttatgacattagatttttattttgtatatgtagaatattataatttttaaaaggactattgatgatagaagaataggggcaagacgacaaaagtacctttgaataaaacaatttaagaaattggtttaagatattggatgatagaagatatttaagatatctagatggtgatattttccttacaagatgggtaccagtatagtaatatctgtatactaactagggctttgtattgtcaataattttttaataattttttaatgaggtatttaccactgaagaaatatgataatataaaaccatcaaattttataattgagatgatactctggaaaaacatgtcatttcattttcagaaaactcttaagctctcttcagtctctgtaatgtttctgattgcatgtttcttcatgaaaagtatgttgttgttttgatagtaataataataaatgtaggctcagctctttcccaggattttcatcaaaaagctttaagtgcctaaccctgcttgtctctgtacatagaagcctgcacagatccaacccttgctaggtatcatagtttaggcccatttaccttcccctgtactggcagttcagccgcttacatgcactcaccctgtttgtggctattttaaattcatattattaaaaaacaaaaaaaacccacctatttgtgttgtccattcactatacgtaactatgtaactctttggagttgcatagcagcagccattttttcagggctgataggatatcattaagagtgtcttatgagacattagtggatatactcatagtaaccatatttatagttttaaagagctagctcttgagcattagtcactaccttcagcttgatgcatggtcacttctttactatttaaaatactacacattgtacaaaatatcgaagacactaccatatgctaaaggaagaaatctagctgggatataggatttttgttgtttttgtttttgtttgttttgctatttagcaataacatggtcaaaaaggcaatcagaaattttaaatacagttaatggatacatttggcaacaattttcccccgagggttttccatggtgtactttgcaagaaataagcactctaatttttaaagtaaatctcttattttagcaaatattatatttcatgacaatggagttctagaaagcagcatctgttttttgttgcgtgtttccattttaaagtgagttgagttctcaaattggaaagaaagattccttgagacgtacttttaaaatctaaagtgtgaaagaaacagcagagtaaaagccagactcattgcaccttcaatgtctgcatagatccagaagttgtacattttacctaacaacatcacttttgttgaacattccaactccagaatgatccccaatcaccctaatctcagaatgctggaatgatgtctgttggaaaacccaggactccacacacaaaactcctgggattttgtttcccatctctttctaggtgtttgcaatgtacaaataatacagctgtgctaatctcacatttagccatgatagatgatggttctagagtgtacttccatttgtaagtcctcctgataagtgctttcttgtttatcactatgtaaatctgaaatattttgtacttcatttgtttttatccattctgaattttcaaagcataaaaatgtcaaagaaaaattgagataaacattttgttcaccattaaatgtttgcatctgcagtctatgatgagaaacaatgaaattatgactaaaatttaacaaatagtattttcttatagaagcaatgtattaaatgattagatacacaggacagttcacagcaaattgtttacttacatggcataattgaaatactgttatttgtaaagagttctatactgcctaccttagctaaccagaattgttcatagacttgtgataatatggtgttatgggaaaacacattttgtgcgcatgatgaagagagcaccgtgaatctagtcttgactgcccctggtggaacatttgaaagcccttgggactccaggagagaggtttttgcagcatgtatgctaaatttgtgagttagcaagaccctgctgtgattactatgttgtacagatcttcaaagtatattgcctaatatgagtcatgttatttctagattgaatttaaagtaagtatggattatggaagtctagtaaatatacttttccctatttttgtcctttttcagtcttttggtaagcatttattaagtacctgctgtatgtcaaggcttactactgctttccaatccttggtgatatgaagacagataagcacgctgcctgctattaggaatctgagctgagtggaaggccaactattaaacctacattgtaataaacaatggtggatgctacggacacattcagtctgttcataaaacatggactgatgggtctgctccaggccacatttgttttttaacagtaacgtggctaggcttccatttataagtcttagcattatttcctttgtgaagtactatgtaacagatgattgtttgctagattttgttttctacaatcaaaatgttgacctgcaaagcagtgtaggattttctctcctcaagagcgtgtattattatctagtagaaaaagcattcccaaagacttggtccatgcagataaggataatgaaattgctcactctaatcctttttctaaatacagtgtttttcaagctggatgtaaattagagtgggtggatattgattaaattatttgatttatatgaaatcaaatgactggttgaggtttttttgaacatttacaaataatggattcctgagagctcaggaagtactgtaatgtcagtgacatatgaagctcctgataaagatccacctcattcatatatttgagcttcagaaatacatgtacctagtataatgcttaacagcacataatatttgttgatgagaaatacactgatgaaacaacac

SEQ ID NO: 2313 - DNA, 1959 bp, Homo sapiens
gcggggtgggaacctcggaaacctgcggaggccgggaggcggctgcaaggggcggggaaggcgggagcccgcagcggaggaggggccgcgggcgggaggcgctgcgaggcgctgctggccctcgggctgcgggagccgggctaggacgccgagcggtgactccccgccgctcccgggggccgtgacggagatgcctacatagaagagtgacagcagctagactaaatgtttaactgctgaactagttcctcaggtatcctggctctagagattgctatgggagattggatgactgttacagatccaggtctgtcttcagaaagcaaaactatctctcaatatacctcagaaacaaagatgtctccatcaagtttatactcacagcaagtgctatgttcttcaatacctttatcgaaaaatgtgcacagttttttcagtgccttctgcacagaagataatattgaacagagtatctcatatcttgatcaggaattgactacttttggttttccttcattatatgaagaatccaaaggtaaagagacaaagagagagttaaatatagtagctgtactaaattgtatgaatgagctgcttgtgcttcagcggaagaaccttctagctcaggaaaatgtggagacacagaatttgaagctgggaagtgatatggaccatctacagagctgctactcaaaacttaaggaacaactggaaacctccaggagggaaatgattgggcttcaggaaagagacagacagttacaatgtaagaacaggaatttgcatcagctactaaagaatgagaaagatgaggtgcaaaaattacaaaatatcattgcaagtcgagctactcagtataatcatgatatgaagagaaaagagcgtgaatataataaactgaaggaacgtctacatcaacttgttatgaacaagaaagataagaaaatagctatggacattttgaattatgtcgggagagctgatggaaaaagaggctcctggaggactggtaaaactgaagccaggaatgaagatgaaatgtataaaattctcttgaatgattatgaatatcgtcagaaacaaatcctaatggaaaatgcagaacttaagaaggttcttcaacaaatgaaaaaggaaatgatttctcttctttctccccaaaagaagaaacctagagaaagagtagatgatagtacaggaactgttatttccgatgttgaagaagatgccggggaactaagcagagagagtatgtgggacctttcctgtgaaactgtgagagagcagcttacaaacagcatcagaaaacagtggagaattttgaaaagtcatgtagaaaagcttgataaccaagtttcaaaggtacacctggaaggttttaatgatgaagatgtaatctcacgacaagaccatgaacaagaaactgaaaaactcgagttagaaattcagcagtgtaaagaaatgattaaaactcagcaacagcttttacagcagcagctcgctactgcatatgatgatgataccacttcactattacgagactgttatttgttggaagaaaaggaacgtctcaaagaagaatggtccctttttaaagagcagaaaaagaattttgagagggagagacgaagctttacagaagccgctattcgcctgggattggagagaaaggcatttgaagaagaaagagccagttggttaaagcagcagtttctaaatatgactacctttgaccaccagaactcagaaaatgtgaaacttttcagtgccttctcaggaagttctgattgggacaatcttatagtgcactcgaggcagccgcaaaagaagcctcacagtgtgtctaatgggtctccagtttgcatgtctaaacttactaaatctcttcctgcttcaccttccacttcagacttttgccagacacgttcctgcatatctgaacatagggcaaagaactga

SEQ ID NO: 2314 - DNA, 759 bp, Homo sapiens
agaagggggcggggagcagaaaacggccgggtgaatcactgggcgtaacaggtgccgcagccgcagctgcgcccgcagcgcgcgcggaccgcagggataaggtcttctttttctccgggtttttttggaggagatgcctacatagaagagtgacagcagctagactaaatgtttaactgctgaactagttcctcaggtatcctggctctagagattgctatgggagattggatgactgttacagatccaggtctgtcttcagaaagcaaaactatctctcaatatacctcagaaacaaagatgtctccatcaagtttatactcacagcaagtgctatgttcttcaatacctttatcgaaaaatgtgcacagttttttcagtgccttctgcacagaagataatattgaacagagtatctcatatcttgatcaggaattgactacttttggttttccttcattatatgaagaatccaaaggtaaagagacaaagagagagttaaatatagtagctgtactaaattgtatgaatgagctgcttgtgcttcagcggaagaaccttctagctcaggaaaatgtggagacacagaatttgaagctgggaagtgatatggaccatctacagagctgctactcaaaacttaaggaacaactggaaacctccaggagggaaatgattgggcttcaggaaagagacagacagttacaatgtaagaacaggaatttgcatcagctactaaagaatgagaaagatgaggtg

SEQ ID NO: 2315 - DNA, 5843 bp, Homo sapiens
gggcgggaggcgctgcgaggcgctgctggccctcgggctgcgggagccgggctaggacgccgagcggtgactccccgccgctcccgggggccgtgacggtgagcagcagcgcctcgcgtcggggattgtgacgcgccccgccagggaggggcgggcgggggtgggcgccggcaaggggcgggcgcgcgcggaggtgagagccggcacctggctcagcgccccgttgttcggcgggaggctccgcgcggctgttggggccgttgcagggtgcgggcgagcgtcgacccgggccgctcctggaggaggaggtgggagaaagcaaaactatctctcaatatacctcagaaacaaagatgtctccatcaagtttatactcacagcaagtgctatgttcttcaatacctttatcgaaaaatgtgcacagttttttcagtgccttctgcacagaagataatattgaacagagtatctcatatcttgatcaggaattgactacttttggttttccttcattatatgaagaatccaaaggtaaagagacaaagagagagttaaatatagtagctgtactaaattgtatgaatgagctgcttgtgcttcagcggaagaaccttctagctcaggaaaatgtggagacacagaatttgaagctgggaagtgatatggaccatctacagagctgctactcaaaacttaaggaacaactggaaacctccaggagggaaatgattgggcttcaggaaagagacagacagttacaatgtaagaacaggaatttgcatcagctactaaagaatgagaaagatgaggtgcaaaaattacaaaatatcattgcaagtcgagctactcagtataatcatgatatgaagagaaaagagcgtgaatataataaactgaaggaacgtctacatcaacttgttatgaacaagaaagataagaaaatagctatggacattttgaattatgtcgggagagctgatggaaaaagaggctcctggaggactggtaaaactgaagccaggaatgaagatgaaatgtataaaattctcttgaatgattatgaatatcgtcagaaacaaatcctaatggaaaatgcagaacttaagaaggttcttcaacaaatgaaaaaggaaatgatttctcttctttctccccaaaagaagaaacctagagaaagagtagatgatagtacaggaactgttatttccgatgttgaagaagatgccggggaactaagcagagagagtatgtgggacctttcctgtgaaactgtgagagagcagcttacaaacagcatcagaaaacagtggagaattttgaaaagtcatgtagaaaagcttgataaccaagtttcaaaggtacacctggaaggttttaatgatgaagatgtaatctcacgacaagaccatgaacaagaaactgaaaaactcgagttagaaattcagcagtgtaaagaaatgattaaaactcagcaacagcttttacagcagcagctcgctactgcatatgatgatgataccacttcactattacgagactgttatttgttggaagaaaaggaacgtctcaaagaagaatggtccctttttaaagagcagaaaaagaattttgagagggagagacgaagctttacagaagccgctattcgcctgggattggagagaaaggcatttgaagaagaaagagccagttggttaaagcagcagtttctaaatatgactacctttgaccaccagaactcagaaaatgtgaaacttttcagtgccttctcaggaagttctgattgggacaatcttatagtgcactcgaggcagccgcaaaagaagcctcacagtgtgtctaatgggtctccagtttgcatgtctaaacttactaaatctcttcctgcttcaccttccacttcagacttttgccagacacgttcctgcatatctgaacatagttcaatcaatgtactgaatataactgctgaagaaattaaaccaaatcaggttggaggagaatgtacaaatcaaaaatggagtgtggcatcaagacctggatcacaggaaggttgctatagtggatgctccttgagctacacaaattctcatgtagaaaaagatgacttaccttagacatgtggactggaatttttttcattaatgtgttcatcaagtttcacatctaagttgaaacagggtgtgtcataaagtcagttatctctaataacttaagatggtctgagttgtttgtttggacttccctgtcttcccccaaagagttgaaatcttaaatctatttaaaaggatataaaagctttggatatgtatttttagtaacagaagcatctggttctgtgaataaaggaatgtatagatgtttggatggaaacaaaagcactagactgagtttcctcttataggtattaaaaatagcacttttaggaaactgattattgtaaatgtttaattttgtctcaaatatagttggcattggaagtttagcctttacttgaatgtatactgtagatttttaacaaagcgagttctatatttattatgtttagtgtggtttgaaattacctctttcatatgttttaaataaagtgaaatttatgtatgttttgtacatagatacacatgattatgttaagaggctttaagatttaaaagtttcacacaaccataagtatagtatttcatgccagtaaaatttttttagtggtattctgtttacagatgtattaggaccattgatgcattacatttaagaattctctttaatacatctgggcaataaatattgaaaggtattccatgaagctgagttctttagataatcaacactactaacattacatttttgagatttttatgacattagatttttattttgtatatgtagaatattataatttttaaaaggactattgatgatagaagaataggggcaagacgacaaaagtacctttgaataaaacaatttaagaaattggtttaagatattggatgatagaagatatttaagatatctagatggtgatattttccttacaagatgggtaccagtatagtaatatctgtatactaactagggctttgtattgtcaataattttttaataattttttaatgaggtatttaccactgaagaaatatgataatataaaaccatcaaattttataattgagatgatactctggaaaaacatgtcatttcattttcagaaaactcttaagctctcttcagtctctgtaatgtttctgattgcatgtttcttcatgaaaagtatgttgttgttttgatagtaataataataaatgtaggctcagctctttcccaggattttcatcaaaaagctttaagtgcctaaccctgcttgtctctgtacatagaagcctgcacagatccaacccttgctaggtatcatagtttaggcccatttaccttcccctgtactggcagttcagccgcttacatgcactcaccctgtttgtggctattttaaattcatattattaaaaaacaaaaaaaacccacctatttgtgttgtccattcactatacgtaactatgtaactctttggagttgcatagcagcagccattttttcagggctgataggatatcattaagagtgtcttatgagacattagtggatatactcatagtaaccatatttatagttttaaagagctagctcttgagcattagtcactaccttcagcttgatgcatggtcacttctttactatttaaaatactacacattgtacaaaatatcgaagacactaccatatgctaaaggaagaaatctagctgggatataggatttttgttgtttttgtttttgtttgttttgctatttagcaataacatggtcaaaaaggcaatcagaaattttaaatacagttaatggatacatttggcaacaattttcccccgagggttttccatggtgtactttgcaagaaataagcactctaatttttaaagtaaatctcttattttagcaaatattatatttcatgacaatggagttctagaaagcagcatctgttttttgttgcgtgtttccattttaaagtgagttgagttctcaaattggaaagaaagattccttgagacgtacttttaaaatctaaagtgtgaaagaaacagcagagtaaaagccagactcattgcaccttcaatgtctgcatagatccagaagttgtacattttacctaacaacatcacttttgttgaacattccaactccagaatgatccccaatcaccctaatctcagaatgctggaatgatgtctgttggaaaacccaggactccacacacaaaactcctgggattttgtttcccatctctttctaggtgtttgcaatgtacaaataatacagctgtgctaatctcacatttagccatgatagatgatggttctagagtgtacttccatttgtaagtcctcctgataagtgctttcttgtttatcactatgtaaatctgaaatattttgtacttcatttgtttttatccattctgaattttcaaagcataaaaatgtcaaagaaaaattgagataaacattttgttcaccattaaatgtttgcatctgcagtctatgatgagaaacaatgaaattatgactaaaatttaacaaatagtattttcttatagaagcaatgtattaaatgattagatacacaggacagttcacagcaaattgtttacttacatggcataattgaaatactgttatttgtaaagagttctatactgcctaccttagctaaccagaattgttcatagacttgtgataatatggtgttatgggaaaacacattttgtgcgcatgatgaagagagcaccgtgaatctagtcttgactgcccctggtggaacatttgaaagcccttgggactccaggagagaggtttttgcagcatgtatgctaaatttgtgagttagcaagaccctgctgtgattactatgttgtacagatcttcaaagtatattgcctaatatgagtcatgttatttctagattgaatttaaagtaagtatggattatggaagtctagtaaatatacttttccctatttttgtcctttttcagtcttttggtaagcatttattaagtacctgctgtatgtcaaggcttactactgctttccaatccttggtgatatgaagacagataagcacgctgcctgctattaggaatctgagctgagtggaaggccaactattaaacctacattgtaataaacaatggtggatgctacggacacattcagtctgttcataaaacatggactgatgggtctgctccaggccacatttgttttttaacagtaacgtggctaggcttccatttataagtcttagcattatttcctttgtgaagtactatgtaacagatgattgtttgctagattttgttttctacaatcaaaatgttgacctgcaaagcagtgtaggattttctctcctcaagagcgtgtattattatctagtagaaaaagcattcccaaagacttggtccatgcagataaggataatgaaattgctcactctaatcctttttctaaatacagtgtttttcaagctggatgtaaattagagtgggtggatattgattaaattatttgatttatatgaaatcaaatgactggttgaggtttttttgaacatttacaaataatggattcctgagagctcaggaagtactgtaatgtcagtgacatatgaagctcctgataaagatccacctcattcatatatttgagcttcagaaatacatgtacctagtataatgcttaacagcacataatatttgttgatgagaaatacactgatgaaacaacac

SEQ ID NO: 2316 - DNA, 2138 bp, Homo sapiens
gagatgcctacatagaagagtgacagcagctagactaaatgtttaactgctgaactagttcctcaggtatcctggctctagagattgctatgggagattggatgactgttacagatccagaaagcaaaactatctctcaatatacctcagaaacaaagatgtctccatcaagtttatactcacagcaagtgctatgttcttcaatacctttatcgaaaaatgtgcacagttttttcagtgccttctgcacagaagataatattgaacagagtatctcatatcttgatcaggaattgactacttttggttttccttcattatatgaagaatccaaaggtaaagagacaaagagagagttaaatatagtagctgtactaaattgtatgaatgagctgcttgtgcttcagcggaagaaccttctagctcaggaaaatgtggagacacagaatttgaagctgggaagtgatatggaccatctacagagctgctactcaaaacttaaggaacaactggaaacctccaggagggaaatgattgggcttcaggaaagagacagacagttacaatgtaagaacaggaatttgcatcagctactaaagaatgagaaagatgaggtgcaaaaattacaaaatatcattgcaagtcgagctactcagtataatcatgatatgaagagaaaagagcgtgaatataataaactgaaggaacgtctacatcaacttgttatgaacaagaaagataagaaaatagctatggacattttgaattatgtcgggagagctgatggaaaaagaggctcctggaggactggtaaaactgaagccaggaatgaagatgaaatgtataaaattctcttgaatgattatgaatatcgtcagaaacaaatcctaatggaaaatgcagaacttaagaaggttcttcaacaaatgaaaaaggaaatgatttctcttctttctccccaaaagaagaaacctagagaaagagtagatgatagtacaggaactgttatttccgatgttgaagaagatgccggggaactaagcagagagagtatgtgggacctttcctgtgaaactgtgagagagcagcttacaaacagcatcagaaaacagtggagaattttgaaaagtcatgtagaaaagcttgataaccaagtttcaaaggtacacctggaaggttttaatgatgaagatgtaatctcacgacaagaccatgaacaagaaactgaaaaactcgagttagaaattcagcagtgtaaagaaatgattaaaactcagcaacagcttttacagcagcagctcgctactgcatatgatgatgataccacttcactattacgagactgttatttgttggaagaaaaggaacgtctcaaagaagaatggtccctttttaaagagcagaaaaagaattttgagagggagagacgaagctttacagaagccgctattcgcctgggattggagattggctttctcctgctaagtgttttacacaagaaatctcttttgggtatccatcattcatccacggtcagtaggtgtggtgtcagaagacagtgcaaccaagactatatttgctgtttaaaaaagaaaggcatttgaagaagaaagagccagttggttaaagcagcagtttctaaatatgactacctttgaccaccagaactcagaaaatgtgaaacttttcagtgccttctcaggaagttctgattgggacaatcttatagtgcactcgaggcagccgcaaaagaagcctcacagtgtgtctaatgggtctccagtttgcatgtctaaacttactaaatctcttcctgcttcaccttccacttcagacttttgccagacacgttcctgcatatctgaacatagttcaatcaatgtactgaatataactgctgaagaaattaaaccaaatcaggttggaggagaatgtacaaatcaaaaatggagtgtggcatcaagacctggatcacaggaaggttgctatagtggatgctccttgagctacacaaattctcatgtagaaaaagatgacttaccttagacatgtggactggaatttttttcattaatgtgttcatcaagtttcacatctaagttgaaacagggtgtgtcataaagtcagttatctctaat

SEQ ID NO: 2317 - DNA, 1414 bp, Homo sapiens
ctcagagtacgcacggtctgattttctctttggattcttccaaaatcagagtcagactgctcccggtgccatgaacggagacgacgcctttgcaaggagacccacggttggtgctcaaataccagagaagatccaaaaggccttcgatgatattgccaaatacttctctaaggaagagtgggaaaagatgaaagcctcggagaaaatcttctatgtgtatatgaagagaaagtatgaggctatgactaaactaggtttcaaggccaccctcccacctttcatgtgtaataaacgggccgaagacttccaggggaatgatttggataatgaccctaaccgtgggaatcaggttgaacgtcctcagatgactttcggcaggctccagggaatctccccgaagatcatgcccaagaagccagcagaggaaggaaatgattcggaggaagtgccagaagcatctggcccacaaaatgatgggaaagagctgtgccccccgggaaaaccaactacctctgagaagattcacgagagatctggaaatagggaggcccaagaaaaggaagagagacgcggaacagctcatcggtggagcagtcagaacacacacaacattggtcgattcagtttgtcaacttctatgggtgcagttcatggtacccccaaaacaattacacacaacagggacccaaaaggggggaacatgcctggacccacagactgcgtgagagaaaacagctggtgatttatgaagagatcagcgaccctgaggaagatgacgagtaactcccctcagggatacgacacatgcccatgatgagaagcagaacgtggtgacctttcacgaacatgggcatggctgcggacccctcgtcatcaggtgcatagcaagtgaaagcaagtgttcacaacagtgaaaagttgagcgtcatttttcttagtgtgccaagagttcgatgttagcgtttacgttgtattttcttacactgtgtcattctgttagatactaacattttcattgatgagcaagacatacttaatgcatattttggtttgtgtatccatgcacctaccttagaaaacaagtattgtcggttacctctgcatggaacagcattaccctcctctctccccagatgtgactactgagggcagttctgagtgtttaatttcagattttttcctctgcatttacacacacacgcacacaaaccacaccacacacacacacacacacacacacacacacacacacacacacacaccaagtaccagtataagcatctgccatctgcttttcccattgccatgcgtcctggtcaagctcccctcactctgtttcctggtcagcatgtactcccctcatccgattcccctgtagcagtcactgacagttaataaacctttgcaaacgttc

SEQ ID NO: 2318 - DNA, 1296 bp, Homo sapiens
actttctctctctttcgattcttccatactcagagtacgcacggtctgattttctctttggattcttccaaaatcagagtcagactgctcccggtgccatgaacggagacgacgcctttgcaaggagacccacggttggtgctcaaataccagagaagatccaaaaggccttcgatgatattgccaaatacttctctaaggaagagtgggaaaagatgaaagcctcggagaaaatcttctatgtgtatatgaagagaaagtatgaggctatgactaaactaggtttcaaggccaccctcccacctttcatgtgtaataaacgggccgaagacttccaggggaatgatttggataatgaccctaaccgtgggaatcaggttgaacgtcctcagatgactttcggcaggctccagggaatctccccgaagatcatgcccaagaagccagcagaggaaggaaatgattcggaggaagtgccagaagcatctggcccacaaaatgatgggaaagagctgtgccccccgggaaaaccaactacctctgagaagattcacgagagatctggacccaaaaggggggaacatgcctggacccacagactgcgtgagagaaaacagctggtgatttatgaagagatcagcgaccctgaggaagatgacgagtaactcccctcagggatacgacacatgcccatgatgagaagcagaacgtggtgacctttcacgaacatgggcatggctgcggacccctcgtcatcaggtgcatagcaagtgaaagcaagtgttcacaacagtgaaaagttgagcgtcatttttcttagtgtgccaagagttcgatgttagcgtttacgttgtattttcttacactgtgtcattctgttagatactaacattttcattgatgagcaagacatacttaatgcatattttggtttgtgtatccatgcacctaccttagaaaacaagtattgtcggttacctctgcatggaacagcattaccctcctctctccccagatgtgactactgagggcagttctgagtgtttaatttcagattttttcctctgcatttacacacacacgcacacaaaccacaccacacacacacacacacacacacacacacacacacacacacacacaccaagtaccagtataagcatctgccatctgcttttcccattgccatgcgtcctggtcaagctcccctcactctgtttcctggtcagcatgtactcccctcatccgattcccctgtagcagtcactgacagttaataaacctttgcaaacgttc

SEQ ID NO: 2319 - DNA, 1217 bp, Homo sapiens
acacgccgatttgcccttttgattcttccacaatcagggtgagactgctcccagtgccatgaacggagacgacgcctttgcaaggagacccagggatgatgctcaaatatcagagaagttacgaaaggccttcgatgatattgccaaatacttctctaagaaagagtgggaaaagatgaaatcctcggagaaaatcgtctatgtgtatatgaagctaaactatgaggtcatgactaaactaggtttcaaggtcaccctcccacctttcatgcgtagtaaacgggctgcagacttccacgggaatgattttggtaacgatcgaaaccacaggaatcaggttgaacgtcctcagatgactttcggcagcctccagagaatcttcccgaagatcatgcccaagaagccagcagaggaagaaaatggtttgaaggaagtgccagaggcatctggcccacaaaatgatgggaaacagctgtgccccccgggaaatccaagtaccttggagaagattaacaagacatctggacccaaaagggggaaacatgcctggacccacagactgcgtgagagaaagcagctggtggtttatgaagagatcagcgaccctgaggaagatgacgagtaactcccctcggggatatgacacatgcccatgatgagaagcagaacgtggtgacctttcacgaacatgggcatggctgcggacccctcgtcatcaggtgcatagcaagtgaaagcaagtgttcacaacagtgaaaagttgagcgtcatttttcttagtgtgccaagagttcgatgttggcgtttccgctgtattttcttgcagtgtgccattctgttagacattagcgttttcgttgatgagcaagacatgcttaatgcatatttcggcttgtgtatccatgcacctacctcagaaaacaagtattgtcaggtattctctccatagaacagcactaccctcctctctccccagatgtgactactgaggggaggtctgagtgtttaatttccgattttttcctctgcatttacacacacaccacacacgcacacacacacaccaagtaccagtataagcatctcccatctgcttttctccattgccatgcgacctggtcaagcccccctcactctgtttcctgttcagcatgtactcccctcatccgattccgttgtatcagtcactgacagttaataaacctttgcaaacgttc

SEQ ID NO: 2320 - DNA, 1081 bp, Homo sapiens
acacgccgatttgcccttttgattcttccacaatcagggtgagactgctcccagtgccatgaacggagacgacgcctttgcaaggagacccagggatgatgctcaaatatcagagaagttacgaaaggccttcgatgatattgccaaatacttctctaagaaagagtgggaaaagatgaaatcctcggagaaaatcgtctatgtgtatatgaagctaaactatgaggtcatgactaaactaggtttcaaggtcaccctcccacctttcatgcgtagtaaacgggctgcagacttccacgggaatgattttggtaacgatcgaaaccacaggaatcaggttgaacgtcctcagatgactttcggcagcctccagagaatcttcccgaaggacccaaaagggggaaacatgcctggacccacagactgcgtgagagaaagcagctggtggtttatgaagagatcagcgaccctgaggaagatgacgagtaactcccctcggggatatgacacatgcccatgatgagaagcagaacgtggtgacctttcacgaacatgggcatggctgcggacccctcgtcatcaggtgcatagcaagtgaaagcaagtgttcacaacagtgaaaagttgagcgtcatttttcttagtgtgccaagagttcgatgttggcgtttccgctgtattttcttgcagtgtgccattctgttagacattagcgttttcgttgatgagcaagacatgcttaatgcatatttcggcttgtgtatccatgcacctacctcagaaaacaagtattgtcaggtattctctccatagaacagcactaccctcctctctccccagatgtgactactgaggggaggtctgagtgtttaatttccgattttttcctctgcatttacacacacaccacacacgcacacacacacaccaagtaccagtataagcatctcccatctgcttttctccattgccatgcgacctggtcaagcccccctcactctgtttcctgttcagcatgtactcccctcatccgattccgttgtatcagtcactgacagttaataaacctttgcaaacgttc

SEQ ID NO: 2321 - DNA, 1384 bp, Homo sapiens
cgctctgattgtttcgattcttccaaaatcagagacagagtgctcccggtgccatgaacggagacgatgcctttgtacggagacctagggttggttctcaaataccagagaagatgcaaaagcatccctggagacaagtctgtgaccgtggaatacatttggtgaatctcagtccgttctggaaggtgggaagagagccagccagcagcattaaagctctactgtgtggcaggggagaagctagggccttcgatgatattgccaaatacttctctgagaaagagtgggaaaagatgaaagcctcggagaaaatcatctatgtgtatatgaagagaaagtatgaggccatgactaaactaggtttcaaggccaccctcccacctttcatgcgtaataaacgggtcgcagacttccaggggaatgattttgataatgaccctaaccgtgggaatcaggttgaacatcctcagatgactttcggcaggctccagggaatcttcccgaagatcacgcccgagaagccagcagaggaaggaaatgattcgaagggagtgccagaagcatctggcccacagaacaatgggaaacagctgcgcccctcaggaaaactaaatacctctgagaaggttaacaagacatctggacccaaaagggggaaacatgcctggacccacagagtgcgtgagagaaagcaactggtgatttatgaagagatcagcgaccctcaggaagatgacgagtaactcccctcggggatatgacacatgcccatgatgagaagcagaacgtggtgacctttcacgaacatgggcatggctgcggatccctcgtcatcaggtgtatagcaagtgaaagcaagtgttcacaacagtgaaaagttgagcgtcatttttcttagtgtgccaagagttcgatgttagtgtttctgttgtattttgttacagtgtgccattctgttagatattagcgttttcactgatgagcaagacatacttaatgcatatttcagtttgtgtatccatgcacctacctcagaaaacaagtatcgtcaggtattctctgcatagaacaacactaccctcctctcttcccagatgtgaccactgagggcagttctgagtgtttaatttcagattttttcctctgcatttacacaaacacacacacatgccacacagacacacatgcgcgcgcgcgcgcacacacacacacacacacacacacacacacacacacaccaagtaccagtataggcatctcccaactgcttttccccatgtgtcctggtcaagcccccctcactctgtttcctgttcagcatgtactcccctcatccgattcccctctatcagtcactgccagttaataaacctttgcaaacgtt

SEQ ID NO: 2322 - DNA, 1261 bp, Homo sapiens
cgctctgattgtttcgattcttccaaaatcagagacagagtgctcccggtgccatgaacggagacgatgcctttgtacggagacctagggttggttctcaaataccagagaagatgcaaaaggccttcgatgatattgccaaatacttctctgagaaagagtgggaaaagatgaaagcctcggagaaaatcatctatgtgtatatgaagagaaagtatgaggccatgactaaactaggtttcaaggccaccctcccacctttcatgcgtaataaacgggtcgcagacttccaggggaatgattttgataatgaccctaaccgtgggaatcaggttgaacatcctcagatgactttcggcaggctccagggaatcttcccgaagatcacgcccgagaagccagcagaggaaggaaatgattcgaagggagtgccagaagcatctggcccacagaacaatgggaaacagctgcgcccctcaggaaaactaaatacctctgagaaggttaacaagacatctggacccaaaagggggaaacatgcctggacccacagagtgcgtgagagaaagcaactggtgatttatgaagagatcagcgaccctcaggaagatgacgagtaactcccctcggggatatgacacatgcccatgatgagaagcagaacgtggtgacctttcacgaacatgggcatggctgcggatccctcgtcatcaggtgtatagcaagtgaaagcaagtgttcacaacagtgaaaagttgagcgtcatttttcttagtgtgccaagagttcgatgttagtgtttctgttgtattttgttacagtgtgccattctgttagatattagcgttttcactgatgagcaagacatacttaatgcatatttcagtttgtgtatccatgcacctacctcagaaaacaagtatcgtcaggtattctctgcatagaacaacactaccctcctctcttcccagatgtgaccactgagggcagttctgagtgtttaatttcagattttttcctctgcatttacacaaacacacacacatgccacacagacacacatgcgcgcgcgcgcgcacacacacacacacacacacacacacacacacacacaccaagtaccagtataggcatctcccaactgcttttccccatgtgtcctggtcaagcccccctcactctgtttcctgttcagcatgtactcccctcatccgattcccctctatcagtcactgccagttaataaacctttgcaaacgtt

SEQ ID NO: 2323 - DNA, 1208 bp, Homo sapiens
atgaacggagacgatgcctttgtacggagacctagggttggttctcaaataccagagaagatgcaaaaggccttcgatgatattgccaaatacttctctgagaaagagtgggaaaagatgaaagcctcggagaaaatcatctatgtgtatatgaagagaaagtatgaggccatgactaaactaggtttcaaggccaccctcccacctttcatgcgtaataaacgggtcgcagacttccaggggaatgattttgataatgaccctaaccgtgggaatcaggttgaacatcctcagatgactttcggcaggctccagggaatcttcccgaagatcacgcccgagaagccagcagaggaaggaaatgattcgaagggagtgccagaagcatctggcccacagaacaatgggaaacagctgcgcccctcaggaaaactaaatacctctgagaaggttaacaagacatctggacccaaaagggggaaacatgcctggacccacagagtgcgtgagagaaagcaactggtgatttatgaagagatcagcgaccctcaggaagatgacgagtaactcccctcggggatatgacacatgcccatgatgagaagcagaacgtggtgacctttcacgaacatgggcatggctgcggatccctcgtcatcaggtgtatagcaagtgaaagcaagtgttcacaacagtgaaaagttgagcgtcatttttcttagtgtgccaagagttcgatgttagtgtttctgttgtattttgttacagtgtgccattctgttagatattagcgttttcactgatgagcaagacatacttaatgcatatttcagtttgtgtatccatgcacctacctcagaaaacaagtatcgtcaggtattctctgcatagaacaacactaccctcctctcttcccagatgtgaccactgagggcagttctgagtgtttaatttcagattttttcctctgcatttacacaaacacacacacatgccacacagacacacatgcgcgcgcgcgcgcacacacacacacacacacacacacacacacacacacaccaagtaccagtataggcatctcccaactgcttttccccatgtgtcctggtcaagcccccctcactctgtttcctgttcagcatgtactcccctcatccgattcccctctatcagtcactgccagttaataaacctttgcaaacgtt

SEQ ID NO: 2324 - DNA, 473 bp, Homo sapiens
ctcataacctctgctgcagaatgccctcatgcaactgaagtctctctagagtttggaaatctttaccaacaaagaaaaattctgatgtattctctttcagttgaacatcctcagatgactttcggcaggctccagggaatcttcccgaagatcacgcccgagaagccagcagaggaaggaaatgattcgaagggagtgccagaagcatctggcccacagaacaatgggaaacagctgcgcccctcaggaaaactaaatacctctgagaaggttaacaagacatctggacccaaaagggggaaacatgcctggacccacagagtgcgtgagagaaagcaactggtgatttatgaagagatcagcgaccctcaggaagatgacgagtaactcccctcggggatatgacacatgcccatgatgagaagcagaacgtggtgacctttcacgaacatgggcatggctgcggatccctc

SEQ ID NO: 2325 - DNA, 1286 bp, Homo sapiens
acactttgtcaccaactgctgccgacctcgccaccactgctttgtctctgaggtcagagtgctcctggtgccatgaacggagacgacgcctttgcaaagagacccagggatgatgctaaagcatcagagaagagaagcaaggccttcgatgatattgccaaatacttctctaaggaagagtgggaaaagatgaaattctcggagaaaatcagctgtgtgcatatgaagagaaagtatgaggccatgactaaactaggtttcaacgtcaccctctcacttttcatgcgtaataaacgggccacagactctcagaggaatgattctgataatgaccgtaaccgtgggaatgaggttgaacgtcctcagatgacttttggcaggctccagagaatcatcccgaagatcatgcccgagaagccagcagaggaaggaagtgattcgaagggagtgccagaagcatctggcccacagaacgatgggaaaaagctgtgcccgccgggaaaagcaagtagctctgagaagattcacgagagatctggacccaaaagggggaaacatgcctggacccacagactgcgtgagagaaagcagctggtgatttatgaagagatcagcgaccctgaggaagatgacaagtaactccataagtgaaccttcggctcaccctccacatccctgcagatgtgctattctgttatgcctcagggatacgacacatgcccatgatgagaagcagaacgtggtgacctttcacgaacgtgggcatggctgcggacccctcgtcatcaggtgtatagcaagtgaaagcaagtgttcacaacagtgaaaagttgagcgtcatttttcttagtgtgccaagagttcgatgttggcgtttccgttgtattttcttgcagtgtgccattctgttagacattagcattttcgttgatgagcaagacatgcttaatgcatatttcggcttgtgtatccatgcacctacctcagaaaacaagtattgtcaggtattctctccatagaacagcactaccctcctctctccccagatgtgactactgaggggaggtctgagtgtttaatttccgattttttcctctgcatttacacacacaccacacacgcacacacacacaccaagtaccagtataagcatctcccatctgcttttctccactgccatgtgtcctggtcaagcccccctcactctgtttcctgttcagcatgtactcccctcatccgattcccctctatcagtcactgacagttaataaacctttgcaaacgtt

SEQ ID NO: 2326 - DNA, 1237 bp, Homo sapiens
ccacactttgtcaccaactgctgccgacctcgccaccactgctttgtctctgaggtcagagtgctcctggtgccatgaacggagacgacgcctttgcaaagagacccagggatgatgctaaagcatcagagaagagaagcaaggccttcgatgatattgccaaatacttctctaaggaagagtgggaaaagatgaaattctcggagaaaatcagctgtgtgcatatgaagagaaagtatgaggccatgactaaactaggtttcaacgtcaccctctcacttttcatgcgtaataaacgggccacagactctcagaggaatgattctgataatgaccgtaaccgtgggaatgaggttgaacgtcctcagatgacttttggcaggctccagagaatcatcccgaagatcatgcccgagaagccagcagaggaaggaagtgattcgaagggagtgccagaagcatctggcccacagaacgatgggaaaaagctgtgcccgccgggaaaagcaagtagctctgagaagattcacgagagatctggacccaaaagggggaaacatgcctggacccacagactgcgtgagagaaagcagctggtgatttatgaagagatcagcgaccctgaggaagatgacaagtaactcccctcagggatacgacacatgcccatgatgagaagcagaacgtggtgacctttcacgaacgtgggcatggctgcggacccctcgtcatcaggtgtatagcaagtgaaagcaagtgttcacaacagtgaaaagttgagcgtcatttttcttagtgtgccaagagttcgatgttggcgtttccgttgtattttcttgcagtgtgccattctgttagacattagcattttcgttgatgagcaagacatgcttaatgcatatttcggcttgtgtatccatgcacctacctcagaaaacaagtattgtcaggtattctctccatagaacagcactaccctcctctctccccagatgtgactactgaggggaggtctgagtgtttaatttccgattttttcctctgcatttacacacacaccacacacgcacacacacacaccaagtaccagtataagcatctcccatctgcttttctccactgccatgtgtcctggtcaagcccccctcactctgtttcctgttcagcatgtactcccctcatccgattcccctctatcagtcactgacagttaataaacctttgcaaacgttcccca

SEQ ID NO: 2327 - DNA, 1311 bp, Homo sapiens
ccaggctccagggacagaaccttctcaaagtgggggtggagactctgattttcccgcctaaagcatcccctgggattggctactttaagttcagagtatgcatgctctgactttctctctcgattcttccatactcagagtcagactgctcctggtgccatgaacggagacgacgcctttgcaaggagacctagggctggtgctcaaataccagagaagatccaaaagtccttcgatgatattgccaaatacttctctaagaaagagtgggaaaagatgaaatccttggagaaaatcagctatgtgtatatgaagagaaagtatgaggccatgactaaactaggcttcaaggccaccctcccacctttcatgcataatacaggggccacagacctccaggggaatgattttgataatgaccgtaaccaagggaatcaggttgaacgtcctcagatgactttttgcaggctccagagaatcttcccgaagatcatgcccaagaagccagcagaggaaggaaatgattcgaagggagtgccagaagcatctggctcacagaacgatgggaaacacctgtgccctccaggaaaaccaagtacctctgagaagattaacaagacatccggacccaaaagggggaaacatgcctggacccacagactgcgtgagagaaagcagctggtgatttatgaagagatcagcgaccctgaagaagacgacgagtaactcccctcggggatacgacatatgcccatgatgagaagcagaacgtggtgacctttcacgaacatgggcatggctgcggacccctcgtcatcaggtgcatagcaagtgaaagcaagtgttcacaacagtgaaaagttgagcgtcgtttttcttagtgtgacaagagttcgatgttagtgtttccattgtattttcttacagtgtgccattctgttagatattagcgttttcattgatgagcaagacatgcttaatgtgtatttcggtttgtgtatccatgcacctacctcagaaagcaagtatagtcaggtattctctccatagaacagcactaccctcctctctccccagatgtgactactgagggcagatctgagtgtttaatttccgattttcccctctgcatttacacaccagacacacaaacacacacacacagacacacacacacacagacacaccaagtaccagtataagcatctcccatatgcttttccccattgccatgagtcctggtcaagccccccttcaatttgtttcctgttcagcatgtactcccctcctctgattccccgtatcagtcac

SEQ ID NO: 2328 - DNA, 1230 bp, Homo sapiens
aaagcatcccccgggattggctactttaagttcagagtatgcagacagactgctcccggtgccatgaacggagacgatgcctttgcaaggagacctagggctggttctcaaataccagagaagatccaaaaggccttcgatgatattgccaaatacttctctaagaaagagtgggaaaagatgaaatcctcggagaaaatcatctatgtgtatatgaagagaaagtatgaggccatgactaaactaggtttcaaggctaccctcccacctttcatgtgtaatacaggggccacagacctccaggggaatgattttgataatgaccgtaaccacaggaatcaggttgaacgttctcagatgactttcggcaggctccagggaatcttcccgaagatcatgcccaagaagccagcagaggtaggaaatgattcgaaggaagtgccagaagcatctggcttacagaacgatgggaaacagctgtgccccccgggaaaaccaactacctctgagaagattaacaaggcatctggacccaaaagggggaaacatgcctggacccacagactgcgtgagagaaagcagctggtgatttatgaagagatcagcgaccctgaagaagacgacgagtaactcccctcggggatacgacacatgcccatgatgagaagcagaatgtggtgacctttcacgaacgtgggcatggctgcggacccctcgtcatcaggtgcatagcaagtgaaagcaagtgttcacaacagtgaaaagttgagcttcattttttagtgtgccaagagttcgatgttagtgtttccgttgtattttcttatagtgtgcaattctgttagatattaatgttttcattgatgagcaagacatgcttaatgtgtatttcggtttgtgtatccatgcacctacctcagaaaacaagtatagtcaggtattctctccatagaacagcactaccttcctctctccccacatgtgactactgagggcagttctgagtgtttaatttccgattttctcctctgcatttacacacacacacacacacacacacagagacacacacacacaccaagtaccagtataagcatctcccatctgcttttccccattgccatgcgtcctggtcaagcccccctcactctgtttcctgttcagcatgtactcccctcctctgattccccgtatcagtcactgacagttaatacacctttgcaaacgttc

SEQ ID NO: 2329 - DNA, 654 bp, Homo sapiens
ctttcgattcttccatactcagagtacgcacggtctgattttctctttcgattcttccaaaatcagagacagactgctcccggtgccatgaacggagacgatgcctttgcaaggagacctagggctggttctcaaataccagagaagatccaaaaggccttcgatgatattgccaaatacttctctaagaaagagtgggaaaagatgaaatcctcggagaaaatcatctatgtgtatatgaagagaaagtatgaggccatgactaaactaggtttcaaggctaccctcccacctttcatgtgtaatacaggggccacagacctccaggggaatgattttgataatgaccgtaaccacaggaatcaggttgaacgttctcagatgactttcggcaggctccagggaatcttcccgaagatcatgcccaagaagccagcagaggtaggaaatgattcgaaggaagtgccagaagcatctggcttacagaacgatgggaaacagctgtgccccccgggaaaaccaactacctctgagaagattaacaaggcatctggacccaaaagggggaaacatgcctggacccacagactgcgtgagagaaagcagctggtgatttatgaagagatcagcgaccctgaagaagacgacgagtaa

SEQ ID NO: 2330 - DNA, 6216 bp, Homo sapiens
ccccgcctttattcagcttccggtagacgctggtagggtaagggagctaagtagatcacttccgggcgactgttgttttatttccggtttatgcgacccggctgcgatttgctgctgagggcagcagctaccgtcactgccgccatcatgtcagactcggacagcgaggaagattcatctggaggtggcccatttactttagcgggtatccttttcggcaacatcagtggagcggggcagctggagggggaaagcgtcttggatgatgagtgtaagaagcacttggcaggcttgggggctttggggctgggcagcctaatcactgaactcacggcaaatgaagaattgactgggactggcggtgccttggtaaatgatgaagggtggattaggagtacagaagatgctgtagactattcagacatcaatgaggtggcagaagatgaaagccaaagacaccagcagacgatggggagcttgcagcccctttaccactcggattatgatgaagatgactatgatgctgattgtgaagacattgattgcaagttgatgcctcctccacctccacccccgggaccaatgaagaaggataaggaccaagatgctattacctgtgtgtctgaaagtggagaagacatcatcttgccctccatcattgccccttcctttttggcctcagagaaagtggatttcagtagttactctgattcagaatctgagatgggacctcaggaagcaacacaggcagaatctgaggatggaaagctgacccttccattggctgggattatgcagcatgatgccaccaagctgttgccaagtgtcaccgaactttttccagaatttcgacctggaaaagtgttacgcttcctacatctttttggaccagggaagaatgtcccatctgtttggcggagtgctcggagaaagaggaagaagcatcgtgagctgatacaggaagagcagatccaggaggtggaatgctcagtagaatcagaagtcagccagaagtctttgtggaactatgactatgctccaccaccacccccagagcagtgtctcgctgatgatgaaatcacgatgatggttcctgtggagtccaaattttcccaatcaactggagatgtagataaagtgacagataccaaaccaagagtggctgagtggcgttatgggcctgcccgactgtggtatgatatgctgggtgtctccgaagatggcagtgggtttgactatggcttcaaactgagaaagacacaacatgaacctgtgataaaatctagaatgatggaggaatttaggaaacttgaggaaagcaatggcactgatcttctggctgacgaaaacttcctgatggtgacacagctgcattgggaggattctatcatctgggatggggaggatatcaaacacaaagggacaaaacctcagggtgcaagcctggcaggctggcttccttctattaagactaggaatgtaatggcttacaatgttcagcaaggttttgcacccactctggatgatgacaaaccttggtactccatttttcccattgacaatgaggatctggtgtatggacgctgggaggacaatatcatttgggatgctcaggccatgccccggctgttggaacctcctgttttggcacttgatcccaatgatgagaacctcattttggaaattcctgatgagaaggaagaggccacctctaactccccctccaaggagagtaagaaggaatcatctctgaagaagagtcgaattctcttgggcaaaacaggtgtcatcagggaggaaccacagcagaacatgtctcagccagaagtgaaagatccatggaatctctccaatgatgagtattatttccccaagcaacagggtcttcggggcacctttggagggaatattatccagcattcaattcctgctatggaattatggcagcccttctttcccacccacatggggcccatcaaaatccggcagttccatcgcccacctctgaaaaagtactcatttggtgcactctctcagccaggtccccattcagtccaacctttgctaaagcacatcaaaaaaaaggccaagatgagagaacaagagaggcaagcctcaggtggtggagagttgttttttatgcgcacacctcaggatctcacaggcaaagatggagatcttattcttgcagaatatagtgaggaaaatggacccttaatgatgcaggttggcatggcaaccaagataaagaactattataaacggaaacctggcaaagatcctggagcaccagattgtaaatatggggaaactgtttactgccatacatctcctttcttgggctctctccatcctggccaattactgcaggcacttgagaacaacctttttcgtgctccagtgtatcttcataagatgccagaaactgattttctgatcattcggacaagacagggttactatattcgggaattagtggatatttttgtggttggccagcagtgtcccttgtttgaagttcctgggcctaactccagaagggccaatatgcatattcgagactttctacaggtttttatttaccgccttttctggaagagtaaagatcggccacggaggatacgaatggaagatataaaaaaagcctttccttcccattcagaaagcagcatccggaagaggctaaagctctgcgctgacttcaaacgcacagggatggattcaaactggtgggtgcttaagtctgattttcgtttaccaacggaagaagagatcagagctaaggtgtcaccagagcagtgctgtgcttattatagcatgatagctgcaaagcaacgactgaaggatgctggctatggtgagaaatccttttttgccccagaagaagaaaatgaggaagatttccagatgaagattgatgatgaagttcacgctgctccttggaacaccacaagggccttcattgctgccatgaagggcaagtgtctcctagaggtgactggggtggcagatcccacagggtgtggtgaaggattctcctatgtgaagattccaaataaaccaacacagcagaaggatgataaagagccacaggcagtgaagaagacagtgacaggaacagatgcagaccttcgtcgcctttccctgaaaaatgccaagcaacttctacgtaaatttggtgtgcctgaggaagagattaaaaagttgtcccgctgggaagtgattgatgtggtgcgcacaatgtcaacagaacaggctcattctggagaggggcccatgagtaaatttgcccgtggatcaaggttttctgtggctgagcatcaagagcgttacaaagaggaatgtcagcgtatctttgacctacagaacaaggttctgtcatcaactgaggtcttatcaactgacacagacagcatctcagctgaagatagtgactttgaagaaatgggaaagaacattgagaacatgttgcagaacaagaaaaccagctctcagctgtcacgtgaatgggaggagcaggagcggaaggaactacggcgaatgctactggtagcaggctcagcagcatcaggaaacaatcacagagatgatgtcacagcttccatgactagccttaagtcttctgccactggacactgtctcaagatttatcgcacatttcgagatgaagaggggaaagagtatgttcgctgtgagacagtccgaaaaccagctgtcattgatgcctatgtgcgcatacggactacaaaagatgagaaattcattcaaaaatttgccctttttgatgaaaaacatcgggaagagatgcggaaagaacggcggaggattcaagagcaactgaggcggcttaagcggaaccaggaaaaggagaagcttaagggtcctcctgagaagaagcccaagaaaatgaaagagcgtcctgacctaaaactgaaatgtggggcatgtggtgccattggacatatgaggactaacaaattctgccccctctattatcaaacaaatgtgccaccttcgaaacctgttgccatgacagaagagcaggaggaggagttggaaaagacagtcattcataatgataatgaagaacttatcaaggttgaagggaccaaaattgtcttcgggaaacagctaattgagaatgtgcatgaggttcgcagaaaatctctggttctcaagtttcctaaacagcagcttcctccaaagaagaaacggcgagttggaaccactgttcattgtgactatttgaatatacctcataagtccatccaccgacgccgcacagaccctatggtgacgctgtcatccatcctggagtctatcatcaatgacatgagagatcttccaaatacacaccctttccacactccagtcaatgcaaaggttgtaaaggactactacaaaatcatcactcggccaatggacctacaaacactccgtgaaaatgtgcgtaaatgcctctacccatctcgggaagagttcagagagcatctggagctaattgtgaaaaacagtgcgacctacaatgggccaaaacattcattgactcagatctctcaatccatgctggatctctgtgatgaaaaacttaaagagaaagaagacaaattagctcgcttagagaaagctatcaaccccttgctggatgatgatgaccaagtggcattttctttcattctggacaacattgtcacccagaaaatgatggcagttccagattcttggccatttcatcacccagttaataagaagtttgttccagattattacaaaatgattgtcaatccagtggatttagagaccatacgtaagaacatctccaagcacaagtatcagagtcgggagagttttctagatgatgtaaaccttattcttgccaacagtgttaagtataatggacctgagagtcagtacactaagactgctcaggagattgtgaacatctgttaccagacaattactgagtatgatgagcatttgactcaacttgagaaggatatttgtacagctaaagaagcagctttggaggaagcagaattagaaagcctggacccaatgaccccagggccctacacatctcagcctcctgatatgtatgataccaacacatccctcagtacgtctcgagatgcctctgtatttcaagatgagagcaatttgtctgtcttggatatttccactgccactccagaaaaacagatgtgccagggccaaggtaggctgggtgaggaagactctgatgtggatgttgaagggtatgatgatgaggaggaggatgggaaacctaagcctccagccccagaagggggagatggtgatcttgcagatgaagaggaaggaactgtacaacaacctgaagccagtgtcctgtatgaggatttgcttatatctgaaggagaagatgatgaggaagatgctgggagtgacgaagaaggagacaatcctttctctgctatccagctgagtgaaagtggaagtgactctgatgtgggatatggtggaataagacccaaacaacccttcatgcttcagcatgcttcaggagaacacaaggatgggcacggaaaatgaagaaagcatgatgtcccatgagggagacggtggggaggcttcccatgatttggaggatagcaacatcagttatgggagctgtgaggagcctgatcccaagttgaacacccaagacacaagcttcagcagcatcggaaatttccagctgggcatggtggctcacacctgtaatctcagcactctgggaggccgaggcgggtggatcacctgaggtcagttcgagaccagcttggccaacatgtcgaaacttcatctctactaaaaatacaaaaattagccaggtgtggtggtgcacgcctgtaatccccagatactcgggaggctgaagcaggagaattgcttgaacccgggaggcagaggttgcagtgagtggagatcacgccactgcgctccagcctgggcgaaagagtgagactccatctcaaaaaaaaagaaaatttccaagcatggtatcatctcacttttctaatttacaggctggaacagatgagagccctcctgctgggacagagaattgggttctagtggactctgctacacttaaacctatgtgacaaaccgcccattattttattgtttatttaattatacaatgcctcgttcctatatggatttgaggcaaattaccataaattttgaaacagc

SEQ ID NO: 2331 - DNA, 813 bp, Homo sapiens
gtgtaaccagctgggagccagccggcaggacgctgtgagttggcgtgctagtgggatggcagatgaggaagaagaccccacgtttgaggaagaaaatgaagaaattggaggaggtgcagaaggtggacagggtaaaagaaagagacttttttctaaagaattgcgatgtatgatgtatggctttggggatgaccagaatccttatactgagtcagtggatattcttgaagatcttgtcatagagtttatcactgaaatgactcacaaggcaatgtcaattggaagacaaggtcgagtacaagttgaagatatcgtcttcttgattcgaaaggacccaaggaagtttgccagggttaaagacttgcttactatgaatgaagaattgaaacgagctagaaaagcatttgatgaagcaaattatggatcttgacactttttgtagtttccgaaaattaccatctggggaaaccatatataataattgtatattttctaaagtaagattctgatatctagccatgtaaatgaaagatggagaaacacaaagttttcagcctttatttttatgcctttgattttagggtgatattggtgcatgtaattgcctgcctttatattaccatacttgaattacttactgggttttaatgaccacacataagtcaaagtaccttgcaaaccatgccgttgttctgacttttgactatttaaaggataaagtagtatttaatgtgttaggtatgtttatgcccttgtaagctatactgtagctttttttttttttttttttttttttgagatggagtctcacta

SEQ ID NO: 2332 - DNA, 1063 bp, Homo sapiens
gctgtgagttggcgtgctagtgggatggcagatgaggaagaagaccccacgtttgaggaagaaaatgaagaaattggaggaggtgcagaaggtggacagggtaaaagaaagagacttttttctaaagaattgcgatgtatgatgtatggctttggggatgaccagaatccttatactgagtcagtggatattcttgaagatcttgtcatagagtttatcactgaaatgactcacaaggcaatgtcaattggaagacaaggtcgagtacaagttgaagatatcgtcttcttgattcgaaaggacccaaggaagtttgccagggttaaagacttgcttactatgaatgaagaattgaaacgagctagaaaagcatttgatgaagcaaattatggatcttgacactttttgtagtttccgaaaattaccatctggggaaaccatatataataattgtatattttctaaagtaagattctgatatctagccatatcgcaccactgcactccagcctgggcgacagagcgagactccgtctcaaaaaaaaaaaaaagaaagcaagtttcacatgaataatgctgtgttggaaggctttttgatttaaaatcttttcggatttataacatcctgttaagttttaggagaacccgttttcccagagcagattcaagcttctaaaaataaatgctttcagtagcaggaatggcattgtttaaaaagctgatggcagggtaagcatttgggttagtgttttattaacatatttgtaagtacttgttcattgtggaaatgtgtccttgactaaaaccatacgtggctatggaaaccatgtttgtagttctgaatacacaggttttgtgtgtatttactctatgtattaaattattattgcccttagtttaaagtaaggattacaattggatttaagtagatcactgaatgttattgtttatgaaacttaactttttgtatgctgcttataaacatgatctataaatcagtgcttgggaaaattttactttcttaatctactgatacaggaataaaatatgaacaattaaacag

SEQ ID NO: 2333 - DNA, 5048 bp, Homo sapiens
acttccgctgacgtcggaggtcagaggttacagacaagatgtcggcggatggtagcttcgagcccttgcggagaggagcatctctgtgacagaagcttgtcgacggcggcttctaggagctagtcgaaggagcgaggttgaggcgggcagcgacccgtcaggtcgctcacctgggcaccggccagctgcgagacgtgacttggggaccgcaggggagtggagagtgtgaggtgccaaagactagtaatgccccgtatccccctaggaagccgggaagccaagctccgcgggaccgcttcatgccgctgactggtgtagagcccgccagaatgaacaggaagaaaggagacaagggctttgaaagcccaaggccatataaattaacccatcaggtcgtctgcatcaacaacataaatttccagagaaaatctgttgtgggatttgtggaactgactatatttcccacagttgcaaacttgaatagaatcaagttgaacagcaaacagtgtagaatataccgagtaaggatcaatgatttagaggctgcttttatttataatgacccaaccttggaagtttgtcacagtgaatcaaaacagagaaacctcaattatttttccaatgcttatgcagctgcagttagtgctgtggaccctgatgcaggaaatggagaactttgcattaaggttccatcagagctatggaaacacgttgatgagttaaaggtcctgaagatacacatcaatttttctttggatcagcccaaaggaggtcttcattttgtggtacccagtgtagagggaagtatggcagagagaggtgctcatgttttctcttgtgggtatcaaaattctacaagattttggttcccttgtgttgattcatactctgaattgtgtacatggaaattagaatttacagtagatgctgcaatggttgctgtttctaatggcgatttggtggagacagtgtatactcatgatatgaggaagaaaactttccattatatgcttaccattcctacagcagcgtcaaatatctccttggccattggaccatttgaaatactggtagatccatacatgcatgaggttactcatttttgtttgccccaacttcttccattgctgaaacataccacatcataccttcatgaagtctttgaattttatgaagaaattcttacatgtcgttacccatactcctgttttaagactgtcttcattgatgaggcttatgttgaagtggctgcttatgcttccatgagcatttttagcacaaatcttttacacagtgccatgattatagatgagacacctttgactagaaggtgtttagcccaatccttggcccagcagttttttggttgtttcatatctagaatgtcttggtctgatgaatgggtgctgaagggaatttcaggctatatctatggactttggatgaaaaaaacttttggtgttaatgagtaccgccattggattaaagaggagctagacaaaatagtggcatatgaactaaaaactggtggggttttactacatcccatatttggtggaggaaaagagaaggataatccggcttcccatctacacttttcaataaagcatccacatacactgtcctgggaatactacagtatgtttcagtgtaaagcccaccttgtgatgagattgattgaaaataggatcagtatggaatttatgctacaagttttcaataaactgctaagtctggctagtactgcttcatctcagaagttccagtcacatatgtggagtcagatgttggtttccacatctgggtttttgaaatccatttcaaatgtctctggcaaagatattcagccgttaataaagcagtgggtagatcagagtggagtggtaaaattttatggaagttttgcatttaatagaaaacgaaatgtcttggaactggaaataaaacaggactatacatctcctggaactcagaaatacgtgggaccacttaaagtgacagtgcaggagttagatggatccttcaatcatacactgcaaattgaagaaaacagccttaaacatgatataccctgccattccaaaagtagaaggaataaaaagaaaaaaatcccactgatgaatggagaagaagttgatatggatctttctgcaatggatgctgattcccctttgctgtggataaggatagacccagatatgtcagtattgaggaaggtagaatttgagcaagctgattttatgtggcagtatcagctccgctatgagagagatgttgttgcacagcaggaatccattttggctttggaaaaattccctactccagcatctcggcttgcactcactgatatattagaacaagagcagtgtttctacagagtaagaatgtcagcttgcttctgtcttgcaaagattgcaaattcaatggtgagcacatggacaggaccaccagccatgaagtcactcttcactaggatgttttgttgtaaaagttgtccaaacattgtgaaaacaaacaactttatgagctttcaaagctattttctacagaagactatgccagttgcaatggctttattaagagatgttcataatctttgtcctaaagaagtcttaacatttattttagacttaatcaagtacaatgacaacaggaaaaataagttttcagataactattatcgtgcagaaatgattgatgccctggccaactctgttacacctgcagtcagtgtgaataatgaagttagaactttggataacttaaatcctgatgtgcgactcattcttgaagaaatcaccagatttttgaatatggaaaaacttcttccgagttacaggcataccatcactgtcagttgtttgagagccatacgggtacttcagaagaacggacatgtgccaagtgatccagctctttttaaatcttatgctgaatatggccactttgtggacattaggatagcagctttggaagcagttgttgattatactaaagtggacagaagttatgaagaactgcaatggctacttaatatgattcagaatgaccctgtaccctatgtaaggcataagattctcaacatgttgactaagaacccaccatttactaagaacatggagtctcccttatgcaatgaagccctggtagatcaactttggaaacttatgaattctggtacttcacatgactggaggttacggtgtggtgctgtggacttgtacttcacactttttggcctcagtagaccttcctgtttacccttgccagagcttgggttggttcttaatctaaaggagaaaaaagctgtcttgaatcctaccataattccagagtcagtagcaggcaaccaagaagctgcaaataatccaagcagtcacccacagctagttggatttcagaaccctttttccagttctcaagatgaggaggagattgatatggatactgttcatgatagccaggccttcatttcccatcatttaaacatgcttgaaaggccgtcaactccagggctctcgaaatatcggccagctagctcccgatctgctttaataccccagcactcagcaggctgtgacagcacacccaccacaaaaccccagtggagtttggaacttgcacggaagggaacaggtaaagaacaagcacctttggagatgagtatgcatccagcggcaagcgctccactctcagtctttactaaggaatctacagcctccaaacacagtgaccaccatcaccaccatcaccatgagcacaagaaaaagaagaagaagcataaacataagcacaaacacaagcataagcatgacagtaaagaaaaggacaaggagcctttcactttctccagccctgccagtggcaggtctattcgttctccttccctttcagactgagaaggggacaaaaagacctttcctttcatgtccagaagaatgtatgtaactaaagctttgtcctctgtgaagaattataaaagggaggggggaaaggattcgcctctcctacagaaattctgaattcatttaagttctaagcatttgatttatgttatttatacagttgggatctaattaggaaaatgtgttttgtagttctggataaactatttcatccgctgtttcctccccaaaacacacacacagagcaaactccctttcataaaagccctcatatccactggcagtccccgttcgcatcatggtctccatgtgtaccgccaaagtcaattatgtttgaaagcctttggtggatgttatggggcaaagttatgatttacacagaagcaactgccaaatctgtggtgcaaccactatctccagtgaaatattgtataacaccatttggaactactgaaaagacagtggcttttctacagtactcttccttattgcaccatttttgtattaacgtagaaactaagcatcagaatttatgaacaaagaatatgttatttttccttttgctctaaaatactgagatttggggaagcaattcttttttaaaaaaattttgaataactatcttttgataacacattcggcggttacgatgttggaatttagcagaactatcaaatccaaaattattttcaaatcaagatgtttaaattataagtttttttgttttgttttccagtaagtataaatgaaaatattcatatgtaaaatatgttttgcttaatgtggacaatttacacacccaacacatactgtttccaaaattatttctatatgacacaaagtatgatacctttaaaaaggtgagcttatatattgtttattaacctggaaatagacaatttggctctcataccataagcatttaaaaacatatgaaatattttgatttctttatatggtggtgtgtttttatttctgaattttccatgtgctttaatatttgtttaagaatattttttatatctgttcaatttttatcattccccttatcattagaaagtttgacaaaaatacttgaatcttggacctctaaatatacttttagttgtgtttaacttgtttaataaataactttttaagttg

SEQ ID NO: 2334 - DNA, 3112 bp, Homo sapiens
gcggccgcccagagcggcggcgggggcggcggggcgcggggcgcgggggcccagctgagccggccgtcggagtgagaccctgcggcagagacgacggaggcggaagcaacccgatcccggaggcggcggcggcggggggagccggagccgcctgggatgttcagtcatgaaacgagtgcgtaccgagcagattcagatggcagtgtcctgctacctcaaacgccggcagtacgtggactcagatggtcccctgaagcaaggactgcggctgtcacagactgctgaagagatggcggccaatctaacagtgcaatcagaatctggttgtgccaacatagtgtctgcagccccttgccaggcagaaccccagcaatatgaagtacagtttggacgactgcggaattttctcactgattctgattcccagcatagccacgaagtgatgcctctcctctatcctctctttgtctacctccatctcaacctggtccaaaacagtccgaagagcacagtggaaagtttttacagccgcttccatggaatgtttctgcagaatgctagccagaaggatgtcattgagcagctacagaccactcaaaccatccaggacatcctatctaacttcaagcttcgagcattcctagataacaagtacgtggtccgtctccaagaagacagctacaactaccttatccgctacctccaaagtgacaacaatactgccctgtgcaaagtcctcaccttacatattcatcttgacgtgcagcctgccaagagaacagactatcagctgtatgccagtggcagctcctcccgcagtgagaacaacggtttggagccccccgacatgcccagccctattctgcagaacgaggctgccctagaggtcttacaggagagcattaagcgagtcaaggatgggcctccctccctcactaccatctgcttctatgccttctataacacagagcagctgttgaacactgcagaaatctcccccgatagcaagctgcttgctgctgggtttgacaactcctgtataaaactttggagtttacgatccaagaagttaaaatcagagccccaccaagtagacgtgtcccgcatccatttggcttgtgatattctggaggaggaggatgatgaggatgataatgcaggcacggagatgaagatactgcggggccactgcggaccagtgtacagcacgaggttcctcgcggacagctcagggttgctctcttgttctgaagacatgtccatcagatactgggatctggggagtttcaccaacactgtgttgtaccaaggacatgcctatcctgtgtgggatctggacatcagtccatatagcctgtacttcgccagcgggtcccacgaccgcaccgccaggctgtggtcatttgatcggacgtacccgctgaggatatatgcaggacacctggcagatgtggactgtgtcaaattccaccctaattcaaactacttggccacgggctcaaccgacaagaccgtccggctgtggagcgctcagcaggggaactcggtgaggcttttcacaggccaccgtggccccgtgctttctctcgccttttctcccaacggtaagtacttggcgtctgctggcgaggaccagcggttgaagctgtgggacttggcctctgggaccctttataaagagttgagaggccacacagacaatatcaccagcctcaccttcagtccagacagcggcttgattgcctctgcctccatggacaactcggtgcgcgtctgggacatcaggaacacttactgcagtgcacctgccgacggctcctccagcgagctcgtgggcgtgtacaccgggcagatgagcaacgtcctgagcgtgcagttcatggcctgtaaccttcttctggtgactggaattacacaagaaaatcaggaacattaattttttaactttgttggaacggactggggtaacagtggaaagcctccagttgcaatccttcaatgagctgagattgaatcattgactgtgaaagagccccctcctcccctctctcctgggccctcattccgggcaggtcccccttcactcagccccccagtgtcgaaggccaaggttggggaggggaacaggagagaggcaatgatgagtgatcaagaattagagtgccctggaggtcactcacaagtcctcatggagactctgccgtgacctcgcgcatgcgagcaccttcctgtctctcattttcaccatctgactggggctaggtttggttagagggcggctgtagagcaccctcaggagaagtggcgccgcaggggtcacgcatggtccagccctcaggtgggagggaagtccttgttggcagagggatgtggggcgggaatgaggaaaggggagggcatgatcctggcaaatagtctttccttttccgtaattacagagaaccaggattttttttaattattgttattataattataattattattattattgacatgaggaaacctagcactggcagagggcaccttctctgcttttaatctttcaggtttgactcctggcactggttttgatacttggaattttgaggttcagggaattcagagaatttggtagcacagtgtattgggagaaagggaaatttcgggtgacagattgatcaccctggctgacatgtttctggaagtgggtgggtgggtttgattgagaacactttgggctcctgcagtgatggtgggaaagaaaaattctttccaaagctgcacttctcttaataattctctcccctcaaaagaaagattatgataaagaataatttggagtaataagtaacaagatagaattagaaaaatgttgaatttctgaatgaccattcagaggtgtggctttttccacgtctttttctcctgcaatgaactgctcccacgtcctgcactgcaataccagtctaatgaacactttgtgaaacaaatcgtaagtatgtacgcacgcatatcaaactatgctctgaggataaagcaagttctaatttgtggaaaaaggattaaatatttctgttttctgaaaagagttattttgtattttgttttctattaaaatgtatttagtttc

SEQ ID NO: 2335 - DNA, 492 bp, Homo sapiens
gcggccgcccagagcggcggcgggggcggcggggcgcggggcgcgggggcccagctgagccggccgtcggagtgagaccctgcggcagagacgacggaggcggaagcaacccgatcccggaggcggcggcggcggggggagccggagccgcctgggatgttcagtcatgaaacgagtgcgtaccgagcagattcagatggcagtgtcctgctacctcaaacgccggcagtacgtggactcagatggtcccctgaagcaaggactgcggctgtcacagactgctgaagagatggcggccaatctaacaggtaatggtgggggctcgtctggtggggtgagcctggagcaggagaactcacgtcaatatccatgtggaattacttctcctcttctcaagacagtgccagagagagcagactgaccaaaaacctcagtgagctacgttaagtgaatgatgttggcctcagagaccctgtctgtcatttagagcgg

SEQ ID NO: 2336 - DNA, 4062 bp, Homo sapiens
ccctgcggcagagacgacggaggcggaagcaacccgatcccggaggcggcggcggcggggggagccggagccgcctgggatgttcagtcatgaaacgagtgcgtaccgagcagattcagatggcagtgtcctgctacctcaaacgccggcagtacgtggactcagatggtcccctgaagcaaggactgcggctgtcacagactgctgaagagatggcggccaatctaacagtgcaatcagaatctggttgtgccaacatagtgtctgcagccccttgccaggcagaaccccagcaatatgaagtacagtttggacgactgcggaattttctcactgattctgattcccagcatagccacgaagtgatgcctctcctctatcctctctttgtctacctccatctcaacctggtccaaaacagtccgaagagcacagtggaaagtttttacagccgcttccatggaatgtttctgcagaatgctagccagaaggatgtcattgagcagctacagaccactcaaaccatccaggacatcctatctaacttcaagcttcgagcattcctagataacaagtacgtggtccgtctccaagaagacagctacaactaccttatccgctacctccaaagtgacaacaatactgccctgtgcaaagtcctcaccttacatattcatcttgacgtgcagcctgccaagagaacagactatcagctgtatgccagtggcagctcctcccgcagtgagaacaacggtttggagccccccgacatgcccagccctattctgcagaacgaggctgccctagaggtcttacaggagagcattaagcgagtcaaggatgggcctccctccctcactaccatctgcttctatgccttctataacacagagcagctgttgaacactgcagaaatctcccccgatagcaagctgcttgctgctgggtttgacaactcctgtataaaactttggagtttacgatccaagaagttaaaatcagagccccaccaagtagacgtgtcccgcatccatttggcttgtgatattctggaggaggaggtatgaataccatttttttcttccctgcacccgccttcctaatttccttagaatgtccttaccaaacacgacatatcttagaatggacttcctagtttccctcatcatatagctaaagccagactaatgacatgttacctgtagccattgaattcctgcacatgcctaacctaagatgcaaaaacaatttttagcagcattaacttcttattaatgaatggtcagtatttatactatgtgaaatgtggatagcaacactaagcctaatgaaagacctttagctaatattgactttagctgagatttgcagtaaatatacacttatgtgtgtgcacatttgctcaggtacaaataatcggtagtaggataactgagtcgaagggcctccattgtcaactgtaatgaatattattttccccacagaaggttgtgccatttcacagtctcagcaacagtagtaagaatactggcatccctgcaccctcaccacactggatggatggtattggctttctgaggccagtgcatatcctgtggctccatgtaccccggggtgttcccagaccccacttggagaagtaacacaggaagtagagttgccagctcccctccccccgtcagtcagtgttcaatcttgtttggcttgtaaccgtttaggacagtcattgaaaagggcaggcgcagcttgggtttcaggtcaccaaaaatcactaccttagaaaaaatgtgggccaaggaagatagaaattaaacttcacagcattaacttttctttagagtggtcctgaaaaagctgtgggccaaagtatttttgtcttatcaccactgaaattcaggtagctctgcctcacattactttggatggaaaattctttacacaatgttgaataattaaggagcaaaaaaatcactctaattaaattacagttaatgataaggatgtcaagaatattgggtgccctaaattaaaccattgttttcctgttcctgttttctgagtccacttccagttaggatggcctttgaatttttgattcttgcaaccgagacagtataattgaaggatttccttgtgatgagtgaagagtctagattcccatgtagaagctttaatttctagaattttatagtactctccaaaatattttttattacatttgtatttgaattttcaaacatctcttttccttggagacagttccctttttgggagttcttctgataaaactgaggaatactgcctgcatttgctttcgattttctgtaaatacaaaaaaaaattacactgaccttattagctttgatgatacagagtttggagattattctgtgcattaaaaattaatattaaagaagatagcattatgacatctgataacagtagaccaaaataaaacattttaagactctggccactactggtaactagctctgtggcttgtcctatgtttatttccgggtatcagaagtgtatctgaagactcagaagtgaggaaccgcatgcggaattccaggaactgaaagaaattaagtatggctggagttaggagaggggccaagacaggaagtgatgtagtgacactgtcttatatgagcaattatggcggccaaactagggtagtggcagtggcaaaggagacatggatggactagagaagagctcggttattcaattactgtaggggataagggagagcaagcatcaagggtgacgtttgtgtttcaggcttaaacagttggatgtccatcaagaagaaagcaaaagacgtcattggaatggtggttttgtttaagcatttctggctttccatcatggttcatactgaaagtactgtagatgctagctaacctctgccctttttaagaataaaccttttttttaaacttaagaactaaagctgagattctcctattctgttgttgaggggcttcctgcatgcccgcccattttatcacagcaatttgagaagttttctttttggtttctgacaacaagcatttggggagaaagccaggcataaattagttacgatagttggtgtttaatgtttctccagtgaaaatttggacttttctttttcccttatagaatgcataattaaaacagactattattttgaaatgaaatattgaatattaaaaaaaataaaatagagactcttaatacaggagccacaaactcacatacctagagaaaccaaacaggtaaaagcaagtggtgaagccacatggattaatgagatgatagaaagtacaaaatcactatgtaagtcagattaaaaagccagcttgcactctctgctttcatctttttgaagcaataactattacataaatcagtgaatacagtatttctacagtatttgaaacggtgttcacacccagcaattccacttctagacatatatccaagagaatggaaaacatgtgcacacaggcacttgtacatgaatatttatggaagcattattcacaatagccaaaaagtggaaacagtccaaatggccatcaagatgaatgaataaataaaatgtagtgtgtgcatgcagtggaatattatttgcccataaaaagaaatgaagcactgatgcaggctgcaacatggatgaacttgaaagctttatgctacgtgaaagaagccagtcataaaaggtcacctactgttattcctttcataggaaatatccagataggcaagtccatagagacagagaggagaggagtggttgccaggggctgggcaaggagaatgagagtgaccgctaatgggtgtggcatttctttgtgaggtaatgaaaatgttctgtattagatagtggtgatcattgcacaactctgtgaatgtactaaaaatcattgaattgtacactttgaaagaattatatagtatgtaattatatctcagtttaaaaaaaaaaacaggataacagtaaccaaaatcttctatgtaagcttaaaattttctctgttaattatgccaaataaaactgaattcacagca

SEQ ID NO: 2337 - DNA, 2956 bp, Homo sapiens
atgaaacgagtgcgtaccgagcagattcagatggcagtgtcctgctacctcaaacgccggcagtacgtggactcagatggtcccctgaagcaaggactgcggctgtcacagactgctgaagagatggcggccaatctaacagtgcaatcagaatctggttgtgccaacatagtgtctgcagccccttgccaggcagaaccccagcaatatgaagtacagtttggacgactgcggaattttctcactgattctgattcccagcatagccacgaagtgatgcctctcctctatcctctctttgtctacctccatctcaacctggtccaaaacagtccgaagagcacagtggaaagtttttacagccgcttccatggaatgtttctgcagaatgctagccagaaggatgtcattgagcagctacagaccactcaaaccatccaggacatcctatctaacttcaagcttcgagcattcctagataacaagtacgtggtccgtctccaagaagacagctacaactaccttatccgctacctccaaagtgacaacaatactgccctgtgcaaagtcctcaccttacatattcatcttgacgtgcagcctgccaagagaacagactatcagctgtatgccagtggcagctcctcccgcagtgagaacaacggtttggagccccccgacatgcccagccctattctgcagaacgaggctgccctagaggtcttacaggagagcattaagcgagtcaaggatgggcctccctccctcactaccatctgcttctatgccttctataacacagagcagctgttgaacactgcagaaatctcccccgatagcaagctgcttgctgctgggtttgacaactcctgtataaaactttggagtttacgatccaagaagttaaaatcagagccccaccaagtagacgtgtcccgcatccatttggcttgtgatattctggaggaggaggatgatgaggatgataatgcaggcacggagatgaagatactgcggggccactgcggaccagtgtacagcacgaggttcctcgcggacagctcagggttgctctcttgttctgaagacatgtccatcagatactgggatctggggagtttcaccaacactgtgttgtaccaaggacatgcctatcctgtgtgggatctggacatcagtccatatagcctgtacttcgccagcgggtcccacgaccgcaccgccaggctgtggtcatttgatcggacgtacccgctgaggatatatgcaggacacctggcagatgtggactgtgtcaaattccaccctaattcaaactacttggccacgggctcaaccgacaagaccgtccggctgtggagcgctcagcaggggaactcggtgaggcttttcacaggccaccgtggccccgtgctttctctcgccttttctcccaacggtaagtacttggcgtctgctggcgaggaccagcggttgaagctgtgggacttggcctctgggaccctttataaagagttgagaggccacacagacaatatcaccagcctcaccttcagtccagacagcggcttgattgcctctgcctccatggacaactcggtgcgcgtctgggacatcaggaacacttactgcagtgcacctgccgacggctcctccagcgagctcgtgggcgtgtacaccgggcagatgagcaacgtcctgagcgtgcagttcatggcctgtaaccttcttctggtgactggaattacacaagaaaatcaggaacattaattttttaactttgttggaacggactggggtaacagtggaaagcctccagttgcaatccttcaatgagctgagattgaatcattgactgtgaaagagccccctcctcccctctctcctgggccctcattccgggcaggtcccccttcactcagccccccagtgtcgaaggccaaggttggggaggggaacaggagagaggcaatgatgagtgatcaagaattagagtgccctggaggtcactcacaagtcctcatggagactctgccgtgacctcgcgcatgcgagcaccttcctgtctctcattttcaccatctgactggggctaggtttggttagagggcggctgtagagcaccctcaggagaagtggcgccgcaggggtcacgcatggtccagccctcaggtgggagggaagtccttgttggcagagggatgtggggcgggaatgaggaaaggggagggcatgatcctggcaaatagtctttccttttccgtaattacagagaaccaggattttttttaattattgttattataattataattattattattattgacatgaggaaacctagcactggcagagggcaccttctctgcttttaatctttcaggtttgactcctggcactggttttgatacttggaattttgaggttcagggaattcagagaatttggtagcacagtgtattgggagaaagggaaatttcgggtgacagattgatcaccctggctgacatgtttctggaagtgggtgggtgggtttgattgagaacactttgggctcctgcagtgatggtgggaaagaaaaattctttccaaagctgcacttctcttaataattctctcccctcaaaagaaagattatgataaagaataatttggagtaataagtaacaagatagaattagaaaaatgttgaatttctgaatgaccattcagaggtgtggctttttccacgtctttttctcctgcaatgaactgctcccacgtcctgcactgcaataccagtctaatgaacactttgtgaaacaaatcgtaagtatgtacgcacgcatatcaaactatgctctgaggataaagcaagttctaatttgtggaaaaaggattaaatatttctgttttctgaaaagagttattttgtattttgttttctattaaaatgtatttagtttcaaaaaaaaaa

SEQ ID NO: 2338 - DNA, 2116 bp, Homo sapiens
aatcaagagccaggaagcctcctggagggccggaaactttccaaggcgcccgccgactggctgtattggggagggcggggccggggccccgggagagggaatgagtgtgagctcgtgagtgggcgccgccgccaccgcccccgccgccgtcgtctcggtagcagccttcgccacgccggggtcttcagctccactggggccatgtcagagcgagaagagcggcggtttgtggagatccctcgggagtctgtccggctcatggcggagagcacgggcctggagctgagcgatgaggtggcggcgctgctcgcagaggacgtgtgctatcgtctgagagaggccacgcagaatagctctcagttcatgaagcacaccaaacgccggaagctgacggttgaggacttcaacagggccctcagatggagcagcgtggaggctgtgtgtggttacggatcacaggaggcactgcccatgcgccccgccagggagggtgaactctactttcctgaggatcgagaggtgaacctggtggagctggccctggctaccaacatccccaaaggctgtgctgagacagctgtcagagttcatgtctcctacctggatggcaaagggaacctggcacctcaaggatcggtgcccagtgctgtgtcttcactgacagatgaccttctcaagtactatcaccaggtgactcgtgctgtgctaggggatgatccgcaactgatgaaggttgcactccaggacttgcagacgaactccaagattggggcactcctgccttactttgtttatgtggtcagtggggtgaaatctgtaagccatgacctggagcaactgcaccggctgctgcaggtggcacggagcctatttcgtaatccgcacctgtgcttggggccctatgtccgctgtctggtgggcagtgtcctctactgtgtcctggagccactggctgcctccatcaaccccctgaatgaccactggactctgcgggatggggctgccctcctgctcagccacatcttctggactcatggggaccttgtaagtggcctctatcagcatatcctgctatccctgcagaagatcctggcagatcctgtgcggccgctctgctgccactatggagccgtggtggggctgcatgctcttggctggaaggcagtagaacgagtcctgtacccacacctgtccacctactggacaaacttgcaggctgtgctggatgattattcagtatctaatgcccaggtcaaagcagatggacacaaagtctatggagccattctggtggcggtagagcgactgctgaagatgaaggcccaggcagcagagcccaacaggggtggcccaggtggcagggggtgccggcgcctggacgacctgccatgggacagccttctctttcaagagtcgtcctccgggggcggtgcagaacccagctttgggtccggcctcccgctgccgccagggggcgcggggccggaggacccttctctttcggtgaccctggccgacatctaccgggagctctacgccttcttcggtgacagcttggccacacgctttggcaccggccagcctgcacccacggctccgcggccgcccggggacaagaaggagccggcggcagccccggactcggtgcggaagatgccgcagctgacggcaagcgccatagtcagcccgcacggcgacgagagcccccggggcagcggcggaggcggccccgcgtcggcctctgggcccgccgcctctgagagcaggcccttgccgcgcgtgcatcgggcgcgcggggcaccccggcagcagggccccgggaccggcacccgcgacgttttccagaagagccgtttcgccccgcgcggcgccccgcactttcgtttcatcatagccgggcggcaggctgggaggcgctgccgcgggcgccttttccagactgccttccccgcgccgtacgggcctagcccggcctcgcgctacgtgcagaaactgcccatgatcggccgtaccagccgccccgcccgccggtgggcgctctcggactactcgctgtacttgccgctctgagtcagtggccccttcgttccttgtaaataaatcccgcccccggaaa

SEQ ID NO: 2339 - DNA, 419 bp, Homo sapiens
gactggctgtattggggagggcggggccggggccccgggagagggaatgagtgtgagctcgtgagtgggcgccgccgccaccgcccccgccgccgtcgtctcggtagcagccttcgccacgccggggtcttcagagctccttgtttagaaactccagagcacgagcagcaaggctggtgtggagggtgttggatcacactcctgggctctccgggaggctgggcagcttttccagtcttcattctccactcccagctccactggggccatgtcagagcgagaagagcggcggtttgtggagatccctcgggagtctgtccggctcatggcggagagcacgggcctggagctgagcgatgaggtggcggcgctgctcgcagaggacgtgtgctatcgtctgagagaggccacgcagaata

SEQ ID NO: 2340 - DNA, 528 bp, Homo sapiens
gagtccttgctccccctccctacttactcagtgcttacttcatgatcttggagaagtcatggaacatttagcctctgagctccactggggccatgtcagagcgagaagagcggcggtttgtggagatccctcgggagtctgtccggctcatggcggagagcacgggcctggagctgagcgatgaggtggcggcgctgctcgcagaggacgtgtgctatcgtctgagagaggccacgcagaatagctctcagttcatgaagcacaccaaacgccggaagctgacggttgaggacttcaacagggccctcagatggagcagcgtggaggctgtgtgtggttacggatcacaggaggcactgcccatgcgccccgccagggagggtgaactctactttcctgaggatcgagaggtgaacctggtggagctggccctggctaccaacatccccaaaggctgtgctgagacagctgtcagagttcatgtctcctacctggatggcaaagggaacctggcacctcaaggatcgg

SEQ ID NO: 2341 - DNA, 4708 bp, Homo sapiens
ggccgcgcgaggtgaccggagtcacagttcccgcaggcggcgacagcagagcgcccactgcctccagcaggtaaccggccgcggccgcgcggcgccggcccagcgcgggcgtgggacgtggagacccggaggagggcggcgggacccgggcggggaaaggcgcggcgtggcttggctcaggtgcgcttctcccacctggcagctcgctcagggctgtggggggtgcctgtgagggcggccccgccttgcgggctggagattaatattaagattggaagtttgtgtcttttgctggatattggaaattgaatgtaatggcaacagaatttataaagagttgctgtggaggatgtttctatggtgaaacagaaaaacacaacttttctgtggaaagagattttaaagcagcagtcccaaatagtcaaaatgctactatctctgtacctccattgacttctgtttctgtaaagcctcagcttggctgtactgaggattatttgctttccaaattaccatctgatggcaaagaagtaccatttgtggtgcccaagtttaagttatcttacattcaacccaggacacaagaaactccttcacatctggaagaacttgaaggatctgccagagcatcttttggagatcgaaaggtagaactttccagttcatcccagcacggacctagctatgatgtgtataacccattctatatgtatcagcacatttcacctgatttgagtcgacgctttcctccccgttcagaagtgaagagactgtatggatcggtttgtgatttaaggacgaacaaacttcccggttcccctgggctaagcaaatctatgtttgatcttacaaactcatctcagcgattcatccagagacatgattcattgtccagtgtacccagtagttcttcttcaaggaaaaattctcaggggagtaacagaagcctggatacaattactctatcaggagatgaaagggactttgggagactgaatgtgaaattgttttataattcttcagtagaacagatctggatcacagttttacagtgcagagatttaagttggccctctagttatggagacactcctactgtttctataaaaggaatacttacattgcccaaaccagtgcatttcaaatcttcagccaaggaaggttccaacgctattgaatttatggaaacgtttgtatttgctattaaacttcaaaatctacaaactgtaagacttgtatttaagattcaaacccagactcccaggaagaaaaccattggagaatgctcaatgtcactcagaacccttagcacacaggaaatggattactctttggatataacaccaccttcaaaaatttctgtttgccatgcagaacttgaattggggacttgttttcaagcagtaaatagcagaattcagttacaaattcttgaggcacggtaccttccaagctcatcaacacctctgactttgagttttttcgtgaaggtgggaatgtttagctcgggagagttgatttataagaaaaagacacgcttactgaaggcctccaatggaagagtcaagtggggagagactatgatttttccacttatacagagtgaaaaagaaattgtttttctcattaagctttacagtcgaagctctgtaagaagaaaacactttgtgggccagatttggataagtgaagacagtaataacattgaagcagtgaaccagtggaaagagacagtaataaatccagaaaaggttgttatcaggtggcacaaattaaatccatcttgaagacttcacacattaatttggtgaagaacttgacattcttttagaagacttatgatttcaatttgctaccaatgagaagaggcaaatcaacaaatttgtcaatttatgggggctataattatggtatataatgtatctgatagaaaatttgataagaaaatgtaatgaattttatcagatatccaaagtaaaggaaatgttttaaaactgcaacaagagacacagacagtaaaatcaaagtattattaggatgactaaataaattataaagtctgtgagaatatcaaccatagatagttctttctatattatgttttcgcttttgtattttaagctttacttagatattcaaaacctggtatatcaagtctctgttagtactattggcatttagaagactttaccattatttcagtgctaggcattattgattaggtcttggctccactgtttacctcttgctatgtattttctcccggtaaaaatgaattgaaccatttcaactattttctatatttggagaaagtttgtgccctgtgttttataatttttttacccataagacatcacattatccctttgtaagctacttatctccaaaaaacttcagaaatagaaaactacattttggcaggaataattgaaaacaccagaaggttgaagtttaattggaaacccagaatatacatactttgctgttttcttccctcaaatattttactatttgttttatttggagttaaaataagagtatcatccatatggtccatcctaattcacagaattaaatgagcttaaatagaaaattcagtattttatgataatcacttcgtttttagtttttaaaatttagattattctataatttaccgtgtttgagtattttctcatttttttcataaccatacctgattatactgtgtaacaaatattttctattgcagttttctttccagtacttattagaactcagtatttggaaataatttcagcttaattgaccataagaactgtggccaaaaagaacagttttttggagaggcagatgacattatacctgattttagaaaatctcactttatttttgctaataagtagactaagtgctctgtgttctcagtcttccctttttttctgcccccattcttactttgtcccaggcatgcagagaaagatggtgatattttaggccaggagtataccttgctataacctaagcatgccttctttattccagctcctatgttctgtgtatatcattaacattttcccaaataaacacttaattctcttttccctaggtgccatctcctcaagctacaaaatgtccacatcttatatcccctttgcttctactgctctgattttgtggtaccagtactctctgccactgaacattttgaaatatttttgttttagatttgcaaaaaatgacatataggtcagtactcacatggatttttaagataaatcacctgtgtgataatattttgaatctgagacgaatacaacttttaaaaattgtttttaaaaatagacttttttttttagagcagttgtaggttaacagaaaaattgagaggaagatagagatttcctttctcccctgacaaagccctcaacagcctcccaggctatcagtatcctgcaccacaatggtacatttgttacaatcaatgaacctactctgaaacatcattatcatccaaagttcatggtttacattagagtcccctcttggtgttatacatgctagaggacaaatatatgatgatatgtatgcatcattataatatagtatagtttcgctgccctaaacatcctctgcaaatgcaactattttaatgggtaccaaagaagtaaatgtatttactggcttttagataataaataacgggctttattgtttattttaaaagctacaatttgttttagctggtttctctgttctattaatgctttgaatttccaaatttaatatatgtagtcatgcatttaacttaatatttaattatttgatttatttaattttctatattcttacaatgtatgtatgatgtataatttaagggaaagctatgacttctcagtttcttagaatcctaggtaaataaaacaataaaaagaaaacccttacatttaaaagagctttcaggtacagaagtattgatacaactaagatcctaaatgttttaattagtgtttacttaagcctttttcaggtgaggaggtactaatgctggttatttccttgaagctttatgtggacctataaataaaaatccaatctcctgctaataggtatgcatattgtgagaaaaacgttaggagctggtagtaaaaaatgagattctatgccaaaataacttctcttcatatttgcctaggcatttcttgacctttacccacttacgcaaggagaaggaaatcataatgatgtcatgtgatcaaaggaaaccatggaagggttcacgctgatagctgatagcttttacagtgctcattcctaacagtggatttacttgtaagctttcagatcaacacaaatagctgcagcctgggttaaaatataacatcactatttggcttttgttttgcatgatttttaaaagcagtactcctagggaaatggcctctgaagtatatcagtttcatctcttaccaagactgttaagaagaaactagtgggattttgaacaagttatataattgtggtctgaaaagaccctaaactgaagttctgtttaaatatagttacatgaatttctctgatactaatgtactcaacagccaggtataaactatatctcctagtaacattttccatttttgtttaatcaaatacttgcttatgaaggatttcagaaatttgtaataaatgtcagcttttgatagcatagcagtaattgacatttcaaaaa

SEQ ID NO: 2342 - DNA, 3751 bp, Homo sapiens
gaggcgcggccgcgcgaggtgaccggagtcacagttcccgcaggcggcgacagcagagcgcccactgcctccagcagattaatattaagattggaagtttgtgtcttttgctggatattggaaattgaatgtaatggcaacagaatttataaagagttgctgtggaggatgtttctatggtgaaacagaaaaacacaacttttctgtggaaagagattttaaagcagcagtcccaaatagtcaaaatgctactatctctgtacctccattgacttctgtttctgtaaagcctcagcttggctgtactgaggattatttgctttccaaattaccatctgatggcaaagaagtaccatttgtggtgcccaagtttaagttatcttacattcaacccaggacacaagaaactccttcacatctggaagaacttgaaggatctgccagagcatcttttggagatcgaaaggtagaactttccagttcatcccagcacggacctagctatgatgtgtataacccattctatatgtatcagcacatttcacctgatttgagtcgacgctttcctccccgttcagaagtgaagagactgtatggatcggtttgtgatttaaggacgaacaaacttcccggttcccctgggctaagcaaatctatgtttgatcttacaaactcatctcagcgattcatccagagacatgattcattgtccagtgtacccagtagttcttcttcaaggaaaaattctcaggggagtaacagaagcctggatacaattactctatcaggagatgaaagggactttgggagactgaatgtgaaattgttttataattcttcagtagaacagatctggatcacagttttacagtgcagagatttaagttggccctctagttatggagacactcctactgtttctataaaaggaatacttacattgcccaaaccagtgcatttcaaatcttcagccaaggaaggttccaacgctattgaatttatggaaacgtttgtatttgctattaaacttcaaaatctacaaactgtaagacttgtatttaagattcaaacccagactcccaggaagaaaaccattggagaatgctcaatgtcactcagaacccttagcacacaggaaatggattactctttggatataacaccaccttcaaaaatttctgtttgccatgcagaacttgaattggggacttgttttcaagcagtaaatagcagaattcagttacaaattcttgaggcacggtaccttccaagctcatcaacacctctgactttgagttttttcgtgaaggtgggaatgtttagctcgggagagttgatttataagaaaaagacacgcttactgaaggcctccaatggaagagtcaagtggggagagactatgatttttccacttatacagagtgaaaaagaaattgtttttctcattaagctttacagtcgaagctctgtaagaagaaaacactttgtgggccagatttggataagtgaagacagtaataacattgaagcagtgaaccagtggaaagagacagtaataaatccagaaaaggttgttatcaggtggcacaaattaaatccatcttgaagacttcacacattaatttggtgaagaacttgacattcttttagaagacttatgatttcaatttgctaccaatgagaagaggcaaatcaacaaatttgtcaatttatgggggctataattatggtatataatgtatctgatagaaaatttgataagaaaatgtaatgaattttatcagatatccaaagtaaaggaaatgttttaaaactgcaacaagagacacagacagtaaaatcaaagtattattaggatgactaaataaattataaagtctgtgagaatatcaaccatagatagttctttctatattatgttttcgcttttgtattttaagctttacttagatattcaaaacctggtatatcaagtctctgttagtactattggcatttagaagactttaccattatttcagtgctaggcattattgattaggtcttggctccactgtttacctcttgctatgtattttctcccggtaaaaatgaattgaaccatttcaactattttctatatttggagaaagtttgtgccctgtgttttataatttttttacccataagacatcacattatccctttgtaagctacttatctccaaaaaacttcagaaatagaaaactacattttggcaggaataattgaaaacaccagaaggttgaagtttaattggaaacccagaatatacatactttgctgttttcttccctcaaatattttactatttgttttatttggagttaaaataagagtatcatccatatggtccatcctaattcacagaattaaatgagcttaaatagaaaattcagtattttatgataatcacttcgtttttagtttttaaaatttagattattctataatttaccgtgtttgagtattttctcatttttttcataaccatacctgattatactgtgtaacaaatattttctattgcagttttctttccagtacttattagaactcagtatttggaaataatttcagcttaattgaccataagaactgtggccaaaaagaacagttttttggagaggcagatgacattatacctgattttagaaaatctcactttatttttgctaataagtagactaagtgctctgtgttctcagtcttccctttttttctgcccccattcttactttgtcccaggcatgcagagaaagatggtgatattttaggccaggagtataccttgctataacctaagcatgccttctttattccagctcctatgttctgtgtatatcattaacattttcccaaataaacacttaattctcttttccctaggtgccatctcctcaagctacaaaatgtccacatcttatatcccctttgcttctactgctctgattttgtggtaccagtactctctgccactgaacattttgaaatatttttgttttagatttgcaaaaaatgacatataggtcagtactcacatggatttttaagataaatcacctgtgtgataatattttgaatctgagacgaatacaacttttaaaaattgtttttaaaaatagacttttttttttagagcagttgtaggttaacagaaaaattgagaggaagatagagatttcctttctcccctgacaaagccctcaacagcctcccaggctatcagtatcctgcaccacaatggtacatttgttacaatcaatgaacctactctgaaacatcattatcatccaaagttcatggtttacattagagtcccctcttggtgttatacatgctagaggacaaatatatgatgatatgtatgcatcattataatatagtatagtttcgctgccctaaacatcctctgcaaatgcaactattttaatgggtaccaaagaagtaaatgtatttactggcttttagataataaataacgggctttattgtttattttaaaagctacaatttgttttagctggtttctctgttctattaatgctttgaatttccaaatttaatatatgtagtcatgcatttaacttaatatttaattatttgatttatttaattttctatattcttacaatgtatgtatgatgtataatttaagggaaagctatgacttctcagtttcttagaatcctaggtaaataaaacaataaaaagaaaacccttacatttaaaa

SEQ ID NO: 2343 - DNA, 5146 bp, Homo sapiens
gtcaagtggtgttagcaatcacatcagcaccaaatggctcaggatgctctggtttcaaagcttataaaacagagggtgattcccttgggactcactcagctcggctccgaaaagcaaaggccagaaggcagcagtgagcctgggtccctgctgtgtagggagactcaggggctgggaagaaggatggaatcagaaatgctgaaggtttacgtgagctttgcaccgagcgcctccgaaccactgcctctgggctcaacagaacacagggattaatattaagattggaagtttgtgtcttttgctggatattggaaattgaatgtaatggcaacagaatttataaagagttgctgtggaggatgtttctatggtgaaacagaaaaacacaacttttctgtggaaagagattttaaagcagcagtcccaaatagtcaaaatgctactatctctgtacctccattgacttctgtttctgtaaagcctcagcttggctgtactgaggattatttgctttccaaattaccatctgatggcaaagaagtaccatttgtggtgcccaagtttaagttatcttacattcaacccaggacacaagaaactccttcacatctggaagaacttgaaggatctgccagagcatcttttggagatcgaaaggtagaactttccagttcatcccagcacggacctagctatgatgtgtataacccattctatatgtatcagcacatttcacctgatttgagtcgacgctttcctccccgttcagaagtgaagagactgtatggatcggtttgtgatttaaggacgaacaaacttcccggttcccctgggctaagcaaatctatgtttgatcttacaaactcatctcagcgattcatccagagacatgattcattgtccagtgtacccagtagttcttcttcaaggaaaaattctcaggggagtaacagaagcctggatacaattactctatcaggagatgaaagggactttgggagactgaatgtgaaattgttttataattcttcagtagaacagatctggatcacagttttacagtgcagagatttaagttggccctctagttatggagacactcctactgtttctataaaaggaatacttacattgcccaaaccagtgcatttcaaatcttcagccaaggaaggttccaacgctattgaatttatggaaacgtttgtatttgctattaaacttcaaaatctacaaactgtaagacttgtatttaagattcaaacccagactcccaggaagaaaaccattggagaatgctcaatgtcactcagaacccttagcacacaggaaatggattactctttggatataacaccaccttcaaaaatttctgtttgccatgcagaacttgaattggggacttgttttcaagcagtaaatagcagaattcagttacaaattcttgaggcacggtaccttccaagctcatcaacacctctgactttgagttttttcgtgaaggtgggaatgtttagctcgggagagttgatttataagaaaaagacacgcttactgaaggcctccaatggaagagtcaagtggggagagactatgatttttccacttatacagagtgaaaaagaaattgtttttctcattaagctttacagtcgaagctctgtaagaagaaaacactttgtgggccagatttggataagtgaagacagtaataacattgaagcagtgaaccagtggaaagagacagtaataaatccagaaaaggttgttatcaggtggcacaaattaaatccatcttgaagacttcacacattaatttggtgaagaacttgacattcttttagaagacttatgatttcaatttgctaccaatgagaagaggcaaatcaacaaatttgtcaatttatgggggctataattatggtatataatgtatctgatagaaaatttgataagaaaatgtaatgaattttatcagatatccaaagtaaaggaaatgttttaaaactgcaacaagagacacagacagtaaaatcaaagtattattaggatgactaaataaattataaagtctgtgagaatatcaaccatagatagttctttctatattatgttttcgcttttgtattttaagctttacttagatattcaaaacctggtatatcaagtctctgttagtactattggcatttagaagactttaccattatttcagtgctaggcattattgattaggtcttggctccactgtttacctcttgctatgtattttctcccggtaaaaatgaattgaaccatttcaactattttctatatttggagaaagtttgtgccctgtgttttataatttttttacccataagacatcacattatccctttgtaagctacttatctccaaaaaacttcagaaatagaaaactacattttggcaggaataattgaaaacaccagaaggttgaagtttaattggaaacccagaatatacatactttgctgttttcttccctcaaatattttactatttgttttatttggagttaaaataagagtatcatccatatggtccatcctaattcacagaattaaatgagcttaaatagaaaattcagtattttatgataatcacttcgtttttagtttttaaaatttagattattctataatttaccgtgtttgagtattttctcatttttttcataaccatacctgattatactgtgtaacaaatattttctattgcagttttctttccagtacttattagaactcagtatttggaaataatttcagcttaattgaccataagaactgtggccaaaaagaacagttttttggagaggcagatgacattatacctgattttagaaaatctcactttatttttgctaataagtagactaagtgctctgtgttctcagtcttccctttttttctgcccccattcttactttgtcccaggcatgcagagaaagatggtgatattttaggccaggagtataccttgctataacctaagcatgccttctttattccagctcctatgttctgtgtatatcattaacattttcccaaataaacacttaattctcttttccctaggtgccatctcctcaagctacaaaatgtccacatcttatatcccctttgcttctactgctctgattttgtggtaccagtactctctgccactgaacattttgaaatatttttgttttagatttgcaaaaaatgacatataggtcagtactcacatggatttttaagataaatcacctgtgtgataatattttgaatctgagacgaatacaacttttaaaaattgtttttaaaaatagacttttttttttagagcagttgtaggttaacagaaaaattgagaggaagatagagatttcctttctcccctgacaaagccctcaacagcctcccaggctatcagtatcctgcaccacaatggtacatttgttacaatcaatgaacctactctgaaacatcattatcatccaaagttcatggtttacattagagtcccctcttggtgttatacatgctagaggacaaatatatgatgatatgtatgcatcattataatatagtatagtttcgctgccctaaacatcctctgcaaatgcaactattttaatgggtaccaaagaagtaaatgtatttactggcttttagataataaataacgggctttattgtttattttaaaagctacaatttgttttagctggtttctctgttctattaatgctttgaatttccaaatttaatatatgtagtcatgcatttaacttaatatttaattatttgatttatttaattttctatattcttacaatgtatgtatgatgtataatttaagggaaagctatgacttctcagtttcttagaatcctaggtaaataaaacaataaaaagaaaacccttacatttaaaagagctttcaggtacagaagtattgatacaactaagatcctaaatgttttaattagtgtttacttaagcctttttcaggtgaggaggtactaatgctggttatttccttgaagctttatgtggacctataaataaaaatccaatctcctgctaataggtatgcatattgtgagaaaaacgttaggagctggtagtaaaaaatgagattctatgccaaaataacttctcttcatatttgcctaggcatttcttgacctttacccacttacgcaaggagaaggaaatcataatgatgtcatgtgatcaaaggaaaccatggaagggttcacgctgatagctgatagcttttacagtgctcattcctaacagtggatttacttgtaagctttcagatcaacacaaatagctgcagcctgggttaaaatataacatcactatttggcttttgttttgcatgatttttaaaagcagtactcctagggaaatggcctctgaagtatatcagtttcatctcttaccaagactgttaagaagaaactagtgggattttgaacaagttatataattgtggtctgaaaagaccctaaactgaagttctgtttaaatatagttacatgaatttctctgatactaatgtactcaacagccaggtataaactatatctcctagtaacattttccatttttgtttaatcaaatacttgcttatgaaggatttcagaaatttgtaataaatgtcagcttttgatagcatagcagtaattgacatttcaaaaatatatatttctttctgtgtttggttgggtgtaatgaggaaaatacctgataaaatgtctgaagacactttctaatgttatcttggtgcataagctgtaatttttattcaaaattaaatttcaaatgtttgcagttttggctaaaacattgagttgaaagaattatgaaaagtgggcccatatgaagtaccatgttcattttgaaatatagatttaagatttagaaatatattaaaagagttaatggagcctcctaaattggattttattttgtgggtgaagaattgtaggaagatgaatgtggcctacagttttagtaatctcctagtggagttttttttaacttagtacttttttagttttaagttttttaatctataaaaaatgtgatttctataaaccatgattacaataaataattatattaaa

SEQ ID NO: 2344 - DNA, 1770 bp, Homo sapiens
gggagtgggtacggggagggaagtggaggggagggggtaagtgatagggtaggggaggccctgggaaaggcaggacctcgaggcgcggccgcgcgaggtgaccggagtcacagttcccgcaggcggcgacagcagagcgcccactgcctccagcagattaatattaagattggaagtttgtgtcttttgctggatattggaaattgaatgtaatggcaacagaatttataaagagttgctgtggaggatgtttctatggtgaaacagaaaaacacaacttttctgtggaaagagattttaaagcagcagtcccaaatagtcaaaatgctactatctctgtacctccattgacttctgtttctgtaaagcctcagcttggctgtactgaggattatttgctttccaaattaccatctgatggcaaagaagtaccatttgtggtgcccaagtttaagttatcttacattcaacccaggacacaagaaactccttcacatctggaagaacttgaaggatctgccagagcatcttttggagatcgaaaggtagaactttccagttcatcccagcacggacctagctatgatgtgtataacccattctatatgtatcagcacatttcacctgatttgagtcgacgctttcctccccgttcagaagtgaagagactgtatggatcggtttgtgatttaaggacgaacaaacttcccggttcccctgggctaagcaaatctatgtttgatcttacaaactcatctcagcgattcatccagagacatgattcattgtccagtgtacccagtagttcttcttcaaggaaaaattctcaggggagtaacagaagcctggatacaattactctatcaggagatgaaagggactttgggagactgaatgtgaaattgttttataattcttcagtagaacagatctggatcacagttttacagtgcagagatttaagttggccctctagttatggagacactcctactgtttctataaaaggaatacttacattgcccaaaccagtgcatttcaaatcttcagccaaggaaggttccaacgtttgccatgcagaacttgaattggggacttgttttcaagcagtaaatagcagaattcagttacaaattcttgaggcacggtaccttccaagctcatcaacacctctgactttgagttttttcgtgaaggtgggaatgtttagctcgggagagttgatttataagaaaaagacacgcttactgaaggcctccaatggaagagtcaagtggggagagactatgatttttccacttatacagagtgaaaaagaaattgtttttctcattaagctttacagtcgaagctctgtaagaagaaaacactttgtgggccagatttggataagtgaagacagtaataacattgaagcagtgaaccagtggaaagagacagtaataaatccagaaaaggttgttatcaggtggcacaaattaaatccatcttgaagacttcacacattaatttggtgaagaacttgacattcttttagaagacttatgatttcaatttgctaccaatgagaagaggcaaatcaacaaatttgtcaatttatgggggctataattatggtatataatgtatctgatagaaaatttgataagaaaatgtaatgaattttatcagatatccaaagtaaaggaaatgttttaaaactgcaacaagagacacagacagtaaaatcaaagtattattaggatgactaaataaattataaagtctgtg

SEQ ID NO: 2345 - DNA, 2379 bp, Homo sapiens
gtccgcgaggggtctgcgagctttgcggagcctcgcccccgagcgcgcggtttccctgccgcgcaggcgcacggaatcctaggcgcggatctcgcgtttccggccggaagcttctccagcctttcccggaagctgcgctcgctacccgggtaacgggtcccggctgtggaagctcccgcggcgccgcgatggacctcgaggaggcggaagagtttaaagaacgctgtactcagtgtgctgctgtctcatggggtcttactgatgaaggcaaatattattgcacttcttgccacaatgttacagagagatatcaggaagttacaaacactgatcttattcctaatacccaaataaaagccctcaaccgggggcttaaaaaaaaaaacaatactgaaaaaggctgggattggtatgtgtgtgaaggtttccagtatattctttatcaacaagcagaagccttaaagaaccttggagtaggcccagagttaaagaacgatgttttacataatttttggaagcgctaccttcagaagagcaagcaggcatattgtaagaacccagtttataccactggaaggaaacctacggtattagaagataatctaagtcattcagactgggctagtgagcctgagctgctaagtgatgtcagctgtcctccttttcttgaaagtggagcggagtctcagtctgacatccacactcgaaaacctttccccgtcagcaaagcatcacaatcagaaacgtctgtctgctctggatctctggatggagttgaatactcacaacgaaaggagaagggaatcgtgaagatgaccatgccacagacacttgccttctgttatctgtccttactttggcagagagaagcaataacactttcagatcttttgaggtttgttgaagaggaccatattccttacataaatgcttttcagcattttccagaacagatgaaattatatggacgtgacagaggaatctttggtatagagtcttggcctgactacgaggacatctacaaaaaaacagtagaagttggaacatttttagatttgcctcgttttccagacataactgaagactgctatcttcatcccaacatactgtgtatgaaatacttgatggaagtcaacctccctgatgaaatgcatagcttaacttgccacgtggtaaaaatgactggaatgggagaagtggattttctgacatttgatcctatagctaaaatggcaaaaactgttaagtacgatgtacaagctgtagctatcattgtggtggtattgaaactgctctttctattggatgacagtttcgagtggtctttgtctaatcttgctgaaaagcataatgaaaagaacaaaaaagataagccatggtttgatttcagaaagtggtaccaaattatgaagaaagcttttgatgagaaaaaacaaaaatgggaagaagcaagggccaagtacctgtggaaaagtgaaaagccactctactactcatttgtcgacaaaccagtagcatataaaaaaagagaaatggtggtgaatctacagaaacaatttagcacactggtcgagtcaacagcaactgctggaaaaaaaagcccttcaagttttcagttcaactggactgaagaggacactgatagaacgtgtttccatggacacagccttcagggagtcctgaaagagaaaggccaatcactgctgactaagaattcattatattggcttagtacacagaaattctgcagatgctattgtacacatgtgacaacctatgaagaatcaaattattctctgagttatcagtttatactaaatctcttctccttcctgctcagaataaagacttcccttctccatgaagaagtgagcttagttgagaagaaactttttgagaaaaaatacagtgtaaaaagaaagaaatcaagatccaagaaagtgagacgacattgagaaaatgaaatagaaactttctggaaaaatattttaatagtgataataacatcagattttaatataacattccagagaattgtggaaaatactgcatatatatgtatagactctgacacatatttacatatatatcaagtgtgcttagaaaaatgtatattgtaaagcaggtgagcttcatttgattttatttttcagagtatgaacattctaagagaaagttaaaacaatagcaaattgtataattgtatccagaaatgtatactcatcgtattttaaagctaaatttattttttaaactagatcccttcattattctttatgccccagagtaaatcccagatggatcaaagatctaaacataatctttcatatgtaaaaatataaaagtattagtagaaaacaaatatgaatgctttgatga

SEQ ID NO: 2346 - DNA, 1931 bp, Homo sapiens
aagctcccgcggcgccgcgatggacctcgaggaggcggaagagtttaaagaacgctgtactcagtgtgctgctgtctcatggggtcttactgatgaaggcaaatattattgcacttcttgccacaatgttacagagtaccttacagattacaaagtttttggatccattatctcatttcctcctcatcactaactgtgagagcctattgatagggctcagaagttgagtgagtttgccaaagttacccaagtaccaggacttgaatagatatcaggaagttacaaacactgatcttattcctaatacccaaataaaagccctcaaccgggggcttaaaaaaaaaaacaatactgaaaaaggctgggattggtatgtgtgtgaaggtttccagtatattctttatcaacaagcagaagccttaaagaaccttggagtaggcccagagttaaagaacgatgttttacataatttttggaagcgctaccttcagaagagcaagcaggcatattgtaagaacccagtttataccactggaaggaaacctacggtattagaagataatctaagtcattcagactgggctagtgagcctgagctgctaagtgatgtcagctgtcctccttttcttgaaagtggagcggagtctcagtctgacatccacactcgaaaacctttccccgtcagcaaagcatcacaatcaggtttgttgaagaggaccatattccttacataaatgcttttcagcattttccagaacagatgaaattatatggacgtgacagaggaatctttggtatagagtcttggcctgactacgaggacatctacaaaaaaacagtagaagttggaacatttttagatttgcctcgttttccagacataactgaagactgctatcttcatcccaacatactgtgtatgaaatacttgatggaagtcaacctccctgatgaaatgcatagcttaacttgccacgtggtaaaaatgactggaatgggagaagtggattttctgacatttgatcctatagctaaaatggcaaaaactgttaagtacgatgtacaagctgtagctatcattgtggtggtattgaaactgctctttctattggatgacagtttcgagtggtctttgtctaatcttgctgaaaagcataatgaaaagaacaaaaaagataagccatggtttgatttcagaaagtggtaccaaattatgaagaaagcttttgatgagaaaaaacaaaaatgggaagaagcaagggccaagtacctgtggaaaagtgaaaagccactctactactcatttgtcgacaaaccagtagcatataaaaaaagagaaatggtggtgaatctacagaaacaatttagcacactggtcgagtcaacagcaactgctggaaaaaaaagcccttcaagttttcagttcaactggactgaagaggacactgatagaacgtgtttccatggacacagccttcagggagtcctgaaagagaaaggccaatcactgctgactaagaattcattatattggcttagtacacagaaattctgcagatgctattgtacacatgtgacaacctatgaagaatcaaattattctctgagttatcagtttatactaaatctcttctccttcctgctcagaataaagacttcccttctccatgaagaagtgagcttagttgagaagaaactttttgagaaaaaatacagtgtaaaaagaaagaaatcaagatccaagaaagtgagacgacattgagaaaatgaaatagaaactttctggaaaaatattttaatagtgataataacatcagattttaatataacattccagagaattgtggaaaatactgcatatatatgtatagactctgacacatatttacatatatatcaagtgtgcttagaaaaatgtatattgtaaagca

SEQ ID NO: 2347 - DNA, 1018 bp, Homo sapiens
acttccgcttccgctggggaggtcctccatgcgcagtcatgagtcgcttcaagtttatcgatattggtatcaacttgactgaccctatgttcagaggaatttataggggggttcaaaagcatcaagatgacttacaggatgtaatagggagagctgtcgagattggtgttaaaaagtttatgattacaggtggaaatctacaagacagtaaagatgcactgcatttggcacaaacaaatggtatgtttttcagtacagttggatgtcatcctacaagatgtggtgaatttgaaaagaataaccctgatctttacttaaaggagttgctaaatcttgctgaaaacaataaagggaaagttgtggcaataggagaatgcggacttgattttgaccgactgcagttttgtcccaaagatactcaactcaaatattttgaaaaacagtttgaactgtcagaacaaacaaaattaccaatgtttcttcattgtcgaaactcacatgctgaatttttggacataatgaaaagaaatagagatcggtgtgtagggggagtggtgcattcatttgatggtaccaaggaagcagcagctgctttgattgacttggatctttatataggatttaatggttgctcactgaaaactgaagctaatttggaagttttgaagtcaattcctagtgaaaaattaatgattgagacagatgcaccttggtgtggagtcaaaagtacacatgctggatcaaaatatataagaactgcatttcctaccaaaaagaagtgggaaagtgggcactgcttaaaagacagaaatgaaccctgccatataattcaaatattggagataatgtcagcagtgagagatgaggatccactggaattagccaatacactatataacaatactattaaagtattttttcctggaatataattggtatatgtcttccactttccatcatgtatgtaaaatttcatagtaaaacttcctgatagtttcaataaagaaattatctgcaa

SEQ ID NO: 2348 - DNA, 889 bp, Homo sapiens
ttccgctggggaggtcctccatgcgcagtcatgagtcgcttcaagtttatcgtttatgattacaggtggaaatctacaagacagtaaagatgcactgcatttggcacaaacaaatggtatgtttttcagtacagttggatgtcatcctacaagatgtggtgaatttgaaaagaataaccctgatctttacttaaaggagttgctaaatcttgctgaaaacaataaagggaaagttgtggcaataggagaatgcggacttgattttgaccgactgcagttttgtcccaaagatactcaactcaaatattttgaaaaacagtttgaactgtcagaacaaacaaaattaccaatgtttcttcattgtcgaaactcacatgctgaatttttggacataatgaaaagaaatagagatcggtgtgtagggggagtggtgcattcatttgatggtaccaaggaagcagcagctgctttgattgacttggatctttatataggatttaatggttgctcactgaaaactgaagctaatttggaagttttgaagtcaattcctagtgaaaaattaatgattgagacagatgcaccttggtgtggagtcaaaagtacacatgctggatcaaaatatataagaactgcatttcctaccaaaaagaagtgggaaagtgggcactgcttaaaagacagaaatgaaccctgccatataattcaaatattggagataatgtcagcagtgagagatgaggatccactggaattagccaatacactatataacaatactattaaagtattttttcctggaatataattggtatatgtcttccactttccatcatgtatgtaaaatttcatagtaaaacttcctgatagtttcaataaagaaattatc

SEQ ID NO: 2349 - DNA, 591 bp, Homo sapiens
atgcgcagtcatgagtcgcttcaagtttatcgatcataggtgacagtgatgtgacacgattcagtgagcccaataactgaggcttcaacttaagagttgtggttttctcctggttacaaacagtgccgttttctactcttactttgttttgaaaacgaaaagtcaatatttgaagaactcttaaataataaaatattggtatcaacttgactgaccctatgttcagaggaatttataggggggttcaaaagcatcaagtttatgattacaggtggaaatctacaagacagtaaagatgcactgcatttggcacaaacaaatggtatgtttttcagtacagttggatgtcatcctacaagatgtggtgaatttgaaaagaataaccctgatctttacttaaaggagttgctaaatcttgctgaaaacaataaagggaaagttgtggcaataggagaatgcggacttgattttgaccgactgcagttttgtcccaaagatactcaactcaaatattttgaaaaacagtttgaactgtcagaacaaacaaaattaccaatgtttcttcattgtcgaaactcacatgctgaattt

SEQ ID NO: 2350 - DNA, 5342 bp, Homo sapiens
tttttttttttttttttggtgccttctaattctaattcttcccatttctgggtgtgtacttagtctctctgagccacagttttctgctctataaagtggggtgataatgctcagtacacggtttgctttggctcgatgagaaatccaggtctgaaagcttcaggtacagcggccggcgctgaggaaaacagcgttaagtgaggcgcgtcagcggacaccacctgcctgcacatctggctggcctcaacttcccgctgttcgagcccacgtgagtggctccgccccatctggcttctgaccaatggacgagcttcctaaggcgtaccgtcccgactccaaggcgcctggctttgaggcgggctgcgtcttgctcggagtcccgccccttgccgggtcgagcaatgggcgccttccgtttggcgcaggccccgcccctgtcgctctccggcctgcgggccgcagggctcgttccggagggcgggcgccacggaggccggagtggtcgcagttcgggcggaggccgggccaggcggggctgtagggctggggcaggcggcgggctgcccggcgggacagctgcggcagccggcggggggcgtcctgagttggcggtcgagggcgctgccagctcccgaggggccgctcgggccccttccggcccgggtctggttgggccgcaggagcagggcgggctgcggcgcccgggtctggccctggcctacgggctaagcgcccggccccggggccgcggatccggcagccatgtgtggatcttgaagcgccatgtggtcttctgaagcgcttgacagttctaaagggctttatattgcaaactgatcaaagcgcttcgtagccccggaagcgcttaggcatctccgaagtagcgctgggcaaagtgaaggcttcctgatctcagaagcacgttgtgggcttggaaaccgacggcagcctttagtcaattttggatcgctttgacttctccaacacggtttggcatctctgaaaccttgagaactgtgatgggcagtggaaagaagagggaaaggtgcccatggcgtccgagcggggcaaggtcaagcacaactggagcagcacgtcggaagggtgtccccgcaagcgcagctgcctccgggagccctgtgatgtggccccctccagccggccagctcagaggtctgcgtcgcgttctggagggcccagcagccccaagcgcctgaaagcccagaaggaggacgatgtggcttgctcgcggaggttatcctggggctcatcccgccgcagaaataactcctcctcctccttctccccacatttcttgggccctggtgtgggcggggccgcctccaaaggctgcctgattcggaacactcgggggttcctgtcttcagggggatcccctctgcgtcctgccaacgcctctttggaagaaatggcttctctagaggaggaagcctgcagccttaaggttgattccaaagatagttctcataactccacaaactctgaatttgcagctgaagctgagggtcagaatgatacaattgaggaacccaacaaggtccagaaaaggaagagggatagacttcgagaccagggctccacaatgatctacctgaaggctatccagggcatcctggggaaatcgatgccaaaaaggaagggagaggctgccactcgggcaaaaccaagcgcagcagagcatcccagccatggagaaggaccagccaggagtgaaggaccagccaagactgcagaaggagcagccaggagtgtcacagtcactgctgctcagaaggagaaagacgcaaccccagaggtcagcatggaggaggataagacagtgccagagaggagcagcttctatgacaggagagtagttatagaccctcaagagaaacccagtgaggagccccttggggaccgaaggactgtcattgacaaatgctctccacccctagagttcttggatgactctgactctcatttagaaatccaaaagcataaagatagggaggtggtgatggagcacccctcttctggaagtgactggtctgatgttgaggagatctccacagtcagattctctcaggaggaacctgtctccctgaaaccttcagccgttccggagccttcttccttcaccaccgactatgtcatgtaccctcctcatttgtacagtagtccttggtgtgactacgccagctattggaccagcagccccaagccttctagctacccctccacaggcagcagcagcaacgatgcagcccaggttgggaagagcagccggagccgcatgagtgattattcccccaactctacagggagtgtccaaaacacctccagagacatggaggcctcagaggaaggctggtcccagaattctcgttcatttcgcttctccagaagctcagaagaaagagaggtgaaggagaaaagaacattccaagaggagatgcctccgcgtccttgtggaggacacgcatccagctccctgccaaagagccacctggagccaagcctagaggagggcttcattgacactcattgtcacctggacatgctctattccaagctatctttccaagggacctttacaaagttcagaaaaatttacagcagctccttccctaaggaatttcagggctgcatctctgacttctgtgatccccgcaccctgacagattgcctatgggaggagctgttgaaagaggatctggtctggggggcctttggctgtcaccctcattttgcacgttactacagtgagagtcaagaaagaaatcttttgcaagccttaaggcaccctaaggctgtggcatttggagaaatgggcttggattactcttacaagtgcaccacgcctgtcccagaacagcacaaggtatttgagagacagctgcagctggctgtgtctctaaagaagcccttggtgatccactgccgagaagctgatgaagatctgctagaaatcatgaaaaagtttgtgccccctgactacaagatccataggcattgcttcaccggcagctacccggtcattgagcccctgctgaagtactttcccaacatgtctgtgggcttcacggcagtgctgacatactcctctgcctgggaggcccgggaagccttgaggcagatcccactggagagaatcatcgtggaaacggatgctccctatttcctccctcgccaggttcccaaaagcctttgccagtatgcccacccgggcctggccttgcatacggtccgagagattgccagagtcaaagatcagccactctccctcaccttggctgccttgcgtgagaacaccagtcgcctctacagtctttaagcagagaagggcgaccagcagcctgacagaacacaggctggcttgaagtctgtgtctcaggtcgaggatgtgtttagagagctgattggaacacagaaaaccaggacaggatgttttcctccaagcgggtcataaggcttcagcttctgggtggtgggtggggtggggtgggcatggaatgaggggtatggggactgcctgtaatagcactgggattttgcctcccagccaaaatgctccagggtaggcagcaaagaagaaagagtgcgatatgagggtacagtgagtttggcagtccaaattctgttctctgcagcctgtttttgagtagttggtgaataaagtcacccgcctacttgtctaagcacatgtgggtgtgtaactcagttcctggttctcggttctaaaaacagacttccaactgggaaactttttgggggaaattaactggacacctatctcggaggtttattttcttgcaaccagtgaagtcgtcctcctcccttccctggataactcttcagtttgactgtcactgttctggtgtcaactccagcgtcggcacaggcagaaggacttcagctgctggtctcattggttccactgccattgatatgggggggtgcagaggagcactcattgtccatgatggagatccaggacagactgggggactccgggaagaggctttcttggggaagaggaccccaaaggaggtacttcctcctcactgatgccctcagggctgctgtgtgggtgtgttaagctgataaggttcagtttgcggcggaaactacctgctagtcttgtgtcaggggctgccagcctccttttgtttcacttttgcccccttcttgggaacatttgaccaaaaataatcctcatttcatcttgtgtacagtcctttgtgtaccccgcccaggttgagaggtgaatcagcgtaattctccgaagctctgctgggcagctcagccatgttacattgtctatgcagaataagcaggcctggtgtctgcaaatgtaccagtccttctcccgcatctcctgggtgcccccttggctttgcctctcctgtgtcctgtctttctgcgttttagaagtgagagcctctccttcaccttttgagcaactgagtcatctcaagtcctgagctctgctctgccgcctgctggtgccttgtaaaggtatactcgttacaggccctagaggttctaatggtccagggttaagtgagaggagactgtactttgtttcaaaggatccttcaccctgatctgcagtgaggtggatagatcacctggagtccctcgtctgtggtcttggaggcttaaattgtaaaatacatcccttatggaatcctaaattcctctaggtgtttttggaaggcgcatttgagccttgtgagctaaaatggaatggatttaatatttcctatctggcatttccatcttgcccctggtacacaagtcactggcctggaactcagccttgattcactgtccgtcttcacggattagctgtgctgttatgttgtctgtgctgcagattggcccatgtgggaagtcgggggggacctgatttcctgcttggaagacttgggggactgccgagcatatcaaagtgtttatagtcaccaagtgaactgcagcacaaccatctcctctccagcaagccctgaagtcagtagtgcctgcaggtgaaaccaaccagccctgtgttagaggaggaaaagcggagatgacatggaagtctccaagcctgtgccatccacctgccaaggaaaagcacaaggtgctatctacttttctctctaggatttagattatcatttatgtgctgttgcacagtgaaacctcacctgtgtgggcgtgaaagctgattggcattgtttttgattcagctttttggatggctaattgttttcactgtgctgtgggaatgcctctgtattttttcccctctttggccatctttttctgaaaataaagtgatggatcctctagcc

SEQ ID NO: 2351 - DNA, 4484 bp, Homo sapiens
ggcaaagtgaaggcttcctgatctcagaagcacgttgtgggcttggaaaccgacggcagcctttagtcaattttggatcgctttgacttctccaacacggtttggcatctctgaaaccttgagaactgtgatgggcagtggaaagaagagggaaaggtgcccatggcgtccgagcggggcaaggtcaagcacaactggagcagcacgtcggaagggtgtccccgcaagcgcagctgcctccgggagccctgtgatgtggccccctccagccggccagctcagaggtctgcgtcgcgttctggagggcccagcagccccaagcgcctgaaagcccagaaggaggacgatgtggcttgctcgcggaggttatcctggggctcatcccgccgcagaaataactcctcctcctccttctccccacatttcttgggccctggtgtgggcggggccgcctccaaaggctgcctgattcggaacactcgggggttcctgtcttcagggggatcccctctgcgtcctgccaacgcctctttggaagaaatggcttctctagaggaggaagcctgcagccttaaggttgattccaaagatagttctcataactccacaaactctgaatttgcagctgaagctgagggtcagaatgatacaattgaggaacccaacaaggtccagaaaaggaagagggatagacttcgagaccagggctccacaatgatctacctgaaggctatccagggcatcctggggaaatcgatgccaaaaaggaagggagaggctgccactcgggcaaaaccaagcgcagcagagcatcccagccatggagaaggaccagccaggagtgaaggaccagccaagactgcagaaggagcagccaggagtgtcacagtcactgctgctcagaaggagaaagacgcaaccccagaggtcagcatggaggaggataagacagtgccagagaggagcagcttctatgacaggagagtagttatagaccctcaagagaaacccagtgaggagccccttggggaccgaaggactgtcattgacaaatgctctccacccctagagttcttggatgactctgactctcatttagaaatccaaaagcataaagatagggaggtggtgatggagcacccctcttctggaagtgactggtctgatgttgaggagatctccacagtcagattctctcaggaggaacctgtctccctgaaaccttcagccgttccggagccttcttccttcaccaccgactatgtcatgtaccctcctcatttgtacagtagtccttggtgtgactacgccagctattggaccagcagccccaagccttctagctacccctccacaggcagcagcagcaacgatgcagcccaggttgggaagagcagccggagccgcatgagtgattattcccccaactctacagggagtgtccaaaacacctccagagacatggaggcctcagaggaaggctggtcccagaattctcgttcatttcgcttctccagaagctcagaagaaagagaggtgaaggagaaaagaacattccaagaggagatgcctccgcgtccttgtggaggacacgcatccagctccctgccaaagagccacctggagccaagcctagaggagggcttcattgacactcattgtcacctggacatgctctattccaagctatctttccaagggacctttacaaagttcagaaaaatttacagcagctccttccctaaggaatttcagggctgcatctctgacttctgtgatccccgcaccctgacagattgcctatgggaggagctgttgaaagaggatctggtctggggggcctttggctgtcaccctcattttgcacgttactacagtgagagtcaagaaagaaatcttttgcaagccttaaggcaccctaaggctgtggcatttggagaaatgggcttggattactcttacaagtgcaccacgcctgtcccagaacagcacaaggtatttgagagacagctgcagctggctgtgtctctaaagaagcccttggtgatccactgccgagaagctgatgaagatctgctagaaatcatgaaaaagtttgtgccccctgactacaagatccataggcattgcttcaccggcagctacccggtcattgagcccctgctgaagtactttcccaacatgtctgtgggcttcacggcagtgctgacatactcctctgcctgggaggcccgggaagccttgaggcagatcccactggagagaatcatcgtggaaacggatgctccctatttcctccctcgccaggttcccaaaagcctttgccagtatgcccacccgggcctggccttgcatacggtccgagagattgccagagtcaaagatcagccactctccctcaccttggctgccttgcgtgagaacaccagtcgcctctacagtctttaagcagagaaggtacagtcctcgggagtctcctagaaaagggcgaccagcagcctgacagaacacaggctggcttgaagtctgtgtctcaggtcgaggatgtgtttagagagctgattggaacacagaaaaccaggacaggatgttttcctccaagcgggtcataaggcttcagcttctgggtggtgggtggggtggggtgggcatggaatgaggggtatggggactgcctgtaatagcactgggattttgcctcccagccaaaatgctccagggtaggcagcaaagaagaaagagtgcgatatgagggtacagtgagtttggcagtccaaattctgttctctgcagcctgtttttgagtagttggtgaataaagtcacccgcctacttgtctaagcacatgtgggtgtgtaactcagttcctggttctcggttctaaaaacagacttccaactgggaaactttttgggggaaattaactggacacctatctcggaggtttattttcttgcaaccagtgaagtcgtcctcctcccttccctggataactcttcagtttgactgtcactgttctggtgtcaactccagcgtcggcacaggcagaaggacttcagctgctggtctcattggttccactgccattgatatgggggggtgcagaggagcactcattgtccatgatggagatccaggacagactgggggactccgggaagaggctttcttggggaagaggaccccaaaggaggtacttcctcctcactgatgccctcagggctgctgtgtgggtgtgttaagctgataaggttcagtttgcggcggaaactacctgctagtcttgtgtcaggggctgccagcctccttttgtttcacttttgcccccttcttgggaacatttgaccaaaaataatcctcatttcatcttgtgtacagtcctttgtgtaccccgcccaggttgagaggtgaatcagcgtaattctccgaagctctgctgggcagctcagccatgttacattgtctatgcagaataagcaggcctggtgtctgcaaatgtaccagtccttctcccgcatctcctgggtgcccccttggctttgcctctcctgtgtcctgtctttctgcgttttagaagtgagagcctctccttcaccttttgagcaactgagtcatctcaagtcctgagctctgctctgccgcctgctggtgccttgtaaaggtatactcgttacaggccctagaggttctaatggtccagggttaagtgagaggagactgtactttgtttcaaaggatccttcaccctgatctgcagtgaggtggatagatcacctggagtccctcgtctgtggtcttggaggcttaaattgtaaaatacatcccttatggaatcctaaattcctctaggtgtttttggaaggcgcatttgagccttgtgagctaaaatggaatggatttaatatttcctatctggcatttccatcttgcccctggtacacaagtcactggcctggaactcagccttgattcactgtccgtcttcacggattagctgtgctgttatgttgtctgtgctgcagattggcccatgtgggaagtcgggggggacctgatttcctgcttggaagacttgggggactgccgagcatatcaaagtgtttatagtcaccaagtgaactgcagcacaaccatctcctctccagcaagccctgaagtcagtagtgcctgcaggtgaaaccaaccagccctgtgttagaggaggaaaagcggagatgacatggaagtctccaagcctgtgccatccacctgccaaggaaaagcacaaggtgctatctacttttctctctaggatttagattatcatttatgtgctgttgcacagtgaaacctcacctgtgtgggcgtgaaagctgattggcattgtttttgattcagctttttggatggctaattgttttcactgtgctgtgggaatgcctctgtattttttcccctctttggccatctttttctgaaaataaagtgatggatcctctagccaa

SEQ ID NO: 2352 - DNA, 2321 bp, Homo sapiens
tctgctggccggtctaaagcggcagccgccggggcgcaatgcgagcggctggcgtaggcttggtggactgtcactgccacctctccgccccggactttgaccgcgatttggatgatgtgttggagaaagccaagaaggccaatgttgtggcccttgtggcagttgccgaacattcaggagaatttgaaaagattatgcaactttcagaaaggtataatgggtttgtcctgccatgcttgggtgttcatccagttcaaggacttccaccagaagaccaaagaagtgtcacactaaaggatttggatgtagctttgcccattattgagaattataaggatcggttgttggcaattggagaggttggactagatttctcccccagatttgctggcactggtgaacagaaggaagagcaaagacaagtcctaatcagacagatccagttagccaaaagactaaatttgcctgtaaatgtgcactcacgctctgctggaagacctaccatcaaccttttacaagagcaaggtgctgagaaggtactgctgcatgcatttgatggtcggccatctgtagccatggaaggagtaagagctgggtacttcttctcaattcccccttctatcataagaagtggacagcagaaacttgtgaaacaattgcctttaacttctatatgcttagaaacagattcacctgcactaggaccagaaaaacaggtacggaatgagccctggaacatttctatttcagcagaatatattgcccaggtgaaagggatctcagtggaagaagttatagaagtgacgacacagaatgcattaaaactgtttcctaagctccgacacttgctccagaaatagcttcaaaaccatccattacaaaatcgaatcaactgcagggggcagcatttgaaaaatagaaatgttctgatgaagaatctgaactgaagaagctgttttatagggttatagaagattgtaattgtagagaaatatttctcttagaaataaaactgggcttggatcctgaaaccctgggttctgattctagccttgtgctgcttttcaattagccgagttctggcaggatattgggaaaatactgctacttcttacattgcccttttatatagaaccaccacctgaactgaaaccattgctactgggaagggtggctcccacaggaagagtataagcactactgtgatgaggatggagtaagctaaagtatacttttttttttttttgatggagtttcgctgttgttgcccaggctggagtgcaatggcacgatcttggctcactgcaacctccacttcccaggttctagcgagtctcctccctcagcctcccaagtagctgggattacaggcatgtgccaccatgcccagctaattttgtatttttagtagagacagggtttctccatgttggtcaggctggtctcgaactcccgacctcaggtgatccgcccgcctcggcctcccaaagtgctgggattacaggcatgagccactgcgccagcctaaagtgtgttcttaccacctatttttcttcccataggagttagccagtgaagggagaatgtctggttttctatgctgtcagaaatctcttttctaggtttgtaaaattgaacttttagtacttcgaattatttctctttaagataaaaatgcatacgatttttacactgatcttagatttttgacttatgaggccagtggtttaaacaatcattattgaataccaagcccaaaagtttagttaatacaccaattgtaagttctggtctgaattttgtcaacatatttagaatgtaaatggcattattaaaaatgtatctgatttctctgtgaacagtaatatttcatatttttaagtttaaaaatgttagtgtaagccaggcacagtggcattcacctgtagtgccaaccactcaggaggctgagatgggagaccttttaagcctgagtttgagtcaggcctgggcaacatagatgtgagcacctatctctaaaaatgtaaataaataaaaatctcaaaaaaattaaaaatctcaagtgtaaaaacagttctgtagatagatggtagtgatggtagcacatcaatgtgaaggtatttaatgccactgaactgtacacttataacgaattaggataaattttatgttatgtgtatttactacaattttttaaaaatcgtatatgtagtttaacaggtgtggtcaatatcaaaacttaggtatttaatcttgttaaattatataagcagaaaatgctggaaaaagtacctgtcatagaaaaaaataaacttcctaaa

SEQ ID NO: 2353 - DNA, 2389 bp, Homo sapiens
agcatgcatccggctggaaactcaggacgctgcagctgaaacgttccggctccggctctgctggccggtctaaagcggcagccgccggggcgcaatgcgagcggctggcgtaggcttggtggactgtcactgccacctctccgccccggactttgaccgcgatttggatgatgtgttggagaaagccaagaaggccaatgttgtggcccttgtggcagttgccgaacattcaggagaatttgaaaagattatgcaactttcagaaaggtataatgggtttgtcctgccatgcttgggtgttcatccagttcaaggacttccaccagaagaccaaagaagtgtcacactaaaggatttggatgtagctttgcccattattgagaattataaggatcggttgttggcaattggagaggttggactagatttctcccccagatttgctggcactggtgaacagaaggaagagcaaagacaagtcctaatcagacagatccagttagccaaaagactaaatttgcctgtaaatgtgcactcacgctctgctggaagacctaccatcaaccttttacaagagcaaggtgctgagaaggtactgctgcatgcatttgatggtcggccatctgtagccatggaaggagtaagagctgggtacttcttctcaattcccccttctatcataagaagtggacagaagcagaaacttgtgaaacaattgcctttaacttctatatgcttagaaacagattcacctgcactaggaccagaaaaacaggtacggaatgagccctggaacatttctatttcagcagaatatattgcccaggtgaaagggatctcagtggaagaagttatagaagtgacgacacagaatgcattaaaactgtttcctaagctccgacacttgctccagaaatagcttcaaaaccatccattacaaaatcgaatcaactgcagggggcagcatttgaaaaatagaaatgttctgatgaagaatctgaactgaagaagctgttttatagggttatagaagattgtaattgtagagaaatatttctcttagaaataaaactgggcttggatcctgaaaccctgggttctgattctagccttgtgctgcttttcaattagccgagttctggcaggatattgggaaaatactgctacttcttacattgcccttttatatagaaccaccacctgaactgaaaccattgctactgggaagggtggctcccacaggaagagtataagcactactgtgatgaggatggagtaagctaaagtatacttttttttttttttgatggagtttcgctgttgttgcccaggctggagtgcaatggcacgatcttggctcactgcaacctccacttcccaggttctagcgagtctcctccctcagcctcccaagtagctgggattacaggcatgtgccaccatgcccagctaattttgtatttttagtagagacagggtttctccatgttggtcaggctggtctcgaactcccgacctcaggtgatccgcccgcctcggcctcccaaagtgctgggattacaggcatgagccactgcgccagcctaaagtgtgttcttaccacctatttttcttcccataggagttagccagtgaagggagaatgtctggttttctatgctgtcagaaatctcttttctaggtttgtaaaattgaacttttagtacttcgaattatttctctttaagataaaaatgcatacgatttttacactgatcttagatttttgacttatgaggccagtggtttaaacaatcattattgaataccaagcccaaaagtttagttaatacaccaattgtaagttctggtctgaattttgtcaacatatttagaatgtaaatggcattattaaaaatgtatctgatttctctgtgaacagtaatatttcatatttttaagtttaaaaatgttagtgtaagccaggcacagtggcattcacctgtagtgccaaccactcaggaggctgagatgggagaccttttaagcctgagtttgagtcaggcctgggcaacatagatgtgagcacctatctctaaaaatgtaaataaataaaaatctcaaaaaaattaaaaatctcaagtgtaaaaacagttctgtagatagatggtagtgatggtagcacatcaatgtgaaggtatttaatgccactgaactgtacacttataacgaattaggataaattttatgttatgtgtatttactacaattttttaaaaatcgtatatgtagtttaacaggtgtggtcaatatcaaaacttaggtatttaatcttgttaaattatataagcagaaaatgctggaaaaagtacctgtcatagaaaaaaataaacttcctaaatcaaagtga

SEQ ID NO: 2354 - DNA, 1073 bp, Homo sapiens
gttccggctccggctctgctggccggtctaaagcggcagccgccggggcgcaatgcgagcggctggcgtaggcttggtggactgtcactgccacctctccgccccggactttgaccgcgatttggatgatgtgttggagaaagccaagaaggccaatgttgtggcccttgtggcagttgccgaacattcaggagaatttgaaaagattatgcaactttcagaaaggtataatgggtttgtcctgccatgcttgggtgttcatccagttcaaggacttccaccagaagaccaaagaagtgtcacactaaaggttggactagatttctcccccagatttgctggcactggtgaacagaaggaagagcaaagacaagtcctaatcagacagatccagttagccaaaagactaaatttgcctgtaaatgtgcactcacgctctgctggaagacctaccatcaaccttttacaagagcaaggtgctgagaaggtactgctgcatgcatttgatggtcggccatctgtagccatggaaggagtaagagctgggtacttcttctcaattcccccttctatcataagaagtggacagaagcagaaacttgtgaaacaattgcctttaacttctatatgcttagaaacagattcacctgcactaggaccagaaaaacaggtacggaatgagccctggaacatttctatttcagcagaatatattgcccaggtgaaagggatctcagtggaagaagttatagaagtgacgacacagaatgcattaaaactgtttcctaagctccgacacttgctccagaaatagcttcaaaaccatccattacaaaatcgaatcaactgcagggggcagcatttgaaaaatagaaatgttctgatgaagaatctgaactgaagaagctgttttatagggttatagaagattgtaattgtagagaaatatttctcttagaaataaaactgggcttggatcctgaaaccctgggttctgattctagccttgtgctgcttttcaattagccgagttctggcaggatattgggaaaatactgctacttcttacattg

SEQ ID NO: 2355 - DNA, 1291 bp, Homo sapiens
tctgctggccggtctaaagcggcagccgccggggcgcaatgcgagcggctggcgtaggcttggtggactgtcactgccacctctccgccccggactttgaccgcgatttggatgatgtgttggagaaagccaagaaggccaatgttgtggcccttgtggcagttgccgaacattcaggagaatttgaaaagattatgcaactttcagaaaggtataatgggtttgtcctgccatgcttgggtgttcatccagttcaaggacttccaccagaagaccaaagaagtgtcacactaaaggatttggatgtagctttgcccattattgagaattataaggatcggttgttggcaattggagaggttggactagatttctcccccagatttgctggcactggtgaacagaaggaagagcaaagacaagtcctaatcagacagatccagttagccaaaagactaaatttgcctgtaaatgtgcactcacgctctgctggaagacctaccatcaaccttttacaagagcaaggtgctgagaaggtactgctgcatgcatttgatggtcggccatctgtagccatggaaggagtaagagctgggtacttcttctcaattcccccttctatcataagaagtggacagctgctttctcttttctctaagaagcagaaacttgtgaaacaattgcctttaacttctatatgcttagaaacagattcacctgcactaggaccagaaaaacagcagaatatattgcccaggtgaaagggatctcagtggaagaagttatagaagtgacgacacagaatgcattaaaactgtttcctaagctccgacacttgctccagaaatagcttcaaaaccatccattacaaaatcgaatcaactgcagggggcagcatttgaaaaatagaaatgttctgatgaagaatctgaactgaagaagctgttttatagggttatagaagattgtaattgtagagaaatatttctcttagaaataaaactgggcttggatcctgaaaccctgggttctgattctagccttgtgctgcttttcaattagccgagttctggcaggatattgggaaaatactgctacttcttacattgcccttttatatagaaccaccacctgaactgaaaccattgctactgggaagggtggctcccacaggaagagtataagcactactgtgatgaggatggagtaagctaaagtatacttttttttttttttgatggagtttcgctgttgttgcccaggctggagtgcaatggcacgatcttggctc

SEQ ID NO: 2356 - DNA, 1381 bp, Homo sapiens
agcatgcatccggctggaaactcaggacgctgcagctgaaacgttccggctccggctctgctggccggtctaaagcggcagccgccggggcgcaatgcgagcggctggcgtaggcttggtggactgtcactgccacctctccgccccggactttgaccgcgatttggatgatgtgttggagaaagccaagaaggccaatgttgtggcccttgtggcagttgccgaacattcaggagaatttgaaaagattatgcaactttcagaaaggtataatgggtttgtcctgccatgcttgggtgttcatccagttcaaggacttccaccagaagaccaaagaagtgtcacactaaaggatttggatgtagctttgcccattattgagaattataaggatcggttgttggcaattggagaggttggactagatttctcccccagatttgctggcactggtgaacagaaggaagagcaaagacaagtcctaatcagacagatccagttagccaaaagactaaatttgcctgtaaatgtgcactcacgctctgctggaagacctaccatcaaccttttacaagagcaaggtgctgagaaggtactgctgcatgcatttgatggtcggccatctgtagccatggaaggagtaagagctgggtacttcttctcaattcccccttctatcataagaagtggacagctgctttctcttttctctaagaagcagaaacttgtgaaacaattgcctttaacttctatatgcttagaaacagattcacctgcactaggaccagaaaaacaggtacggaatgagccctggaacatttctatttcagcagaatatattgcccaggtgaaagggatctcagtggaagaagttatagaagtgacgacacagaatgcattaaaactgtttcctaagctccgacacttgctccagaaatagcttcaaaaccatccattacaaaatcgaatcaactgcagggggcagcatttgaaaaatagaaatgttctgatgaagaatctgaactgaagaagctgttttatagggttatagaagattgtaattgtagagaaatatttctcttagaaataaaactgggcttggatcctgaaaccctgggttctgattctagccttgtgctgcttttcaattagccgagttctggcaggatattgggaaaatactgctacttcttacattgcccttttatatagaaccaccacctgaactgaaaccattgctactgggaagggtggctcccacaggaagagtataagcactactgtgatgaggatggagtaagctaaagtatacttttttttttttttgatggagtttcgctgttgttgcccaggctggagtgcaatggcacgatcttggctc

SEQ ID NO: 2357 - DNA, 4408 bp, Homo sapiens
ttttttacccatgttagtcctctctggcgcatcagttgaggcagacctcggagcagcaggaggaggtggaaggggtgggagcaaaggagtgcatcagtgagagagcgcgcgagagagacccaggaaaggagacttggccggcgcgtcgccggttcctggatcccaacacaagcgagaaagcggaaacgccaaatctgttttttgcccgcggtggggaagggggcagatctcgggaggccccgagagccttttagtttttggtgggggaagagcgagagcgcgcgtgtgcccgcgtgagtgtatatgagagaggggcgggcgggcgcggggcgggggggatggccgagaagcgaaggggctcgccgtgcagcatgctaagcctcaaggcgcacgctttctcggtggaggcgctgatcggcgccgagaagcagcaacagcttcagaagaagcggcgaaaactgggcgccgaagaggcggcgggggccgtggacgacggaggctgcagccgcggcggcggcgcgggcgaaaagggttcttctgagggagacgaaggcgctgcgctcccgccgccggctggggcgacgtctgggccggctcggagtggcgcagacctggagcgcggagccgcgggcggctgtgaggacggcttccagcagggagcttcccctctggcgtcaccgggaggctcccccaaggggtctccggcgcgctccctggcccggcccgggacccctctgccctcgccgcaggccccgcgggtggatctgcagggagccgagctctggaagcgctttcatgagataggcactgagatgatcatcaccaaggccggcaggcgcatgtttccagcaatgagagtgaagatctctggattagatcctcaccagcaatattacattgccatggatattgtaccagtggacaacaaaagatacaggtatgtttaccacagttcgaaatggatggtggcaggtaatgctgactcgcctgtgccaccccgtgtgtacattcatccagactcgcctgcctcgggggagacttggatgagacaagttatcagcttcgacaagctgaagctcaccaacaatgaactggatgaccaaggccatattattcttcattctatgcacaaataccaaccgcgagtgcacgtcatccgtaaagactgtggagacgatctttctcccatcaagcctgttccatccggggagggagtaaaggcattctcctttccagaaactgtcttcacaaccgtcactgcctatcagaatcagcagattactcgcctgaagatagataggaatccatttgctaaaggcttccgagactccgggcgcaacagaatgggtttggaagccttggtggaatcatatgcattctggcgaccatcactacggactctgacctttgaagatatccctggaattcccaagcaaggcaatgcaagttcctccaccttgctccaaggtactgggaatggcgttcctgccactcaccctcaccttttgtctggctcctcttgctcctctcctgccttccatctggggcccaacaccagccagctgtgtagtctggcccctgctgactattctgcctgtgcccgctcaggcctcaccctcaaccgatacagcacatctttggcagagacctacaacaggctcaccaaccaggctggtgagacctttgccccgcccaggactccctcctatgtgggcgtgagcagcagcacctccgtgaacatgtccatgggtggcactgatggggacaccttcagctgcccacagaccagcttatccatgcagatttcgggaatgtccccccagctccagtatatcatgccatcaccctccagcaatgccttcgccactaaccagacccatcagggttcctataatacttttagattacacagcccctgtgcactatatggatataacttctccacatcccccaaactggctgccagtcctgagaaaattgtttcttcccaaggaagtttcttggggtcctcaccgagtgggaccatgacggatcggcagatgttgccccctgtggaaggagtgcacctgcttagcagtgggggtcagcagagtttctttgactctaggaccctaggaagcttaactctgtcatcatctcaagtatctgcacatatggtctgatgaagcctttaagttaaatgacatttggatctgtctaacatattttctttttcttttttaaaagctatgtggaaagaaactctctgtggtttataaaatgtacatataatagaaaatgaaggctcactgggttttttgactttatcatggtgagattgtaattatctatggtatatatgtatgctgtatatacatagcacatggagtatcacggcccctattgttcccctgtttcatccagttgcacggagtattggcatgcgtgtagtatgtttaagcaaagttctcagactcttttaaaaacaagatggtaaacttaaaacttggcaattatactatccagaagaacacttataacttaatttatcagaaaaatgctctaaacggtttcatacttgatgtattgataaccagcagtaaccagcatgtagagtcttgtgatttctgttattcttggacacagtgtgagaatctaaaatacaaaagccagttgaagtcttagtgttagtcctgaggtatttgtaatcatgaaggatcagctttttcattcctgcttattatttaccacacatactatatgaccttgggtctataaaaaaatcataacccataataattgttattttcttaaggaaggtaaaggagaggcttgtgatttttttttttacactttccattgggcacataagaggttcttattcatctgtagagaacaaatttccagtattttcgattttttgcttattttatatatcaaatagaccattaaagaatgttctataaacatttttaaattccaattttcaccaggggaggaatatgtgatatgagtggaatggcaaaaggaaaataaatccacctcaaattcattgattccaatgagaaatgtctatcttttaaatcaagagtaatactattgttaactataccttatgtttttgtatagtttgtttttaaatttagaatattttttccatcttgctctgagcttcctgaccgatagtatataagtaaaaaaaatgcatttatgctacttatttatatcttgtaattcctacacattgaacccttttccccttcttaaccttgtccgtctgcctgagtctttcccaaaacagatagttcctaggcctgtatggtgttaaataacacggtgaggaatttcagtaggttatctccagcaatctgtcttttgggagctatagtgcaaaggccaaagcccattactataaagaccctcttggaggactaagaaggaagatactaattatgataaaggaactataaaacttttaacctcaacagaatttgtaatgtcagaactggagaaattaaaatcagtattaaattttttaattcctaaaataatatatgcatggttgaagagttaaaaacaagtaactttgagagcacagtatgagataaataaaaaaggctaagaatacatgatgaggcacattccccttctgaggagaaagcgaaataacatgtctgtgcattgacccattcattacatttcatgtatcttaagcaaaagagcatgattttctctcattgctaaaaagagttgctttaactcatccctggatttggtggggaaagggtacaactcctgatttgctgtttcactttgaaacaacacaatttgttagatacttagggagatatactgttgaatttgcacaggatgtgactctgtttatacatattaacaaatttccttttggattccttagcagttcatcaaattagtattaaatttttaaatttaaaactagcatgaagggacatgaaatatttgcagtaggtggatctatgtaagatgtttgggtatggcattaatagcttgacaaagatttggggaaaggtgttaagaatgagtccatctcagccaatagtgcttggtgtataattcaagaacagagagttttccatcttgaaaaaacatggaaagtaatgctctatacccatatgtattaataagagcattttccttcttgccgttgatcatttcagatgataccacaatatgagtataattttttattaatcttttttctggtaaaattttagcaatattgtacaaatgctttttttaggttttactgtaaatattaatcaccacgtcacttcagagactagccttttattgctgaattaaatgacatgcatacattgataattatatatctgtattttattaaaaagtacttaaaattatattaaaatatgttattaaacccttt

SEQ ID NO: 2358 - DNA, 1237 bp, Homo sapiens
agagggcggcatatttggaaacttggtttcccgaagggcggctgtgaggacggcttccagcagggagcttcccctctggcgtcaccgggaggctcccccaaggggtctccggcgcgctccctggcccggcccgggacccctctgccctcgccgcaggccccgcgggtggatctgcagggagccgagctctggaagcgctttcatgagataggcactgagatgatcatcaccaaggccggcaggcgcatgtttccagcaatgagagtgaagatctctggattagatcctcaccagcaatattacattgccatggatattgtaccagtggacaacaaaagatacaggtatgtttaccacagttcgaaatggatggtggcaggtaatgctgactcgcctgtgccaccccgtgtgtacattcatccagactcgcctgcctcgggggagacttggatgagacaagttatcagcttcgacaagctgaagctcaccaacaatgaactggatgaccaaggccatattattcttcattctatgcacaaataccaaccgcgagtgcacgtcatccgtaaagactgtggagacgatctttctcccatcaagcctgttccatccggggagggagtaaaggcattctcctttccagaaactgtcttcacaaccgtcactgcctatcagaatcagcagattactcgcctgaagatagataggaatccatttgctaaaggcttccgagactccgggcgcaacagaatgggtttggaagccttggtggaatcatatgcattctggcgaccatcactacggactctgacctttgaagatatccctggaattcccaagcaagaatacagggacttgaagacagactacatttttcctgagcgagacaatttggtctcaagggaaaccaaactgtagcacagaatgtgagagagagcaacaataggatggaatgcataaaatccttccccagagcaagcttctcccacttcttgaaaggctttatttttatatagcctctggaagccagacaaagtatcacttagaaagcgagcctcacagggcggctctggagagatctgaaggctgcgttcataagttcagaaagaacaaagtttatgctttaggccgctagaccgtaagctctttgagttcagtttttatcttcattgtatttcaagaactgtgcaagtatctggtacctggaatatgctcaataaatgtttgaataaagatt

SEQ ID NO: 2359 - DNA, 4009 bp, Homo sapiens
gtcgctaccaggagccaggtgattatcctaattaatgtctatctaattaaattactgtcagcagctaaccaatggcaggagccgtttcatcggctgcacaagcagcaagatcaaaagtgagccttttctgattgctgcatagtgtcaattggccaatctcttctcccagggaaaaaaaaaagtaaatcaaacctttgagaagcatttgctggttgaagtgctttctgtctagtgagggggtctgtggatttctagtttatgataaataggactttaaaaaccagggacgggagggcgagtgttcaggttctagagctatgcagctggagcactgcctttctccttctatcatgctctccaagaaatttctcaatgtgagcagcagctacccacattcaggcggatccgagcttgtcttgcacgatcatcccattatctcgaccactgacaacctggagagaagttcacctttgaaaaaaattaccagggggatgacgaatcagtcagatacagacaattttcctgactccaaggactcaccaggggacgtccagagaagtaaactctctcctgtcttggacggggtctctgagcttcgtcacagtttcgatggctctgctgcagatcgctacctcctctctcagtccagccagccacagtctgcggccactgctcccagtgccatgttcccgtaccccggccagcacggaccggcgcaccccgccttctccatcggcagccctagccgctacatggcccaccacccggtcatcaccaacggagcctacaacagcctcctgtccaactcctcgccgcagggataccccacggccggctacccctacccacagcagtacggccactcctaccaaggagctccgttctaccagttctcctccacccagccggggctggtgcccggcaaagcacaggtgtacctgtgcaacaggcccctttggctgaaatttcaccggcaccaaacggagatgatcatcaccaaacagggaaggcgcatgtttccttttttaagttttaacatttctggtctcgatcccacggctcattacaatatttttgtggatgtgattttggcggatcccaatcactggaggtttcaaggaggcaaatgggttccttgcggcaaagcggacaccaatgtgcaaggaaatcgggtctatatgcatccggattcccccaacactggggctcactggatgcgccaagaaatctcttttggaaaattaaaacttacgaacaacaaaggagcttcaaataacaatgggcagatggtggttttacagtccttgcacaagtaccagccccgcctgcatgtggtggaagtgaacgaggacggcacggaggacactagccagcccggccgcgtgcagacgttcactttccctgagactcagttcatcgccgtcaccgcctaccagaacacggatattacacaactgaaaatagatcacaacccttttgcaaaaggatttcgggataattatgacacgatctacaccggctgtgacatggaccgcctgaccccctcgcccaacgactcgccgcgctcgcagatcgtgcccggggcccgctacgccatggccggctctttcctgcaggaccagttcgtgagcaactacgccaaggcccgcttccacccgggcgcgggcgcgggccccgggccgggtacggaccgcagcgtgccgcacaccaacgggctgctgtcgccgcagcaggccgaggacccgggcgcgccctcgccgcaacgctggtttgtgacgccggccaacaaccggctggacttcgcggcctcggcctatgacacggccacggacttcgcgggcaacgcggccacgctgctctcttacgcggcggcgggcgtgaaggcgctgccgctgcaggctgcaggctgcactggccgcccgctcggctactacgccgacccgtcgggctggggcgcccgcagtcccccgcagtactgcggcaccaagtcgggctcggtgctgccctgctggcccaacagcgccgcggccgccgcgcgcatggccggcgccaatccctacctgggcgaggaggccgagggcctggccgccgagcgctcgccgctgccgcccggcgccgccgaggacgccaagcccaaggacctgtccgattccagctggatcgagacgccctcctcgatcaagtccatcgactccagcgactcggggatttacgagcaggccaagcggaggcggatctcgccggccgacacgcccgtgtccgagagttcgtccccgctcaagagcgaggtgctggcccagcgggactgcgagaagaactgcgccaaggacattagcggctactatggcttctactcgcacagctaggccgcccctgcccgcccggccccgccgcggcccggacccccagccagcccctcacagctcttccccagctccgcctccccacactcctccttgcgcacccactcattttatttgaccctcgatggccgtctgcagcgaataagtgcaggtctccgagcgtgattttaaccttttttgcacagcagtctctgcaattagctcaccgaccttcaactttgctgtaaaccttttggttttcctacttactcttcttctgtggagttatcctcctacaattcccctccccctcgtctttctcttacctcctacttctctttcttgtaatgaaactcttcacctttaggagacctgggcagtcctgtcaggcagcagcgattccgacccgccaagtctcggcctccacattaaccataggatgttgactctagaacctggacccacccagcgcgtcctttcttatccccgagtggatggatggatggatggatggtagggatgttaataattttagtggaacaaagcctgtgaaatgattgtacatagtgttaatttattgtaacgaatggctagtttttattctcgtcaaggcacaaaaccagttcatgcttaacctttttttcctttcctttctttgcttttctttctctcctctcatactttctcttctctctcttttaattttcttgtgagataatattctaagaggctctagaaacatgaaatactcagtagtgatgggtttcccacttctcctcaatccgttgcatgaaataattactatgtgccctaatgcacacaaatagctaaggagaatccacccaaacacctttaaaggataggtgtctgttcataggcaagtcgattaagtggcatgatgcctgcaaagcaaagtcaactggagttgtatgttccccccaccttctaaatagaatagctcgacatcagcaatattattttgccttatttgtttttccccaaagtgccaaatccattactggtctgtgcaggtgccaaatatgctgacaaactgtttctgaatatctttcagtaccccttcacctttatatgctgtaaatctttgtaatgaatactctattaatgatatagatgactgaattgttggtaactatagtgtagtctagtgaagatgaattgtgtgagttgtatattttactgcattttagttttgaaaatgacttccccaccacctagaaacagctgaaatttgacttccttgggagaacactagcattaatgcaagtaagactgattttcccctaagtcttgttatatttgataaggagcattaatccccctggaaatagattagtaggatttctaatgttgtgtagcaaacctatacttttttgtatttaaaaattaatgtgaaatatgcatcatacacaatattcaatctagattccagtccatggggggatttttcctaataggaattcagggtctaaacgtgtgtatattttggctcttctgtaaatctaatgttgtgatttttatatttgtttcgttttgtctgtgaactgaataatttatacaagaacacactccattgagaaacgttttgttttttgctcgtttgtatcgtctgtgtataacaagtaaaataaacctggtaaaaacgctaa

SEQ ID NO: 2360 - DNA, 1454 bp, Homo sapiens
tttgtggactggctcgagcgacttttaaaacgatcggccaatgacttctaaaaggaaacgagggggacagggggacagactgagctgcgagaagggggaggattatgcaaaagctattttaatcacccccagttaataggaagaaagaatggcctaaaaaagccccagttaatgggcttcatggtggagtaaggaaatcgggtctatatgcatccggattcccccaacactggggctcactggatgcgccaagaaatctcttttggaaaattaaaacttacgaacaacaaaggagcttcaaataacaatgggcagatggtggttttacagtccttgcacaagtaccagccccgcctgcatgtggtggaagtgaacgaggacggcacggaggacactagccagcccggccgcgtgcagacgttcactttccctgagactcagttcatcgccgtcaccgcctaccagaacacggatattacacaactgaaaatagatcacaacccttttgcaaaaggatttcgggataattatgacacgatctacaccggctgtgacatggaccgcctgaccccctcgcccaacgactcgccgcgctcgcagatcgtgcccggggcccgctacgccatggccggctctttcctgcaggaccagttcgtgagcaactacgccaaggcccgcttccacccgggcgcgggcgcgggccccgggccgggtacggaccgcagcgtgccgcacaccaacgggctgctgtcgccgcagcaggccgaggacccgggcgcgccctcgccgcaacgctggtttgtgacgccggccaacaaccggctggacttcgcggcctcggcctatgacacggccacggacttcgcgggcaacgcggccacgctgctctcttacgcggcggcgggcgtgaaggcgctgccgctgcaggctgcaggctgcactggccgcccgctcggctactacgccgacccgtcgggctggggcgcccgcagtcccccgcagtactgcggcaccaagtcgggctcggtgctgccctgctggcccaacagcgccgcggccgccgcgcgcatggccggcgccaatccctacctgggcgaggaggccgagggcctggccgccgagcgctcgccgctgccgcccggcgccgccgaggacgccaagcccaaggacctgtccgattccagctggatcgagacgccctcctcgatcaagtccatcgactccagcgactcggggatttacgagcaggccaagcggaggcggatctcgccggccgacacgcccgtgtccgagagttcgtccccgctcaagagcgaggtgctggcccagcgggactgcgagaagaactgcgccaaggacattagcggctactatggcttctactcgcacagctaggccgcccctgcccgcccggccccgccgcggcccggacccccagccagcccctcacagct

SEQ ID NO: 2361 - DNA, 1335 bp, Homo sapiens
atcactggaggtttcaaggaggcaaatgggttccttgcggcaaagcggacaccaatgtgcaaggaaatcgggtctatatgcatccggattcccccaacactggggctcactggatgcgccaagaaatctcttttggaaaattaaaacttacgaacaacaaaggagcttcaaataacaatgggcagatggtggttttacagtccttgcacaagtaccagccccgcctgcatgtggtggaagtgaacgaggacggcacggaggacactagccagcccggccgcgtgcagacgttcactttccctgagactcagttcatcgccgtcaccgcctaccagaacacggatattacacaactgaaaatagatcacaacccttttgcaaaaggatttcgggataattatgacacgatctacaccggctgtgacatggaccgcgcgggccccgggccgggtacggaccgcagcgtgccgcacaccaacgggctgctgtcgccgcagcaggccgaggacccgggcgcgccctcgccgcaacgctggtttgtgacgccggccaacaaccggctggacttcgcggcctcggcctatgacacggccacggacttcgcgggcaacgcggccacgctgctctcttacgcggcggcgggcgtgaaggcgctgccgctgcaggctgcaggctgcactggccgcccgctcggctactacgccgacccgtcgggctggggcgcccgcagtcccccgcagtactgcggcaccaagtcgggctcggtgctgccctgctggcccaacagcgccgcggccgccgcgcgcatggccggcgccaatccctacctgggcgaggaggccgagggcctggccgccgagcgctcgccgctgccgcccggcgccgccgaggacgccaagcccaaggacctgtccgattccagctggatcgagacgccctcctcgatcaagtccatcgactccagcgactcggggatttacgagcaggccaagcggaggcggatctcgccggccgacacgcccgtgtccgagagttcgtccccgctcaagagcgaggtgctggcccagcgggactgcgagaagaactgcgccaaggacattagcggctactatggcttctactcgcacagctaggccgcccctgcccgcccggccccgccgcggcccggacccccacctccccacactcctccttgcgcacccactcattttatttgaccctcgatggccgtctgcagcgaataagtgcaggtctccgagcgtgattttaaccttttttgcacagcagtctctgcaattagctcaccgaccttcaactttgctgtaaaccttttgg

SEQ ID NO: 2362 - DNA, 2826 bp, Homo sapiens
gtttccggaggagtgtgtccgcgcaattgaacgactttatgtcacttcctatcggatcggcggaagttgcttccgagcgcgttgagctttggcgaagtgggttccggtggtggcagaggtgcttgtgtttttgtcggtacaggagagtcgctatggcggcggtggattcggatgtcgaatcgctgccgcgtggggggttccgctgctgcctctgccacgttactacagccaaccgacccagccttgatgcccacttgggaggcagaaagcaccggcacctggtagaactacgagctgcgagaaaggcccagggacttcgaagtgtgtttgtcagtggctttcccagggatgtggattctgctcagctctctgagtacttcctagcatttggacctgtggccagtgttgtcatggacaaggacaagggagtgtttgccattgtggagatgggggacgtgggtgctcgagaggctgtcttgtcacagtcccagcacagcctgggaggacatcgcctgcgtgtccgcccacgggagcagaaggagttccagagcccggcctccaaatcccccaaaggagcggcccccgacagtcaccagctggccaaagcgctagctgaggctgcagacgtgggggcacaaatgataaagcttgtggggctgagggagttgtccgaggccgagcggcagcttcgcagcctagtggtggccctgatgcaggaggtcttcacagagttcttccctggctgtgtggtccacccttttggctcttccataaatagcttcgatgtccatggctgtgatcttgacctcttcttggatctgggtgacttggaagagccccagccagtcccaaaggctccagaatctccatcgctggactcggccctggcttccccactggaccctcaagccctggcctgcaccccagcttcccctccagattcacaacctcctgcttctccccaggattctgaagccctggactttgaaaccccttcctcctccctggcgccccaaactccggactctgccttggcctccgagacccttgcttctccccagtctctgcctccagcttcaccactgctagaggacagggaagagggggacctggggaaggcctcggaactagcagagaccccaaaggaggagaaagcagagggggcagcaatgctggagctggtgggatccattctccggggctgtgtccctggggtgtatcgagtccaaactgtgccctctgcccggcgccctgtggtcaagttctgtcatcggccttcaggtctccacggtgatgtctccctcagtaaccggctggccctgcataactcccgtttcctgagtctctgctctgagctggatggtcgagtccggcccctcgtgtacaccctccgctgctgggctcagggtcgggggctgtcagggagtggcccccttctcagtaactacgccctgaccttgctggtgatctattttcttcagaccagggaccctcctgtgttgcccactgtgtcccagctcacccagaaagcaggagagggggaacaggtggaagtcgatggctgggactgcagtttccccagggatgcctcaagactggagcccagcataaatgtggagcccctcagttccctgctagcccagttcttctcctgtgtatcttgttgggatcttcgtggctccctgctgtccctgcgggagggtcaggcactgcctgtggcagggggcctgccttctaatctctgggagggtctgcgccttggccccctgaatctccaggacccttttgacctgagtcacaatgtcgcagccaatgtgaccagccgggtggctgggcgcctacagaactgctgccgagcagcagccaattactgccgaagcctccagtaccagcgccgttcctcccggggtcgggactgggggctgctccctcttctgcagcccagctcccccagctccctgctctctgctacgccgatccctttaccccttgcacccttcacccagctcactgctgccctggtgcaggtattcagggaagcactggggtgccatatagaacaggcaaccaagagaacgcggtcagaaggaggtggaactggggagtcctctcagggagggacaagcaaaagactcaaagtagatggacagaaaaactgctgtgaggaggggaaagaggagcagcagggatgtgcaggggacggtggggaagacagggtagaagagatggttatagaggttggagagatggtgcaggactgggccatgcagagccctgggcagccaggggacctgcccctgaccactggaaagcatggagcccctggagaagaggggcagcccagccacgcagccctggcagagcgggggcccaagggacatgaggcagcccaagaatggtctcagggtgaggcagggaagggggcatccctgccctcctcagcgagctggcgctgtgccttgtggcaccgagtgtggcaagggcggcggcgagcccgtagacgcttgcagcagcaaaccaaggagggagctggaggtggcgctggcacaagagcagggtggctggcgactgaggctcaggtcacccaggagctgaaaggactgagtggtggcgaagagaggccagaaactgagcccctgctgagctttgtggcgtctgtctccccggctgaccgaatgctcactgtgaccccgctccaggatccccaaggcctgttccctgatctccatcatttcttacaggttttcctccctcaagcaattcgacatctcaagtgaagacatggcccctgaagggcaataaagctgctagtttattaatacagtc

SEQ ID NO: 2363 - DNA, 3363 bp, Homo sapiens
gaggtgcgccagtagctctggcgcctccggcgtacaccacgcagcccactactgcggaaggaatgggcctggctccaggacctcgtggagtccggaaggtgcccggtggtggcagagctccccaaccagggctagaagccgtcgcagaacacccgttttgcgggaggacagggggcggagggagggagtaacagccctgaaaaggttggaagtccagggacagccctgggctccgtggggcaaagaattggaagccgccgatcctccgcctttattcgtcgggtaaataagggtcgagggtacagacgcacgggtgtctactgcggggtgaaggagctgccgcaagatgccacccggcgccggcctttgtggctgctgtcatgaatattcacgatgctttgggccaatcaacgtctgaacagcttaaagcacaccaatcggcttaccgcatgcagataagcatcgtaacgcgccgcttttcctgaaacgggcggggactggacagcggctagaaacggaacccagagtcgaaggagcttggtttccggaggagtgtgtccgcgcaattgaacgactttatgtcacttcctatcggatcggcggaagttgcttccgagcgcgttgagctttggcgaagtgggttccggtggtggcagaggtgcttgtgtttttgtcggtacaggagagtcgctatggcggcggtggattcggatgtcgaatcgctgccgcgtggggggttccgctgctgcctctgccacgttactacagccaaccgacccagccttgatgcccacttgggaggcagaaagcaccggcacctggtagaactacgagctgcgagaaaggcccagggacttcgaagtgtgtttgtcagtggctttcccagggatgtggattctgctcagctctctgagtacttcctagcatttggacctgtggccagtgttgtcatggacaaggacaagggagtgtttgccattgtggagatgggggacgtgggtgctcgagaggctgtcttgtcacagtcccagcacagcctgggaggacatcgcctgcgtgtccgcccacgggagcagaaggagttccagagcccggcctccaaatcccccaaaggagcggcccccgacagtcaccagctggccaaagcgctagctgaggctgcagacgtgggggcacaaatgataaagcttgtggggctgagggagttgtccgaggccgagcggcagcttcgcagcctagtggtggccctgatgcaggaggtcttcacagagttcttccctggctgtgtggtccacccttttggctcttccataaatagcttcgatgtccatggctgtgatcttgacctcttcttggatctgggtgacttggaagagccccagccagtcccaaaggctccagaatctccatcgctggactcggccctggcttccccactggaccctcaagccctggcctgcaccccagcttcccctccagattcacaacctcctgcttctccccaggattctgaagccctggactttgaaaccccttcctcctccctggcgccccaaactccggactctgccttggcctccgagacccttgcttctccccagtctctgcctccagcttcaccactgctagaggacagggaagagggggacctggggaaggcctcggaactagcagagaccccaaaggaggagaaagcagagggggcagcaatgctggagctggtgggatccattctccggggctgtgtccctggggtgtatcgagtccaaactgtgccctctgcccggcgccctgtggtcaagttctgtcatcggccttcaggtctccacggtgatgtctccctcagtaaccggctggccctgcataactcccgtttcctgagtctctgctctgagctggatggtcgagtccggcccctcgtgtacaccctccgctgctgggctcagggtcgggggctgtcagggagtggcccccttctcagtaactacgccctgaccttgctggtgatctattttcttcagaccagggaccctcctgtgttgcccactgtgtcccagctcacccagaaagcaggagagggggaacaggtggaagtcgatggctgggactgcagtttccccagggatgcctcaagactggagcccagcataaatgtggagcccctcagttccctgctagcccagttcttctcctgtgtatcttgttgggatcttcgtggctccctgctgtccctgcgggagggtcaggcactgcctgtggcagggggcctgccttctaatctctgggagggtctgcgccttggccccctgaatctccaggacccttttgacctgagtcacaatgtcgcagccaatgtgaccagccgggtggctgggcgcctacagaactgctgccgagcagcagccaattactgccgaagcctccagtaccagcgccgttcctcccggggtcgggactgggggctgctccctcttctgcagcccagctcccccagctccctgctctctgctacgccgatccctttaccccttgcacccttcacccagctcactgctgccctggtgcaggtattcagggaagcactggggtgccatatagaacaggcaaccaagagaacgcggtcagaaggaggtggaactggggagtcctctcagggagggacaagcaaaagactcaaagtagatggacagaaaaactgctgtgaggaggggaaagaggagcagcagggatgtgcaggggacggtggggaagacagggtagaagagatggttatagaggttggagagatggtgcaggactgggccatgcagagccctgggcagccaggggacctgcccctgaccactggaaagcatggagcccctggagaagaggggcagcccagccacgcagccctggcagagcgggggcccaagggacatgaggcagcccaagaatggtctcagggtgaggcagggaagggggcatccctgccctcctcagcgagctggcgctgtgccttgtggcaccgagtgtggcaagggcggcggcgagcccgtagacgcttgcagcagcaaaccaaggagggagctggaggtggcgctggcacaagagcagggtggctggcgactgaggctcaggtcacccaggagctgaaaggactgagtggtggcgaagagaggccagaaactgagcccctgctgagctttgtggcgtctgtctccccggctgaccgaatgctcactgtgaccccgctccaggatccccaaggcctgttccctgatctccatcatttcttacaggttttcctccctcaagcaattcgacatctcaagtgaagacatggcccctgaagggcaataaagctgctagtttattaataca

SEQ ID NO: 2364 - DNA, 1936 bp, Homo sapiens
ctttccctgggtgcccacatgaacagagacaccaggatgctctcctgagaccacagcaactgcagaagctgaagacatttccagaagttcaagcttccaccctctgcaggtccccactgagctgggacccaggtcatccaccccaccccaaatccctggataggaaacccctttctcctcctgctccttgtccccttcatccctgccgcccagcatcctactggcctcagcacctgtggccagaccgtccaagatcctctgaaggcccagctcttgctgtccaccccggcagtaggcaggcagcctggccatgtgccctccggtcagcatgcggtatgaggaagagggcatgtcctacctctacgcctcctggatgtatcagcttcaacatggagatcagctaagcatttgcttcacctgcttcaaggctgcctttctagactttaaagacttgctggagtcagaggactgggaagaagacaactgggaccctgagctgatggagcacactgaggcagagtcagagcaggaggggtcctcagggatggagctgagctgggggcagagcccaggacagcctgtgcaggggggctctgaggcatgggggccagggaccctggcagcagccccagaagggttggaagatgcaggtctggacccccactttgtccccactgaactatggcctcaggaggctgtgcccctgggcctgggccttgaggatgctgactggacccagggtcttccctggagatttgaggagcttcttacctgctcacactggccaagcttctttccttcatagcaggggtttctcaaagtggacctgcccccaggggagcccgtggtgttgaagctgggcattacctgggcagtggaccctgccgaggctgaggcctagttactggccctgcagcttgtctccatggtgggctgctatgataccatctacctacagaagatgaccccagacagggccctgaggaccccagggcagcactggaaattgctgctggagcctggtgaagtgtgggtggtgagactccaagatgcaccccaagagcaggacctgcactggtggatgctgagcattctagaaacatcgttaacaggacacagggcagagctggtccctgcagcctcagccctgcagaagaggattcaccatagtctcttattcaccctggaccaacagggagagcaagaagggagactcagcctgtaagccacagtcctccagccaagaacaggatctcagcacccctgagacacagagcaggggtcctgaggaaagcctggctgttgcaggagcctcggccatgggggagctgccctgtttccagcctcagtccagggccccagaactgagagactaaggctcatgtagctgccattgtcctgggcacaccaggacatcagagactgggaagggccagcaattgctgttccacaacagccaggggagcagttggcaaaggaaacatggggagcaactttaggggctgggagatagggcctgttgtggcctcagagggaagcattacaaatattcataacctggaaacaagttcttaccagttgattgtcacatagttctggatgtgttggcctgaatggctgttgtgctgcttgtgacatggggggcagggcacagaacttgtgcctatttcaccttggccatggggagggacattgcttgtaaaacacatgctctgcagaacacaccagaatctgtggtgacctggatgtgttctcgactttgccaggacaatctcaggggtgccacaagaccctgtcagcagcactaggatctctggtctacagtggagggagagctggttttaaatgttggccgttgatgcaatttaaccatttaattcctgttgctctatatgttgtttttaattttaaaaagtcataaaagctttcaaacaag

SEQ ID NO: 2365 - DNA, 1924 bp, Homo sapiens
tccctcccacccccaggccctcccctggccctggaccctccaaggagacagcggcaggagcgcacggtctacactgaaagccagcagaaagtgctagaattttactttcagaaggaccagtacccgaactacgaccagcgactgaatctggcggagatgctcagcctcagggagcaacagctgcaggtgtggttcaagaatcgccgcgccaaactagctcgggagcggcggctccagcagcagccccagcgcgtccctgggcagagaggccgaggagcccgcgctgcgcccctagtccctgcagcctctgcctccgcacctcagcggggcccctcgggaatccttccagcggcggaacccacgatctgcagcctccaccaggcctggggtggccctgggtgcagagcccagaagggcatcccagctgccctgagtccaggccctggcccgatccctgccccaatcccaggcccagcccagatcccaggcccactccctggctcaattccaggcccaattccaggcccagctcagatcccaagcccgatcccagccccaatcccaggcccaatttcaggcccagtccagatcccaggcccattccgtggcccaatcccaggcccaatttcaggcccagccccgatcccaggcccaatctcaggcccattctcaggcccaaacccaggcccgatcccaggcccaaacccaggcccgatcccaggcccaatctcaggcccgatcccaggcccaatctcagtcccgatcccaggcccgatcccaggcccaatctcaggcccaatctcaggcccaaacccaggcccgatcccaggcccaatcccaggcccaatctcaggcccgaacccaggcccgatcccaggcccaatctcaggcccgaacccaggcctgatcccaggcccaatcccaggcccaatctcaggcccaggcccaattataggcccgattcccagcccagcccagatcccaggcccaggcagactccaaggcccaggtcccatcttaagtcctggccggatgcgaagccctggctcacttccaggcctagccccgattttaggcccaggctcaggcccaggctcaggctcagtcccagctccaatcccaggcccaggatcactcccagccccagcccccttatggcctcagagccccgatgcctccgacttcttgccagacacccagttattccctcacttcacagagctgctcctacccctagaccccttggagggatcctcagtctccaccatgacctctcagtaccaagaaggggatgactctatgggcaaaaaacactcagggtctcagccccaagaggagggtggctctgtgaatgaaaatcactcaggccccaggttattactggatttatagggggcctgtgcctgcaaagttcttcagatcccagagggcctggagtggctgatctacactgctggtgactttctgcagtgaatgcatcaccctttacccaccctgctgcaggtggacatttgctgtcttcactgtgcagctatcacaggtggctctgctgtgaatgtgcctgcctgtcatttgaattgagcctgagcgtttctctgctgggattggagtcgctgctcactgggatatctggcattagtggatgctgctcgagagctttctaaagggcttttcccagggcttctgatggtcagcatcttccccaacacttaggattgtgagactttttaatgtttgtcgatccaatgacttgtggttttgttgtggttgtaatatccatttccctgatgattgagaagttaaaccctcacatgttaattgaaccttagatatcttcataatgtgtatttgtttaccccttttccttcatttatttgaatgtattcttatattctcttggcaattaaagttctgcagacacctt

SEQ ID NO: 2366 - DNA, 2059 bp, Homo sapiens
atggatgaagctggaaaccatcattctgagcaaactatcacaaggacagaaaaccaaacaccgcatgctctcgctcataggaggatggggccctgtctgtcttgttctcagctgtattcccagtacctaggactgtcccagacacacagcagccctcccctggccctggaccctccaaggagacagcggcaggagcgcacggtctacactgaaagccagcagaaagtgctagaattttactttcagaaggaccagtacccgaactacgaccagcgactgaatctggcggagatgctcagcctcagggagcaacagctgcaggtgtggttcaagaatcgccgcgccaaactagctcgggagcggcggctccagcagcagccccagcgcgtccctgggcagagaggccgaggagcccgcgctgcgcccctagtccctgcagcctctgcctccgcacctcagcggggcccctcgggaatccttccagcggcggaacccacgatctgcagcctccaccaggcctggggtggccctgggtgcagagcccagaagggcatcccagctgccctgagtccaggccctggcccgatccctgccccaatcccaggcccagcccagatcccaggcccactccctggctcaattccaggcccaattccaggcccagctcagatcccaagcccgatcccagccccaatcccaggcccaatttcaggcccagtccagatcccaggcccattccgtggcccaatcccaggcccaatttcaggcccagccccgatcccaggcccaatctcaggcccattctcaggcccaaacccaggcccgatcccaggcccaaacccaggcccgatcccaggcccaatctcaggcccgatcccaggcccaatctcagtcccgatcccaggcccgatcccaggcccaatctcaggcccaatctcaggcccaaacccaggcccgatcccaggcccaatcccaggcccaatctcaggcccgaacccaggcccgatcccaggcccaatctcaggcccgaacccaggcctgatcccaggcccaatcccaggcccaatctcaggcccaggcccaattataggcccgattcccagcccagcccagatcccaggcccaggcagactccaaggcccaggtcccatcttaagtcctggccggatgcgaagccctggctcacttccaggcctagccccgattttaggcccaggctcaggcccaggctcaggctcagtcccagctccaatcccaggcccaggatcactcccagccccagcccccttatggcctcagagccccgatgcctccgacttcttgccagacacccagttattccctcacttcacagagctgctcctacccctagaccccttggagggatcctcagtctccaccatgacctctcagtaccaagaaggggatgactctatgggcaaaaaacactcagggtctcagccccaagaggagggtggctctgtgaatgaaaatcactcaggccccaggttattactggatttatagggggcctgtgcctgcaaagttcttcagatcccagagggcctggagtggctgatctacactgctggtgactttctgcagtgaatgcatcaccctttacccaccctgctgcaggtggacatttgctgtcttcactgtgcagctatcacaggtggctctgctgtgaatgtgcctgcctgtcatttgaattgagcctgagcgtttctctgctgggattggagtcgctgctcactgggatatctggcattagtggatgctgctcgagagctttctaaagggcttttcccagggcttctgatggtcagcatcttccccaacacttaggattgtgagactttttaatgtttgtcgatccaatgacttgtggttttgttgtggttgtaatatccatttccctgatgattgagaagttaaaccctcacatgttaattgaaccttagatatcttcataatgtgtatttgtttaccccttttccttcatttatttgaatgtattcttatattctcttggcaattaaagttctgcagacacctt

SEQ ID NO: 2367 - DNA, 1526 bp, Homo sapiens
cgaccagcgactgaatctggcggagatgctcagcctcagggagcaacagctgcaggtgtggttcaagaatcgccgcgccaaactagctcgggagcggcggctccagcagcagccccagcgcgtccctgggcagagaggccgaggagcccgcgctgcgcccctagtccctgcagcctctgcctccgcacctcagcggggcccctcgggaatccttccagcggcggaacccacgatctgcagcctccaccaggcctggggtggccctgggtgcagagcccagaagggcatcccagctgccctgagtccaggccctggcccgatccctgccccaatcccaggcccagcccagatcccaggcccactccctggctcaattccaggcccaattccaggcccagctcagatcccaagcccgatcccagccccaatcccaggcccaatttcaggcccagtccagatcccaggcccattccgtggcccaatcccaggcccaatctcaggcccattctcaggcccaaacccaggcccgatcccaggcccaaacccaggcccgatcccaggcccaatctcaggcccgatcccaggcccaatctcagtcccgatcccaggcccgatcccaggcccaatctcaggcccaatctcaggcccaaacccaggcccgatcccaggcccaatcccaggcccaatctcaggcccgaacccaggcccgatcccaggcccaatctcaggcccgaacccaggcctgatcccaggcccaatcccaggcccaatctcaggcccaggcccaattataggcccgattcccagcccagcccagatcccaggcccaggcagactccaaggcccaggtcccatcttaagtcctggccggatgcgaagccctggctcacttccaggcctagccccgattttaggcccaggctcaggcccaggctcaggctcagtcccagctccaatcccaggcccaggatcactcccagccccagcccccttatggcctcagagccccgatgcctccgacttcttgccagacacccagttattccctcacttcacagagctgctcctacccctagaccccttggagggatcctcagtctccaccatgacctctcagtaccaagaaggggatgactctatgggcaaaaaacactcagggtctcagccccaagaggagggtggctctgtgaatgaaaatcactcaggccccaggttattactggatttatagggggcctgtgcctgcaaagttcttcagatcccagagggcctggagtggctgatctacactgctggtgactttctgcagtgaatgcatcaccctttacccaccctgctgcaggtggacatttgctgtcttcactgtgcagctatcacaggtggctctgctgtgaatgtgcctgcctgtcatttgaattgagcctgagcgtttctctgctgggattggagtcgctgctcactgggatatctggcattagtggatgctgctcgagagctttctaaagggcttttcccagggcttctga

SEQ ID NO: 2368 - DNA, 1980 bp, Homo sapiens
gggaggccctgaaacgcgcggagcttccctctgcctccaggctttcccagcgagagtgaaattaaacttgaaactcggatcaactggcagtcgttgttggtagaacgccctaaggacccctccccgcgggacggagggaggactcgggacagggaattggccctgggagaaaacgcgcggggggcgtccgagacgccccgtgaaagccgtgccgacccttgggaggactgacaggtctagagacacgcgctgtctgttgtggtgggcctcccgggaataagtgaggggctctgtgtttcgaggatggttctagcgcagagccgggtgtctgccggggtgggctccccgcattgttcgggctccggcgggggcggctctgattcctttccatggcccgcctcccaccccgggaatccccagtgctccttttccacggcttttctggcgtccccccgactctcccgcggcactttggcctaccttcccccagcgccgtggtcctccctggcgaccccctctgcgctcctggggtcctcctgcgccccccctcctccaccggcgcgctgcccacagccgcgtgccctctccccggagctggggaccaaggctgggccccgccggccgcatcggtgggaacttccgcggtccccatcccagggcgcacagggtccagctcctcggcgccgactcctggaaacaatgaaaggtattgttgcagcatctggcagtgagactgaggatgaggacagcatggacattcccttggacctttcttcatccgctggctcaggcaagagaaggagaaggggcaacctacccaaggagtctgtgcagattcttcgggattggctgtatgagcaccgttacaatgcctatccttcagagcaagaaaaagcgttgctgtcccagcaaacacacctgtctacgctacaggtctgtaactggttcatcaacgcccgccgcaggctcctccctgacatgctgagaaaggatggcaaagatccaaatcagttcacaatttcccgccgtggggccaagatttctgaaacgagctctgtggagtccgtgatgggcatcaaaaacttcatgccagctctagaggagaccccatttcattcctgtacagctgggccaaacccaaccctagggaggccactgtctcctaagccgtcatccccgggatcagttttggctcgtccatcagtgatctgccataccactgtgactgcattgaaagatgtccctttctctctctgccagtcggtcggtgtgggacaaaacacagatatacagcagatagcggccaaaaacttcacagacacctctctcatgtacccagaggacacttgtaaatctggaccaagtacgaatacacagagtggtcttttcaacactcctccccctactccaccggacctcaaccaggacttcagtggatttcagcttctagtggatgttgcactcaaacgggctgcagagatggagcttcaggcaaaacttacagcttaacccattttcaagcaaaacagttctcagaaatgtcatgattgccggggtgaaggcaagagatgaattgcattattttatatattttttattaatatttgcacatgggattgctaaaacagcttcctgttactgagatgtcttcaatggaatacagtcattccaagaactataaacttaaagctactgtagaaacaaagggttttcttttttaaatgtttcttggtagattattcataatgtgagatggttcccaatatcatgtgattttttttttcctccccttccctttttttgttattttttcagactgtgcaatacttagagaacctatagcatcttctcattcccatgtggaacaggatgcccacatactgtctaattaataaattttccattttttttcaaacaagtatgaatctagttggttgatgccttttttttcatgacataataaagtattttctttaaaaa

SEQ ID NO: 2369 - DNA, 2055 bp, Homo sapiens
atcagaggcggctgtctcgtgcggctagagcagggccagtagagttcggggcagctgtcaaaaacgagacggggaggcttttcttcccgggggtggaggagggaaggagggaggtgtccttttttccatctgttgcagtttccgaaccaaacgcaccctcgccagccccgggaagaaaggcccaagggagaaacctggggcgctcggctggtgcccccaccgccgggcgagggatgcgggcggtccgtgcgcggcaggcggaaaggatcgtgtttctggacccggccaccccccgcgtccgcaccgccgcccccgagggacgagtgacagcggccgccgcgctcggtccagtcttcccggctggaaggtgcgggggaggggcggaggagcggcggggcgggagggggacggggcgggcggctgggggcggaggcaggacctcctgtaccttccctcctcgcctctctcactctgacagcgccgaggtgcgccgagcaggagcagggaacaaaggagcggagaggggaggggagagagttgggcgagggagagcccccggccggctgccagaagatcccggcgggaggaagcccaagtgtcacttgaattccacccaaggagcgggcgcctgggatcagagcgtcctgtttagcaataacggctggagcacgtcctacaagttacgggagagtcggctgtgaaggagacgttcgcttatcccctgtgtccccgctcctggcccctccagacccccgccttgcctcgcgctgggaggggagatccagaatgaaaggcaagaaaggtattgttgcagcatctggcagtgagactgaggatgaggacagcatggacattcccttggacctttcttcatccgctggctcaggcaagagaaggagaaggggcaacctacccaaggagtctgtgcagattcttcgggattggctgtatgagcaccgttacaatgcctatccttcagagcaagaaaaagcgttgctgtcccagcaaacacacctgtctacgctacaggtctgtaactggttcatcaacgcccgccgcaggctcctccctgacatgctgagaaaggatggcaaagatccaaatcagttcacaatttcccgccgtggggccaagatttctgaaacgagctctgtggagtccgtgatgggcatcaaaaacttcatgccagctctagaggagaccccatttcattcctgtacagctgggccaaacccaaccctagggaggccactgtctcctaagccgtcatccccgggatcagttttggctcgtccatcagtgatctgccataccactgtgactgcattgaaagatgtccctttctctctctgccagtcggtcggtgtgggacaaaacacagatatacagcagatagcggccaaaaacttcacagacacctctctcatgtacccagaggacacttgtaaatctggaccaagtacgaatacacagagtggtcttttcaacactcctccccctactccaccggacctcaaccaggacttcagtggatttcagcttctagtggatgttgcactcaaacgggctgcagagatggagcttcaggcaaaacttacagcttaacccattttcaagcaaaacagttctcagaaatgtcatgattgccggggtgaaggcaagagatgaattgcattattttatatattttttattaatatttgcacatgggattgctaaaacagcttcctgttactgagatgtcttcaatggaatacagtcattccaagaactataaacttaaagctactgtagaaacaaagggttttcttttttaaatgtttcttggtagattattcataatgtgagatggttcccaatatcatgtgattttttttttcctccccttccctttttttgttattttttcagactgtgcaatacttagagaacctatagcatcttctcattcccatgtggaacaggatgcccacatactgtctaattaataaattttccattttttttcaaacaagtatgaatctagttggttgatgccttttttttcatgacata

SEQ ID NO: 2370 - DNA, 1088 bp, Homo sapiens
tttctgtgggaggccctgaaacgcgcggagcttccctctgcctccaggctttcccagcgagagtgaaattaaacttgaaactcggatcaactggcagtcgttgtattgttgcagcatctggcagtgagactgaggatgaggacagcatggacattcccttggacctttcttcatccgctggctcaggcaagagaaggagaaggggcaacctacccaaggagtctgtgcagattcttcgggattggctgtatgagcaccgttacaatgcctatccttcagagcaagaaaaagcgttgctgtcccagcaaacacacctgtctacgctacaggtctgtaactggttcatcaacgcccgccgcaggctcctccctgacatgctgagaaaggatggcaaagatccaaatcagttcacaatttcccgccgtggggccaagatttctgaaacgagctctgtggagtccgtgatgggcatcaaaaacttcatgccagctctagaggagaccccatttcattcctgtacagctgggccaaacccaaccctagggaggccactgtctcctaagccgtcatccccgggatcagttttggctcgtccatcagtgatctgccataccactgtgactgcattgaaagatgtccctttctctctctgccagtcggtcggtgtgggacaaaacacagatatacagcagatagcggccaaaaacttcacagacacctctctcatgtacccagaggacacttgtaaatctggaccaagtacgaatacacagagtggtcttttcaacactcctccccctactccaccggacctcaaccaggacttcagtggatttcagcttctagtggatgttgcactcaaacgggctgcagagatggagcttcaggcaaaacttacagcttaacccattttcaagcaaaacagttctcagaaatgtcatgattgccggggtgaaggcaagagatgaattgcattattttatatattttttattaatatttgcacatgggattgctaaaacagcttcctgttactgagatgtcttcaatggaatacagtcattccaagaactataaacttaaagcta

SEQ ID NO: 2371 - DNA, 1352 bp, Homo sapiens
cacaacatttccttgtatgtggatagcgtgaaagaagcttgtgatcctgcccccaccctccccaccgccacattttttaaagtgtattgttgcagcatctggcagtgagactgaggatgaggacagcatggacattcccttggacctttcttcatccgctggctcaggcaagagaaggagaaggggcaacctacccaaggagtctgtgcagattcttcgggattggctgtatgagcaccgttacaatgcctatccttcagagcaagaaaaagcgttgctgtcccagcaaacacacctgtctacgctacaggtctgtaactggttcatcaacgcccgccgcaggctcctccctgacatgctgagaaaggatggcaaagatccaaatcagttcacaatttcccgccgtggggccaagatttctgaaacgagctctgtggagtccgtgatgggcatcaaaaacttcatgccagctctagaggagaccccatttcattcctgtacagctgggccaaacccaaccctagggaggccactgtctcctaagccgtcatccccgggatcagttttggctcgtccatcagtgatctgccataccactgtgactgcattgaaagatgtccctttctctctctgccagtcggtcggtgtgggacaaaacacagatatacagcagatagcggccaaaaacttcacagacacctctctcatgtacccagaggacacttgtaaatctggaccaagtacgaatacacagagtggtcttttcaacactcctccccctactccaccggacctcaaccaggacttcagtggatttcagcttctagtggatgttgcactcaaacgggctgcagagatggagcttcaggcaaaacttacagcttaacccattttcaagcaaaacagttctcagaaatgtcatgattgccggggtgaaggcaagagatgaattgcattattttatatattttttattaatatttgcacatgggattgctaaaacagcttcctgttactgagatgtcttcaatggaatacagtcattccaagaactataaacttaaagctactgtagaaacaaagggttttcttttttaaatgtttcttggtagattattcataatgtgagatggttcccaatatcatgtgattttttttttcctccccttccctttttttgttattttttcagactgtgcaatacttagagaacctatagcatcttctcattcccatgtggaacaggatgcccacatactgtctaattaataaattttccattttttttcaaacaagtatgaatctagttggttgatgccttttttttcatgacataataaagtattttcttt

SEQ ID NO: 2372 - DNA, 1523 bp, Homo sapiens
caaaggccaggcctgacggaagagcccagccttcgccgagggccgcagggagccagagactcgagcctgcggttccagccccgccgcggttccggccccgccgcgatcccgaggcctgcgcatgctcggtgctgcgcggggctccctccttaccgcaggagctcctcatcgagaaacccaggttggtgtcttttccacgtggtagaagctggctaacctccacttccacattccagcccaagggaaagtccaaggtattgttgcagcatctggcagtgagactgaggatgaggacagcatggacattcccttggacctttcttcatccgctggctcaggcaagagaaggagaaggggcaacctacccaaggagtctgtgcagattcttcgggattggctgtatgagcaccgttacaatgcctatccttcagagcaagaaaaagcgttgctgtcccagcaaacacacctgtctacgctacaggtctgtaactggttcatcaacgcccgccgcaggctcctccctgacatgctgagaaaggatggcaaagatccaaatcagttcacaatttcccgccgtggggccaagatttctgaaacgagctctgtggagtccgtgatgggcatcaaaaacttcatgccagctctagaggagaccccatttcattcctgtacagctgggccaaacccaaccctagggaggccactgtctcctaagccgtcatccccgggatcagttttggctcgtccatcagtgatctgccataccactgtgactgcattgaaagatgtccctttctctctctgccagtcggtcggtgtgggacaaaacacagatatacagcagatagcggccaaaaacttcacagacacctctctcatgtacccagaggacacttgtaaatctggaccaagtacgaatacacagagtggtcttttcaacactcctccccctactccaccggacctcaaccaggacttcagtggatttcagcttctagtggatgttgcactcaaacgggctgcagagatggagcttcaggcaaaacttacagcttaacccattttcaagcaaaacagttctcagaaatgtcatgattgccggggtgaaggcaagagatgaattgcattattttatatattttttattaatatttgcacatgggattgctaaaacagcttcctgttactgagatgtcttcaatggaatacagtcattccaagaactataaacttaaagctactgtagaaacaaagggttttcttttttaaatgtttcttggtagattattcataatgtgagatggttcccaatatcatgtgattttttttttcctccccttccctttttttgttattttttcagactgtgcaatacttagagaacctatagcatcttctcattcccatgtggaacaggatgcccacatactgtctaattaataaattttccattttttttcaaacaagtatgaatctagttggttgatgccttttttttcatgacataataaagtattttcttt

SEQ ID NO: 2373 - DNA, 1739 bp, Homo sapiens
gcgccgcgccgcgcccgcgtgtcaatggcagccgcgcattctggaagaagttggttcttgtctcgaatacttttcctcccgtgccccgccccttgaatcagaggcggctgtctcgtgcggctagagcagggccagtagagttcggggcagctgtcaaaaacgagacggggaggcttttcttcccgggggtggaggagggaaggagggaggtgtccttttttccatctgttgcagtttccgaaccaaacgcaccctcgccagccccgggaagaaaggcccaagggagaaacctggggcgctcggctggtgcccccaccgccgggcgagggatgcgggcggtccgtgcgcggcaggcggaaaggatcgtgtttctggacccggccaccccccgcgtccgcaccgccgcccccgagggacgagtgacagcggccgccgcgctcggtccagtcttcccggctggaaggtattgttgcagcatctggcagtgagactgaggatgaggacagcatggacattcccttggacctttcttcatccgctggctcaggcaagagaaggagaaggggcaacctacccaaggagtctgtgcagattcttcgggattggctgtatgagcaccgttacaatgcctatccttcagagcaagaaaaagcgttgctgtcccagcaaacacacctgtctacgctacaggtctgtaactggttcatcaacgcccgccgcaggctcctccctgacatgctgagaaaggatggcaaagatccaaatcagttcacaatttcccgccgtggggccaagatttctgaaacgagctctgtggagtccgtgatgggcatcaaaaacttcatgccagctctagaggagaccccatttcattcctgtacagctgggccaaacccaaccctagggaggccactgtctcctaagccgtcatccccgggatcagttttggctcgtccatcagtgatctgccataccactgtgactgcattgaaagatgtccctttctctctctgccagtcggtcggtgtgggacaaaacacagatatacagcagatagcggccaaaaacttcacagacacctctctcatgtacccagaggacacttgtaaatctggaccaagtacgaatacacagagtggtcttttcaacactcctccccctactccaccggacctcaaccaggacttcagtggatttcagcttctagtggatgttgcactcaaacgggctgcagagatggagcttcaggcaaaacttacagcttaacccattttcaagcaaaacagttctcagaaatgtcatgattgccggggtgaaggcaagagatgaattgcattattttatatattttttattaatatttgcacatgggattgctaaaacagcttcctgttactgagatgtcttcaatggaatacagtcattccaagaactataaacttaaagctactgtagaaacaaagggttttcttttttaaatgtttcttggtagattattcataatgtgagatggttcccaatatcatgtgattttttttttcctccccttccctttttttgttattttttcagactgtgcaatacttagagaacctatagcatcttctcattcccatgtggaacaggatgcccacatactgtctaattaataaattttccattttttttcaaacaagtatgaatctagttggttgatgccttttttttcatgacataataaagtattttctttaaaaatt

SEQ ID NO: 2374 - DNA, 1585 bp, Homo sapiens
ggcccaagggagaaacctggggcgctcggctggtgcccccaccgccgggcgagggatgcgggcggtccgtgcgcggcaggcggaaaggatcgtgtttctggacccggccaccccccgcgtccgcaccgccgcccccgagggacgagtgacagcggccgccgcgctcggtccagtcttcccggctggaaggagcgggcgcctgggatcagagcgtcctgtttagcaataacggctggagcacgtcctacaagttacgggagagtcggctgtgaaggagacgttcgcttatcccctgtgtccccgctcctggcccctccagacccccgccttgcctcgcgctgggaggggagatccagaatgaaaggcaagaaaggtattgttgcagcatctggcagtgagactgaggatgaggacagcatggacattcccttggacctttcttcatccgctggctcaggcaagagaaggagaaggggcaacctacccaaggagtctgtgcagattcttcgggattggctgtatgagcaccgttacaatgcctatccttcagagcaagaaaaagcgttgctgtcccagcaaacacacctgtctacgctacaggtctgtaactggttcatcaacgcccgccgcaggctcctccctgacatgctgagaaaggatggcaaagatccaaatcagttcacaatttcccgccgtggggccaagatttctgaaacgagctctgtggagtccgtgatgggcatcaaaaacttcatgccagctctagaggagaccccatttcattcctgtacagctgggccaaacccaaccctagggaggccactgtctcctaagccgtcatccccgggatcagttttggctcgtccatcagtgatctgccataccactgtgactgcattgaaagatgtccctttctctctctgccagtcggtcggtgtgggacaaaacacagatatacagcagatagcggccaaaaacttcacagacacctctctcatgtacccagaggacacttgtaaatctggaccaagtacgaatacacagagtggtcttttcaacactcctccccctactccaccggacctcaaccaggacttcagtggatttcagcttctagtggatgttgcactcaaacgggctgcagagatggagcttcaggcaaaacttacagcttaacccattttcaagcaaaacagttctcagaaatgtcatgattgccggggtgaaggcaagagatgaattgcattattttatatattttttattaatatttgcacatgggattgctaaaacagcttcctgttactgagatgtcttcaatggaatacagtcattccaagaactataaacttaaagctactgtagaaacaaagggttttcttttttaaatgtttcttggtagattattcataatgtgagatggttcccaatatcatgtgattttttttttcctccccttccctttttttgttattttttcagactgtgcaatacttagagaacctatagcatcttctcattcccatgtggaacaggatgcccacatactgtctaattaataaattttccattttttttcaaacaa

SEQ ID NO: 2375 - DNA, 2214 bp, Homo sapiens
aaagtacttacagccaaaagagcttcctctggggcttgcatattcagtttcctttgtcatgtaatcatttaagactgaactctgcttattgatatgtagtattctattctaggttgagctcaaactggtagctgaaatttaggagacatttttaattcatttagtattaggcatcttttgaccttactaaagtaccagtagtagaaaaatatttttgtgtgatgaaactgaaaacatcagtggtcgtatttaataaaaggtgactagtactgcccatttaaagtaggtgtctaactttgaataaatgtggatagcaatgaataagaaatgaccatgcatggtgttagcagaaaattttaacatgtgttttacctttagaatactaactgggttcagcgtagtatgtaattttccttccttatatccatgaaaaaaaatgtacgagtgctccctttcatttcaaaccttcagtagaggaaggaggaagagtagcatttaaaatgtacattaggactggttaggttgcttttcctagttagcactgatcttagaaagaaggttggtaggcatattccaactgccacagcacccttcctgtttcaaatgtggcaggttattcattttgggtgcagtttgtctcctccaatgattagacgaaagagttttctgaccatcattcaaaaggaatgtgagaagttaatgaatcctagaggaaagcggctgagaaaaggcatctggcatttggttgagagcctcctatgtggtgctagtcaaactacttttacttggaccctgaattcaggacagaaaacactgctccttctcctcgctctcagttgttgggaaagcatggttacattgaatggtcagcgttaagtgagctttgcaatagttgctgtgcttataaagcaactgacaactggcccttgtcctttcctaggtattgttgcagcatctggcagtgagactgaggatgaggacagcatggacattcccttggacctttcttcatccgctggctcaggcaagagaaggagaaggggcaacctacccaaggagtctgtgcagattcttcgggattggctgtatgagcaccgttacaatgcctatccttcagagcaagaaaaagcgttgctgtcccagcaaacacacctgtctacgctacaggtctgtaactggttcatcaacgcccgccgcaggctcctccctgacatgctgagaaaggatggcaaagatccaaatcagttcacaatttcccgccgtggggccaagatttctgaaacgagctctgtggagtccgtgatgggcatcaaaaacttcatgccagctctagaggagaccccatttcattcctgtacagctgggccaaacccaaccctagggaggccactgtctcctaagccgtcatccccgggatcagttttggctcgtccatcagtgatctgccataccactgtgactgcattgaaagatgtccctttctctctctgccagtcggtcggtgtgggacaaaacacagatatacagcagatagcggccaaaaacttcacagacacctctctcatgtacccagaggacacttgtaaatctggaccaagtacgaatacacagagtggtcttttcaacactcctccccctactccaccggacctcaaccaggacttcagtggatttcagcttctagtggatgttgcactcaaacgggctgcagagatggagcttcaggcaaaacttacagcttaacccattttcaagcaaaacagttctcagaaatgtcatgattgccggggtgaaggcaagagatgaattgcattattttatatattttttattaatatttgcacatgggattgctaaaacagcttcctgttactgagatgtcttcaatggaatacagtcattccaagaactataaacttaaagctactgtagaaacaaagggttttcttttttaaatgtttcttggtagattattcataatgtgagatggttcccaatatcatgtgattttttttttcctccccttccctttttttgttattttttcagactgtgcaatacttagagaacctatagcatcttctcattcccatgtggaacaggatgcccacatactgtctaattaataaattttccattttttttcaaacaagtatgaatctagttggttgatgccttttttttcatgacataataaagtattttctttaaaaa

SEQ ID NO: 2376 - DNA, 3030 bp, Homo sapiens
cagcgttggctggggggaggcagtgggggtgcatctacgggagcggttgggctgtaagctttcgctacatcacagaattgtgccagtgtttctctttggagtgcctcgccagctttaacaaccgtttggatatgacttgctcgggcaaaagttgtgcattggcccgatcaagcctgacttctagccaaggtattgttgcagcatctggcagtgagactgaggatgaggacagcatggacattcccttggacctttcttcatccgctggctcaggcaagagaaggagaaggggcaacctacccaaggagtctgtgcagattcttcgggattggctgtatgagcaccgttacaatgcctatccttcagagcaagaaaaagcgttgctgtcccagcaaacacacctgtctacgctacaggtctgtaactggttcatcaacgcccgccgcaggctcctccctgacatgctgagaaaggatggcaaagatccaaatcagttcacaatttcccgccgtggggccaagatttctgaaacgagctctgtggagtccgtgatgggcatcaaaaacttcatgccagctctagaggagaccccatttcattcctgtacagctgggccaaacccaaccctagggaggccactgtctcctaagccgtcatccccgggatcagttttggctcgtccatcagtgatctgccataccactgtgactgcattgaaagatgtccctttctctctctgccagtcggtcggtgtgggacaaaacacagatatacagcagatagcggccaaaaacttcacagacacctctctcatgtacccagaggacacttgtaaatctggaccaagtacgaatacacagagtggtcttttcaacactcctccccctactccaccggacctcaaccaggacttcagtggatttcagcttctagtggatgttgcactcaaacgggctgcagagatggagcttcaggcaaaacttacagcttaacccattttcaagcaaaacagttctcagaaatgtcatgattgccggggtgaaggcaagagatgaattgcattattttatatattttttattaatatttgcacatgggattgctaaaacagcttcctgttactgagatgtcttcaatggaatacagtcattccaagaactataaacttaaagctactgtagaaacaaagggttttcttttttaaatgtttcttggtagattattcataatgtgagatggttcccaatatcatgtgattttttttttcctccccttccctttttttgttattttttcagactgtgcaatacttagagaacctatagcatcttctcattcccatgtggaacaggatgcccacatactgtctaattaataaattttccattttttttcaaacaagtatgaatctagttggttgatgccttttttttcatgacataataaagtattttctttaaaaattgttgtaattcagagtatttctgttgagggaggtgcttcttaaaaataagtaggaatatagcaccccagtgagcaggaagctgggggggtagggtgcagtgttagggggtgtcaccagctctttgaaaacctgtggacaacaagccagtttgcataaacaggatgtgtgatatttactcttgataggaggcatagcaggcccttagagctttacttaaactgcatggcaaattgaaatgaatcattttagtgtttagctagccactaaatcccttgctgatctgtcctgcgtagtttaaaacgtggccatgttataaagaaaagtcttgaagcatccggttattgctgagttttcagaagaaaacaacgcaagcaatctcttgccctttttccacgttaccctttaaaataacctttgttcagtggtacatttagttaaggcatttgtattcaaatgtagcatagtatttgcagagaaattaccttttaaaacatctcaaaagtgttttctaaaatgatgaaataaacggtggggttctgtctatggtgggattgtcagtttattaggtgagtattttccaaggtctcagtttgtgaaaaaatggtgctatgtacaagtggagtttgttgggatagacaatcacttacaaagcccagatggccagaagggaattggtgttgctcctttcacttgtatggttgagcagatttgtcacatgccacaaaaccattctttgtagtcatgcttagtatgagcttgctttgttgttacggtcatgttctttccagccctgccccagctatgaattgtctaagtgtgagggagcatcagagcttcagtattgtttaaagaatgtagaaaaatacaaatttgtctaattttgaaactattttagaaagtccctactgtagaaagagctaaactcaaagactttccttgtaagtgaaagaaaaaaactgctgatgattaccaagaggcgtaagaaaattaggtgagggaatgttgtgctctagcctgtggggtgcagcttcgtagggcacatcagcttagaatggtctggcctcacctcagagagtcacagaaatagacaaaaacccaaaaagtactagtaaagtaaatacaaggaacaaaataaacattaataaaaatgaatgacgcaaaggtgatccagaatcattacttgctccaacagctagatcaaaggctgaacattttgctttagtatagatgagggaaatgagcaagtcctaaaaggtttgccctgttacggtgtttcatcactcatactggaaggagaaggaaaggagccatatgactcatttaaaagaaaaactgtaagtcaccttaaattccctatgttttacttcattttttccctattgaggttgttacaggtcatggttgataatagttggtgttgaatgaatgtaatccattatttaaaaacaggtacatttaagtgaaaagataaatgtaaaaagctgttcatatcaaagccaaatagaaatgatttttatgcttataatttacatggtgcaatatatctttttaatttgtttactttt

SEQ ID NO: 2377 - DNA, 563 bp, Homo sapiens
agcatgtgagcgtgacaagtgtctgtccgcaacgtgtcagatttcgaaactgccttgcaatccagtccggaactcgcagctttagcccgggggaacagacgttcgtttaggctgtgtctcatcattcccccccgccccacccccgccgacctcccactgtcgctgctggaggaagagccccgggaggagaagggtgcgccgcgccgcgcccgcgtgtcaatggcagccgcgcattctggaagaagtattgttgcagcatctggcagtgagactgaggatgaggacagcatggacattcccttggacctttcttcatccgctggctcaggcaagagaaggagaaggggcaacctacccaaggagtctgtgcagattcttcgggattggctgtatgagcaccgttacaatgcctatccttcagagcaagaaaaagcgttgctgtcccagcaaacacacctgtctacgctacaggtctgtaactggttcatcaacgcccgccgcaggctcctccctgacatgctgagaaaggatggcaaagatccaaatcagttcacaatttcccg

SEQ ID NO: 2378 - DNA, 526 bp, Homo sapiens
cacaacatttccttgtatgtggatagcgtgaaagaagcttgtgatcctgcccccaccctccccaccgccacattttttaaagtgtattgttgcagcatctggcagtgagactgaggatgaggacagcatggacattcccttggacctttcttcatccgctggctcaggcaagagaaggagaaggggcaacctacccaaggagtctgtgcagattcttcgggattggctgtatgagcaccgttacaatgcctatccttcagagcaagaaaaagcgttgctgtcccagcaaacacacctgtctacgctacaggtctgtaactggttcatcaacgcccgccgcaggctcctccctgacatgctgagaaaggatggcaaagatccaaatcagttcacaatttcccgccgtggggccaagatttctgaaacgagctctgtggagtccgtgatgggcatcaaaaacttcatgccagctctagaggagaccccatttcattcctgtacagctgggccaaacccaaccctaggg

SEQ ID NO: 2379 - DNA, 820 bp, Homo sapiens
cagcgagagtgaaattaaacttgaaactcggatcaactggtattgttgcagcatctggcagtgagactgaggatgaggacagcatggacattcccttggacctttcttcatccgctggctcaggcaagagaaggagaaggggcaacctacccaaggagtctgtgcagattcttcgggattggctgtatgagcaccgttacaatgcctatccttcagagcaagaaaaagcgttgctgtcccagcaaacacacctgtctacgctacaggtctgtaactggttcatcaacgcccgccgcaggctcctccctgacatgctgagaaaggatggcaaagatccaaatcagttcacaatttcccgccgtggggccaagatttctgaaacgagctctgtggagtccgtgatgggcatcaaaaacttcatgccagctctagaggagaccccatttcattcctgtacagctgggccaaacccaaccctagggaggccactgtctcctaagccgtcatccccgggatcagttttggctcgtccatcagtgatctgccataccactgtgactgcattgaaagatgtccctttctctctctgccagtcggtcggtgtgggacaaaacacagatatacagcagatagcggccaaaaacttcacagacacctctctcatgtacccagaggacacttgtaaatctggaccaagtacgaatacacagagtggtcttttcaacactcctccccctactccaccggacctcaaccaggacttcagtggatttcagcttctagtggatgttgcactcaaacgggctgcagagatggagct

SEQ ID NO: 2380 - DNA, 801 bp, Homo sapiens
tggcttgtccccaggaccgcgctccccccgagccgttttaggtgtgtgttctcttctgtcccgagcagtcagcaaaccacagaagaaaaaaatcgtaaggtattgttgcagcatctggcagtgagactgaggatgaggacagcatggacattcccttggacctttcttcatccgctggctcaggcaagagaaggagaaggggcaacctacccaaggagtctgtgcagattcttcgggattggctgtatgagcaccgttacaatgcctatccttcagagcaagaaaaagcgttgctgtcccagcaaacacacctgtctacgctacaggtctgtaactggttcatcaacgcccgccgcaggctcctccctgacatgctgagaaaggatggcaaagatccaaatcagttcacaatttcccgccgtggggccaagatttctgaaacgagctctgtggagtccgtgatgggcatcaaaaacttcatgccagctctagaggagaccccatttcattcctgtacagctgggccaaacccaaccctagggaggccactgtctcctaagccgtcatccccgggatcagttttggctcgtccatcagtgatctgccataccactgtgactgcattgaaagatgtccctttctctctctgccagtcggtcggtgtgggacaaaacacagatatacagcagatagcggccaaaaacttcacagacacctctctcatgtacccagaggacacttgtaaatctggaccaagtacgaatacacagagtggtcttttcaacactcctccccctactc

SEQ ID NO: 2381 - DNA, 706 bp, Homo sapiens
taagaaaataaaatattagccgagtgtggcgtcacacgcctgtagtcctatctacttgggaggctgagacaggaggatctcttgagctcaggagttcaagactgcagtgagctgtgatggcgtcactgcactccagcctgggcgacaaaacgaggctctgtccccaaacaccaaaaacctcacaaggctcttccaggttggtgtcttttccacgtggtagaagctggctaacctccacttccacattccagcccaagggaaagtccaaggtattgttgcagcatctggcagtgagactgaggatgaggacagcatggacattcccttggacctttcttcatccgctggctcaggcaagagaaggagaaggggcaacctacccaaggagtctgtgcagattcttcgggattggctgtatgagcaccgttacaatgcctatccttcagagcaagaaaaagcgttgctgtcccagcaaacacacctgtctacgctacaggtctgtaactggttcatcaacgcccgccgcaggctcctccctgacatgctgagaaaggatggcaaagatccaaatcagttcacaatttcccgccgtggggccaagatttctgaaacgagctctgtggagtccgtgatgggcatcaaaaacttcatgccagctctagaggagaccccatttcattcctgtacagctgggccaaacccaacc

SEQ ID NO: 2382 - DNA, 564 bp, Homo sapiens
atgccattgtttgtaattcatttctgtttttaagattctagattgtctacaagcaaaagaatgtatttctttagtcattcggagtagcctgctgtagtttttgaaaggtattgttgcagcatctggcagtgagactgaggatgaggacagcatggacattcccttggacctttcttcatccgctggctcaggcaagagaaggagaaggggcaacctacccaaggagtctgtgcagattcttcgggattggctgtatgagcaccgttacaatgcctatccttcagagcaagaaaaagcgttgctgtcccagcaaacacacctgtctacgctacaggtctgtaactggttcatcaacgcccgccgcaggctcctccctgacatgctgagaaaggatggcaaagatccaaatcagttcacaatttcccgccgtggggccaagatttctgaaacgagctctgtggagtccgtgatgggcatcaaaaacttcatgccagctctagaggagaccccatttcattcctgtacagctgggccaaacccaaccctagggaggccactgtctcc

SEQ ID NO: 2383 - DNA, 990 bp, Homo sapiens
acattctttcagacccggcccgctgcggggcgttcctggggggtagcctcaaggccagcggggttccttcggctgcgtttctgtgggaggccctgaaacgcgcggagcttccctctgcctccaggctttcccagcgagagtgaaattaaacttgaaactcggatcaactggcagtcgttgttggtattgttgcagcatctggcagtgagactgaggatgaggacagcatggacattcccttggacctttcttcatccgctggctcaggcaagagaaggagaaggggcaacctacccaaggagtctgtgcagattcttcgggattggctgtatgagcaccgttacaatgcctatccttcagagcaagaaaaagcgttgctgtcccagcaaacacacctgtctacgctacaggtctgtaactggttcatcaacgcccgccgcaggctcctccctgacatgctgagaaaggatggcaaagatccaaatcagttcacaatttcccgccgtggggccaagatttctgaaacgagctctgtggagtccgtgatgggcatcaaaaacttcatgccagctctagaggagaccccatttcattcctgtacagctgggccaaacccaaccctagggaggccactgtctcctaagccgtcatccccgggatcagttttggctcgtccatcagtgatctgccataccactgtgactgcattgaaagatgtccctttctctctctgccagtcggtcggtgtgggacaaaacacagatatacagcagatagcggccaaaaacttcacagacacctctctcatgtacccagaggacacttgtaaatctggaccaagtacgaatacacagagtggtcttttcaacactcctccccctactccaccggacctcaaccaggacttcagtggatttcagcttctagtggatgttgcactcaaacgggctgcagagatggagcttcaggcaaaacttacagcttaaccca

SEQ ID NO: 2384 - DNA, 1267 bp, Homo sapiens
ctctcgctcttgccctctggggacccaaaaggcccctggtcctcaagtcagccacctctgtgtcttcctccatccaaaagacctgcaggagcttctgagcctggtgacacttgctggggaccaagaccatcctactccgccccagccacgctgcatgacctcatctcagcccaaaaacagacattgggaacatctgaccatccatcccgttcccccgctctttttggctacctgcagtgaccccagcagcaggggcgggagttgcctgccctcttccagcctggaagagcatctgtcctacgctcctccttccgggagtgactcccgcccgcatctcggggtgggaagggttcaggaaacacagaccagcttatcttaaggaagcctggtcgggaatctttcaaaaacacatctgttacaagggggaaagacacctccaggacaacagtgatttgcctcagcggggcaaaggccaggcctgacggaagagcccagccttcgccgagggccgcagggagccagagactcgagcctgcggttccagccccgccgcggttccggccccgccgcgatcccgaggcctgcgcatgctcggtgctgcgcggggctccctccttaccgcaggagctcctcatcgagaaacccaggttggtgtcttttccacgtggtagaagctggctaacctccacttccacattccagcccaagggaaagtccaaggtattgttgcagcatctggcagtgagactgaggatgaggacagcatggacattcccttggacctttcttcatccgctggctcaggcaagagaaggagaaggggcaacctacccaaggagtctgtgcagattcttcgggattggctgtatgagcaccgttacaatgcctatccttcagagcaagaaaaagcgttgctgtcccagcaaacacacctgtctacgctacaggtctgtaactggttcatcaacgcccgccgcaggctcctccctgacatgctgagaaaggatggcaaagatccaaatcagttcacaatttcccgccgtggggccaagatttctgaaacgagctctgtggagtccgtgatgggcatcaaaaacttcatgccagctctagaggagaccccatttcattcctgtacagctgggccaaacccaaccctagggaggccactgtctcctaagccgtcatccccgggatcagttttggctcgtccatcagtgatctgccataccactgtgactgcattgaaagatgtccctttctctct

SEQ ID NO: 2385 - DNA, 1213 bp, Homo sapiens
cgtgagtgccgctgacagaagtcaagagaatcggctgggacggggttggggcgacaacgggccgggggggacccgacaggccagagccccttggggaggagcggcggctggaggcgcgaggctcctccggatgcccggagagccgcttgcgacttaactcccgcctctttcccagatgccgcgtcactgctccgccgccggctgctgcacacgggacacgcgcgagacgcgcaaccgcggcatctccttccacagacttcccaagaaggacaacccgaggcgaggcttgtggctggccaactgccagcggctggaccccagcggccagggcctgtgggacccggcatccgagtacatctacttctgctccaaacactttgaggaggactgctttgagctggtgggaatcagtggatatcacaggctaaaggagggggcagtccccaccatatttgagtctttctccaagttgcgccggacaaccaagaccaaaggacacagttacccacctggccccgctgaagtcagccggctcagacgatgcaggaagcgctgctccgagggccgagggcccacaactccattttctccacctccacctgctgatgtcacctgctttcctgtggaagaggcctcagcacctgccactttgccggcctccccagctgggaggctggagcctggccttagcagccccttttcagacctactgggccccttgggtgcccaggcagatgaagcaggctgcagcgcccagccttcaccagagcggcagccctcccctctcgaaccacggccagtctccccctcagcgtatatgctgcgcctgcccccacccgccggagcctacatccagaatgaacacagctaccaggtgggcagcgccttactctggaagcggcgagccgaggcagcccttgatgcccttgacaaggcccagcgccagctgcaggcctgcaagcggcgggagcagcggctgcggttgagactgaccaagctgcagcaggagcgggcacgggagaagcgggcacaggcagatgcccgccagactctgaaggagcatgtgcaggactttgccatgcagctgagcagcagcatggcctgaggggctgctggactgaccgaggggctgcccagcaagactgcagcctcttcctccctcagatcccaccagacccaccaggtgccataataaagcggattctagacggag

SEQ ID NO: 2386 - DNA, 1144 bp, Homo sapiens
cccgccccgccccggtggcgggggcacctccggctctccagtctctatggtaccaacttccggcgcgcgctacccctcgcgagacttcggcggcgcagcaatggccagagcatgccgcgtcactgctccgccgccggctgctgcacacgggacacgcgcgagacgcgcaaccgcggcatctccttccacagacttcccaagaaggacaacccgaggcgaggcttgtggctggccaactgccagcggctggaccccagcggccagggcctgtgggacccggcatccgagtacatctacttctgctccaaacactttgaggaggactgctttgagctggtgggaatcagtggatatcacaggctaaaggagggggcagtccccaccatatttgagtctttctccaagttgcgccggacaaccaagaccaaaggacacagttacccacctggccccgctgaagtcagccggctcagacgatgcaggaagcgctgctccgagggccgagggcccacaactccattttctccacctccacctgctgatgtcacctgctttcctgtggaagaggcctcagcacctgccactttgccggcctccccagctgggaggctggagcctggccttagcagccccttttcagacctactgggccccttgggtgcccaggcagatgaagcaggctgcagcgcccagccttcaccagagcggcagccctcccctctcgaaccacggccagtctccccctcagcgtatatgctgcgcctgcccccacccgccggagcctacatccagaatgaacacagctaccaggtgggcagcgccttactctggaagcggcgagccgaggcagcccttgatgcccttgacaaggcccagcgccagctgcaggcctgcaagcggcgggagcagcggctgcggttgagactgaccaagctgcagcaggagcgggcacgggagaagcgggcacaggcagatgcccgccagactctgaaggagcatgtgcaggactttgccatgcagctgagcagcagcatggcctgaggggctgctggactgaccgaggggctgcccagcaagactgcagcctcttcctccctcagatcccaccagacccaccaggtgccataataaagcggattctaga

SEQ ID NO: 2387 - DNA, 1633 bp, Homo sapiens
tgccgggagagtgaggccgcgggggctgggaagggaccggtgtatgggggacagcaggcgaaggtcactcgggaaccagcccagctctgaggctgcgggcaggtcggaaagggagcaggacggcgacccccgtggcctccagagctctgtgtacgagagccggcgggtcacagaccccgaacgccaggacctggacaatgcagagctgggaccagaagacccagaagaggagcttccccccgaggaggtggccggggaggagttcccggagaccctggatcccaaagaggcactttctgagttggagagagtcctggacaaggacttggaagaggacattcctgaaatcagccggctgtccatcagccagaagctccccagcaccaccatgaccaaagcaaggaagaggaggaggcggaggaggctcatggagctggcagagcccaagataaactggcaagtcctgaaagacaggaagggacgctgtggtaaggggtatgcctggatctccccatgtaagatgagcttgcacttctgtctctgctggccctctgtgtactggaccgagcggttccttgaggacaccaccctcaccatcacagtgcccgcggtgtcccgccgcgtggaggaactgtctcggcccaagagattctacctggaatattacaacaacaacaggacgactcctgtctggcccattcctcggtcctccctggaatacagagcgtcgagtcgcctgaaggaactggccgccccgaagattcgtgataacttctggagcatgcccatgtctgaggtgtcccaggtatccagggcagcccaaatggcagtccccagctcgcggatcctccagttgtcaaagccgaaggccccagccaccctcttggaagagtgggaccccgtgccaaaacccaagccacatgtgtcagaccataaccgcctccttcacttggccaggcccaaagctcagtcggacaagtgcgttcctgaccgagatcctcgctgggaggtgctggatgtcaccaagaaggtggtggccagcccccggatcatctccctggccaagcccaaagtgcgcaagggcctcaacgagggatacgacaggcgtcccctcgcctctatgagcttgccacccccaaaagcatcaccagaaaagtgtgatcaacccaggcctggcctctaagacctccgctcccagtaaacaccctcaggcaccctaaccctgtgtatgtgattattctgagctttttggcctggagaagggagggcgggctagaaggccaaaagaaggatgaggaggacaataatatttatttttgcatccaacctgcgacttgtccagctgtttattttccgagtcactttcattgaccatctcgagcgccttctgaatctcttcagtccagacttattcgtccattcctgagggcccacgggaccgtcggagtcggaacgacagccacagtcaaaccagccgacgctcctgctgaggggccacgggaccgtcggagtcggaacgacagccacagtcaaaccagccgacgctcctgctgaggggccacgggaccgtcggagtcggaacgacagccacagtcaaagcagccgacgctcctgctgagggcccacgggaccg

SEQ ID NO: 2388 - DNA, 1068 bp, Homo sapiens
atgggggacagcaggcgaaggtcactcgggaaccagcccagctctgaggctgcgggcaggtcggaaagggagcaggacggcgacccccgtggcctccagagctctgtgtacgagagccggcgggtcacagaccccgaacgccaggacctggacaatgcagagctgggaccagaagacccagaagaggagcttccccccgaggaggtggccggggaggagttcccggagaccctggatcccaaagaggcactttctgagttggagagagtcctggacaaggacttggaagaggacattcctgaaatcagccggctgtccatcagccagaagctccccagcaccaccatgaccaaagcaaggaagaggaggaggcggaggaggctcatggagctggcagagcccaagataaactggcaagtcctgaaagacaggccctctgtgtactggaccgagcggttccttgaggacaccaccctcaccatcacagtgcccgcggtgtcccgccgcgtggaggaactgtctcggcccaagagattctacctggaatattacaacaacaacaggacgactcctgtctggcccattcctcggtcctccctggaatacagagcgtcgagtcgcctgaaggaactggccgccccgaagattcgtgataacttctggagcatgcccatgtctgaggtgtcccaggtatccagggcagcccaaatggcagtccccagctcgcggatcctccagttgtcaaagccgaaggccccagccaccctcttggaagagtgggaccccgtgccaaaacccaagccacatgtgtcagaccataaccgcctccttcacttggccaggcccaaagctcagtcggacaagtgcgttcctgaccgagatcctcgctgggaggtgctggatgtcaccaagaaggtggtggccagcccccggatcatctccctggccaagcccaaagtgcgcaagggcctcaacgagggatacgacaggcgtcccctcgcctctatgagcttgccacccccaaaagcatcaccagaaaagtgtgatcaacccaggcctggcctctaa

SEQ ID NO: 2389 - DNA, 2556 bp, Homo sapiens
gagcaaggtgggcggtgactagaagctcttccgtttattgggctgttgagcgggggccgaccgacggccaggagtttcttttctgcgcttgtgcgttttctgttcggtttccttcccgctagcggggccacgagggttgctaggcaacagcccctgggtgacttggtcttagggtcctgtccggcttggggctgatgaaaggagctgtccgcgcccgggctcttccgagaagtggttgctgacagccacaaagtgaaagggagtgaggcggcgtggacgagtaaggagtgacagtgaggattcacatttgggttatttcaagatgagcttcctactgcccaagctgactagcaaaaaggaagtagaccaggcgataaaaagtactgctgagaaggtgttggttctcaggtttgggagagatgaagatcctgtctgtctgcagctagatgatattctttctaagacctcttctgacttaagtaaaatggctgctatatacctggtagatgtggaccaaactgcagtttatacacagtattttgacatcagttatattccatctactgtctttttcttcaatgggcagcatatgaaagtggattatggatctccagatcacactaagtttgtgggaagcttcaaaaccaaacaagacttcatagatttgattgaagtaatctatcgaggagcaatgagggggaagcttattgtccaaagtcctattgatcccaagaatattcccaaatatgaccttctctatcaagacatttagtacattaattgctgtcaaagatgaagaagaaggcacatcttgacacagtacctgaatccagctgtgctgtgtttctggagtcctttggaaacatgtgtcccagaggagaagaggtttgacttgcgtgtagaaaacccggcccctgaggaaaagaccccactggttctctgatgacctgggatgcctaactgtctactccctgcaagcctcagagcagccaagtcattggtgttcattttccccacagtgatttttgtaacttctctttctaatgtttttctttatccctttaatacagaaccctcccaaacattggctagtacaacttgatttcatcatgttcatttgatacacaagtgaactggaaagtcacttcccatagaagcaaaagtacttattttctaccctagctgggtgcatgtgtgtgcacacacacacacacacacacccccacacccctttgccggttcctcgactcatacatccctcgtgctttcccatctccagtctgtattactgtaggttctcttcaaataattaattgagcagacaagtttgttttattttggagcctttttggctctggcttttaaacattgtcctggttggctcatttaatttttttttttttttttgagaccgagtcactcttgtcacccaggctggagtgcagtggcgcgatctcggctcactgcaagctccacctcctgggttcatgccattttcctgcttcagcctcctgagtagctgggactacaggcgcccgccaccatgcccagctaattttttgtatttttatagaggcgcagtttcaccgtgttagccaagatggtctcgatctcctgacctcgtgatctgccctcctcagcctcccaggtgctgggattataggcgtgagccaccgcgcgcaccccatttaattattttttatgttataaaatttaatatggaaagtgagaatttgaaccttcaccatccaccactctattcaggtaaaacaatgaatgagccaccttagcaggagcagatttttcccagaagctgctgcctcttcctgaggcagaaaattggattactaaggctcaaaactaaaagagatgtcagcattgttggatagaaatgtcacctatatgggatttgcctgttttaataactttgtaaggaattcttgctcttctaggggtgcctggcgcaaccgtgggcaagttactgctcctctttaaacctcgtggtggttattgaaacagatttattagaaggagagggtaggtgcagagctggagagccatgggtgaggcagcttgtgacctgcctagcagccgctgaccacctctccaacagaagcctagtcctgttcagagcagcactgtcactgcaagtccagccccctttgccaggggctccattccacccctttcctgcagggaggggtgccatgagtcttgcttttggctcatacaggagagagggaaggctgccaggcactgcttgtatccctgctgataagaggagggagtcactccaggaataagacaaaaggagaggaggaggccatcacctctggcctcttccatcgtacacttcctgtctctggtttaatcatgatgcatggagctacaacagccatcttaggtccccgaggtgcccagcatcacgtaaaacatcgatatgctaagaagaacaaaaagagcccaatctctgatgttattgagctcctgcatgaactctggacctgcctgcctcagacttctgtgaaagaataaaatttctttttgcctaagtca

SEQ ID NO: 2390 - DNA, 2490 bp, Homo sapiens
acgcccgattcctggatccaagtgtggaacggtacgccaacaggctctcaaggcctcctctggggctctgatcagacacttccgagtctccttgtgaccaatcactcttagcctaagagactacatcccgcctctagtctgggggcaggaaaaggaggggaaaaaggtcgaccatctttaatacgggcggaggtgacgcctagcttccggtcagagccgagcaaggagtgacagtgaggattcacatttgggttatttcaagatgagcttcctactgcccaagctgactagcaaaaaggaagtagaccaggcgataaaaagtactgctgagaaggtgttggttctcaggtttgggagagatgaagatcctgtctgtctgcagctagatgatattctttctaagacctcttctgacttaagtaaaatggctgctatatacctggtagatgtggaccaaactgcagtttatacacagtattttgacatcagttatattccatctactgtctttttcttcaatgggcagcatatgaaagtggattatggatctccagatcacactaagtttgtgggaagcttcaaaaccaaacaagacttcatagatttgattgaagtaatctatcgaggagcaatgagggggaagcttattgtccaaagtcctattgatcccaagaatattcccaaatatgaccttctctatcaagacatttagtacattaattgctgtcaaagatgaagaagaaggcacatcttgacacagtacctgaatccagctgtgctgtgtttctggagtcctttggaaacatgtgtcccagaggagaagaggtttgacttgcgtgtagaaaacccggcccctgaggaaaagaccccactggttctctgatgacctgggatgcctaactgtctactccctgcaagcctcagagcagccaagtcattggtgttcattttccccacagtgatttttgtaacttctctttctaatgtttttctttatccctttaatacagaaccctcccaaacattggctagtacaacttgatttcatcatgttcatttgatacacaagtgaactggaaagtcacttcccatagaagcaaaagtacttattttctaccctagctgggtgcatgtgtgtgcacacacacacacacacacacccccacacccctttgccggttcctcgactcatacatccctcgtgctttcccatctccagtctgtattactgtaggttctcttcaaataattaattgagcagacaagtttgttttattttggagcctttttggctctggcttttaaacattgtcctggttggctcatttaatttttttttttttttttgagaccgagtcactcttgtcacccaggctggagtgcagtggcgcgatctcggctcactgcaagctccacctcctgggttcatgccattttcctgcttcagcctcctgagtagctgggactacaggcgcccgccaccatgcccagctaattttttgtatttttatagaggcgcagtttcaccgtgttagccaagatggtctcgatctcctgacctcgtgatctgccctcctcagcctcccaggtgctgggattataggcgtgagccaccgcgcgcaccccatttaattattttttatgttataaaatttaatatggaaagtgagaatttgaaccttcaccatccaccactctattcaggtaaaacaatgaatgagccaccttagcaggagcagatttttcccagaagctgctgcctcttcctgaggcagaaaattggattactaaggctcaaaactaaaagagatgtcagcattgttggatagaaatgtcacctatatgggatttgcctgttttaataactttgtaaggaattcttgctcttctaggggtgcctggcgcaaccgtgggcaagttactgctcctctttaaacctcgtggtggttattgaaacagatttattagaaggagagggtaggtgcagagctggagagccatgggtgaggcagcttgtgacctgcctagcagccgctgaccacctctccaacagaagcctagtcctgttcagagcagcactgtcactgcaagtccagccccctttgccaggggctccattccacccctttcctgcagggaggggtgccatgagtcttgcttttggctcatacaggagagagggaaggctgccaggcactgcttgtatccctgctgataagaggagggagtcactccaggaataagacaaaaggagaggaggaggccatcacctctggcctcttccatcgtacacttcctgtctctggtttaatcatgatgcatggagctacaacagccatcttaggtccccgaggtgcccagcatcacgtaaaacatcgatatgctaagaagaacaaaaagagcccaatctctgatgttattgagctcctgcatgaactctggacctgcctgcctcagacttctgtgaaagaataaaatttctttttgcct

SEQ ID NO: 2391 - DNA, 2388 bp, Homo sapiens
gagagggaccaaggccactccaggcagcatccctggatctcagcgaggccgctccaggcagcaggatttgaccagagcaaggaggaaggccaaggcggccaggacggatgcagcatccctgaggagtgacagtgaggattcacatttgggttatttcaagatgagcttcctactgcccaagctgactagcaaaaaggaagtagaccaggcgataaaaagtactgctgagaaggtgttggttctcaggtttgggagagatgaagatcctgtctgtctgcagctagatgatattctttctaagacctcttctgacttaagtaaaatggctgctatatacctggtagatgtggaccaaactgcagtttatacacagtattttgacatcagttatattccatctactgtctttttcttcaatgggcagcatatgaaagtggattatggatctccagatcacactaagtttgtgggaagcttcaaaaccaaacaagacttcatagatttgattgaagtaatctatcgaggagcaatgagggggaagcttattgtccaaagtcctattgatcccaagaatattcccaaatatgaccttctctatcaagacatttagtacattaattgctgtcaaagatgaagaagaaggcacatcttgacacagtacctgaatccagctgtgctgtgtttctggagtcctttggaaacatgtgtcccagaggagaagaggtttgacttgcgtgtagaaaacccggcccctgaggaaaagaccccactggttctctgatgacctgggatgcctaactgtctactccctgcaagcctcagagcagccaagtcattggtgttcattttccccacagtgatttttgtaacttctctttctaatgtttttctttatccctttaatacagaaccctcccaaacattggctagtacaacttgatttcatcatgttcatttgatacacaagtgaactggaaagtcacttcccatagaagcaaaagtacttattttctaccctagctgggtgcatgtgtgtgcacacacacacacacacacacccccacacccctttgccggttcctcgactcatacatccctcgtgctttcccatctccagtctgtattactgtaggttctcttcaaataattaattgagcagacaagtttgttttattttggagcctttttggctctggcttttaaacattgtcctggttggctcatttaatttttttttttttttttgagaccgagtcactcttgtcacccaggctggagtgcagtggcgcgatctcggctcactgcaagctccacctcctgggttcatgccattttcctgcttcagcctcctgagtagctgggactacaggcgcccgccaccatgcccagctaattttttgtatttttatagaggcgcagtttcaccgtgttagccaagatggtctcgatctcctgacctcgtgatctgccctcctcagcctcccaggtgctgggattataggcgtgagccaccgcgcgcaccccatttaattattttttatgttataaaatttaatatggaaagtgagaatttgaaccttcaccatccaccactctattcaggtaaaacaatgaatgagccaccttagcaggagcagatttttcccagaagctgctgcctcttcctgaggcagaaaattggattactaaggctcaaaactaaaagagatgtcagcattgttggatagaaatgtcacctatatgggatttgcctgttttaataactttgtaaggaattcttgctcttctaggggtgcctggcgcaaccgtgggcaagttactgctcctctttaaacctcgtggtggttattgaaacagatttattagaaggagagggtaggtgcagagctggagagccatgggtgaggcagcttgtgacctgcctagcagccgctgaccacctctccaacagaagcctagtcctgttcagagcagcactgtcactgcaagtccagccccctttgccaggggctccattccacccctttcctgcagggaggggtgccatgagtcttgcttttggctcatacaggagagagggaaggctgccaggcactgcttgtatccctgctgataagaggagggagtcactccaggaataagacaaaaggagaggaggaggccatcacctctggcctcttccatcgtacacttcctgtctctggtttaatcatgatgcatggagctacaacagccatcttaggtccccgaggtgcccagcatcacgtaaaacatcgatatgctaagaagaacaaaaagagcccaatctctgatgttattgagctcctgcatgaactctggacctgcctgcctcagacttctgtgaaagaataaaatttctttttgcct

SEQ ID NO: 2392 - DNA, 1285 bp, Homo sapiens
gggcacagccgcgaggttctgcgcgggcgcggaagacgggcggcgcgtggcggaaggcaggcttgctcctcggggtgggggagggtatccggcttaagggggctgcggtggacaccacttcttaatgtcgggggtcttcgcggcgctcacctcggctcctagggttcgggacggtacgcaccagccaccttcgcgccgaaggcggtagggcgccacggagaggaaccgctctaggcacgtaaggcctcgtgaggttgcgtcgcgcgcggagcactctgggacttgtagttctggagatggagcgagctgtgccgctcgcggtgcctctgggtcagacagaggtgttccaggccttgcagcggctccatatgaccatcttctcccagagcgtctcaccatgtgggaagtttctggcggctggcaacaattacgggcagattgccatcttcagcttgtcctctgctttgagctcagaagccaaagaggaaagtaagaagccggtggtgactttccaagcccatgatgggcccgtctatagcatggtttccaccgatcgacatctgcttagtgctggggatggggaggtgaaggcctggctttgggcggagatgctcaagaagggctgtaaggagctgtggcgtcgtcagcctccatacaggaccagcctggaagtgcctgagatcaacgctttgctgctggtccccaaggagaattccctcatcctggctgggggagactgtcagttgcacactatggaccttgaaactgggactttcacgagggtcctccggggccacacagactacatccactgcctggcactgcgggaaaggagcccagaggtgctgtcaggtggcgaggatggagctgttcgactttgggacctgcgcacagccaaggaggtccagacgatcgaggtctataagcacgaggagtgctcgaggccccacaatgggcgctggattggatgtttggcaactgattccgactggatggtctgtggagggggcccagccctcaccctctggcacctccgatcctccacacccaccaccatcttccccatccgggcgccacagaagcacgtcaccttctaccaggacctggtcctgacagctgcaggcaacagctgccgggtggatgtcttcaccaacctgggttaccgagccttctccctgtccttctgatctctgacgacacccccagccagctcagggttttagagtgtttttcattttctttttttttttttttttacaataaagtttcaggcttttttaccatg

SEQ ID NO: 2393 - DNA, 1420 bp, Homo sapiens
gggcacagccgcgaggttctgcgcgggcgcggaagacgggcggcgcgtggcggaaggcaggcttgctcctcggggtgggggagggtatccggcttaagggggctgcggtggacaccacttcttaatgtcgggggtcttcgcggcgctcacctcggctcctagggttcgggacggtacgcaccagccaccttcgcgccgaaggcggtagggcgccacggagaggaaccgctctaggcacgtaaggcctcgtgaggttgcgtcgcgcgcggagcactctgggacttgtagttctggagatggagcgagctgtgccgctcgcggtgcctctgggtcagacagaggtgttccaggccttgcagcggctccatatgaccatcttctcccagagcgtctcaccatgtgggaagtttctggcggctggcaacaattacgggcagattgccatcttcagcttgtcctctgctttgagctcagaagccaaagaggaaagtaagaagccggtggtgactttccaagcccatgatgggcccgtctatagcatggtttccaccgatcgacatctgcttagtgctggggatggggaggtgaaggcctggctttgggcggagatgctcaagaagggctgtaaggagctgtggcgtcgtcagcctccatacaggaccagcctggaagtgcctgagatcaacgctttgctgctggtccccaaggagaattccctcatcctggctgggggagactgtcagttgcacactatggaccttgaaactgggactttcacgagggtcctccggggccacacagactacatccactgcctggcactgcgggaaaggagcccagaggtgctgtcaggtggcgaggatggagctgttcgactttgggacctgcgcacagccaaggaggtccagacgatcgaggtctataagcacgaggagtgctcgaggccccacaatgggcgctggattggatgtttggcaactgattccgactggatggtctgtggagggggcccagccctcaccctctggcacctccgatcctccacacccaccaccatcttccccatccgggcgccacagaagcacgtcaccttctaccaggacctgattctgtcagctggccagggccgctgcgtcaaccagtggcagctgagcggggagctgaaggcccaggtgcctggctcctccccagggctgctcagcctcagcctcaaccagcagcctgccgcgcctgagtgcaaggtcctgacagctgcaggcaacagctgccgggtggatgtcttcaccaacctgggttaccgagccttctccctgtccttctgatctctgacgacacccccagccagctcagggttttagagtgtttttcattttctttttttttttttttttacaataaagtttcaggcttttttaccatg

SEQ ID NO: 2394 - DNA, 4432 bp, Homo sapiens
ggagacgctgggcgcgctgtggggcgggggcgaggttcgggctggttgttccgttgcgagctgcagctgcgatctctgtggtaggcccagaagtgtatgctgacttgtaaagtgaagaagccagtggtgctgcgggtgttcttttggggtagtgtctgggatccagtacgagttgaatcattgttcaaataaggtgtaattgaaaagtgatcctctcttcagagatgtcaaaaacaaacaaatccaagtctggatctcgctcttctcgctcaagatctgcatcaagatctcgttctcgttcattttcgaagtctcggtcccgaagccgatctctctctcgttcaaggaagcgcaggctgagttctaggtctcgttccagatcatattctccagctcataacagagaaagaaaccacccaagagtatatcagaatcgggatttccgaggtcacaacagaggctatagaaggccctattatttccgtgggcgtaacagaggcttttatccatggggccaatataaccgaggaggctatggaaactaccgctcaaattggcagaattaccggcaagcatacagtcctcgtcgaggccgttcaagatcccggtccccaaagagaaggtccccttcaccaaggtccaggagccattctagaaactctgataagtcgtcttctgaccggtcaaggcgctcctcatcctcccgttcttcctccaaccatagccgagttgaatcttctaagcgcaagtctgcaaaggagaaaaagtcctcttctaaggatagccggccatctcaggctgccggggataaccagggagatgaggccaaggagcagacattctctggaggcacctctcaagatacaaaagcatctgagagctcgaagccatggccagatgccacctacggcactggttctgcatcacgggcctcagcagtttctgagctgagtcctcgggagcgaagcccagctctcaaaagccccctccagtctgtggtggtgaggcggcggtcaccccgtcctagccccgtgccaaaacctagtcctccactttccagcacatcccagatgggctcaactctgccgagtggtgccgggtatcagtctgggacacaccaaggtcagttcgaccatggttctgggtccctgagtccatccaaaaagagccctgtgggtaagagtccaccatccactggctccacatatggctcatctcagaaggaggagagtgctgcttcaggaggagcagcctatacaaagaggtatctagaagagcagaagacagagaatggaaaagataaggaacagaaacaaacaaataccgataaagaaaaaataaaagagaaagggagcttctctgacacaggcttgggtgatggaaaaatgaaatctgattcttttgctcccaaaactgattctgagaagccttttcggggcagtcagtctcccaaaaggtataagctccgagatgactttgagaagaagatggctgacttccacaaggaggagatggatgatcaagataaggacaaagctaagggaagaaaggaatctgagtttgatgatgaacccaaatttatgtctaaagtcataggtgcaaacaaaaaccaggaggaggagaagtcaggcaaatgggagggcctggtatatgcacctccagggaaggaaaagcagagaaaaacagaggagctggaggaggagtctttcccagagagatccaaaaaggaagatcggggcaagagaagcgaaggtgggcacaggggctttgtgcctgagaagaatttccgagtgactgcttataaagcagtccaggagaaaagctcatcacctcccccaagaaagacctctgagagccgagacaagctgggagcgaaaggagattttcccacaggaaagtcttccttttccattactcgagaggcacaggtcaatgtccggatggactcttttgatgaggacctcgcacgacccagtggcttattggctcaggaacgcaagctttgccgagatctagtccatagcaacaaaaaggaacaggagtttcgttccattttccagcacatacaatcagctcagtctcagcgtagcccctcagaactgtttgcccaacatatagtgaccattgttcaccatgttaaagagcatcactttgggtcctcaggaatgacattacatgaacgctttactaaatacctaaagagaggaactgagcaggaggcagccaaaaacaagaaaagcccagagatacacaggagaatagacatttcccccagtacattcagaaaacatggtttggctcatgatgaaatgaaaagtccccgggaacctggctacaaggctgagggaaaatacaaagatgatcctgttgatctccgccttgatattgaacgtcgtaaaaaacataaggagagagatcttaaacgaggtaaatcgagagaatcagtggattcccgagactccagtcactcaagggaaaggtcagctgaaaaaacagagaaaactcataaaggatcaaagaaacagaagaagcatcggagagcaagagacaggtccagatcctcctcctcttcctcccagtcatctcactcctacaaagcagaagagtacactgaagagacagaggaaagagaggagagcaccacgggctttgacaaatcaagactggggaccaaagactttgtgggtccaagtgaaagaggaggtggcagagctcgaggaacctttcagtttcgagccagaggaagaggctggggcagaggcaactactctgggaacaataacaacaacagcaacaacgattttcaaaaaagaaaccgggaagaggagtgggacccagagtacacacccaaaagcaagaagtattacttgcatgatgaccgtgaaggcgaaggcagtgacaagtgggtgagccggggccggggccgaggagcctttcctcggggtcggggccggttcatgttccggaaatcaagtaccagccccaagtgggcccatgacaagttcagtggggaggaaggggagattgaagacgacgagagtgggacagagaaccgagaagagaaggacaatatacagcccacaaccgagtaggggccacccttgacgggattcctgcccaggggagagaggcgctgggaagatggctggtgaggagcttaacagaggaacctcaagaagattctgaaaatcctacccccaccccccaccagccgcacagattgtactaccgcgagaggcatccctggcgctgtctcccactggacagaggaggctggccatggggcccaggggtcaggcccagcttttgagcagaatacaacgcattgggctttagctgtttttctcatttgttggtgtgtggggtgggggcaggggtagggcgggagagcgatgcttggatttttgtttcctattagaaaccaacagttttgttctaatttcatttcatttggagctaagatgactaatttgatgattttcgatctcttttcccctgtcctgattttaaaagccccctcctttttttttttttttttctttttttaggcatatgtagtaatattagaaacatttaatttgggaaactttgattcttgaaagagaaaacaaaagcatgtgaataaactttgaagtgttcacctcagtttgggaccaaactgcttggatctttgtaaaaaccggttttgtatgtcaaggaggagtttaaggcctttccgaccaccttgtgttccccttttctgcgcagccatgtatcacgtggagttgctccttaccacacctcacgtgcccctgagccctatttcctgatttcttctgggctggacttccccgttctccaccagcagctccagtatcccaaactttctagtcctgctgatcctcccagcaacggggtggaaactggagggcagtgtctggtctgttttctaagaaacttatgaattctattatctttacaaatatgagaaaattttttcaatattttttattaatctttttataaaatgaaaagaaactcctatgatcgattaaggaaggtggttatggctgggtggttcaggggtttttttgggtttctttttttttttctttgtctttttaaccttaagctgtttaagttgaagcattctcagatgtttggggggaaacatcctcttaaaatgggtccttgtgcttgccttctggggaggcggtcctgagcaggtgaatcataaggcatttatgcatatgttatatgcggactgcacccacctctcccccccagcctttgcctcttgcgttgttgtgctgctttccccttactttgctacatttctatagttaagttggttttacttgaatgattcatgtttagggggaaaatgaaaatctcccttaaaatttgtttcaactcctcctgcaaataaaataaatgaagtggcagatgtaaa

SEQ ID NO: 2395 - DNA, 3339 bp, Homo sapiens
ctgtggggcgggggcgaggttcgggctggttgttccgttgcgagctgcagctgcgatctctgtggtaggcccagcctggtggccaaaaacgggatagtccaaatttgtctcctacgggaatattagagttctcacttttttcttgggctggagctgaggccggcttgcattccagtggcaatcggcgtgagttctgcttatatgagaagtgtatgctgacttgtaaagtgaagaagccagtggtgctgcgggtgttcttttggggtagtgtctgggatccagtacgagttgaatcattgttcaaataaggtgtaattgaaaagtgatcctctcttcagagatgtcaaaaacaaacaaatccaagtctggatctcgctcttctcgctcaagatctgcatcaagatctcgttctcgttcattttcgaagtctcggtcccgaagccgatctctctctcgttcaaggaagcgcaggctgagttctaggtctcgttccagatcatattctccagctcataacagagaaagaaaccacccaagagtatatcagaatcgggatttccgaggtcacaacagaggctatagaaggccctattatttccgtgggcgtaacagaggcttttatccatggggccaatataaccgaggaggctatggaaactaccgctcaaattggcagaattaccggcaagcatacagtcctcgtcgaggccgttcaagatcccggtccccaaagagaaggtccccttcaccaaggtccaggagccattctagaaactctgataagtcgtcttctgaccggtcaaggcgctcctcatcctcccgttcttcctccaaccatagccgagttgaatcttctaagcgcaagtctgcaaaggagaaaaagtcctcttctaaggatagccggccatctcaggctgccggggataaccagggagatgaggccaaggagcagacattctctggaggcacctctcaagatacaaaagcatctgagagctcgaagccatggccagatgccacctacggcactggttctgcatcacgggcctcagcagtttctgagctgagtcctcgggagcgaagcccagctctcaaaagccccctccagtctgtggtggtgaggcggcggtcaccccgtcctagccccgtgccaaaacctagtcctccactttccagcacatcccagatgggctcaactctgccgagtggtgccgggtatcagtctgggacacaccaaggtcagttcgaccatggttctgggtccctgagtccatccaaaaagagccctgtgggtaagagtccaccatccactggctccacatatggctcatctcagaaggaggagagtgctgcttcaggaggagcagcctatacaaagaggtatctagaagagcagaagacagagaatggaaaagataaggaacagaaacaaacaaataccgataaagaaaaaataaaagagaaagggagcttctctgacacaggcttgggtgatggaaaaatgaaatctgattcttttgctcccaaaactgattctgagaagccttttcggggcagtcagtctcccaaaaggtataagctccgagatgactttgagaagaagatggctgacttccacaaggaggagatggatgatcaagataaggacaaagctaagggaagaaaggaatctgagtttgatgatgaacccaaatttatgtctaaagtcataggtgcaaacaaaaaccaggaggaggagaagtcaggcaaatgggagggcctggtatatgcacctccagggaaggaaaagcagagaaaaacagaggagctggaggaggagtctttcccagagagatccaaaaaggaagatcggggcaagagaagcgaaggtgggcacaggggctttgtgcctgagaagaatttccgagtgactgcttataaagcagtccaggagaaaagctcatcacctcccccaagaaagacctctgagagccgagacaagctgggagcgaaaggagattttcccacaggaaagtcttccttttccattactcgagaggcacaggtcaatgtccggatggactcttttgatgaggacctcgcacgacccagtggcttattggctcaggaacgcaagctttgccgagatctagtccatagcaacaaaaaggaacaggagtttcgttccattttccagcacatacaatcagctcagtctcagcgtagcccctcagaactgtttgcccaacatatagtgaccattgttcaccatgttaaagagcatcactttgggtcctcaggaatgacattacatgaacgctttactaaatacctaaagagaggaactgagcaggaggcagccaaaaacaagaaaagcccagagatacacaggagaatagacatttcccccagtacattcagaaaacatggtttggctcatgatgaaatgaaaagtccccgggaacctggctacaaggctgagggaaaatacaaagatgatcctgttgatctccgccttgatattgaacgtcgtaaaaaacataaggagagagatcttaaacgaggtaaatcgagagaatcagtggattcccgagactccagtcactcaagggaaaggtcagctgaaaaaacagagaaaactcataaaggatcaaagaaacagaagaagcatcggagagcaagagacaggtccagatcctcctcctcttcctcccagtcatctcactcctacaaagcagaagagtacactgaagagacagaggaaagagaggagagcaccacgggctttgacaaatcaagactggggaccaaagactttgtgggtccaagtgaaagaggaggtggcagagctcgaggaacctttcagtttcgagccagaggaagaggctggggcagaggcaactactctgggaacaataacaacaacagcaacaacgattttcaaaaaagaaaccgggaagaggagtgggacccagagtacacacccaaaagcaagaagtattacttgcatgatgaccgtgaaggcgaaggcagtgacaagtgggtgagccggggccggggccgaggagcctttcctcggggtcggggccggttcatgttccggaaatcaagtaccagccccaagtgggcccatgacaagttcagtggggaggaaggggagattgaagacgacgagagtgggacagagaaccgagaagagaaggacaatatacagcccacaaccgagtaggggccacccttgacgggattcctgcccaggggagagaggcgctgggaagatggctggtgaggagcttaacagaggaacctcaagaagattctgaaaatcctacccccaccccccaccagccgcacagattg

SEQ ID NO: 2396 - DNA, 380 bp, Homo sapiens
tgtggggcgggggcgaggttcgggctggttgttccgttgcgagctgcagctgcgatctctgtggtaggcccaggtcaagagtcttcatctccagctgcctcagttttcttatcactaaaacagcaaagtgtatgctgacttgtaaagtgaagaagccagtggtgctgcgggtgttcttttggggtagtgtctgggatccagtacgagttgaatcattgttcaaataaggtgtaattgaaaagtgatcctctcttcagagatgtcaaaaacaaacaaatccaagtctggatctcgctcttctcgctcaagatctgcatcaagatctcgttctcgttcattttcgaagtctcggtcccgaagccgatctctctctcgttcaa

SEQ ID NO: 2397 - DNA, 2012 bp, Homo sapiens
ccggcgcgggcggcgcgcacgggactctgctgtgcgcgcgcccgcccgcccgccgtccgcgcaggccctcggtccgctctgccctcggggtcgtggcgcccatccctcccctgttctgctgtcgccgcccggacaggggctcgggagccgggctgggggcaggggctggagccgcgggaccagcgcctgaggtgccccggagaggccatggagctgagcagcaagaagaagcttcacgccctgtccctggccgagaagatccaggtgctggaactcctggatgagtccaagatgtcccagtcggaggtggcccggcgcttccaggtttcccagccccagatctcgcgcatctgcaagaataaggagaagctgctggcggactggtgcagcggcacagccaaccgagagcgcaagcgcaagcgggagtccaagtacagcgggatcgacgaggctctgctctgctggtaccacattgcccgggccaaggcctgggacgtgacggggcccatgctgctccacaaagccaaggagctggccgatatcatgggccaggacttcgtgcccagcatcggctggctggtccgctggaaacgccgaaacaacgtcggctttggggcccgccatgttcttgcgccttcattcccccctgagccacctcccccggggctcacatcccaggctcagctgcctctttccctaaaagacttctctccagaggacgtgtttggctgtgctgaattgcccttgctgtatcgggcagtgcccggcagctttggtgcatgtgatcaagtacaggtgctgctgtgtgccaacagcaggggcaccgagaagcggcgggtactgctgggtgggctccaggctgccccgagatgcttctttgggatccgcagtgaggctctgcctgcctcctaccacccggacctgggcatcccctggttagagtggttggcacagtttgaccgggacatgggacagcagggccgacaggtggctttgctgctggctgcccgagtggtggaggagctggcaggcctgcctgggctctaccacgtgaagctcttgcctctggccgcctctagcaccacgcctcccctgcccagctcagtggtccgggcctttaaggcccattaccgacaccggctgttgggcaaactggctgccatccaaagcgagagggatggcacctcgctggccgaggccggggcaggcatcaccgtgctggacgccctgcacgtggcgtctgccgcctgggccaaggtgcctcctcagctcattttcagcagcttcattcaagaagggctggctcccggcaaaacgcccccgtcctcgcacaaaacctctgagatgccaccagtccccggcgggctgagcctggaggagttttcccgctttgtggacctggagggtgaggagccaaggtctggagtatgtaaggaggagataggcactgaagacgagaagggggacagagagggtgcctttgagcccctgcccaccaaagctgatgccctccgggccctgggcaccttgaggaggtggtttgaatgcaacagcacttctcctgagctattcgaaaaattctacgactgtgaggaggaggtggagcggctttgctgcctatgaaggcgccttcactgcttgccagagccccttcctctcttgtttcccatggaaacggcctcttcagaaggcagatcgggctgtctctttcctgtggaaatagaactgtcgtaaaggtgtagaagggagagaagttgggacaccaagtctgagcttggagtggcagtcgtccaaaccccaggaagagagctctaaagatggggcttcgggggtaggaatccaggatgcttagtttctagaccctgcttgaaagttctagagcctttgaaagggagttagtctagaggcagccacttagaaaggtggaatttgggctttttggacagactgcttccttgaactttgtgttaaaaacagttctgcttctgaaaataaagtttttaatcagaaaa

SEQ ID NO: 2398 - DNA, 2472 bp, Homo sapiens
gggtaattttctggcagcgacctaatgcgcgcggggccagaggcaccggctagagctgggagcttgcggaagggcgcccctgcctggtcttgagaggtcgaaggtctccaggaggcctccgcctccctctttttcattcacacaccctagcctcacacgttaggaggacccccccaacagaccgtgagctggtgccgggagggtggaggtagatgtacctcacctccacgctaccacagaagagcgaaagctgctttctcagccaccggagagcacgaagaagaagaagatatactggcaagttctagaaggattctaccattttcttctttaccatgaacaaacttgaaaattaatgggtaatagttgcatgaaaacttttgaacgttttttcttatctctgaggccttctatggagaattaataggaggttgaatgtgtgcatggataaaatggatcatcttaaaggattgaagttccaaaaatacatcagcaggactggacaggttttatataatgagatttctattttagcttgacttctacaactctgaataagctataaactgagctatacaaggtactaggaaggaagtttctcttctaaaatattctagttgcatataatatttttcttcagatctttgaaaaagcatattttgtcatcaagttcctacaaaataagactattagacaccaacttttagtgtataaagtaggatagaaagcagcaatctatattatactggaaaacaaatttaattaaagaaacagtcaccaggaagttaagaagagtaatctctacataagcactggctgagatggcagaagcttctgtggatgcctcaactctgcctgtaacagtgaagaaaaagaaaagcctatccattgaggaaaagatcgacatcataaatgcagtggaaagtggcaagaaaaaagcagagattgctgctgaatatggaataaagaaaaattcattgtcttctattatgaagaataaagacaaagttctagaagcctttgaatctctaagatttgatccaaagagaaaaagactgagaactgctttttacacagatctggaagaggcattaatgagatggtatcgaattgctcagtgtctaaatgtaccagttaatggtccgatgttacgtctaaaagctaatgattttgcccagaaactgggccataatgattttaagtgcagtaatggttggctggatcgttttaaatccaggtatggtttagtattcagagctcaacctgtagaagctacaggtgtaccagtagacccttcgactgtctggtaccaaaatgtacttccttattatttaaatgattatcatcctaaaaatgtttttaatataaaagagactgggctgctttatcgaatgttacctaccaatacatttgcatttaaaggcgaaacatgttcagttggaaagttatgcaaagacagaataactctggtggttggcacaaacatggatggctcagagaaacttcctttgcttgtcattggaaaaaagagaactccacattgtttcaaaggtttaaaatcattgcctgtgtgttatgaagctaacagaatggcatggatgacctccgatgtatttgaacaatggatgcgaaagcttgatgaggaatttcaagcccagcaacgaagagtggtgatttttgttgagtcttttccagcacatccagaggtaaagaacctaaaatccattgagttagcattctttccatcatgtttatcttccaaatgtatagctatgaaacaaggtgttattaaaagccttaaaatcaaatatcgacactgtcttatcaagaaatttttaagctctgttgaaggtagcaaagaatttacattttcactactagatgcagttgatacattgcatctttgctggagggctgtaaccccagagactattgttaaaagctatgaagaggcaggattcaaatctcaaaagggagaaagtgacataacaaatgcagagaaggatactggtctggatttggttgctgatgctctgggggcaggagtagaatttcctgaaggtttatctatagaagaatatgctgccctggatgatgatttggagacatgtgaagcagcaccaaatggtgattccatatgcaccaaagaaagtaaatcggatgaaactggattttacacttctgatgaagaggatgatgatggatctccaggaactgaactccctttaccatcaaaatctgaggcaataactgctttagatactctgaaaaaatttctcagaagtcaagatatgaatgacggacttcaaaattctttagcagaccttgaaaattttattaactctttatcacctaagtaactatgtattgtacatctaaagagtaatagcttttcctgatacattttattatataaggtatgtaaaggagttgtaccacaccacttaaacataaaaaatggaaaactgctaa

SEQ ID NO: 2399 - DNA, 2412 bp, Homo sapiens
atgtaccccgcgggccccccggccggcccggtaccgcgccgcggccgccgtcccctgcccgggccccccgcgcccgccccagcccccgtccccgctgcacggccgccgccccccgcgcccgggccgcggccccgcgtggccgtgaagatggccttccgcaaggcctactccatcaaggacaagctgcaggccatcgagcgcgtcaagggcggcgagcggcaggccagtgtgtgccgcgacttcggcgtgccgggcgggacgctgcgcggctggctcaaggacgagcccaagctgcgctggttcctggagcagctgggcggtgaggtgggcactcagcgcaagaagatgcggctggccaacgaggaggagatcgaccgcgccgtgtacgcctggttcctggcgctgcgccagcacggggtgccgctgtctggcccgctcatccaggcgcaggccgaggccttcgcgcgccagatctacgggcccgagtgcaccttcaaggccagccacggctggttctggcgctggcagaagcgccacggcatctccagccagcgcttctacggcgaggccgggcccccagccccgagccccgcgcccggcccgcccgtcaaggaggagcccgcgctgccctccggcgccggccccctgcccgaccgcgccccggccccgccgcccccggccgagggcggctacggggacgagcagatttacagcgccagcgtcaccggcctctactggaagctgcttccggagcaggctgcgcccccgggcgcaggggaccccggggcggggggctgtggccggcgctggcggggcgaccgcgtaacggtgctgctggccgcaaacctgaccggcagccacaagctgaagccgctggtcatcgggcggctgccggacccgcccagcctgcgccaccacaaccaggacaagttcccggcctcctaccgctacagccccgacgcctggctcagccgcccgctgctgcggggctggttctttgaggaatttgtcccaggcgtcaaacgctacctgcgccgaagctgcctgcagcagaaggccgtgctgctggtggcccacccgccctgcccaagcccagctgccagtatgcccgccctggacagcgaggatgcccccgtgcggtgcaggccggagcccctcggtcccccggaggagctgcagacaccggatggcgctgtgcgggtgctgttcctgtccaaaggcagcagccgggcacatatccccgcaccgctggagcagggcgtggtggccgccttcaaacagctgtacaagcgcgagctgctgcgactggctgtgtcctgcgccagcggctccccgctggacttcatgcgcagcttcatgctcaaggacatgctctacctggctggcctctcctgggacctggtgcaggcgggcagcattgagcgctgctggctgctgggcctgcgggctgccttcgagccccggcccggcgaggacagtgctgggcagccggcccaggccgaggaagccgccgagcacagcagggtgctcagcgacctcacccacctggcggctctggcctacaagtgcctggctccggaggaggttgcggagtggctgcacctggacgatgatgggggtccgcccgagggctgcagggaggaggtgggcccagccctgccccctgcagcgcctccggccccagccagtctgccctctgccatggggggcggagaggacgaggaggaggccaccgactatggagggacctcagtgccgactgccggggaggccgtgcgggggctagaaacagctctgcggtggctggagaaccaggaccccagagaggtggggccactgaggctggtgcagttgcgctcactcatcagcatggcccggaggctggggggcatcgggcataccccagcaggcccctatgacggtgtgtgaccaggccagcccagtgacctttctcctgctgcacttggagggaggggacatacacacagtctcccatctctcctcccctccccctggggtggcccaccgcatgggtacagggggttccaggaatccaaatccagcatggcttggaggagctctgttggtgagaggtcgccctgcctcactggcaccctgggggcacagctggaagagaggcctggcccatgctcctctcagggcaggcacatgtacggggcatacaaggcacagcgcctgttggaacaggtggctgtgttcctgctctggcccccgtggggctgggcctccgcccctgcaccagtcacatgcactggacgagggccgaaactcctgtctgctatcgagccctggtgctatgtggccccggagccacagcacaatcatctcagtggcgaagcacaccacttgattctatttttttttaacacattaaatctgtttttaaagata

SEQ ID NO: 2400 - DNA, 2412 bp, Homo sapiens; identical to SEQ ID NO: 2399

SEQ ID NO: 2401 - DNA, 4006 bp, Homo sapiens
gcaagctgcgccgctcacattcccggaggcgcttggcccggcggctggacgagggggatggctggcgcactcgcgctccccgctgtcggcgagaggcggctccagtcgtgacagcagcaacaaggaagtggaggcgagggctcgcgcgcgcatcccgggggctgaaggagccccggccccgcggccccgcccggcgacacacggcgcggagtcgcgacagcccctctcgcttcccctcctcggagtcgcgatatggggtcctgaagggcaagaataggagcacaggttcgctccgcaggctcctcaccgatgcctgccgagggccccgggggtcaagccccggggagctcgaggaagacggcagggacacggtcgtcaccgaggcaccggtttggcggctgcaccggcagtagcggcacaccacggatcgccagggagacccgtcccggcggccctcgcggcgcaccggaagcggtcggcagcgcgtgactgcatgcgacccctggcgcaagcgcaacagcccagccctagcttgggagcggacccacacgaactgctcaaaggcttggagcgggtctagtaaggcgaacggactgcttccggccagaggtcccgggcggaggaggaagctgtggctgccggcggtgggacgccccggccgctcagcccccgggcactgctgtggggcgttcagctttccacacttggggcaaagcaagccgcgaggaggaaccagacagtcctgttagttgtggccagccctcattccctggaaatggcaaacaaggggaacaagaagcgtcggcagttctctctggaggagaaaatgaaagttgtgggagctgtagactcaggcaagaggaaaggtgatgtggcaaaagaatttggtatcactccctctactttatctacattcttaaaggatcgcaccaaatttgaagaaaaggtgcgggaggcatccgtgggaccccagcggaaaaggatgaggagcgctctttatgatgacattgataaggctgtttttgcttggtttcaagaaatccatgccaaaaacattcttgtgactggttctgtcattcggaaaaaagcactaaacttggccaacatgcttggctatgacaattttcaagcaagtgtgggctggctgaacagatttagagatcgccacggaattgctttgaaagcagtctgtagagaagatagtgacaggttaatgaatggtctaggaatagataagattaatgagtggcatgcaggggaaattataaaactgattgctgactacagcccagatgatatctttaatgctgatgagacaggagtgtttttccagttgcttccccagcacacacttgctgctaaaggagaccactgtagagggggcaagaaagcaaagcagcggttgacagcactcttttgttgcaatgcctcggggactgaaaaaatgagaccattgattgttggtaggtcagccagcccacactgcctcaagaacattcattccctcccttgtgattaccgagccaaccagtgggcttggatgacaagggatctgtttaatgagtggctgatgcaagtggatgccaggatgaagagggcggaacgccggatcctcttgctcatagacaactgctctgctcataacatgcttccacacttggaaaggattcaggttgggtatctgccctccaactgtactgctgtcctgcagccactgaatcttggcataattcacaccatgaaagtactgtaccagagccaccttctaaaacagatcctcctcaagctcaacagcagtgaggatcaagaagaggtggacatcaagcaggccatcgacatgattgctgcagcgtggtggtcagtcaagccatccacagtggtgaaatgttggcagaaggcaggcatcgtccctatggaatttgcagaatgtgacacagaatcagcagccagtgaaccagacattgccattgaaaagttgtggcacacagtggctattgccacctgtgtcccaaatgaagtaaatttccaggactttgttactgcagatgatgatctcattatctctcaggacacagacatcatccaggacatggtggctggcgaaaataccagtgaagcaggaagtgaagatgaaggggaggtatctttaccagagcaaccaaaagtcaccatcacagaagccatatcaagtgtacagaaacttagacagttcctttccacttgtgtagacattcctgatgccatttttggacaattaaatggcatagatgaatatttaatgaaaagagtgacacaaacccttattgattccaaaattacagatttcctccaaacaaaataatgcaggaatttatttcagaaaatgtagtttacaagaataaagatttctttagataggttgttgagccaatttaagtaaagcaatgttattgtgacaacattccagtactctgaaatagccaggaaacttctttgaatggaatttgactaatatgtgtgttttcttttcttttgtttttggctgtctctggtccttgattcaagatgtattttgattcatccaagggtttccaaacttgtctgcaaattaggatcacttgagaatcctttaaaaattccaaagctcaggccatatcccaggcctattaaatcacaatctttggtgacgggtcacaggcattggtagttttgaagctctccaggtgattccaatgtgcagacaaatttgaaaactgaaccaaccacaggaacatcaagtacactgtgggcctgggtccagcttctttccagtaagtgtatctcaggggcttccaaatttagcttacatcagaatcacttggaaggcttgttaaaacccaaggctgctaggcccacccccagagtttgatacagtagacctcaggtgggacccaaaaatttgcatttctaacacattctcagctgatgcagtccaggctccatgctttgaaaaccactggtctagctttagataggatattgagccaatttaaataaagcaatatactggtctagctgagttctagaacttctctctttagctggccatctgaatactcccccatcactaattgttaaaaaaagaatcaactgttcttactctagagctcttttttcctttctgctgatttgctggaagcactacaagacttctgtttgttcgttcgtttgtttgtttgtttgtttttaaagatggggtcttgttatattgcctaggctggaatgcagtggttattcacaggcatgattataacacactactctctctaactcctggcctcaagccatcctcccaaatagatgggactactgatgcacactgccatgctggccttacgaaatgttttaataggcatttcactaatagggatctggagtacaaggaaatacagtgcatttaagacataggctgggcatggtggctcatgcctgtaatcccagcacattgggaagatcacttgaggcaaggagtttgagaccagactggccaacacagcgagacccccatctctaaaaaaaaaaaaattaataagacatggatacaaccagggagggaggttataataatagagcatcctgttaatcagaatcatgggggagaacatacagcccagcgtgcctctcactttccagaaagggtgagaggatcattagagagttcattagagagtatttattcctaataagtcagataaatgtcagtttcatttttagaagtttcacacaatacctgctaatggtgtgatgtcatttttccccctgcttcaggttaattttttggatatttcagaaacccatagcaattcagtgatttttctttttgtagtagctcagtcaaaacaggtaacagcagattaatcatagaaaatgttgcttccacattaacaaaacaatcactgaaaaacagcagatgtttaaatagattattttatagcttattttggatattttttcttttaataaactaatatgatcatttgaattaaaa

SEQ ID NO: 2402 - DNA, 2429 bp, Homo sapiens
gcaacagcccagccctagcttgggagcggacccacacgaactgctcaaaggcttggagcgggtctagtaaggcgaacggactgcttccggccagaggtcccgggcggaggaggaagctgtggctgccggcggtgggacgccccggccgctcagcccccgggcactgctgtggggcgttcaggtaacaggggcggggctgtgctgagcgtgagggatctaggccccgcctcacctttcagagccacgtcgggcgctgggaagcctacaataccaccctctcctcagcacgacgttcaaggcctgacctcagcctgtctcagtctttccctctcattcaggatcgggttcatacgtagtgccgcatcaagtagcgccttcatcactccagtgatctgccctcaatccgtctctcccactggcccacgaatagtgatggtagtgagttcctggagtgactcaagctgagctgaatgaccgtatggagagcttccgtaaatcaaatagggattggattggattgtcctttctctccagtgtcacaagttgtccacatttgtacaagttcccgcacaaccctcactgtattccagtctgcctacttctctgcatctaccgccatcaccaaccttctagccaccatcatctcctgcctggactgatgtagttctccccacatcccctctacaatccattctccacgaagcagtcagattgatcattttgcactctttccacacttggggcaaagcaagccgcgaggaggaaccagacagtcctgttagttgtggccagccctcattccctggaaatggcaaacaaggggaacaagaagcgtcggcagttctctctggaggagaaaatgaaagttgtgggagctgtagactcaggcaagaggaaaggtgatgtggcaaaagaatttggtatcactccctctactttatctacattcttaaaggatcgcaccaaatttgaagaaaaggtgcgggaggcatccgtgggaccccagcggaaaaggatgaggagcgctctttatgatgacattgataaggctgtttttgcttggtttcaagaaatccatgccaaaaacattcttgtgactggttctgtcattcggaaaaaagcactaaacttggccaacatgcttggctatgacaattttcaagcaagtgtgggctggctgaacagatttagagatcgccacggaattgctttgaaagcagtctgtagagaagatagtgacaggttaatgaatggtctaggaatagataagattaatgagtggcatgcaggggaaattataaaactgattgctgactacagcccagatgatatctttaatgctgatgagacaggagtgtttttccagttgcttccccagcacacacttgctgctaaaggagaccactgtagagggggcaagaaagcaaagcagcggttgacagcactcttttgttgcaatgcctcggggactgaaaaaatgagaccattgattgttggtaggtcagccagcccacactgcctcaagaacattcattccctcccttgtgattaccgagccaaccagtgggcttggatgacaagggatctgtttaatgagtggctgatgcaagtggatgccaggatgaagagggcggaacgccggatcctcttgctcatagacaactgctctgctcataacatgcttccacacttggaaaggattcaggttgggtatctgccctccaactgtactgctgtcctgcagccactgaatcttggcataattcacaccatgaaagtactgtaccagagccaccttctaaaacagatcctcctcaagctcaacagcagtgaggatcaagaagaggtggacatcaagcaggccatcgacatgattgctgcagcgtggtggtcagtcaagccatccacagtggtgaaatgttggcagaaggcaggcatcgtccctatggaatttgcagaatgtgacacagaatcagcagccagtgaaccagacattgccattgaaaagttgtggcacacagtggctattgccacctgtgtcccaaatgaagtaaatttccaggactttgttactgcagatgatgatctcattatctctcaggacacagacatcatccaggacatggtggctggcgaaaataccagtgaagcaggaagtgaagatgaaggggaggtatctttaccagagcaaccaaaagtcaccatcacagaagccatatcaagtgtacagaaacttagacagttcctttccacttgtgtagacattcctgatgccatttttggacaattaaatggcatagatgaatatttaatgaaaagagtgacacaaacccttattgattccaaaattacagatttcctccaaacaaaataatgcaggaatttatttcagaaaatgtagtttacaagaataaagatttctttagata

SEQ ID NO: 2403 - DNA, 1716 bp, Homo sapiens
gccgtgtctagctgttcgggtgtgctgtggtcatcctccctgcgcacctacagccgcagaccgccggtggggggcgggggatgccgggctgccgcatcagcgcctgcggcccgggggcccaggaggggacggcagagcagaggtcgccgccgccgccctgggatcccatgccgtcctctcagcccccgcccccaactccgaccttgactcctaccccgaccccgggtcagtccccgccgctgccggacgcagctggggcttcagcaggcgcggccgaggaccaggagctgcagcgctggcgccagggcgctagcgggatcgcggggctcgccggccccggagggggctctggcgcggctgcgggggcggggggccgcgcgctggagctggccgaagcacggcggcggctgctggaggtggagggccgccggcgcctggtgtcggagctggagagccgcgtgctgcagctgcaccgcgttttcttggcggccgagctgcgcctggcgcaccgcgcggagagcctgagccgcctgagcggcggcgtggcgcaggccgagctctacctggcggctcacgggtcgcgcctcaagaagggcccgcgccgcggccgccgcggccgaccccccgcgctgctggcctcggcgctgggcctgggcggctgcgtgccctggggtgccgggcgactgcggcgcggccacggccccgagcccgactcgcccttccgccgcagcccgccccgcggccccgcctccccgcagcgctgacctccacgcccggacccctggccaccccgacaagcttcgccgaggtgccgaccgaccgactgatcgcggacgccggctggaaggactacggatccgcaggaagaggcagttgggggccaggggcccagtagaggaggctgagctccttccaactcctcagaacctccactctatggatctggacctctggattcggctttctccctgggcactgccttcaggaagacgttgagaattgaccttacacaatcccagcgccctcctcacaggagcctttcactttacagtggcaaggggctggttctggagaactggctgatgctctgaatttcttcatataccccacatttgactttggcttacactgtacaattggagatgttgctacaggtccctgagatgcaatcagattaagcgtagcaagcattgccaatgggaaagtcaaaataatttattttttttccctttccccctaccccatccccagccaagaatttcttttcaagatatcgtcatcattcttaaacaacattcttaacccccagctggggtccccattttaatagatgtcattgcttcaagtctaacggcgccgggaggcctgtttgagggaaaacattagtttgaaaaatccccgttcccttcatccactgcccttgttctccacgtgggagtgtgcttgtggcccctcagaaagatagtctgctggctcctaggggttggggtgggggacacacctttttctcaggaagaggtgatggcaatgtaaaacatctaagcaaagttttaaatgaaaaaaaggaaacacatttaaacatcctgataatggagggaaggggggcacatttacacatagcccagaacttgtagaattctgcatagtgaatgtatattgaattagtctcctgccttatacattcaggaggaataaatttccataatgtaaggcaaa

SEQ ID NO: 2404 - DNA, 575 bp, Homo sapiens
gcggccgaccccccgcgctgctggcctcggcgctgggcctgggcggctgcgtgccctggggtgccgggcgactgcggcgcggccacggccccgagcccgactcgcccttccgccgcagcccgccccgcggccccgcctccccgcagcgctgacctccacgcccggacccctggccaccccgacaagcttcgccgaggtgccgaccgaccgactgatcgcggacgccggctggaaggactacggatccgcaggaagaggcagttgggggccaggggcccagtagaggaggctgaggtgcggtcttagcggctgctccttccaactcctcagaacctccactctatggatctggacctctggattcggctttctccctgggcactgccttcaggaagacgttgagaattgaccttacacaatcccagcgccctcctcacaggagcctttcactttacagtggcaaggggctggttctggagaactggctgatgctctgaatttcttcatataccccacatttgactttggcttacactgtacaattggagatgttgctacaggtccctgagatgcaa

SEQ ID NO: 2405 - DNA, 982 bp, Homo sapiens
tacttattgttagaatactgtgaaggcaatgacttggatttctatctgaagcaacacaagttaatgtcagagaaagaagctcggtctattgtaatgcagattgtaaatgcactaagatatctcaatgagatcaaaccccctattatacattatgatcttaagccaggaaacatcctactggtagatggaacagcatgtggtgaaatcaaaatcactgattttggtctgtccaagattatggatgatgatagctatggtgtagatggaatggatctaacttcccagggggcaggcacttactggtatttacctcctgagtgttttgtagttggaaaagagccaccaaagatttccaacaaggttgatgtatggtcggttggagtcatcttctttcagtgtctttatggtagaaagccatttggtcacaatcaatctcaacaagacattcttcaagaaaatacaatattaaaagccacagaagtccagttccctgtaaaaccggttgtaagcagtgaagccaaggcatttataagacgctgtttggcatatcgaaaagaagatcgatttgatgtgcaccagctggcaaatgacccataccttctcccacacatgagaagatcaaattcttcaggaaacctacacatggctgggctgacagcatcccctacacccccttcttcaagcataattacttactgactttcctccaagattggcatgatatctttgaatttgcttccagatgcacacttaagtttgagagcatttgagtgtttgttttctttttcttttttttttttttttttttttacacaagacgtggttaagaactgtttgtgaactgaagttcctcatagtgtcatttgtatgagagaggatcatggacaatgaataaatgcacacttctgactataattttgagcagtgaaggaaggatgactgcctgttacacagaaacaggaataccatgttaagatagagg

SEQ ID NO: 2406 - DNA, 2783 bp, Homo sapiens
aactgatgcagaggttaccccaccgcctcagccgccacccacagcccgccgccgccgcctcccgggcgacgccgggggccgacgcactgcagaggtgccggcaggttccgcccgcggaagtgtcctcggccggcgcagcccgcgctccgcccgcgctccgaccccggcccggctggcaccccctcgacgcctccgccgccgcgctcctttcctcctcctctcctctggcgcgcccgctcgctccctcgcttctccccctttccctcctccctgtcccctctccttccctcacctctttcctccccacctcccctcttctcggtttcctcccccatccccttgactctcccctcccagccctcgctctctcgctcgccctcagcgcggcccccgccatgacggaggcgggtgccggtgccgttgccgccgctgccgtcgcagggggggagtcgggttcccagaaagtagcttgatgagtgtccaaagtagcagtggaagtttggaggggccgccatcttggtcccagctctccacgtctccaaccccgggctcggcggcggcggccaggtccctgctgaatcacacgccgccatccgggaggcccagggaaggtgcaatggatgagcttcatagtctggatccaagaaggcaagagttattggaagctagatttactggagttgcaagtgggagcactggaagtacgggcagttgcagtgttggagctaaagcctcaacaaataacgaaagctctaatcacagttttggaagcttgggatctttaagtgacaaagaatcagagacaccggagaagaaacaatcggaatcatccaggggaagaaagagaaaagcagaaaaccagaatgaaagtagtcagggaaaaagtattgggggacgtggccacaaaattagcgactattttgaataccagggtggaaatggctcaagtccagtaagaggcatacctcctgcaatccgttctcctcaaaattcacattcacattccactccttcctcatctgttcgaccgaatagcccttctcctactgcattagcatttggggaccaccctattgtacaaccaaagcaattatcctttaaaattattcagactgatctcacaatgctgaaattagcagcattagaaagtaataaaatccaggacctggaaaagaaggagggacgtatagatgatttgctcagggctaactgtgatctcagacggcaaatagatgaacaacaaaaattacttgaaaaatacaaagaacgattaaataagtgcatatcaatgagcaagaaacttcttattgaaaagagtacacaagaaaagctgtcaagcagagagaagagtatgcaagatcgattacgcctcgggcactttacaacagttagacatggcgcttcatttactgaacaatggacagatggttttgcatttcagaatcttgtgaagcaacaagaatgggtgaatcagcaaagggaagatattgaaaggcaaaggaaacttctagccaaacgcaaacctcccacagctaataattctcaggcaccctctaccaattctgaaccaaaacaaaggaaaaacaaagcagtcaatggagcagagaatgatccctttgttagaccaaatttaccacaactgttgactttggcagaatatcatgaacaggaagaaattttcaaacttagactaggacatctcaaaaagagataacagtatagcaacaactctgccactgaaatcctgttctctgaccgatattggcacctgcaaagagaaacaaccagtaacaggcagcagcagcatcagtattaatcttccatgatgaaatctttacaggtcaagaacaagtacacagctcttttctcactccttcacagtggaccatgcaactagttgaaatggaagacaatggattgtctacaagccttttgaacagtggagaatgcagggcgttggctttaggaagaggcagaaatccaggcagaacttgaacgtttggaaagagtcagaaatcttcacatacgtgagctgaaaagaataaacaatgaagataattcacagttcaaagatcacccaacattaaatgaaagatatttattacttcatctgcttggtagaggtggctttagtgaagtgtataaggcttttgacctttatgaacaaagatatgctgctgtgaagatacatcagcttaataaaagctggagagatgagaagaaagaaaactaccacaaacatgcctgcagagagtatagaatacacaaagaactggatcaccccagaatagttaaactctatgattatttctccttggatacagatacgttttgtacagtgttagaatactgtgaaggcaatgacttggatttctatctgaagcaacacaagttaatgtcagagaaagaagctcggtctattgtaatgcagattgtaaatgcactaagatatctcaatgagatcaaaccccctattatacattatgatcttaagccaggaaacatcctactggtagatggaacagcatgtggtgaaatcaaaatcactgattttggtctgtccaagattatggatgatgatagctatggtgtagatggaatggatctaacttcccagggggcaggcacttactggtatttacctcctgagtgttttgtagttggaaaagagccaccaaagatttccaacaaggttgatgtatggtcggttggagtcatcttctttcagtgtctttatggtagaaagccatttggtcacaatcaatctcaacaagacattcttc

SEQ ID NO: 2407 - DNA, 5663 bp, Homo sapiens
gacgccgggggccgacgcactgcagaggtgccggcaggttccgcccgcggaagtgtcctcggccggcgcagcccgcgctccgcccgcgctccgaccccggcccggctggcaccccctcgacgcctccgccgccgcgctcctttcctcctcctctcctctggcgcgcccgctcgctccctcgcttctccccctttccctcctccctgtcccctctccttccctcacctctttcctccccacctcccctcttctcggtttcctcccccatccccttgactctcccctcccagccctcgctctctcgctcgccctcagcgcggcccccgccatgacggaggcgggtgccggtgccgttgccgccgctgccgtcgcagggggggagtcgggttcccagaaagtagcttgatgagtgtccaaagtagcagtggaagtttggaggggccgccatcttggtcccagctctccacgtctccaaccccgggctcggcggcggcggccaggtccctgctgaatcacacgccgccatccgggaggcccagggaaggtgcaatggatgagcttcatagtctggatccaagaaggcaagagttattggaagctagatttactggagttgcaagtgggagcactggaagtacgggcagttgcagtgttggagctaaagcctcaacaaataacgaaagctctaatcacagttttggaagcttgggatctttaagtgacaaagaatcagagacaccggagaagaaacaatcggaatcatccaggggaagaaagagaaaagcagaaaaccagaatgaaagtagtcagggaaaaagtattgggggacgtggccacaaaattagcgactattttgaataccagggtggaaatggctcaagtccagtaagaggcatacctcctgcaatccgttctcctcaaaattcacattcacattccactccttcctcatctgttcgaccgaatagcccttctcctactgcattagcatttggggaccaccctattgtacaaccaaagcaattatcctttaaaattattcagactgatctcacaatgctgaaattagcagcattagaaagtaataaaatccaggacctggaaaagaaggagggacgtatagatgatttgctcagggctaactgtgatctcagacggcaaatagatgaacaacaaaaattacttgaaaaatacaaagaacgattaaataagtgcatatcaatgagcaagaaacttcttattgaaaagagtacacaagaaaagctgtcaagcagagagaagagtatgcaagatcgattacgcctcgggcactttacaacagttagacatggcgcttcatttactgaacaatggacagatggttttgcatttcagaatcttgtgaagcaacaagaatgggtgaatcagcaaagggaagatattgaaaggcaaaggaaacttctagccaaacgcaaacctcccacagctaataattctcaggcaccctctaccaattctgaaccaaaacaaaggaaaaacaaagcagtcaatggagcagagaatgatccctttgttagaccaaatttaccacaactgttgactttggcagaatatcatgaacaggaagaaattttcaaacttagactaggacatctcaaaaaggaagaggcagaaatccaggcagaacttgaacgtttggaaagagtcagaaatcttcacatacgtgagctgaaaagaataaacaatgaagataattcacagttcaaagatcacccaacattaaatgaaagatatttattacttcatctgcttggtagaggtggctttagtgaagtgtataaggcttttgacctttatgaacaaagatatgctgctgtgaagatacatcagcttaataaaagctggagagatgagaagaaagaaaactaccacaaacatgcctgcagagagtatagaatacacaaagaactggatcaccccagaatagttaaactctatgattatttctccttggatacagatacgttttgtacagtgttagaatactgtgaaggcaatgacttggatttctatctgaagcaacacaagttaatgtcagagaaagaagctcggtctattgtaatgcagattgtaaatgcactaagatatctcaatgagatcaaaccccctattatacattatgatcttaagccaggaaacatcctactggtagatggaacagcatgtggtgaaatcaaaatcactgattttggtctgtccaagattatggatgatgatagctatggtgtagatggaatggatctaacttcccagggggcaggcacttactggtatttacctcctgagtgttttgtagttggaaaagagccaccaaagatttccaacaaggttgatgtatggtcggttggagtcatcttctttcagtgtctttatggtagaaagccatttggtcacaatcaatctcaacaagacattcttcaagaaaatacaatattaaaagccacagaagtccagttccctgtaaaaccggttgtaagcagtgaagccaaggcatttataagacgctgtttggcatatcgaaaagaagatcgatttgatgtgcaccagctggcaaatgacccataccttctcccacacatgagaagatcaaattcttcaggaaacctacacatggctgggctgacagcatcccctacacccccttcttcaagcataattacttactgactttcctccaagattggcatgatatctttgaatttgcttccagatgcacacttaagtttgagagcatttgagtgtttgttttctttttcttttttttttttttttttttttacacaagacgtggttaagaactgtttgtgaactgaagttcctcatagtgtcatttgtatgagagaggatcatggacaatgaataaatgcacacttctgactataattttgagcagtgaaggaaggatgactgcctgttacacagaaacaggaataccatgttaagatagaggaaaaaaattttgtttatttgggggaacactgtaaataacgtttataatacttaaatacatttggttgttactagagagttctaatatgaagggtagtttttcattatttaaaaacacatggaaaaatatgagacatatttctaacatacgaactatagtgcctggatacattcttcagcatttggcagttaatctgctgaaaccaaagtaagaactgaatgacagtgacagttgtgttttatagtaatagaatgtgagagttagaatctttggacaaagttaggctttgtcatttgcctattcagacttttaccaagttgtacctcgagatcacatgtccgttttctttcactggttatattaaagggagagctattatttctaaatactttacacctttgacaaaatgagctgcttgtgttgaaatcagttgaattcactaaattataatattgccagtgttttcaacacgttagaattgataacaggtatttttcttttgttaccaggccttgttcatcaaaacaggtgacagtgagtaaccaaatgcagaccagttctatgcaggataatgataaattcccttctagctctattgtaaattgttgtacagatgtcatatttcaattactaagtttcagcagcttattcttgtacaaatgtttaaaatatggcttttctaattggatattgtattttttttaagtcttcttgaaggcactctaattgctgctaaatgatgttgcttctttgctaaaaaattaaatgacctagaaggtgcaagttgactgtacatcatagatattaaaaagcagacagtcattaacaatcaagatgtaaaagtgatccatgttggacataattgagtttttaaatcagtttattgggttctagggctgtagaacacatagatactagatttttaatttgttcatggttattctacatttctagaaagttcttatcagcaagatggtcccataagcaaatttcttgtggtttgtacagatttgttaaaatgtgaacgttttctaactgcctcgtagggtagaaaccaatatttttcaggatgctgtatttcactcctgtaaggactttttctttattgtcacattcataatgctgatacttacatgtaagttgttcatgttgcagaaaaaggttatacgtaccacggattctctttaatattgtacagttaaactgtatttctgatgttgcaagccattttgttttttcattgtacatagacacattgtctctttaaaatgctgctgaaattgtagagagtatagccaaaacagtaataaacaatgacagttaaaatgtaaagactatgaaaattacattggaagggagctttcaagatggtaggatattgactaactgagctccttcacttaaaaatcagctgaataaattccttaagtatacttcaagacaagtgtaaattgtttcaagctgttaaagttaaacctaataaccattatcaaggcaactcctgggtaagtaacacttagaaccatcaagagtggtttaaggggctggctatacccattcctctgtagagcacagagaaatcctattaaaaaaaaaatactacatggtaatgaaatcttagcattgattgagtgctttacgtgctgcctgcaagttttcagttttgttgttagagttttcgtctttatgaatgataaagtcctatgttcataaagtaacatttaaattcctgaactaaaaggaaatgcctgttgtgcttaaaattttggggagatacgaagtgaatgtgtaaatctaactttgaggttcagtaagttaagtagtatagacctagagatcactgctttaccattttactttcaaatgaatgagagcgactgctagtggcagaacgcagaaaaggggaaaaacaagccatgaaatgaagttgctttcctgacctgggtttaggtcatcattttaaaatcaaagatgtgtaggagatgaatcaacttatagacccatattttccttctaaaagtttcccaaagaaatgttatagattttgaataacatgccagtgacccagcaggtccaagatggctaaccaagatggctaatttagccacattgaataacttacttttaccctcacatggaaagttggtatctattgctaaatgatttcaaggtcactctgacagtctttgacactgttttttttagggttttattgttttctggtctcctggtgtctgtcctcagaattaaagcatgtcctgcatccctaagatgatagccaaggcctctcttttattaagagtcagcactgatgtagggtaaaatcaacagtttttgcatatgattttaaaatctttctttgatttgaatttgctttagtgtgtgcatgttgagaggaagtaagtgtagaaaccaccctaatttgtaagttgggagttggagatacttggtggtttttcaaaaataaagactcaatcttttttttttttttaaacactcactaccatctccttctaaaacaactctgtcagtttaaatggcatataaaatgtgaacaaacacctcattacatgaagtcaaaatggtgaagagcttcagtgaaacatttaaagagtatattgtgtgttgttttgctgttcatcattacttattaaatgcagtaatgttgattgcc

SEQ ID NO: 2408 - DNA, 2156 bp, Homo sapiens
attacaagcactttcaaaatgccaacatttccagaataaattatctgaaagtgttacttcccaacccccacccttcagcagttgttctaaatggctgttttattcttgtatgatttgaaaactactggcaagacaccggagaagaaacaatcggaatcatccaggggaagaaagagaaaagcagaaaaccagaatgaaagtagtcagggaaaaagtattgggggacgtggccacaaaattagcgactattttgaataccagggtggaaatggctcaagtccagtaagaggcatacctcctgcaatccgttctcctcaaaattcacattcacattccactccttcctcatctgttcgaccgaatagcccttctcctactgcattagcatttggggaccaccctattgtacaaccaaagcaattatcctttaaaattattcagactgatctcacaatgctgaaattagcagcattagaaagtaataaaatccaggacctggaaaagaaggagggacgtatagatgatttgctcagggctaactgtgatctcagacggcaaatagatgaacaacaaaaattacttgaaaaatacaaagaacgattaaataagtgcatatcaatgagcaagaaacttcttattgaaaagagtacacaagaaaagctgtcaagcagagagaagagtatgcaagatcgattacgcctcgggcactttacaacagttagacatggcgcttcatttactgaacaatggacagatggttttgcatttcagaatcttgtgaagcaacaagaatgggtgaatcagcaaagggaagatattgaaaggcaaaggaaacttctagccaaacgcaaacctcccacagctaataattctcaggcaccctctaccaattctgaaccaaaacaaaggaaaaacaaagcagtcaatggagcagagaatgatccctttgttagaccaaatttaccacaactgttgactttggcagaatatcatgaacaggaagaaattttcaaacttagactaggacatctcaaaaaggaagaggcagaaatccaggcagaacttgaacgtttggaaagagtcagaaatcttcacatacgtgagctgaaaagaataaacaatgaagataattcacagttcaaagatcacccaacattaaatgaaagatatttattacttcatctgcttggtagaggtggctttagtgaagtgtataaggcttttgacctttatgaacaaagatatgctgctgtgaagatacatcagcttaataaaagctggagagatgagaagaaagaaaactaccacaaacatgcctgcagagagtatagaatacacaaagaactggatcaccccagaatagttaaactctatgattatttctccttggatacagatacgttttgtacagtgttagaatactgtgaaggcaatgacttggatttctatctgaagcaacacaagttaatgtcagagaaagaagctcggtctattgtaatgcagattgtaaatgcactaagatatctcaatgagatcaaaccccctattatacattatgatcttaagccaggaaacatcctactggtagatggaacagcatgtggtgaaatcaaaatcactgattttggtctgtccaagattatggatgatgatagctatggtgtagatggaatggatctaacttcccagggggcaggcacttactggtatttacctcctgagtgttttgtagttggaaaagagccaccaaagatttccaacaaggttgatgtatggtcggttggagtcatcttctttcagtgtctttatggtagaaagccatttggtcacaatcaatctcaacaagacattcttcaagaaaatacaatattaaaagccacagaagtccagttccctgtaaaaccggttgtaagcagtgaagccaaggcatttataagacgctgtttggcatatcgaaaagaagatcgatttgatgtgcaccagctggcaaatgacccataccttctcccacacatgagaagatcaaattcttcaggaaacctacacatggctgggctgacagcatcccctacacccccttcttcaagcataattacttactgactttcctccaagattggcatgatatctttgaatttgcttccagatgcacactt

SEQ ID NO: 2409 - DNA, 5730 bp, Homo sapiens
aactgatgcagaggttaccccaccgcctcagccgccacccacagcccgccgccgccgcctcccgggcgacgccgggggccgacgcactgcagaggtgccggcaggttccgcccgcggaagtgtcctcggccggcgcagcccgcgctccgcccgcgctccgaccccggcccggctggcaccccctcgacgcctccgccgccgcgctcctttcctcctcctctcctctggcgcgcccgctcgctccctcgcttctccccctttccctcctccctgtcccctctccttccctcacctctttcctccccacctcccctcttctcggtttcctcccccatccccttgactctcccctcccagccctcgctctctcgctcgccctcagcgcggcccccgccatgacggaggcgggtgccggtgccgttgccgccgctgccgtcgcagggggggagtcgggttcccagaaagtagcttgatgagtgtccaaagtagcagtggaagtttggaggggccgccatcttggtcccagctctccacgtctccaaccccgggctcggcggcggcggccaggtccctgctgaatcacacgccgccatccgggaggcccagggaaggtgcaatggatgagcttcatagtctggatccaagaaggcaagagttattggaagctagatttactggagttgcaagtgggagcactggaagtacgggcagttgcagtgttggagctaaagcctcaacaaataacgaaagctctaatcacagttttggaagcttgggatctttaagtgacaaagaatcagagacaccggagaagaaacaatcggaatcatccaggggaagaaagagaaaagcagaaaaccagaatgaaagtagtcagggaaaaagtattgggggacgtggccacaaaattagcgactattttgaataccagggtggaaatggctcaagtccagtaagaggcatacctcctgcaatccgttctcctcaaaattcacattcacattccactccttcctcatctgttcgaccgaatagcccttctcctactgcattagcatttggggaccaccctattgtacaaccaaagcaattatcctttaaaattattcagactgatctcacaatgctgaaattagcagcattagaaagtaataaaatccaggacctggaaaagaaggagggacgtatagatgatttgctcagggctaactgtgatctcagacggcaaatagatgaacaacaaaaattacttgaaaaatacaaagaacgattaaataagtgcatatcaatgagcaagaaacttcttattgaaaagagtacacaagaaaagctgtcaagcagagagaagagtatgcaagatcgattacgcctcgggcactttacaacagttagacatggcgcttcatttactgaacaatggacagatggttttgcatttcagaatcttgtgaagcaacaagaatgggtgaatcagcaaagggaagatattgaaaggcaaaggaaacttctagccaaacgcaaacctcccacagctaataattctcaggcaccctctaccaattctgaaccaaaacaaaggaaaaacaaagcagtcaatggagcagagaatgatccctttgttagaccaaatttaccacaactgttgactttggcagaatatcatgaacaggaagaaattttcaaacttagactaggacatctcaaaaaggaagaggcagaaatccaggcagaacttgaacgtttggaaagagtcagaaatcttcacatacgtgagctgaaaagaataaacaatgaagataattcacagttcaaagatcacccaacattaaatgaaagatatttattacttcatctgcttggtagaggtggctttagtgaagtgtataaggcttttgacctttatgaacaaagatatgctgctgtgaagatacatcagcttaataaaagctggagagatgagaagaaagaaaactaccacaaacatgcctgcagagagtatagaatacacaaagaactggatcaccccagaatagttaaactctatgattatttctccttggatacagatacgttttgtacagtgttagaatactgtgaaggcaatgacttggatttctatctgaagcaacacaagttaatgtcagagaaagaagctcggtctattgtaatgcagattgtaaatgcactaagatatctcaatgagatcaaaccccctattatacattatgatcttaagccaggaaacatcctactggtagatggaacagcatgtggtgaaatcaaaatcactgattttggtctgtccaagattatggatgatgatagctatggtgtagatggaatggatctaacttcccagggggcaggcacttactggtatttacctcctgagtgttttgtagttggaaaagagccaccaaagatttccaacaaggttgatgtatggtcggttggagtcatcttctttcagtgtctttatggtagaaagccatttggtcacaatcaatctcaacaagacattcttcaagaaaatacaatattaaaagccacagaagtccagttccctgtaaaaccggttgtaagcagtgaagccaaggcatttataagacgctgtttggcatatcgaaaagaagatcgatttgatgtgcaccagctggcaaatgacccataccttctcccacacatgagaagatcaaattcttcaggaaacctacacatggctgggctgacagcatcccctacacccccttcttcaagcataattacttactgactttcctccaagattggcatgatatctttgaatttgcttccagatgcacacttaagtttgagagcatttgagtgtttgttttctttttcttttttttttttttttttttttacacaagacgtggttaagaactgtttgtgaactgaagttcctcatagtgtcatttgtatgagagaggatcatggacaatgaataaatgcacacttctgactataattttgagcagtgaaggaaggatgactgcctgttacacagaaacaggaataccatgttaagatagaggaaaaaaattttgtttatttgggggaacactgtaaataacgtttataatacttaaatacatttggttgttactagagagttctaatatgaagggtagtttttcattatttaaaaacacatggaaaaatatgagacatatttctaacatacgaactatagtgcctggatacattcttcagcatttggcagttaatctgctgaaaccaaagtaagaactgaatgacagtgacagttgtgttttatagtaatagaatgtgagagttagaatctttggacaaagttaggctttgtcatttgcctattcagacttttaccaagttgtacctcgagatcacatgtccgttttctttcactggttatattaaagggagagctattatttctaaatactttacacctttgacaaaatgagctgcttgtgttgaaatcagttgaattcactaaattataatattgccagtgttttcaacacgttagaattgataacaggtatttttcttttgttaccaggccttgttcatcaaaacaggtgacagtgagtaaccaaatgcagaccagttctatgcaggataatgataaattcccttctagctctattgtaaattgttgtacagatgtcatatttcaattactaagtttcagcagcttattcttgtacaaatgtttaaaatatggcttttctaattggatattgtattttttttaagtcttcttgaaggcactctaattgctgctaaatgatgttgcttctttgctaaaaaattaaatgacctagaaggtgcaagttgactgtacatcatagatattaaaaagcagacagtcattaacaatcaagatgtaaaagtgatccatgttggacataattgagtttttaaatcagtttattgggttctagggctgtagaacacatagatactagatttttaatttgttcatggttattctacatttctagaaagttcttatcagcaagatggtcccataagcaaatttcttgtggtttgtacagatttgttaaaatgtgaacgttttctaactgcctcgtagggtagaaaccaatatttttcaggatgctgtatttcactcctgtaaggactttttctttattgtcacattcataatgctgatacttacatgtaagttgttcatgttgcagaaaaaggttatacgtaccacggattctctttaatattgtacagttaaactgtatttctgatgttgcaagccattttgttttttcattgtacatagacacattgtctctttaaaatgctgctgaaattgtagagagtatagccaaaacagtaataaacaatgacagttaaaatgtaaagactatgaaaattacattggaagggagctttcaagatggtaggatattgactaactgagctccttcacttaaaaatcagctgaataaattccttaagtatacttcaagacaagtgtaaattgtttcaagctgttaaagttaaacctaataaccattatcaaggcaactcctgggtaagtaacacttagaaccatcaagagtggtttaaggggctggctatacccattcctctgtagagcacagagaaatcctattaaaaaaaaaatactacatggtaatgaaatcttagcattgattgagtgctttacgtgctgcctgcaagttttcagttttgttgttagagttttcgtctttatgaatgataaagtcctatgttcataaagtaacatttaaattcctgaactaaaaggaaatgcctgttgtgcttaaaattttggggagatacgaagtgaatgtgtaaatctaactttgaggttcagtaagttaagtagtatagacctagagatcactgctttaccattttactttcaaatgaatgagagcgactgctagtggcagaacgcagaaaaggggaaaaacaagccatgaaatgaagttgctttcctgacctgggtttaggtcatcattttaaaatcaaagatgtgtaggagatgaatcaacttatagacccatattttccttctaaaagtttcccaaagaaatgttatagattttgaataacatgccagtgacccagcaggtccaagatggctaaccaagatggctaatttagccacattgaataacttacttttaccctcacatggaaagttggtatctattgctaaatgatttcaaggtcactctgacagtctttgacactgttttttttagggttttattgttttctggtctcctggtgtctgtcctcagaattaaagcatgtcctgcatccctaagatgatagccaaggcctctcttttattaagagtcagcactgatgtagggtaaaatcaacagtttttgcatatgattttaaaatctttctttgatttgaatttgctttagtgtgtgcatgttgagaggaagtaagtgtagaaaccaccctaatttgtaagttgggagttggagatacttggtggtttttcaaaaataaagactcaatcttttttttttttttaaacactcactaccatctccttctaaaacaactctgtcagtttaaatggcatataaaatgtgaacaaacacctcattacatgaagtcaaaatggtgaagagcttcagtgaaacatttaaagagtatattgtgtgttgttttgctgttcatcattacttattaaatgcagtaatgttgattgcc

SEQ ID NO: 2410 - DNA, 2605 bp, Homo sapiens
aagagaagagagggagaaggcacactgaggaatgccaaggactgccagcagcaccagaagctaggagagaggcacagaacagactcctagcttctcctaggctccctctgagcctccaggaagaaccaatcccggtgacatcttgattttggacttctggcatcagaactgtgcaatggatgagcttcatagtctggatccaagaaggcaagagttattggaagctagatttactggagttgcaagtgggagcactggaagtacgggcagttgcagtgttggagctaaagcctcaacaaataacgaaagctctaatcacagttttggaagcttgggatctttaagtgacaaagaatcagagacaccggagaagaaacaatcggaatcatccaggggaagaaagagaaaagcagaaaaccagaatgaaagtagtcagggaaaaagtattgggggacgtggccacaaaattagcgactattttgaataccagggtggaaatggctcaagtccagtaagaggcatacctcctgcaatccgttctcctcaaaattcacattcacattccactccttcctcatctgttcgaccgaatagcccttctcctactgcattagcatttggggaccaccctattgtacaaccaaagcaattatcctttaaaattattcagactgatctcacaatgctgaaattagcagcattagaaagtaataaaatccaggacctggaaaagaaggagggacgtatagatgatttgctcagggctaactgtgatctcagacggcaaatagatgaacaacaaaaattacttgaaaaatacaaagaacgattaaataagtgcatatcaatgagcaagaaacttcttattgaaaagagtacacaagaaaagctgtcaagcagagagaagagtatgcaagatcgattacgcctcgggcactttacaacagttagacatggcgcttcatttactgaacaatggacagatggttttgcatttcagaatcttgtgaagcaacaagaatgggtgaatcagcaaagggaagatattgaaaggcaaaggaaacttctagccaaacgcaaacctcccacagctaataattctcaggcaccctctaccaattctgaaccaaaacaaaggaaaaacaaagcagtcaatggagcagagaatgatccctttgttagaccaaatttaccacaactgttgactttggcagaatatcatgaacaggaagaaattttcaaacttagactaggacatctcaaaaaggaagaggcagaaatccaggcagaacttgaacgtttggaaagagtcagaaatcttcacatacgtgagctgaaaagaataaacaatgaagataattcacagttcaaagatcacccaacattaaatgaaagatatttattacttcatctgcttggtagaggtggctttagtgaagtgtataaggcttttgacctttatgaacaaagatatgctgctgtgaagatacatcagcttaataaaagctggagagatgagaagaaagaaaactaccacaaacatgcctgcagagagtatagaatacacaaagaactggatcaccccagaatagttaaactctatgattatttctccttggatacagatacgttttgtacagtgttagaatactgtgaaggcaatgacttggatttctatctgaagcaacacaagttaatgtcagagaaagaagctcggtctattgtaatgcagattgtaaatgcactaagatatctcaatgagatcaaaccccctattatacattatgatcttaagccaggaaacatcctactggtagatggaacagcatgtggtgaaatcaaaatcactgattttggtctgtccaagattatggatgatgatagctatggtgtagatggaatggatctaacttcccagggggcaggcacttactggtatttacctcctgagtgttttgtagttggaaaagagccaccaaagatttccaacaaggttgatgtatggtcggttggagtcatcttctttcagtgtctttatggtagaaagccatttggtcacaatcaatctcaacaagacattcttcaagaaaatacaatattaaaagccacagaagtccagttccctgtaaaaccggttgtaagcagtgaagccaaggcatttataagacgctgtttggcatatcgaaaagaagatcgatttgatgtgcaccagctggcaaatgacccataccttctcccacacatgagaagatcaaattcttcaggaaacctacacatggctgggctgacagcatcccctacacccccttcttcaagcataattacttactgactttcctccaagattggcatgatatctttgaatttgcttccagatgcacacttaagtttgagagcatttgagtgtttgttttctttttcttttttttttttttttttttttacacaagacgtggttaagaactgtttgtgaactgaagttcctcatagtgtcatttgtatgagagaggatcatggacaatgaataaatgcacacttctgactataattttgagcagtgaaggaaggatgactgcctgttacacagaaacaggaataccatgtt

SEQ ID NO: 2411 - DNA, 3413 bp, Homo sapiens
gtggagcccggcgccggcggcggctgcccgggcggggggttgcggcgctcaggagaggccccggctccgccccgggcctgcccagggggagagcggagcggtccgcagccgggtcgggtcggggcccctcccgggaggagcgtggagcggcggcggcggcggcggcagaaatgatggaagaattgcatagcctggacccacgacggcaggaattattggaggccaggtttactggagtaggtgttagtaagggaccacttaatagtgagtcttccaaccagagcttgtgcagcgtcggatccttgagtgataaagaagtagagactcccgagaaaaagcagaatgaccagcgaaatcggaaaagaaaagctgaaccatatgaaactagccaagggaaaggcactcctaggggacataaaattagtgattactttgagtttgctgggggaagcgcgccaggaaccagccctggcagaagtgttccaccagttgcacgatcctcaccgcaacattccttatccaatcccttaccgcgacgagtagaacagcccctctatggtttagatggcagtgctgcaaaggaggcaacggaggagcagtctgctctgccaaccctcatgtcagtgatgctagcaaaacctcggcttgacacagagcagctggcgcaaaggggagctggcctctgcttcacttttgtttcagctcagcaaaacagtccctcatctacgggatctggcaacacagagcattcctgcagctcccaaaaacagatctccatccagcacagacagacccagtccgacctcacaatagaaaaaatatctgcactagaaaacagtaagaattctgacttagagaagaaggagggaagaatagatgatttattaagagccaactgtgatttgagacggcagattgatgaacagcaaaagatgctagagaaatacaaggaacgattaaatagatgtgtgacaatgagcaagaaactccttatagaaaagtcaaaacaagagaagatggcgtgtagagataagagcatgcaagaccgcttgagactgggccactttactactgtccgacacggagcctcatttactgaacagtggacagatggttatgcttttcagaatcttatcaagcaacaggaaaggataaattcacagagggaagagatagaaagacaacggaaaatgttagcaaagcggaaacctcctgccatgggtcaggcccctcctgcaaccaatgagcagaaacagcggaaaagcaagaccaatggagctgaaaatgaaacgccctcttctgggaatacagagctaaaggatacagccccagccttaggagcccacagtttacttaggttaacgttagcagaataccatgaacaagaagaaatcttcaaactcagattaggtcatcttaaaaaggaggaagcagagatccaggcagagctggagagactagaaagggttagaaatctacatatcagggaactaaaaaggatacataatgaagataattcacaatttaaagatcatccaacgctaaatgacagatatttgttgttacatcttttgggtagaggaggtttcagtgaagtttacaaggcatttgatctaacagagcaaagatacgtagctgtgaaaattcaccagttaaataaaaactggagagatgagaaaaaggagaattaccacaagcatgcatgtagggaataccggattcataaagagctggatcatcccagaatagttaagctgtatgattacttttcactggatactgactcgttttgtacagtattagaatactgtgagggaaatgatctggacttctacctgaaacagcacaaattaatgtcggagaaagaggcccggtccattatcatgcagattgtgaatgctttaaagtacttaaatgaaataaaacctcccatcatacactatgacctcaaaccaggtaatattcttttagtaaatggtacagcgtgtggagagataaaaattacagattttggtctttcgaagatcatggatgatgatagctacaattcagtggatggcatggagctaacatcacaaggtgctggtacttattggtatttaccaccagagtgttttgtggttgggaaagaaccaccaaagatctcaaataaagttgatgtgtggtcggtgggtgtgatcttctatcagtgtctttatggaaggaagccttttggccataaccagtctcagcaagacatcctacaagagaatacgattcttaaagctactgaagtgcagttcccgccaaagccagtagtaacacctgaagcaaaggcgtttattcgacgatgcttggcctaccgaaaggaggaccgcattgatgtccagcagctggcctgtgatccctacttgttgcctcacatccgaaagtcagtctctacaagtagccctgctggagctgctattgcatcaacctctggggcgtccaataacagttcttctaattgagactgactccaaggccacaaactgttcaacacacacaaagtggacaaatggcgttcagcagcgggtttggaacatagcgaatccgaatggatctgatgaaacctgtaccaggtgcttttattttcttgcttttttcccatccatagagcatgacagcatcgattctcattgaggagaaaccttgggcagctccggccaggccttgtaggaaaaggccccgcccgaggttccagcgtcaacggccactgtgtgtggctgctctgagtgaggaaaaaattaaaaagaaaaactggttccatgtactgtgaacttgaaaacttgcagactcaggggggtccctgatgcagtgcttcagatgaagaatgtggacttgaaaatacagactgggctagtccagtgtctatatttaaacttgttcttttcttttaataaagtttaggtaacatctcctgaaaagcttgtagcacaaaggctcagctggggatggtgtttgacttcggaggaaaaaagttgctattgcccgttaaaggcactagagttagtgttttatccctaaataatttcaatttttaaaaacatgcagcttccctctccccttttttatttttgaaagaatacatttggtcataaagtgaaacccgtattagcaagtacgtggcaatgttcattccaatcagatgcagctttctcctccgtctggtctcctgtttgcaattgcttccctcatctcagtagggaaaaaattgagtgggagtactgagatgtgtgggtttttgccattggacaaagaatgaggttagaagactgcagcttggagtctctctaggttttcaactatttcttcacaatttgaacacttgacggttgtcccttttaatttatttgaagtgctatttttttaaataaaggttcatctgtccatgc

SEQ ID NO: 2412 - DNA, 5341 bp, Homo sapiens
gcggccgcccgggcccgggcccgcgtcgggcgcctggctctgtacgcgagcccggggatctgcggccttcgtgccccccctcccccgcccgccctctcgtggagcccggcgccggcggcggctgcccgggcggggggttgcggcgctcaggagaggccccggctccgccccgggcctgcccagggggagagcggagcggtccgcagccgggtcgggtcggggcccctcccgggaggagcgtggagcggcggcggcggcggcggcagcagaaatgatggaagaattgcatagcctggacccacgacggcaggaattattggaggccaggtttactggagtaggtgttagtaagggaccacttaatagtgagtcttccaaccagagcttgtgcagcgtcggatccttgagtgataaagaagtagagactcccgagaaaaagcagaatgaccagcgaaatcggaaaagaaaagctgaaccatatgaaactagccaagggaaaggcactcctaggggacataaaattagtgattactttgagcgacgagtagaacagcccctctatggtttagatggcagtgctgcaaaggaggcaacggaggagcagtctgctctgccaaccctcatgtcagtgatgctagcaaaacctcggcttgacacagagcagctggcgcaaaggggagctggcctctgcttcacttttgtttcagctcagcaaaacagtccctcatctacgggatctggcaacacagagcattcctgcagctcccaaaaacagatctccatccagcacagacagacccagtccgacctcacaatagaaaaaatatctgcactagaaaacagtaagaattctgacttagagaagaaggagggaagaatagatgatttattaagagccaactgtgatttgagacggcagattgatgaacagcaaaagatgctagagaaatacaaggaacgattaaatagatgtgtgacaatgagcaagaaactccttatagaaaagtcaaaacaagagaagatggcgtgtagagataagagcatgcaagaccgcttgagactgggccactttactactgtccgacacggagcctcatttactgaacagtggacagatggttatgcttttcagaatcttatcaagcaacaggaaaggataaattcacagagggaagagatagaaagacaacggaaaatgttagcaaagcggaaacctcctgccatgggtcaggcccctcctgcaaccaatgagcagaaacagcggaaaagcaagaccaatggagctgaaaatgaaacgttaacgttagcagaataccatgaacaagaagaaatcttcaaactcagattaggtcatcttaaaaaggaggaagcagagatccaggcagagctggagagactagaaagggttagaaatctacatatcagggaactaaaaaggatacataatgaagataattcacaatttaaagatcatccaacgctaaatgacagatatttgttgttacatcttttgggtagaggaggtttcagtgaagtttacaaggcatttgatctaacagagcaaagatacgtagctgtgaaaattcaccagttaaataaaaactggagagatgagaaaaaggagaattaccacaagcatgcatgtagggaataccggattcataaagagctggatcatcccagaatagttaagctgtatgattacttttcactggatactgactcgttttgtacagtattagaatactgtgagggaaatgatctggacttctacctgaaacagcacaaattaatgtcggagaaagaggcccggtccattatcatgcagattgtgaatgctttaaagtacttaaatgaaataaaacctcccatcatacactatgacctcaaaccaggtaatattcttttagtaaatggtacagcgtgtggagagataaaaattacagattttggtctttcgaagatcatggatgatgatagctacaattcagtggatggcatggagctaacatcacaaggtgctggtacttattggtatttaccaccagagtgttttgtggttgggaaagaaccaccaaagatctcaaataaagttgatgtgtggtcggtgggtgtgatcttctatcagtgtctttatggaaggaagccttttggccataaccagtctcagcaagacatcctacaagagaatacgattcttaaagctactgaagtgcagttcccgccaaagccagtagtaacacctgaagcaaaggcgtttattcgacgatgcttggcctaccgaaaggaggaccgcattgatgtccagcagctggcctgtgatccctacttgttgcctcacatccgaaagtcagtctctacaagtagccctgctggagctgctattgcatcaacctctggggcgtccaataacagttcttctaattgagactgactccaaggccacaaactgttcaacacacacaaagtggacaaatggcgttcagcagcgggtttggaacatagcgaatccgaatggatctgatgaaacctgtaccaggtgcttttattttcttgcttttttcccatccatagagcatgacagcatcgattctcattgaggagaaaccttgggcagctccggccaggccttgtaggaaaaggccccgcccgaggttccagcgtcaacggccactgtgtgtggctgctctgagtgaggaaaaaattaaaaagaaaaactggttccatgtactgtgaacttgaaaacttgcagactcaggggggtccctgatgcagtgcttcagatgaagaatgtggacttgaaaatacagactgggctagtccagtgtctatatttaaacttgttcttttcttttaataaagtttaggtaacatctcctgaaaagcttgtagcacaaaggctcagctggggatggtgtttgacttcggaggaaaaaagttgctattgcccgttaaaggcactagagttagtgttttatccctaaataatttcaatttttaaaaacatgcagcttccctctccccttttttatttttgaaagaatacatttggtcataaagtgaaacccgtattagcaagtacgtggcaatgttcattccaatcagatgcagctttctcctccgtctggtctcctgtttgcaattgcttccctcatctcagtagggaaaaaattgagtgggagtactgagatgtgtgggtttttgccattggacaaagaatgaggttagaagactgcagcttggagtctctctaggttttcaactatttcttcacaatttgaacacttgacggttgtcccttttaatttatttgaagtgctatttttttaaataaaggttcatctgtccatgcagtcctcttggattctctgaatgtagtaactatgaagctatgccaaaggtaggcagaaaatgggcttgggagccagacactccagggatcagtagttcctacccatagtctttgtgtgcttgctaaatggtgtacatttcttgttaaccacgttattaaaacttgatcagcacataagctttcttctgttagatcttttggcagcaaacaaccttccccccaagcctctgaattttgtgggtgtgtggtggtgtgtgtctgtgtgtgcatgtacacacacactttgtctagctcactttaaaagattcatcaaatggaattttaaaaataatctgaaaagaaatagatatttcaggccgggcctggtggttcacgcctgtaatcccagcactttgggaggccgaggtgggtggatcacgaggtcgggagttcgagatcagtctggtcaacatggtgaaacgccatctctactaaaaatataaaaattagcctggcgtggtggcgtgtgcctctagtcccagctacccgggaggctgaggcaggagaatttctggaacccaggaggcggaggttgcagtgagccgagatggcaccactgcaatccagcctaggcaacagaatgagactctgtctcagaaaaaaaaaaaaaaaaaaaaggagaaatagatgtttcaaatatgaacattcttttggcaccaattttcttttttaatttggttgtttctgagatgtatgatcaactgaagatggagctgaaatgggagacgggtggccccaccgtgcccttgaaacagcagagcactcctcagtagagagggagggagccaagagcctgaacatgtggtcgccagcttggaatgttactgacatatgtggcgagggcttagccagaaatatttaaagatgtagtattccggcctgtgagttgtctgggcagggagggggagtcagaaagggtagagagctctcaaataactcatgactctagtgttcctttcacatgtgaacagtgtcactgatgacacattttctaggaccttcgtttgttttgtggacctgcctcagtctcctcagtatcaggcgatcttaagggaagatggagtgtttcaaattggagagaagttcatgggtaggtatcgtcctgtggaattctgaatgcaaggaagtcaaccccagaggccttggtacccccagctttctaaaactactttattacaatttatatgtatatacacatgcacatataaacgtgtgcatttatgtatgtgtgtatagtaccttttttaaaaaaacatttcctccaagctgctaagcaaagggtctcacaggtcgagcacagtgctgagaggatggtgtctgcataatgaagacatggatgaagctgagaccgtgttcaaactcactgaaaacaatgaagttctattccttttttcttcctctccaatgatcttgcagttgatttgtttgttttttaattttttaacatttttttaacgttgaaaaaatgctgcgtctttctttaagccttcccagtaacttcctgccttttttttccccgtgggcttttaagtgaagctgcaggattttatctttcaatctgccctttctacccttgtcctattgaaaggatgccctcttcccttgcttttttggtctagggcctgtttggagctaactaggcttggctgagtccgggcaagaccttcttccgaggcatggacaagccccagagaacatgcagaacattgacctttccattgactgtctttcaagcagccagtgaaatcactaagtggggttcttccatgacatattttgttaatatgggtttcactttttccaagaatagtcccttgttgccacaatgttgatttactttacacaatgacagtatgtattaatttgtaattaaacccatccagattgttttagccttttcccaatggggtgggggagggaagaaggatattaaaataagttttaagaagc

SEQ ID NO: 2413 - DNA, 5437 bp, Homo sapiens
gcggccgcccgggcccgggcccgcgtcgggcgcctggctctgtacgcgagcccggggatctgcggccttcgtgccccccctcccccgcccgccctctcgtggagcccggcgccggcggcggctgcccgggcggggggttgcggcgctcaggagaggccccggctccgccccgggcctgcccagggggagagcggagcggtccgcagccgggtcgggtcggggcccctcccgggaggagcgtggagcggcggcggcggcggcggcagcagaaatgatggaagaattgcatagcctggacccacgacggcaggaattattggaggccaggtttactggagtaggtgttagtaagggaccacttaatagtgagtcttccaaccagagcttgtgcagcgtcggatccttgagtgataaagaagtagagactcccgagaaaaagcagaatgaccagcgaaatcggaaaagaaaagctgaaccatatgaaactagccaagggaaaggcactcctaggggacataaaattagtgattactttgagtttgctgggggaagcgcgccaggaaccagccctggcagaagtgttccaccagttgcacgatcctcaccgcaacattccttatccaatcccttaccgcgacgagtagaacagcccctctatggtttagatggcagtgctgcaaaggaggcaacggaggagcagtctgctctgccaaccctcatgtcagtgatgctagcaaaacctcggcttgacacagagcagctggcgcaaaggggagctggcctctgcttcacttttgtttcagctcagcaaaacagtccctcatctacgggatctggcaacacagagcattcctgcagctcccaaaaacagatctccatccagcacagacagacccagtccgacctcacaatagaaaaaatatctgcactagaaaacagtaagaattctgacttagagaagaaggagggaagaatagatgatttattaagagccaactgtgatttgagacggcagattgatgaacagcaaaagatgctagagaaatacaaggaacgattaaatagatgtgtgacaatgagcaagaaactccttatagaaaagtcaaaacaagagaagatggcgtgtagagataagagcatgcaagaccgcttgagactgggccactttactactgtccgacacggagcctcatttactgaacagtggacagatggttatgcttttcagaatcttatcaagcaacaggaaaggataaattcacagagggaagagatagaaagacaacggaaaatgttagcaaagcggaaacctcctgccatgggtcaggcccctcctgcaaccaatgagcagaaacagcggaaaagcaagaccaatggagctgaaaatgaaacgttaacgttagcagaataccatgaacaagaagaaatcttcaaactcagattaggtcatcttaaaaaggaggaagcagagatccaggcagagctggagagactagaaagggttagaaatctacatatcagggaactaaaaaggatacataatgaagataattcacaatttaaagatcatccaacgctaaatgacagatatttgttgttacatcttttgggtagaggaggtttcagtgaagtttacaaggcatttgatctaacagagcaaagatacgtagctgtgaaaattcaccagttaaataaaaactggagagatgagaaaaaggagaattaccacaagcatgcatgtagggaataccggattcataaagagctggatcatcccagaatagttaagctgtatgattacttttcactggatactgactcgttttgtacagtattagaatactgtgagggaaatgatctggacttctacctgaaacagcacaaattaatgtcggagaaagaggcccggtccattatcatgcagattgtgaatgctttaaagtacttaaatgaaataaaacctcccatcatacactatgacctcaaaccaggtaatattcttttagtaaatggtacagcgtgtggagagataaaaattacagattttggtctttcgaagatcatggatgatgatagctacaattcagtggatggcatggagctaacatcacaaggtgctggtacttattggtatttaccaccagagtgttttgtggttgggaaagaaccaccaaagatctcaaataaagttgatgtgtggtcggtgggtgtgatcttctatcagtgtctttatggaaggaagccttttggccataaccagtctcagcaagacatcctacaagagaatacgattcttaaagctactgaagtgcagttcccgccaaagccagtagtaacacctgaagcaaaggcgtttattcgacgatgcttggcctaccgaaaggaggaccgcattgatgtccagcagctggcctgtgatccctacttgttgcctcacatccgaaagtcagtctctacaagtagccctgctggagctgctattgcatcaacctctggggcgtccaataacagttcttctaattgagactgactccaaggccacaaactgttcaacacacacaaagtggacaaatggcgttcagcagcgggtttggaacatagcgaatccgaatggatctgatgaaacctgtaccaggtgcttttattttcttgcttttttcccatccatagagcatgacagcatcgattctcattgaggagaaaccttgggcagctccggccaggccttgtaggaaaaggccccgcccgaggttccagcgtcaacggccactgtgtgtggctgctctgagtgaggaaaaaattaaaaagaaaaactggttccatgtactgtgaacttgaaaacttgcagactcaggggggtccctgatgcagtgcttcagatgaagaatgtggacttgaaaatacagactgggctagtccagtgtctatatttaaacttgttcttttcttttaataaagtttaggtaacatctcctgaaaagcttgtagcacaaaggctcagctggggatggtgtttgacttcggaggaaaaaagttgctattgcccgttaaaggcactagagttagtgttttatccctaaataatttcaatttttaaaaacatgcagcttccctctccccttttttatttttgaaagaatacatttggtcataaagtgaaacccgtattagcaagtacgtggcaatgttcattccaatcagatgcagctttctcctccgtctggtctcctgtttgcaattgcttccctcatctcagtagggaaaaaattgagtgggagtactgagatgtgtgggtttttgccattggacaaagaatgaggttagaagactgcagcttggagtctctctaggttttcaactatttcttcacaatttgaacacttgacggttgtcccttttaatttatttgaagtgctatttttttaaataaaggttcatctgtccatgcagtcctcttggattctctgaatgtagtaactatgaagctatgccaaaggtaggcagaaaatgggcttgggagccagacactccagggatcagtagttcctacccatagtctttgtgtgcttgctaaatggtgtacatttcttgttaaccacgttattaaaacttgatcagcacataagctttcttctgttagatcttttggcagcaaacaaccttccccccaagcctctgaattttgtgggtgtgtggtggtgtgtgtctgtgtgtgcatgtacacacacactttgtctagctcactttaaaagattcatcaaatggaattttaaaaataatctgaaaagaaatagatatttcaggccgggcctggtggttcacgcctgtaatcccagcactttgggaggccgaggtgggtggatcacgaggtcgggagttcgagatcagtctggtcaacatggtgaaacgccatctctactaaaaatataaaaattagcctggcgtggtggcgtgtgcctctagtcccagctacccgggaggctgaggcaggagaatttctggaacccaggaggcggaggttgcagtgagccgagatggcaccactgcaatccagcctaggcaacagaatgagactctgtctcagaaaaaaaaaaaaaaaaaaaaggagaaatagatgtttcaaatatgaacattcttttggcaccaattttcttttttaatttggttgtttctgagatgtatgatcaactgaagatggagctgaaatgggagacgggtggccccaccgtgcccttgaaacagcagagcactcctcagtagagagggagggagccaagagcctgaacatgtggtcgccagcttggaatgttactgacatatgtggcgagggcttagccagaaatatttaaagatgtagtattccggcctgtgagttgtctgggcagggagggggagtcagaaagggtagagagctctcaaataactcatgactctagtgttcctttcacatgtgaacagtgtcactgatgacacattttctaggaccttcgtttgttttgtggacctgcctcagtctcctcagtatcaggcgatcttaagggaagatggagtgtttcaaattggagagaagttcatgggtaggtatcgtcctgtggaattctgaatgcaaggaagtcaaccccagaggccttggtacccccagctttctaaaactactttattacaatttatatgtatatacacatgcacatataaacgtgtgcatttatgtatgtgtgtatagtaccttttttaaaaaaacatttcctccaagctgctaagcaaagggtctcacaggtcgagcacagtgctgagaggatggtgtctgcataatgaagacatggatgaagctgagaccgtgttcaaactcactgaaaacaatgaagttctattccttttttcttcctctccaatgatcttgcagttgatttgtttgttttttaattttttaacatttttttaacgttgaaaaaatgctgcgtctttctttaagccttcccagtaacttcctgccttttttttccccgtgggcttttaagtgaagctgcaggattttatctttcaatctgccctttctacccttgtcctattgaaaggatgccctcttcccttgcttttttggtctagggcctgtttggagctaactaggcttggctgagtccgggcaagaccttcttccgaggcatggacaagccccagagaacatgcagaacattgacctttccattgactgtctttcaagcagccagtgaaatcactaagtggggttcttccatgacatattttgttaatatgggtttcactttttccaagaatagtcccttgttgccacaatgttgatttactttacacaatgacagtatgtattaatttgtaattaaacccatccagattgttttagccttttcccaatggggtgggggagggaagaaggatattaaaataagttttaagaagc

SEQ ID NO: 2414 - DNA, 2511 bp, Homo sapiens
aaggaattttctttttgcagcagaaatgatggaagaattgcatagcctggacccacgacggcaggaattattggaggccaggtttactggagtaggtgttagtaagggaccacttaatagtgagtcttccaaccagagcttgtgcagcgtcggatccttgagtgataaagaagtagagactcccgagaaaaagcagaatgaccagcgaaatcggaaaagaaaagctgaaccatatgaaactagccaagggaaaggcactcctaggggacataaaattagtgattactttgagcgacgagtagaacagcccctctatggtttagatggcagtgctgcaaaggaggcaacggaggagcagtctgctctgccaaccctcatgtcagtgatgctagcaaaacctcggcttgacacagagcagctggcgcaaaggggagctggcctctgcttcacttttgtttcagctcagcaaaacagtccctcatctacgggatctggcaacacagagcattcctgcagctcccaaaaacagatctccatccagcacagacagacccagtccgacctcacaatagaaaaaatatctgcactagaaaacagtaagaattctgacttagagaagaaggagggaagaatagatgatttattaagagccaactgtgatttgagacggcagattgatgaacagcaaaagatgctagagaaatacaaggaacgattaaatagatgtgtgacaatgagcaagaaactccttatagaaaagtcaaaacaagagaagatggcgtgtagagataagagcatgcaagaccgcttgagactgggccactttactactgtccgacacggagcctcatttactgaacagtggacagatggttatgcttttcagaatcttatcaagcaacaggaaaggataaattcacagagggaagagatagaaagacaacggaaaatgttagcaaagcggaaacctcctgccatgggtcaggcccctcctgcaaccaatgagcagaaacagcggaaaagcaagaccaatggagctgaaaatgaaacgttaacgttagcagaataccatgaacaagaagaaatcttcaaactcagattaggtcatcttaaaaaggaggaagcagagatccaggcagagctggagagactagaaagggttagaaatctacatatcagggaactaaaaaggatacataatgaagataattcacaatttaaagatcatccaacgctaaatgacagatatttgttgttacatcttttgggtagaggaggtttcagtgaagtttacaaggcatttgatctaacagagcaaagatacgtagctgtgaaaattcaccagttaaataaaaactggagagatgagaaaaaggagaattaccacaagcatgcatgtagggaataccggattcataaagagctggatcatcccagaatagttaagctgtatgattacttttcactggatactgactcgttttgtacagtattagaatactgtgagggaaatgatctggacttctacctgaaacagcacaaattaatgtcggagaaagaggcccggtccattatcatgcagattgtgaatgctttaaagtacttaaatgaaataaaacctcccatcatacactatgacctcaaaccaggtaatattcttttagtaaatggtacagcgtgtggagagataaaaattacagattttggtctttcgaagatcatggatgatgatagctacaattcagtggatggcatggagctaacatcacaaggtgctggtacttattggtatttaccaccagagtgttttgtggttgggaaagaaccaccaaagatctcaaataaagttgatgtgtggtcggtgggtgtgatcttctatcagtgtctttatggaaggaagccttttggccataaccagtctcagcaagacatcctacaagagaatacgattcttaaagctactgaagtgcagttcccgccaaagccagtagtaacacctgaagcaaaggcgtttattcgacgatgcttggcctaccgaaaggaggaccgcattgatgtccagcagctggcctgtgatccctacttgttgcctcacatccgaaagtcagtctctacaagtagccctgctggagctgctattgcatcaacctctggggcgtccaataacagttcttctaattgagactgactccaaggccacaaactgttcaacacacacaaagtggacaaatggcgttcagcagcgggtttggaacatagcgaatccgaatggatctgatgaaacctgtaccaggtgcttttattttcttgcttttttcccatccatagagcatgacagcatcgattctcattgaggagaaaccttgggcagctccggccaggccttgtaggaaaaggccccgcccgaggttccagcgtcaacggccactgtgtgtggctgctctgagtgaggaaaaaattaaaaagaaaaactggttccatgtactgtgaacttgaaaacttgcagactca

SEQ ID NO: 2415 - DNA, 2487 bp, Homo sapiens
actgcccgcgggagccgccgccgccgccgccgcgcccgccatggacgtccgcctgtacccctcggcgcccgcggtgggcgcgcggcccggggccgagccggccggcctggcgcacctggactattaccacggcggcaagtttgatggtgacagtgcctacgtggggatgagtgacggaaacccagagctcctgtcaaccagccagacctacaacggccagagcgagaacaacgaagactatgagatccccccgataacacctcccaacctcccggagccatccctcctgcacctgggggaccacgaagccagctaccactcgctgtgccacggcctcacccccaacggtctgctccctgcctactcctatcaggccatggacctcccagccatcatggtgtccaacatgctagcacaggacagccacctgctgtcgggccagctgcccacgatccaggagatggtccactcggaagtggctgcctatgactcgggccggcccgggcccctgctgggtcgcccggcaatgctggccagccacatgagtgccctcagccagtcccagctcatctcgcagatgggcatccggagcagcatcgcccacagctccccatcaccgccggggagcaagtcagcgaccccctctccctccagctccactcaggaagaggagtcggaagtgcatttcaagatctcgggagaaaagagaccttcagccgacccaggaaaaaaggccaagaacccgaagaagaagaaaaagaaggaccccaatgagccgcagaagcctgtgtcggcctacgcactcttcttcagagacactcaggccgccatcaagggtcagaaccccagtgccactttcggtgacgtgtccaaaatcgtggcctccatgtgggacagcctgggagaggaacagaagcaggcctacaagaggaagacagaagcagcaaagaaggaatatctgaaggccctggcagcctaccgggctagcctcgtctccaagagctccccagatcaaggtgagaccaagagcactcaggcaaacccaccagccaaaatgctcccacccaagcagcccatgtatgccatgccaggcctggcctccttcctgacgccgtcggacctgcaggccttccgcagtggggcctcccctgccagcctcgcccggacgctgggctccaagtctctgctgccaggcctcagtgcgtccccgccgccgccaccctccttcccgctcagccccacactgcaccagcagctgtcactgccccctcacgcccagggcgccctcctcagtccacctgttagcatgtccccagccccccagccccctgtcctgcccacccccatggcactccaggtgcagctggcgatgagcccctcacctccagggccacaggacttcccgcacatctctgagttccccagcagctcgggatcctgctcacctggcccatccaaccccaccagcagcggggactgggacagcagctaccccagtggggagtgtggcatcagcacctgcagcctgctccccagggacaaatcgctctacctcacctaatcccgcctccctaccatccctgaggctcgctggaaggcactgctcagagcctgaagggctgacagcagaaaagaggccctggccagaggcagggtggcccatcggagagagcagtgacacacccattgcccgggggctgagtctcttcctcaacctcccaccagactctgcagaggcagcccactgcccaccaccagcccaaagaacctgcaggaaccttccgcccgctgacctgcttgctccagggtaactgtggaccctgtcctcgccctgcgcacggtaccctatgtctggacacccggccccagctccagccccagcccaggtgggccgcccctggcggggtcgcttaccaacggacacccaccccagatgcatgggccagagggccggcccccggcatagatgtgcacatcggttttccagtgtgaacaaaagattacgaaacctagaaactgttggttccgtgtaagtagttgactacgtgttttagaactgtgctgaagacatctgtaagactattttgtgggggaaaaaagtagtttcctttaaggtaaaaagcattttatatgatccttagcacatttttaagttttatcttaagggagacgcgcacaaaagcggctgccaaaccgtttcgtcatcctcacagcaaggaccggacgcttgctagccaccccggagcactgctctccttttaatcatgtattcatctattttaaattgccggcgacgacttttgtctatttatgaagaaaccttgagaacgaagttacagcttatcctaccgtgtgtgtggttttggggtttcgtttgggtttgggttcttgacgtcgtttgcagctgtttcctggccctggcgagtgtctgtcttggtgcccagtgcttctctcaaatctctttataataaaacttctgaaaagctg

SEQ ID NO: 2416 - DNA, 2605 bp, Homo sapiens
accaggagctccgaacacgcaggcccaaattggaataggagatggattttgataaaagaggttaaataacaggtttttccatttcaccttatacgaatgggatggggggtgggggtgctgggcctccagccaatagaggaccaagagttgtcaggagggcttataaagcttgctatttctggcattttttcctctttctctgctgattatgcagcagactcgcacagaggctgtcgcgggcgcgttctctcgctgcctgggcttctgtggaatgagactcgggctccttctacttgcaagacactggtgcattgcaggtgtgtttccgcagaagtttgatggtgacagtgcctacgtggggatgagtgacggaaacccagagctcctgtcaaccagccagacctacaacggccagagcgagaacaacgaagactatgagatccccccgataacacctcccaacctcccggagccatccctcctgcacctgggggaccacgaagccagctaccactcgctgtgccacggcctcacccccaacggtctgctccctgcctactcctatcaggccatggacctcccagccatcatggtgtccaacatgctagcacaggacagccacctgctgtcgggccagctgcccacgatccaggagatggtccactcggaagtggctgcctatgactcgggccggcccgggcccctgctgggtcgcccggcaatgctggccagccacatgagtgccctcagccagtcccagctcatctcgcagatgggcatccggagcagcatcgcccacagctccccatcaccgccggggagcaagtcagcgaccccctctccctccagctccactcaggaagaggagtcggaagtgcatttcaagatctcgggagaaaagagaccttcagccgacccaggaaaaaaggccaagaacccgaagaagaagaaaaagaaggaccccaatgagccgcagaagcctgtgtcggcctacgcactcttcttcagagacactcaggccgccatcaagggtcagaaccccagtgccactttcggtgacgtgtccaaaatcgtggcctccatgtgggacagcctgggagaggaacagaagcagagctccccagatcaaggtgagaccaagagcactcaggcaaacccaccagccaaaatgctcccacccaagcagcccatgtatgccatgccaggcctggcctccttcctgacgccgtcggacctgcaggccttccgcagtggggcctcccctgccagcctcgcccggacgctgggctccaagtctctgctgccaggcctcagtgcgtccccgccgccgccaccctccttcccgctcagccccacactgcaccagcagctgtcactgccccctcacgcccagggcgccctcctcagtccacctgttagcatgtccccagccccccagccccctgtcctgcccacccccatggcactccaggtgcagctggcgatgagcccctcacctccagggccacaggacttcccgcacatctctgagttccccagcagctcgggatcctgctcacctggcccatccaaccccaccagcagcggggactgggacagcagctaccccagtggggagtgtggcatcagcacctgcagcctgctccccagggacaaatcgctctacctcacctaatcccgcctccctaccatccctgaggctcgctggaaggcactgctcagagcctgaagggctgacagcagaaaagaggccctggccagaggcagggtggcccatcggagagagcagtgacacacccattgcccgggggctgagtctcttcctcaacctcccaccagactctgcagaggcagcccactgcccaccaccagcccaaagaacctgcaggaaccttccgcccgctgacctgcttgctccagggtaactgtggaccctgtcctcgccctgcgcacggtaccctatgtctggacacccggccccagctccagccccagcccaggtgggccgcccctggcggggtcgcttaccaacggacacccaccccagatgcatgggccagagggccggcccccggcatagatgtgcacatcggttttccagtgtgaacaaaagattacgaaacctagaaactgttggttccgtgtaagtagttgactacgtgttttagaactgtgctgaagacatctgtaagactattttgtgggggaaaaaagtagtttcctttaaggtaaaaagcattttatatgatccttagcacatttttaagttttatcttaagggagacgcgcacaaaagcggctgccaaaccgtttcgtcatcctcacagcaaggaccggacgcttgctagccaccccggagcactgctctccttttaatcatgtattcatctattttaaattgccggcgacgacttttgtctatttatgaagaaaccttgagaacgaagttacagcttatcctaccgtgtgtgtggttttggggtttcgtttgggtttgggttcttgacgtcgtttgcagctgtttcctggccctggcgagtgtctgtcttggtgcccagtgcttctctcaaatctctttataataaaacttctgaaaagctgaaaa

SEQ ID NO: 2417 - DNA, 2010 bp, Homo sapiens
actgcccgcgggagccgccgccgccgccgccgcgcccgccatggacgtccgcctgtacccctcggcgcccgcggtgggcgcgcggcccggggccgagccggccggcctggcgcacctggactattaccacggcggcaagtttgatggtgacagtgcctacgtggggatgagtgacggaaacccagagctcctgtcaaccagccagacctacaacggccagagcgagaacaacgaagactatgagatccccccgataacacctcccaacctcccggagccatccctcctgcacctgggggaccacgaagccagctaccactcgctgtgccacggcctcacccccaacggtctgctccctgcctactcctatcaggccatggacctcccagccatcatggtgtccaacatgctagcacaggacagccacctgctgtcgggccagctgcccacgatccaggagatggtccactcggaagtggctgcctatgactcgggccggcccgggcccctgctgggtcgcccggcaatgctggccagccacatgagtgccctcagccagtcccagctcatctcgcagatgggcatccggagcagcatcgcccacagctccccatcaccgccggggagcaagtcagcgaccccctctccctccagctccactcaggaagaggagtcggaagtgcatttcaagatctcgggagaaaagagaccttcagccgacccaggaaaaaaggccaagaacccgaagaagaagaaaaagaaggaccccaatgagccgcagaagcctgtgtcggcctacgcactcttcttcagagacactcaggccgccatcaagggtcagaaccccagtgccactttcggtgacgtgtccaaaatcgtggcctccatgtgggacagcctgggagaggaacagaagcaggacttcccgcacatctctgagttccccagcagctcgggatcctgctcacctggcccatccaaccccaccagcagcggggactgggacagcagctaccccagtggggagtgtggcatcagcacctgcagcctgctccccagggacaaatcgctctacctcacctaatcccgcctccctaccatccctgaggctcgctggaaggcactgctcagagcctgaagggctgacagcagaaaagaggccctggccagaggcagggtggcccatcggagagagcagtgacacacccattgcccgggggctgagtctcttcctcaacctcccaccagactctgcagaggcagcccactgcccaccaccagcccaaagaacctgcaggaaccttccgcccgctgacctgcttgctccagggtaactgtggaccctgtcctcgccctgcgcacggtaccctatgtctggacacccggccccagctccagccccagcccaggtgggccgcccctggcggggtcgcttaccaacggacacccaccccagatgcatgggccagagggccggcccccggcatagatgtgcacatcggttttccagtgtgaacaaaagattacgaaacctagaaactgttggttccgtgtaagtagttgactacgtgttttagaactgtgctgaagacatctgtaagactattttgtgggggaaaaaagtagtttcctttaaggtaaaaagcattttatatgatccttagcacatttttaagttttatcttaagggagacgcgcacaaaagcggctgccaaaccgtttcgtcatcctcacagcaaggaccggacgcttgctagccaccccggagcactgctctccttttaatcatgtattcatctattttaaattgccggcgacgacttttgtctatttatgaagaaaccttgagaacgaagttacagcttatcctaccgtgtgtgtggttttggggtttcgtttgggtttgggttcttgacgtcgtttgcagctgtttcctggccctggcgagtgtctgtcttggtgcccagtgcttctctcaaatctctttataataaaacttctgaaaagctg

SEQ ID NO: 2418 - DNA, 2519 bp, Homo sapiens
cgcagccctggcgcagacgcgtgggctccgtggcgatgcggggtgttgcctgaggctccactgaagctatggcataatttgcagaatttgcacttcattacttttctgaaattcaaacaaattctgaaactgcacgagttctggctgagagctgtggatctgtgcattttgatggtgacagtgcctacgtggggatgagtgacggaaacccagagctcctgtcaaccagccagacctacaacggccagagcgagaacaacgaagactatgagatccccccgataacacctcccaacctcccggagccatccctcctgcacctgggggaccacgaagccagctaccactcgctgtgccacggcctcacccccaacggtctgctccctgcctactcctatcaggccatggacctcccagccatcatggtgtccaacatgctagcacaggacagccacctgctgtcgggccagctgcccacgatccaggagatggtccactcggaagtggctgcctatgactcgggccggcccgggcccctgctgggtcgcccggcaatgctggccagccacatgagtgccctcagccagtcccagctcatctcgcagatgggcatccggagcagcatcgcccacagctccccatcaccgccggggagcaagtcagcgaccccctctccctccagctccactcaggaagaggagtcggaagtgcatttcaagatctcgggagaaaagagaccttcagccgacccaggaaaaaaggccaagaacccgaagaagaagaaaaagaaggaccccaatgagccgcagaagcctgtgtcggcctacgcactcttcttcagagacactcaggccgccatcaagggtcagaaccccagtgccactttcggtgacgtgtccaaaatcgtggcctccatgtgggacagcctgggagaggaacagaagcaggcctacaagaggaagacagaagcagcaaagaaggaatatctgaaggccctggcagcctaccgggctagcctcgtctccaagagctccccagatcaaggtgagaccaagagcactcaggcaaacccaccagccaaaatgctcccacccaagcagcccatgtatgccatgccaggcctggcctccttcctgacgccgtcggacctgcaggccttccgcagtggggcctcccctgccagcctcgcccggacgctgggctccaagtctctgctgccaggcctcagtgcgtccccgccgccgccaccctccttcccgctcagccccacactgcaccagcagctgtcactgccccctcacgcccagggcgccctcctcagtccacctgttagcatgtccccagccccccagccccctgtcctgcccacccccatggcactccaggtgcagctggcgatgagcccctcacctccagggccacaggacttcccgcacatctctgagttccccagcagctcgggatcctgctcacctggcccatccaaccccaccagcagcggggactgggacagcagctaccccagtggggagtgtggcatcagcacctgcagcctgctccccagggacaaatcgctctacctcacctaatcccgcctccctaccatccctgaggctcgctggaaggcactgctcagagcctgaagggctgacagcagaaaagaggccctggccagaggcagggtggcccatcggagagagcagtgacacacccattgcccgggggctgagtctcttcctcaacctcccaccagactctgcagaggcagcccactgcccaccaccagcccaaagaacctgcaggaaccttccgcccgctgacctgcttgctccagggtaactgtggaccctgtcctcgccctgcgcacggtaccctatgtctggacacccggccccagctccagccccagcccaggtgggccgcccctggcggggtcgcttaccaacggacacccaccccagatgcatgggccagagggccggcccccggcatagatgtgcacatcggttttccagtgtgaacaaaagattacgaaacctagaaactgttggttccgtgtaagtagttgactacgtgttttagaactgtgctgaagacatctgtaagactattttgtgggggaaaaaagtagtttcctttaaggtaaaaagcattttatatgatccttagcacatttttaagttttatcttaagggagacgcgcacaaaagcggctgccaaaccgtttcgtcatcctcacagcaaggaccggacgcttgctagccaccccggagcactgctctccttttaatcatgtattcatctattttaaattgccggcgacgacttttgtctatttatgaagaaaccttgagaacgaagttacagcttatcctaccgtgtgtgtggttttggggtttcgtttgggtttgggttcttgacgtcgtttgcagctgtttcctggccctggcgagtgtctgtcttggtgcccagtgcttctctcaaatctctttataataaaacttctgaaaagctgaaaa

SEQ ID NO: 2419 - DNA, 1271 bp, Homo sapiens
cgaagaagaagaaaaagaaggaccccaatgagccgcagaagcctgtgtcggcctacgcactcttcttcagagacactcaggccgccatcaagggtcagaaccccagtgccactttcggtgacgtgtccaaaatcgtggcctccatgtgggacagcctgggagaggaacagaagcaggacttcccgcacatctctgagttccccagcagctcgggatcctgctcacctggcccatccaaccccaccagcagcggggactgggacagcagctaccccagtggggagtgtggcatcagcacctgcagcctgctccccagggacaaatcgctctacctcacctaatcccgcctccctaccatccctgaggctcgctggaaggcactgctcagagcctgaagggctgacagcagaaaagaggccctggccagaggcagggtggcccatcggagagagcagtgacacacccattgcccgggggctgagtctcttcctcaacctcccaccagactctgcagaggcagcccactgcccaccaccagcccaaagaacctgcaggaaccttccgcccgctgacctgcttgctccagggtaactgtggaccctgtcctcgccctgcgcacggtaccctatgtctggacacccggccccagctccagccccagcccaggtgggccgcccctggcggggtcgcttaccaacggacacccaccccagatgcatgggccagagggccggcccccggcatagatgtgcacatcggttttccagtgtgaacaaaagattacgaaacctagaaactgttggttccgtgtaagtagttgactacgtgttttagaactgtgctgaagacatctgtaagactattttgtgggggaaaaaagtagtttcctttaaggtaaaaagcattttatatgatccttagcacatttttaagttttatcttaagggagacgcgcacaaaagcggctgccaaaccgtttcgtcatcctcacagcaaggaccggacgcttgctagccaccccggagcactgctctccttttaatcatgtattcatctattttaaattgccggcgacgacttttgtctatttatgaagaaaccttgagaacgaagttacagcttatcctaccgtgtgtgtggttttggggtttcgtttgggtttgggttcttgacgtcgtttgcagctgtttcctggccctggcgagtgtctgtcttggtgcccagtgcttctctcaaatctctttataataaaacttctgaaaagctgaaaa

SEQ ID NO: 2420 - DNA, 2415 bp, Homo sapiens
gattgaacagcgcgcgtgggtttcccgcagccctggcgcagacgcgtgggctccgtggcgatgcgggtttgatggtgacagtgcctacgtggggatgagtgacggaaacccagagctcctgtcaaccagccagacctacaacggccagagcgagaacaacgaagactatgagatccccccgataacacctcccaacctcccggagccatccctcctgcacctgggggaccacgaagccagctaccactcgctgtgccacggcctcacccccaacggtctgctccctgcctactcctatcaggccatggacctcccagccatcatggtgtccaacatgctagcacaggacagccacctgctgtcgggccagctgcccacgatccaggagatggtccactcggaagtggctgcctatgactcgggccggcccgggcccctgctgggtcgcccggcaatgctggccagccacatgagtgccctcagccagtcccagctcatctcgcagatgggcatccggagcagcatcgcccacagctccccatcaccgccggggagcaagtcagcgaccccctctccctccagctccactcaggaagaggagtcggaagtgcatttcaagatctcgggagaaaagagaccttcagccgacccaggaaaaaaggccaagaacccgaagaagaagaaaaagaaggaccccaatgagccgcagaagcctgtgtcggcctacgcactcttcttcagagacactcaggccgccatcaagggtcagaaccccagtgccactttcggtgacgtgtccaaaatcgtggcctccatgtgggacagcctgggagaggaacagaagcaggcctacaagaggaagacagaagcagcaaagaaggaatatctgaaggccctggcagcctaccgggctagcctcgtctccaagagctccccagatcaaggtgagaccaagagcactcaggcaaacccaccagccaaaatgctcccacccaagcagcccatgtatgccatgccaggcctggcctccttcctgacgccgtcggacctgcaggccttccgcagtggggcctcccctgccagcctcgcccggacgctgggctccaagtctctgctgccaggcctcagtgcgtccccgccgccgccaccctccttcccgctcagccccacactgcaccagcagctgtcactgccccctcacgcccagggcgccctcctcagtccacctgttagcatgtccccagccccccagccccctgtcctgcccacccccatggcactccaggtgcagctggcgatgagcccctcacctccagggccacaggacttcccgcacatctctgagttccccagcagctcgggatcctgctcacctggcccatccaaccccaccagcagcggggactgggacagcagctaccccagtggggagtgtggcatcagcacctgcagcctgctccccagggacaaatcgctctacctcacctaatcccgcctccctaccatccctgaggctcgctggaaggcactgctcagagcctgaagggctgacagcagaaaagaggccctggccagaggcagggtggcccatcggagagagcagtgacacacccattgcccgggggctgagtctcttcctcaacctcccaccagactctgcagaggcagcccactgcccaccaccagcccaaagaacctgcaggaaccttccgcccgctgacctgcttgctccagggtaactgtggaccctgtcctcgccctgcgcacggtaccctatgtctggacacccggccccagctccagccccagcccaggtgggccgcccctggcggggtcgcttaccaacggacacccaccccagatgcatgggccagagggccggcccccggcatagatgtgcacatcggttttccagtgtgaacaaaagattacgaaacctagaaactgttggttccgtgtaagtagttgactacgtgttttagaactgtgctgaagacatctgtaagactattttgtgggggaaaaaagtagtttcctttaaggtaaaaagcattttatatgatccttagcacatttttaagttttatcttaagggagacgcgcacaaaagcggctgccaaaccgtttcgtcatcctcacagcaaggaccggacgcttgctagccaccccggagcactgctctccttttaatcatgtattcatctattttaaattgccggcgacgacttttgtctatttatgaagaaaccttgagaacgaagttacagcttatcctaccgtgtgtgtggttttggggtttcgtttgggtttgggttcttgacgtcgtttgcagctgtttcctggccctggcgagtgtctgtcttggtgcccagtgcttctctcaaatctctttataataaaacttctgaaaagctg

SEQ ID NO: 2421 - DNA, 2262 bp, Homo sapiens
gtttccaagagggaagcaggaggctggcttcacttggttcccagacatctcatgagtgccggctgcctgcccagccctctgcctggtgctgggaggcaggtgtctctgcacttgagcagatgccgggaggcaacgtgtggagagctctgccagaggcttggaaagagggtgaggccagaggatggagcaggagagggaaggcttctctgaggaggtgacatttcagatccaggagatggtccactcggaagtggctgcctatgactcgggccggcccgggcccctgctgggtcgcccggcaatgctggccagccacatgagtgccctcagccagtcccagctcatctcgcagatgggcatccggagcagcatcgcccacagctccccatcaccgccggggagcaagtcagcgaccccctctccctccagctccactcaggaagaggagtcggaagtgcatttcaagatctcgggagaaaagagaccttcagccgacccaggaaaaaaggccaagaacccgaagaagaagaaaaagaaggaccccaatgagccgcagaagcctgtgtcggcctacgcactcttcttcagagacactcaggccgccatcaagggtcagaaccccagtgccactttcggtgacgtgtccaaaatcgtggcctccatgtgggacagcctgggagaggaacagaagcaggcctacaagaggaagacagaagcagcaaagaaggaatatctgaaggccctggcagcctaccgggctagcctcgtctccaagagctccccagatcaaggtgagaccaagagcactcaggcaaacccaccagccaaaatgctcccacccaagcagcccatgtatgccatgccaggcctggcctccttcctgacgccgtcggacctgcaggccttccgcagtggggcctcccctgccagcctcgcccggacgctgggctccaagtctctgctgccaggcctcagtgcgtccccgccgccgccaccctccttcccgctcagccccacactgcaccagcagctgtcactgccccctcacgcccagggcgccctcctcagtccacctgttagcatgtccccagccccccagccccctgtcctgcccacccccatggcactccaggtgcagctggcgatgagcccctcacctccagggccacaggacttcccgcacatctctgagttccccagcagctcgggatcctgctcacctggcccatccaaccccaccagcagcggggactgggacagcagctaccccagtggggagtgtggcatcagcacctgcagcctgctccccagggacaaatcgctctacctcacctaatcccgcctccctaccatccctgaggctcgctggaaggcactgctcagagcctgaagggctgacagcagaaaagaggccctggccagaggcagggtggcccatcggagagagcagtgacacacccattgcccgggggctgagtctcttcctcaacctcccaccagactctgcagaggcagcccactgcccaccaccagcccaaagaacctgcaggaaccttccgcccgctgacctgcttgctccagggtaactgtggaccctgtcctcgccctgcgcacggtaccctatgtctggacacccggccccagctccagccccagcccaggtgggccgcccctggcggggtcgcttaccaacggacacccaccccagatgcatgggccagagggccggcccccggcatagatgtgcacatcggttttccagtgtgaacaaaagattacgaaacctagaaactgttggttccgtgtaagtagttgactacgtgttttagaactgtgctgaagacatctgtaagactattttgtgggggaaaaaagtagtttcctttaaggtaaaaagcattttatatgatccttagcacatttttaagttttatcttaagggagacgcgcacaaaagcggctgccaaaccgtttcgtcatcctcacagcaaggaccggacgcttgctagccaccccggagcactgctctccttttaatcatgtattcatctattttaaattgccggcgacgacttttgtctatttatgaagaaaccttgagaacgaagttacagcttatcctaccgtgtgtgtggttttggggtttcgtttgggtttgggttcttgacgtcgtttgcagctgtttcctggccctggcgagtgtctgtcttggtgcccagtgcttctctcaaatctctttataataaaacttctgaaaagctg

SEQ ID NO: 2422 - DNA, 687 bp, Homo sapiens
agccgccgccgccgccgccgcgcccgccatggacgtccgcctgtacccctcggcgcccgcggtgggcgcgcggcccggggccgagccggccggcctggcgcacctggactattaccacggcggcaagtttgatggtgacagtgcctacgtggggatgagtgacggaaacccagagctcctgtcaaccagccagacctacaacggccagagcgagaacaacgaagactatgagatccccccgataacacctcccaacctcccggagccatccctcctgcacctgggggaccacgaagccagctaccactcgctgtgccacggcctcacccccaacggtctgctccctgcctactcctatcaggccatggacctcccagccatcatggtgtccaacatgctagcacaggacagccacctgctgtcgggccagctgcccacgatccaggagatggtccactcggaagtggctgcctatgactcgggccggcccgggcccctgctgggtcgcccggcaatgctggccagccacatgagtgccctcagccagtcccagctcatctcgcagatgggcatccggagcagcatcgcccacagctccccatcaccgccggggagcaagtcagcgaccccctctccctccagctccactcaggaagaggagtcggaagtgcatttcaagatctcggg

SEQ ID NO: 2423 - DNA, 2012 bp, Homo sapiens
ggttggagctgttgcgccgagcagtcatggcggcggccagagctactacgccggccgatggcgaggagcccgccccggaggctgaggctctggccgcagcccgggagcggagcagccgcttcttgagcggcctggagctggtgaagcagggtgccgaggcgcgcgtgttccgtggccgcttccagggccgcgcggcggtgatcaagcaccgcttccccaagggctaccggcacccggcgctggaggcgcggcttggcagacggcggacggtgcaggaggcccgggcgctcctccgctgtcgccgcgctggtaaggaatatctgccccagttgtcttttttgtggactatgcttccaactgcttatatatggaagaaattgaaggctcagtgactgttcgagattatattcagtccactatggagactgaaaaaactccccagggtctctccaacttagccaagacaattgggcaggttttggctcgaatgcacgatgaagacctcattcatggtgatctcaccacctccaacatgctcctgaaaccccccctggaacagctgaacattgtgctcatagactttgggctgagtttcatttcagcacttccagaggataagggagtagacctctatgtcctggagaaggccttcctcagtacccatcccaacactgaaactgtgtttgaagcctttctgaagagctactccacctcctccaaaaaggccaggccagtgctaaaaaaattagatgaagtgcgcctgagaggaagaaagaggtccatggttgggtagaagaatgtgtatgacaaccacacacagtgaagctcttttttcaaagtaaatttgaagaaatgctacaagtatgagatgagatctaagtaaaggtgttaagatatttttaagtggtatgtgatcgtgtcattatcatctgcacttcactcaagagcttactatgtgtctaagtcatgttctaggcagaattgggtatttaaagtaaattgaggacaggcttctcccagattgtgacatgtatatctcagatacatgggtgtggcattgaaccacataatgagaacattattctctttttagtccttgtgagacaaggatgaagtctcagttgctgatactcgctgagcttactggccctctaacccagtgtttttttttgttgttgttgtgtacatgttatatttattttgaaaccagtttaatgggatacaaccagcattttaaaaaatgaaatagaatacagcatggaaaatatcagtgtattgttttatgaaactttcacgtgtatatatagaccaaggatatgtgctgagttttgatgtcaaatatatttctctttcagggtcatgatcaaaaaatgaaaagtctgcttaactccaatttctcttttaaaaaagcagacttacagctttcaggcaactgaaattcatgttaacatgtttttatttttattgctttgtatttttgtggttaccttctaagacaagtgattgatctaaagttccttttaagtttataccgctaaacaaactgagttgatttctatcacaggcagtaagtaggtagagcaaaaatggtgaagtgacttgtgaagactgaagtttgatgaagtctggtttaaggcacaggtaaactgagtgtggatgcaaaagtaccaggagctagcttttaaccttgcccagcctcagtttcttttcttagaagaagctatgtttgggtgggaagggaagagagggataagaaaatacctttcttccttgtaaactccaatcaacaaacatattttgagtgccttttgtgttccttggcaccctgttgggtattgggtacttggcaccctgttgggtattgggtacaatggtgagccagacagacacagcgcctgtccttttgtaagaatatttatttttataaaaaagtataaagtatacagtgggatgttttgatatacattatgaaatgattgctacagctgagctaattaacacccatcacctca

SEQ ID NO: 2424 - DNA, 3515 bp, Homo sapiens
gaaagagacgaccaactgagaggtgggcccccaaagccggctgcgagagtcaccgaagatttccggagagccaaggagtcgggaagagccacttactgagcgttgccgaacgtgtacggagatagccgaagaggcggaaggcggggccacaagagcccttcctgcagggaacctcaggcttcagagagccgaaaagttgggaggcgtaaccacttacaggccggaagtgtccggggtggacgcattcgggtagccgaagaagtcccaggattgccgaagaagtcccaggatttccgaagcgagccgaagcatcgcgacagttttcagagacagctgatcggttggagctgttgcgccgagcagtcatggcggcggccagagctactacgccggccgatggcgaggagcccgccccggaggctgaggctctggccgcagcccgggagcggagcagccgcttcttgagcggcctggagctggtgaagcagggtgccgaggcgcgcgtgttccgtggccgcttccagggccgcgcggcggtgatcaagcaccgcttccccaagggctaccggcacccggcgctggaggcgcggcttggcagacggcggacggtgcaggaggcccgggcgctcctccgctgtcgccgcgctggaatatctgccccagttgtcttttttgtggactatgcttccaactgcttatatatggaagaaattgaaggctcagtgactgttcgagattatattcagtccactatggagactgaaaaaactccccagggtctctccaacttagccaagacaattgggcaggttttggctcgaatgcacgatgaagacctcattcatggtgatctcaccacctccaacatgctcctgaaaccccccctggaacagctgaacattgtgctcatagactttgggctgagtttcatttcagcacttccagaggataagggagtagacctctatgtcctggagaaggccttcctcagtacccatcccaacactgaaactgtgtttgaagcctttctgaagagctactccacctcctccaaaaaggccaggccagtgctaaaaaaattagatgaagtgcgcctgagaggaagaaagaggtccatggttgggtagaagaatgtgtatgacaaccacacacagtgaagctcttttttcaaagtaaatttgaagaaatgctacaagtatgagatgagatctaagtaaaggtgttaagatatttttaagtggtatgtgatcgtgtcattatcatctgcacttcactcaagagcttactatgtgtctaagtcatgttctaggcagaattgggtatttaaagtaaattgaggacaggcttctcccagattgtgacatgtatatctcagatacatgggtgtggcattgaaccacataatgagaacattattctctttttagtccttgtgagacaaggatgaagtctcagttgctgatactcgctgagcttactggccctctaacccagtgtttttttttgttgttgttgtgtacatgttatatttattttgaaaccagtttaatgggatacaaccagcattttaaaaaatgaaatagaatacagcatggaaaatatcagtgtattgttttatgaaactttcacgtgtatatatagaccaaggatatgtgctgagttttgatgtcaaatatatttctctttcagggtcatgatcaaaaaatgaaaagtctgcttaactccaatttctcttttaaaaaagcagacttacagctttcaggcaactgaaattcatgttaacatgtttttatttttattgctttgtatttttgtggttaccttctaagacaagtgattgatctaaagttccttttaagtttataccgctaaacaaactgagttgatttctatcacaggcagtaagtaggtagagcaaaaatggtgaagtgacttgtgaagactgaagtttgatgaagtctggtttaaggcacaggtaaactgagtgtggatgcaaaagtaccaggagctagcttttaaccttgcccagcctcagtttcttttcttagaagaagctatgtttgggtgggaagggaagagagggataagaaaatacctttcttccttgtaaactccaatcaacaaacatattttgagtgccttttgtgttccttggcaccctgttgggtattgggtacttggcaccctgttgggtattgggtacaatggtgagccagacagacacagcgcctgtccttttgtaagaatatttatttttataaaaaagtataaagtatacagtgggatgttttgatatacattatgaaatgattgctacagctgagctaattaacacccatcacctcacatagttactgtcttgtttcttaatatggacatttgcagctatgaatttccctctgcacactgttgtcatcacacactctcagttttggtattttgtgtttttgttttcattcatctcaaagtattttctaatttcccttgtgatttcttctttgaccccttgattgtttagaaatctgttaatttccacacatttgtaaatgttccaatttttcttttgttattgccagcttcattccattgtgttcagagatgatacagtcagtgcctgttcttatgaagcaaacattctataatagtaggaccagtaccctgtctgtttcattcaccacagtcagcatgccccaagtgcccagcatggggcggatggccaggaatgagtgaaaacttcccttcctgggtagttgtgactagtagagaggaaaaataatataattgcctgcttactgcatgccaggcattgggctgggaatttttatattggatctaaaataactcttaagttaggcattatccccattttatagatggagaaactggccccaaaaggtgggaacttgtccaagacgtcacaggtagcaagaggtacttttacctggctccaaatctgtgttctttccactgacaaatgagatatgggatatggtgcatctttacagtactataataagtattggcgtataacattattttcaaggaactccaagggccacaggagctgacaggtttttcaattaatattcccaacatgaatgagatgcctcattcctcagtttcctcacgtgtactataaggctagtacctgctttgttggggtatggttggctcgtgtgcattaagtcaacaaatccctagttgatagggtttggctgtgtccccatccaaatctcatcttgaattgttcccgtaatccccacgtgacatgggagggacccagtgggaggtaatttaatcctcggggcggctacctccgtgctgttctcgtgatagcgagtgagttctcacgagatctgatggttttataaggggcttttccctcttgttcggcacttcctgctgccacgtggagaagggtgtgtttgtttccccatctgccatgattataagttttctgaggcatccccagccatgctgaactgtgagttattaaacttttcctttataaatta

SEQ ID NO: 2425 - DNA, 1955 bp, Homo sapiens
ggtgagtcatgcttcaggtttgccagggcctgtgtcccgcaaaaaggcgagcccttattcccagcggaagcccaccccggctcgcggcagctttccggtgcgccctgggcggcgtagatccgaaggagtattgtgaggattgagatgactggagtgtgtgtggcctggagagttgctcaataaatatatgttgccttccactgtgaagagagtctcgctctgtcgccaggttggagtgcagtggcatgatctcggctcaccgcaaactctgcctcccgggttcaagcaattctcctgcctcggccttccgagtagctgggactacagctgtaaagatgtctgacaagaaccagatagctgccagagcttctcttattgagcaactgatgtccaaaaggaattttgaggatcttggcaaccaccttactgagctagaaacaatttatgtgactaaggagcatctccaggagacagatgtggtcagagctgtgtacagagtcctcaaaaactgcccctctgtggctttgaaaaagaaagccaagtgtttgctatcaaagtggaaagctgtttataagcagactcactccaaagcgaggaacagccctaaattatttcctgtgaggggtaataaagaagaaaattcaggaccttctcatgacccaagtcagaatgagacactgggcatctgcagctcgaattctctgtcttcccaagacgttgcaaaactcagtgaaatgattgtgcctgaaaatagagccattcaattgaaacctaaggaagagcattttggggatggtgaccctgaatccactggcaagagatcgagtgagttgctggatcccacaacacccatgagaactaaatgcatagagcttctttacgcagctttaactagttcttccacagatcaacccaaagctgatttgtggcaaaactttgcaagagaaattgaagagcatgtttttaccctttattcaaagaacatcaaaaaatataaaacttgcatcagaagcaaagttgccaatttgaagaaccccagaaattctcatttacaacaaaacttgctctctgggaccacgtctccacgagaatttgctgaaatgactgtcatggagatggcaaataaggaactgaagcagttgagagcctcctacacggaatcttgtatccaggaacattaccttccccaagtaattgatggcacacagacaaataaaataaaatgcagacgctgtgagaaatacaattgcaaagtcactgtaattgacagaggaacacttttccttcccagctgggtgcggaattcaaacccagatgaacaaatgatgacttacgtaatttgtaacgaatgtggggagcagtggtaccatagcaagtgggtgtgctggtaactgtaaatcagtgttctcttaacagataaccggagtgataccttttatttgtacaacccttttgtgcttttaaaaatcttatacacactactctctaaaacagaaaaaggaggaaagaaagtcgttagctgaagctgccaccaccatccctaaaagttacagtttggggagagggagtggatgactatttatattgtgccttgtggccatttagtaccttactgtagacagagtgtgggtgagaacagcccagcataaactgggagactgtgggaaatgcattcccaggcctcacaccattgaatccgaatctgcattttgacaggatccccaggtaatcttccaggataggatagtttgagaagtgctactttagcaataggcctgtggctctcagcagtggctgcatattaaaatcatctgggaagctttgaaaacccactggtgctgagaccccaccctagaacaattcagttggaacctatgagatgggacccaggcatcaacatttcttttttcattcctcaagttattttaagatgcagtcagagttgagaactactc

SEQ ID NO: 2426 - DNA, 2988 bp, Homo sapiens
tgtgaggattgagatgactggagtgtgtgtggcctggagagttgctcaataaatatatgttgccttccactgtgaagagctgtaaagatgtctgacaagaaccagatagctgccagagcttctcttattgagcaactgatgtccaaaaggaattttgaggatcttggcaaccaccttactgagctagaaacaatttatgtgactaaggagcatctccaggagacagatgtggtcagagctgtgtacagagtcctcaaaaactgcccctctgtggctttgaaaaagaaagccaagtgtttgctatcaaagtggaaagctgtttataagcagactcactccaaagcgaggaacagccctaaattatttcctgtgaggggtaataaagaagaaaattcaggaccttctcatgacccaagtcagaatgagacactgggcatctgcagctcgaattctctgtcttcccaagacgttgcaaaactcagtgaaatgattgtgcctgaaaatagagccattcaattgaaacctaaggaagagcattttggggatggtgaccctgaatccactggcaagagatcgagtgagttgctggatcccacaacacccatgagaactaaatgcatagagcttctttacgcagctttaactagttcttccacagatcaacccaaagctgatttgtggcaaaactttgcaagagaaattgaagagcatgtttttaccctttattcaaagaacatcaaaaaatataaaacttgcatcagaagcaaagttgccaatttgaagaaccccagaaattctcatttacaacaaaacttgctctctgggaccacgtctccacgagaatttgctgaaatgactgtcatggagatggcaaataaggaactgaagcagttgagagcctcctacacggaatcttgtatccaggaacattaccttccccaagtaattgatggcacacagacaaataaaataaaatgcagacgctgtgagaaatacaattgcaaagtcactgtaattgacagaggaacacttttccttcccagctgggtgcggaattcaaacccagatgaacaaatgatgacttacgtaatttgtaacgaatgtggggagcagtggtaccatagcaagtgggtgtgctggtaactgtaaatcagtgttctcttaacagataaccggagtgataccttttatttgtacaacccttttgtgcttttaaaaatcttatacacactactctctaaaacagaaaaaggaggaaagaaagtcgttagctgaagctgccaccaccatccctaaaagttacagtttggggagagggagtggatgactatttatattgtgccttgtggccatttagtaccttactgtagacagagtgtgggtgagaacagcccagcataaactgggagactgtgggaaatgcattcccaggcctcacaccattgaatccgaatctgcattttgacaggatccccaggtaatcttccaggataggatagtttgagaagtgctactttagcaataggcctgtggctctcagcagtggctgcatattaaaatcatctgggaagctttgaaaacccactggtgctgagaccccaccctagaacaattcagttggaacctatgagatgggacccaggcatcaacatttcttttttcattcctcaagttattttaagatgcagtcagagttgagaactactcagaaataggctctcatttgatcctttttacagctctaagacaagaatgttattccaggcacttcacgaatgaggaaacaggtccacagaggtgtggtgacatgtccaagtgacacaaccataaatagtaccaattctgacagatcccagattttctccctcctgactcactgagactggctcaatatcgacttctgagaaatgtattcctggaggtcggggacaaaatgaagaatgtgtttaaactccaacattgggtgactagatcttcattcttttcccctctcttttctcatttataggtctcccttcaaccacaaaagtcaccctggaactcatcccgcagttagaattttgtttggagccctcttgcttagttgaaggagtttcgtagttgttttttgtttttgtttttgtttttgttttttccccctgtgaacaggtttttcgggggtatgtaaactctaggatgtttagtttctgatgtcaggagtcttcatgttctcaaggacaagtgtccttgagatggacattaatggtcattagtctgtcagaggaagcccatcactttagcctttgaatgtagtaacagacgtttatctaataaatgaattgaagataaaattacctctttgaggcctttgcaaacagtgtttaaccagtttatataattgtttgactacaacacgccttctatgtgattatggctgattttttttccttaaaaaactcatggaatgttcaccgttttatagttttaaaaagtttactttggcggtctctacaaacctaccatttcactttctcaccagttcttttctcctaactctcttcctttgttggagctctgaaggcctaactgtgtgtacactttacctgcctgacagaattctccaaaacatgcataaaagtaaaatatgttcgtattttcaaataatttggaagagtcggctcaatgccatcaagtgtaaaatctattttgatatacttgctctccgtgtcttcccagggctgctttttgtgatgcaacatgtttagtccttaacttgcaaggtcatctaaaacttgaagtttcacaaagtgtggtttcatatgacttggaataatctgaaaaactattcagtggttacgaaagagcacagcacataaaaaccaaatttgattagttcaagtcggtgtttatgttttgctttgggggtttgtgtgtatgtgtgtagtttttatttatattggaatttggcaaactaaatgttcagacaaataaaagtaattaaaatggaaa

SEQ ID NO: 2427 - DNA, 1205 bp, Homo sapiens
agttctccgtgggcactgggcggctgaaggctccggaactgcgcctgcgcttttcggagtattgtgaggattgagatgactggagtgtgtgtggcctggagagttgctcaataaatatatgttgccttccactgtgaagagctgtaaagatgtctgacaagaaccagatagctgccagagcttctcttattgagcaactgatgtccaaaaggaattttgaggatcttggcaaccaccttactgagctagaaacaatttatgtgactaaggagcatctccaggagacagatgtggtcagagctgtgtacagagtcctcaaaaactgcccctctgtggctttgaaaaagaaagccaagtgtttgctatcaaagtggaaagctgtttataagcagactcactccaaagcgaggaacagccctaaattatttcctgtgaggggtaataaagaagaaaattcaggaccttctcatgacccaagtcagaatgagacactgggcatctgcagctcgaattctctgtcttcccaagacgttgcaaaactcagtgaaatgattgtgcctgaaaatagagccattcaattgaaacctaaggaagagcattttggggatggtgaccctgaatccactggcaagagatcgagtgagttgctggatcccacaacacccatgagaactaaatgcatagagcttctttacgcagctttaactagttcttccacagatcaacccaaagctgatttgtggcaaaactttgcaagagaaattgaagagcatgtttttaccctttattcaaagaacatcaaaaaatataaaacttgcatcagaagcaaagttgccaatttgaagaaccccagaaattctcatttacaacaaaacttgctctctgggaccacgtctccacgagaatttgctgaaatgactgtcatggagatggcaaataaggaactgaagcagttgagagcctcctacacggaatcttgtatccaggaacattaccttccccaagtaattgatggcacacagacaaataaaataaaatgcagacgctgtgagaaatacaattgcaaagtcactgtaattgacagaggaacacttttccttcccagctgggtgcggaattcaaacccagatgaacaaatgatgacttacgtaatttgtaacgaatgtggggagcagtggtaccatagcaagtgggtgtgctggtaa

SEQ ID NO: 2428 - DNA, 1538 bp, Homo sapiens
gacgttgtcccagtcccggtgatcggaagttctccgtgggcactgggcggctgaaggctccggaactgcgcctgcgcttttcggagtattgtgaggattgagatgactggagtgtgtgtggcctggagagttgctcaataaatatatgttgccttccactgtgaagagagtctcgctctgtcgccaggttggagtgcagtggcatgatctcggctcaccgcaaactctgcctcccgggttcaagcaattctcctgcctcggccttccgagtagctgggactacagagatggggtttcaccatgttagccaggatggtctcgatctcctgacctcgtgatctgcctgcctcggcctcccaaagtgctgggattacaggctgtaaagatgtctgacaagaaccagatagctgccagagcttctcttattgagcaactgatgtccaaaaggaattttgaggatcttggcaaccaccttactgagctagaaacaatttatgtgactaaggagcatctccaggagacagatgtggtcagagctgtgtacagagtcctcaaaaactgcccctctgtggctttgaaaaagaaagccaagtgtttgctatcaaagtggaaagctgtttataagcagactcactccaaagcgaggaacagccctaaattatttcctgtgaggggtaataaagaagaaaattcaggaccttctcatgacccaagtcagaatgagacactgggcatctgcagctcgaattctctgtcttcccaagacgttgcaaaactcagtgaaatgattgtgcctgaaaatagagccattcaattgaaacctaaggaagagcattttggggatggtgaccctgaatccactggcaagagatcgagtgagttgctggatcccacaacacccatgagaactaaatgcatagagcttctttacgcagctttaactagttcttccacagatcaacccaaagctgatttgtggcaaaactttgcaagagaaattgaagagcatgtttttaccctttattcaaagaacatcaaaaaatataaaacttgcatcagaagcaaagttgccaatttgaagaaccccagaaattctcatttacaacaaaacttgctctctgggaccacgtctccacgagaatttgctgaaatgactgtcatggagatggcaaataaggaactgaagcagttgagagcctcctacacggaatcttgtatccaggaacattaccttccccaagtaattgatggcacacagacaaataaaataaaatgcagacgctgtgagaaatacaattgcaaagtcactgtaattgacagaggaacacttttccttcccagctgggtgcggaattcaaacccagatgaacaaatgatgacttacgtaatttgtaacgaatgtggggagcagtggtaccatagcaagtgggtgtgctggtaactgtaaatcagtgttctcttaacagataaccggagtgataccttttatttgtacaacccttttgtgcttttaaaaatcttatacacactactctcta

SEQ ID NO: 2429 - DNA, 4097 bp, Homo sapiens
gtggcccagaggcgcgagggccggcggagtttcttcagaggaactaccgccctgggaggaagcgtctgtttagtttcaacacagacgactgggcttgggagcctacgaggttgcagtctggagggcgccaacagcagctaccagggctgcttttcctgaacacgctgcaagcacgtcaaggtagtcggagtcccctaacaatggataaattcgtcattcgaacgcctagaatccagaatagccctcagaagaaagattctggaggaaaggtttacaagcaggccacgattgaatctctgaagagagttgtggttgtagaagacataaaaagatggaaaactatgctggagcttcctgatcaaaccaaagagaatcttgttgaagccttacaagaattaaagaagaaaataccctccagggaagtgttaaaatcaacaaggataggtcacactgtgaacaagatgcgtaaacactcagattcagaagtggcttctcttgccagagaagtttacactgagtggaaaactttcactgaaaaacattcaaatagaccttctattgaagttagaagtgatcccaaaaccgagtcgttgaggaaaaatgctcagaaattactctcagaagccttggaattaaagatggatcacctactggttgaaaatattgaacgggaaacgtttcatctctgctcccgcctcattaatgggccgtaccggcggacggtgagagccctggtcttcacattaaagcaccgagctgaaatccgggctcaggtgaagagcggctcgctgccagtcggcacgtttgtacagacccacaaaaagtgacctgaggacggttccagccctgggccaggcagagaggaaaatgggcctgtctctgccgttcaaagacgcttttgagtttgggtgatggctgatgctggctgtgctagattttcccatggtgccgttcctttgcagacagaggattcggagagccctaggagacaggcctgcaggaatgtgcttcattagctgcagtgcgctggtgctgcctaacagaacgcacactggctgtcactaggaagcgccatacggttgctatcacccaacatggtgaaagggtgatggatttcactgtgaatatgccaaggacacctctaaacttcccccatgtcagtcagatgaagttactactatatttcaccaccctgcaggtaactgaaactcaattaccgctgccgctcactcggttccatccccctgagtttagatagctctggtgcctctcagaactcccctgtctgttctctttgctctatcccaggggtgagcctgcgagagccagccaactaccccttcttcccagagctcacttatctgaacgtttcagctctccctggaagaccttctgcgttggtctccagagcccccatgctgaggctactaatgaggaactggcccgaagcctcccacacctcagggtttatttgaatacgctggcgctctcagtttagggctctgtagaagatacataatgaaatttctcttgaaatgaattactgcagtagaaaaaagtacatacatatatatgttaaaatgaaatatctctacacaggcctgttttaacaattacgtaaataatacttgtttttttaaaagtaatagtaagctgggaacttttttttctaaaacaaaaggtggagttcgttcactgaaaagtgttttgagttgagaaggggtacagttggtgaaatttaaaaatgatggaacaaggatttgaggaatgtagaagactcaaggaagtggggattagattaggggagactggagcacgtttgtaatctgaaaggaaagagctggtagaaggggagagatttaaaatccaaaaaaaaggaagatgagttgaaaagcaaggggagaagggacgggactaacattattgcctaccttctaaatactaggcacttttcctaagacagtttattaacctttacctggatctttatatagttttgtaaaaatattgcttacttctctcacccattgtattaagtaggtattgttgttttcattttttagatttattcgtttatttagcaaccatttcctgagcatccattctgtggggtaggtgtatactgagcagtagttacaaatgggagcctgaggctcactgaacagaaacatcaccttcaatttcctactgctagtaactattggagctagaataataataatcgagcgtttaccctgggcccagcactgtggtaaccattttacaaaaagaaaatacccagttaaacatgagaaaagtgaggctcagaaaggtatagtaacttactcaaggtcacgcagatagtgaatgacagatctaagattcaaaatccgggtctatttgattgtatatggttgccttggatgatttcatctactctcatgttttcaagcatcatttacatgctgatgacattccagtttgtatcgtcagcccagacctgtcccctgactttcagatgatatttcctagatgccccatagacatctcagatataacatgtcttctttccattggcagtaccagcaagccagacactccagctaggaactcaaggagtcagcctagaccccacatctcccaccctcagccaaccaagtcctggtggtttgattaggttggtgcaaaagtaattgtggtttttgccattacttctaatatattacttctttgcatttgctgttccagttgcaatgctctttccccagacatctgcatgttcttgtcctcacttgctttaggtctctctttcccttatcaaaaaggcttttgctgactatcctaaatacaatagcactccctcccaactattctttaatgctgtacctagctttatttttcttcagaatatttattactctttaacatagttatttctttattgtctatctccccactcccagaatgtaagcttcatgaaagcagagtctctgttctgttccctgttatatctccagcatctggaacagagcctgggacaagctaggtctccataactatttattggatagttgagtgactggttgtggatgtacagtataagcatctaattcaatcagggagtgcttcctggaggagctgatacctgtgttcagtcttaaagggcaggagtttggataggggaatgttagttaatagaatgaaaatttcaaaattaaagggcaggagtaattaattgggtggttgagatgcatgcctggcagagcaagcagagtatggaaaaacccagaagtggagatatctggaaggtgattggtatggctggagtagaggacactggcaggagagtagctggagatgaggcaggagaggaaggcaaggaccaggatcaggtttgaagggtcttgagcatcaggtgaaggcgttagactgatttgaagcaggaactggtcacttttgtgttaataggctatgtggaagagaagctggggtagggagacaggaagtagcaagcttcatgtttaaagaaccaaagagttctgctaacttaggaacccagagtaagttgaaaacaaattgctctctggctgaaagccttcagtggtgatagttggaaagtagaatgattgcagagatgtgctttggagatttggaaagcaggctgtgttatttgtggctgttttctccttgatgcatgtgcagaatttccatgaacgctaatggagctattctgagcatttgctgaagggaaggaagcttgcagacatccctcccaatcttgcccacacactgagaagtaactcggagctacagtctgttaaaaatgaaaaggttgaggccgggtgcattggttcatgcctataatcccagcgctttgggaggtcgaggcaggcagatcacctgaggtcaggagtttgaaaccagcctggccaacatggcgaaaccctgtctgtactaaaaatacaaaaattagccagatatgatggcaggcgcctgtaatcccagctacttggaaggctgaggtatgagaatcgcttgaacctgggagatggaggctgcagtaagccaagattgtaccactgcactccagcctgggcaacagagtgagactctgtctc

SEQ ID NO: 2430 - DNA, 936 bp, Homo sapiens
tcctcgctagagcgtgcacttctggaagctaggaacctcctaactcaggacgtagactgatgattgattacagtttcaattcttcggaagatctttcttttaaagagaaaatcttacttcctgtcaattccactcgaggccccataattcatgaattcttccagagaactcaattgtgttactttggggaaaaaatatcatggcagtctttagtggggttttagaatctgccctctttcttgaccagaacacgctgcaagcacgtcaaggtagtcggagtcccctaacaatggataaattcgtcattcgaacgcctagaatccagaatagccctcagaagaaagattctggaggaaaggtttacaagcaggccacgattgaatctctgaagagagttgtggttgtagaagacataaaaagatggaaaactatgctggagcttcctgatcaaaccaaagagaatcttgttgaagccttacaagaattaaagaagaaaataccctccagggaagtgttaaaatcaacaaggataggtcacactgtgaacaagatgcgtaaacactcagattcagaagtggcttctcttgccagagaagtttacactgagtggaaaactttcactgaaaaacattcaaatagaccttctattgaagttagaagtgatcccaaaaccgagtcgttgaggaaaaatgctcagaaattactctcagaagccttggaattaaagatggatcacctactggttgaaaatattgaacgggaaacgtttcatctctgctcccgcctcattaatgggccgtaccggcggacggtgagagccctggtcttcacattaaagcaccgagctgaaatccgggctcaggtgaagagcggctcgctgccagtcggcacgtttgtacagacccacaaaaagtgacctgaggacggttccagccc

SEQ ID NO: 2431 - DNA, 953 bp, Homo sapiens
gcgacggccggggccggggtcctgcccggctgcggaggcgggcgcgacgggcgcgggggtcgctgctcctgaggcgatgatgggcaaggaagaggagattgcgcggatcgcccggaggctggacaagatggtgaccaagaagagcgcgcgtttgtcaccctccgtctcccatagcatttgtcgccggcaacagtttggagtctgaggagggagccatggatttgctgcgggagctgaaggccatgcctatcacgctgcacctgctccagtccacccgagtcgggatgtctgtcaacgcccttcggaagcagagctcggatgaggaggtcattgcactggccaagtctctcatcaagtcctggaagaagctcctggatgcttccgatgccaaagccagggagcgggggaggggcatgcctctgcccacgtcctcgagggatgcctcagaggccccggatcccagccgcaagaggccggagctgcccagggcaccgtcgactccgaggatcaccacatttcctccggtgcctgtcacctgtgatgccgtgcgcaacaagtgccgcgagatgctgaccgctgccctgcagacggaccatgaccacgtggccatcggtgcggactgcgagcgcctgtcggctcagatcgaggaatgcatcttccgggacgttggaaacacagacatgaagtataagaaccgtgtacggagtcgtatctccaacctgaaggatgccaagaaccctgacctgcggcggaatgtgctgtgtggggccataacaccccagcagatcgctgtgatgacctcagaggagatggccagtgatgagctgaaggagatccgtaaggccatgaccaaggaggccatccgagagcaccagatggcccgcactggcggcacgcagacagacctgttcacctgcggcaagtgcaggaaaaagaactgcacctacacacag

SEQ ID NO: 2432 - DNA, 1235 bp, Homo sapiens
aggatgccgcgcgcggccgcggggccgagggtttgaaccgggggtctgtcgtccgcggcggggctgcgtcggctgcggcgggtgtgggaggtggcgacggccggggccggggtcctgcccggctgcggaggcgggcgcgacgggcgcgggggtcgctgctcctgaggcgatgatgggcaaggaagaggagattgcgcggatcgcccggaggctggacaagatggtgaccaagaagagcgcggagggagccatggatttgctgcgggagctgaaggccatgcctatcacgctgcacctgctccagtccacccgagtcgggatgtctgtcaacgcccttcggaagcagagctcggatgaggaggtcattgcactggccaagtctctcatcaagtcctggaagaagctcctggatgcttccgatgccaaagccagggagcgggggaggggcatgcctctgcccacgtcctcgagggatgcctcagaggccccggatcccagccgcaagaggccggagctgcccagggcaccgtcgactccgaggatcaccacatttcctccggtgcctgtcacctgtgatgccgtgcgcaacaagtgccgcgagatgctgaccgctgccctgcagacggaccatgaccacgtggccatcggtgcggactgcgagcgcctgtcggctcagatcgaggaatgcatcttccgggacgttggaaacacagacatgaagtataagaaccgtgtacggagtcgtatctccaacctgaaggatgccaagaaccctgacctgcggcggaatgtgctgtgtggggccataacaccccagcagatcgctgtgatgacctcagaggagatggccagtgatgagctgaaggagatccgtaaggccatgaccaaggaggccatccgagagcaccagatggcccgcactggcggcacgcagacagacctgttcacctgcggcaagtgcaggaaaaagaactgcacctacacacaggtgcagacccgcagctctgatgagcccatgaccacctttgttgtctgcaacgagtgtggaaaccgctggaagttctgctgacccctcgtgtagatgtgctgcagccttgggccctccccggcccacgtcctccgttgacacagcttctctggagaccctagaaggcggcatgtcctgccctcaacctgcctgcctggattgcacctttctgccctttccccctcattattaaatgtttctttttgcc

SEQ ID NO: 2433 - DNA, 1427 bp, Homo sapiens
agggtttaaccgaaaccgaacattaaccgtagccctaacgcggctgagggatccaggccttgcctctgggccgggtgagagacagacactcgccaaccagtccgcagtggctccccgtgtgtgcgaggctcccgcctgcgtgtgtgcgtgtgcatgtgtgcctgcgcacaggggagggaaagttcttcagctgccgagggcgggagtaggggctggagcagcaccctgcggcgaggccccacaggagaatcgatggttctgatgctgtcagcctctgggtgcaaattctgagggcccgggagcgtctggcggccctgagcagcttgctggggaagctccgtggaggaggaagtccggaggcatgtgatgtgaatcagctgacatcatcttgacgggagccctgtgaggcggacacttaactccagtttcacaggagggagccatggatttgctgcgggagctgaaggccatgcctatcacgctgcacctgctccagtccacccgagtcgggatgtctgtcaacgcccttcggaagcagagctcggatgaggaggtcattgcactggccaagtctctcatcaagtcctggaagaagctcctggatgcttccgatgccaaagccagggagcgggggaggggcatgcctctgcccacgtcctcgagggatgcctcagaggccccggatcccagccgcaagaggccggagctgcccagggcaccgtcgactccgaggatcaccacatttcctccggtgcctgtcacctgtgatgccgtgcgcaacaagtgccgcgagatgctgaccgctgccctgcagacggaccatgaccacgtggccatcggtgcggactgcgagcgcctgtcggctcagatcgaggaatgcatcttccgggacgttggaaacacagacatgaagtataagaaccgtgtacggagtcgtatctccaacctgaaggatgccaagaaccctgacctgcggcggaatgtgctgtgtggggccataacaccccagcagatcgctgtgatgacctcagaggagatggccagtgatgagctgaaggagatccgtaaggccatgaccaaggaggccatccgagagcaccagatggcccgcactggcggcacgcagacagacctgttcacctgcggcaagtgcaggaaaaagaactgcacctacacacaggtgcagacccgcagctctgatgagcccatgaccacctttgttgtctgcaacgagtgtggaaaccgctggaagttctgctgacccctcgtgtagatgtgctgcagccttgggccctccccggcccacgtcctccgttgacacagcttctctggagaccctagaaggcggcatgtcctgccctcaacctgcctgcctggattgcacctttctgccctttccccctcattattaaatgtttctttttgcc

SEQ ID NO: 2434 - DNA, 1733 bp, Homo sapiens
ggccgcggggccgagggtttgaaccgggggtctgtcgtccgcggcggggctgcgtcggctgcggcgggtgtgggaggtggcgacggccggggccggggtcctgcccggctgcggaggcgggcgcgacgggcgcgggggtcgctgctcctgaggcgatgatgggcaaggaagaggagattgcgcggatcgcccggaggctggacaagatggtgaccaagaagagcgcggagggagccatggatttgctgcgggagctgaaggccatgcctatcacgctgcacctgctccagtccacccgagtcgggatgtctgtcaacgcccttcggaagcagagctcggatgaggaggtcattgcactggccaagtctctcatcaagtcctggaagaagctcctggatgcttccgatgccaaagccagggagcgggggaggggcatgcctctgcccacgtcctcgagggatgcctcagaggccccggatcccagccgcaagaggccggagctgcccagggcaccgtcgactccgaggatcaccacatttcctccggtgcctgtcacctgtgatgccgtgcgcaacaagtgccgcgagatgctgaccgctgccctgcagacggaccatgaccacgtggccatcggtgcggactgcgagcgcctgtcggctcagatcgaggaatatatcctttgggtaggggctgtgggcctgggtttctggtggagtcaggaggctgcctggcctggtgccctctggtggctgctggatgccactgcccagctgtccaggggtcacctgcctgggtggtcacctgcctgggtggtcaggctgtctcacctcaggagggcccccggaccagctgaagggctgattctgtctgcttgtggggcctaggtcccctggggctgtagcctgaagctgggtctcagtcaggaatgggcctggggcaggcttggccctgcagcccttcacctctccaccaggtgtgggtgggcagaccgacccctgtgtggctgggcagaacctttccagcccccaccccaacatggcccccagcggggcaggtggtaggtggagggcagcgacgttgtcctcaggtgggtccttaaaacacttgcacgcatcttccgggacgttggaaacacagacatgaagtataagaaccgtgtacggagtcgtatctccaacctgaaggatgccaagaaccctgacctgcggcggaatgtgctgtgtggggccataacaccccagcagatcgctgtgatgacctcagaggtgagcccctgttggaggggctggagggctgctccctcggagcggtgggctaagccactggccccgtgctccaggagatggccagtgatgagctgaaggagatccgtaaggccatgaccaaggaggccatccgagagcaccagatggcccgcactggcggcacgcagacagacctgttcacctgcggcaagtgcaggaaaaagaactgcacctacacacaggtgcagacccgcagctctgatgagcccatgaccacctttgttgtctgcaacgagtgtggaaaccgctggaagttctgctgacccctcgtgtagatgtgctgcagccttgggccctccccggcccacgtcctccgttgacacagcttctctggagaccctagaaggcggcatgtcctgccctcaacctgcctgcctggattgcacctttctgccctttccccctcattattaaatgtttctttttgcc

SEQ ID NO: 2435 - DNA, 726 bp, Homo sapiens
ggcaggacgagacccctccccggcagagactaaccgggacgcaggggagacccccacccgtggccgagacccctgccccgggccagccctgccgttcactcccgcaaccccggcagaggccgcgatcaggcctggaccttgtcccgggagagccacccgctctggactcagacccctccctcgcccgcagtcacaggctccgcacccttccctgtcccttaactccagacccccagcctggcccgtcgactccttccttggccctgtcccgcctctcggagcccccggggtgttcgggcctcctctgcgggccgcgccagccccttgccttcctccatcccggcctgggcatcctcacaggccgagccccgccccccaactcagccctctcccacgctccgtctcttacagcgtttgtcaccctccgtctcccatagcatttgtcgccggcaacagtttggagtctgaggagggagccatggatttgctgcgggagctgaaggccatgcctatcacgctgcacctgctccagtccacccgagtcgggatgtctgtcaacgcccttcggaagcagagctcggatgaggaggtcattgcactggccaagtctctcatcaagtcctggaagaagctcctggatgcttccgatgccaaagccagggagcgggggaggggcatgcctctgcccacgtcctcgagggatgcctcagaggccccggatcccag

SEQ ID NO: 2436 - DNA, 1083 bp, Homo sapiens
gaaccaggtttctctaataaattctctcccttctttagccaggacttagcccgcagcaacttgggttgtgggtagttatgtggacaccctccgaaaagagccggtgtgcttatataagagccaggaggtcgggcaagcctcctctgggagtgtctgggcgctggagcctctggccggctctgttcactgcggcctgggcctctgttgtcttgcggccacagcgagactttggaggaggctgtgtgtgaggactttgaaggggccagtaggcagaaggaggtgatattgtctgttgagatctaaagtcctttatgaaggtcctccttctccttccaggagggagccatggatttgctgcgggagctgaaggccatgcctatcacgctgcacctgctccagtccacccgagtcgggatgtctgtcaacgcccttcggaagcagagctcggatgaggaggtcattgcactggccaagtctctcatcaagtcctggaagaagctcctggatgcttccgatgccaaagccagggagcgggggaggggcatgcctctgcccacgtcctcgagggatgcctcagaggccccggatcccagccgcaagaggccggagctgcccagggcaccgtcgactccgaggatcaccacatttcctccggtgcctgtcacctgtgatgccgtgcgcaacaagtgccgcgagatgctgaccgctgccctgcagacggaccatgaccacgtggccatcggtgcggactgcgagcgcctgtcggctcagatcgaggaatgcatcttccgggacgttggaaacacagacatgaagtataagaaccgtgtacggagtcgtatctccaacctgaaggatgccaagaaccctgacctgcggcggaatgtgctgtgtggggccataacaccccagcagatcgctgtgatgacctcagaggagatggccagtgatgagctgaaggagatccgtaaggccatgaccaaggaggccatccgagagcaccagatggcccgcactggcggcacgcagacagacctgttcacctgcggcaagtgcaggaaaaagaactgcacctacacacag

SEQ ID NO: 2437 - DNA, 941 bp, Homo sapiens
cacggatgtgggttacaacttggaatgcttgaggctgcagaacccctccccttcttgactgagcagtaagggttccctgctgtggtgcaggaacatgtgggcagagccctgggtgtctccaggagggagccatggatttgctgcgggagctgaaggccatgcctatcacgctgcacctgctccagtccacccgagtcgggatgtctgtcaacgcccttcggaagcagagctcggatgaggaggtcattgcactggccaagtctctcatcaagtcctggaagaagctcctggatgcttccgatgccaaagccagggagcgggggaggggcatgcctctgcccacgtcctcgagggatgcctcagaggccccggatcccagccgcaagaggccggagctgcccagggcaccgtcgactccgaggatcaccacatttcctccggtgcctgtcacctgtgatgccgtgcgcaacaagtgccgcgagatgctgaccgctgccctgcagacggaccatgaccacgtggccatcggtgcggactgcgagcgcctgtcggctcagatcgaggaatgcatcttccgggacgttggaaacacagacatgaagtataagaaccgtgtacggagtcgtatctccaacctgaaggatgccaagaaccctgacctgcggcggaatgtgctgtgtggggccataacaccccagcagatcgctgtgatgacctcagaggagatggccagtgatgagctgaaggagatccgtaaggccatgaccaaggaggccatccgagagcaccagatggcccgcactggcggcacgcagacagacctgttcacctgcggcaagtgcaggaaaaagaactgcacctacacacaggtgcagacccgcagctctgatgagcccatgaccacctttgttgtctgcaacgagtgtggaaaccgctggaag

SEQ ID NO: 2438 - DNA, 1197 bp, Homo sapiens
ccttcgcgcctcctgcccccgaggccctactgctgcccctgtgcccctcgccccgccgggcgtcgcgggccaacatgggccaggaagaggagctgctgaggatcgccaaaaagctggagaagatggtggccaggaagaacacggaaggggccctggaccttctgaagaagctgcacagctgccagatgtccatccagctactacagacaaccaggattggagttgctgttaatggggtccgcaagcactgctcagacaaggaggtggtgtccttggccaaagtccttatcaaaaactggaagcggctgctagactcccctggacccccaaaaggagaaaaaggagaggaaagagaaaaggcaaagaagaaggaaaaagggcttgagtgttcagactggaagccagaagcaggcctttctccaccaaggaaaaaacgagaagaccccaaaaccaggagagactctgtggactccaagtcttctgcctcctcctctccaaaaagaccatcggtggaaagagcatgctcgctgatgcagtaactgaaatgccctcgaggtggcgcacagaagcagcgggcccggcctccagatgcctctactcagacctggggcaggaggattttctaaggactggtgcggtgcgggcacatccggggagcagaaggaagctgttgataaatccaacctcccaccccggccgatgatgccctctctgcagtttggctcagttcccaggcgtgtgcattgaaagcaaaatgagtgtggctgcctgaaatgctgcccagacacgaattccagccagccagccagctcctaaccggggaggcgggaccagggctgggtgtgccctgccaggaaggtgggaagaaatgctccaaacagcctagtcttgctcaggtaggaggactctggaaacctctcttttaaagacacagttgatgtgttgaaaagaatttggaagggcgacaggcaggttcgtggtctgactataccctttgctagttggatggataacttggggcagtaacttggatggataattcagttcagctctctgagcttcagtctactgatctgtaaaatggagacaattatgaacccctttcaaggtcattgtgaggattaaatgaggtaatgaaatacccagcactgttcccaaaccatgtaaatgctcaataaatacataatactttgtaat

SEQ ID NO: 2439 - DNA, 1559 bp, Homo sapiens
tgtttggggcccgcgcgggttgcgcgccctccgccttcgcgcctcctgcccccgaggccctactgctgcccctgtgcccctcgccccgccgggcgtcgcgggccaacatgggccaggaagaggagctgctgaggatcgccaaaaagctggagaagatggtggccaggaagaacacggaaggggccctggaccttctgaagaagctgcacagctgccagatgtccatccagctactacagacaaccaggattggagttgctgttaatggggtccgcaagcactgctcagacaaggaggtggtgtccttggccaaagtccttatcaaaaactggaagcggctgctagactcccctggacccccaaaaggagaaaaaggagaggaaagagaaaaggcaaagaagaaggaaaaagggcttgagtgttcagactggaagccagaagcaggcctttctccaccaaggaaaaaacgagaagaccccaaaaccaggagagactctgtggactccaagtcttctgcctcctcctctccaaaaagaccatcggtggaaagatcaaacagcagcaaatcaaaagcggagagccccaaaacacctagcagccccttgacccccacgtttgcctcttccatgtgtctcctggccccctgctatctcacaggggactctgtccgggacaagtgtgtggagatgctgtcagcagccctgaaggcggacgatgattacaaggactatggagtcaactgtgacaagatggcatcagaaatcgaagatcatatctaccaagagctcaagagcacggacatgaagtaccggaaccgcgtgcgcagccgcataagcaacctcaaggaccccaggaaccccggcctgcggcggaacgtgctcagtggggccatctccgcagggcttatagccaagatgacggcagaggaaatggccagtgatgaactgagggagttgaggaatgccatgacccaggaggccatccgtgagcaccagatggccaagactggcggcaccaccactgacctcttccagtgcagcaaatgcaagaagaagaactgcacctataaccaggtgcagacacgcagtgctgatgagcccatgactacctttgtcttatgcaatgaatgtggcaatcgctggaagttctgctgatggaacagccagccatgaacaaggtgaggaagaagaaagaggaagcgctgaattatctgaactggagaagcaataaaaattaaagtgaaggaaaatactgaactctgtctgagtgggatggtatgagttagaggaagaattctcttgcaaattaataatcggtcattagaaacaattggttaatgggggagcctaattggagaatgatgctgagaatttgtattgatgaacctcttttagaaactgcagagggctgggcacggtggtttatggctgtaatctgcaaactctgggaggctgaggtgggagaatcgcttaaccccagaagtttgagtccagcccaggcaacacagcaagaccccatctctataaaaagaaaaaataaagaaactgcagcgccttaga

SEQ ID NO: 2440 - DNA, 1080 bp, Homo sapiens
gcgcccgcgcagaatcagctgtctgagctgcccaggcggcgggggagcagcgagcgggcttcagcgagccgcaggaggcacaggcctgtcctgggtccccgcaggtctgcgcgtctgttgttcccagcgctctgagaggcctgaaaaggaagagcaacctgtccagaatccccgcaggaaaaggaggggaaatctcgacatggaaaaactcttcaatgaaaatgaaggaatgccttcgaatcaaggaaagatagacaatgaagaacagccaccgcacgagggaaagccagaagtagcttgtattctggaagacaagaagttagaaaacgagggaaacacagaaaacacgggcaagagagttgaggaaccgttaaaggataaagaaaagccagagagtgcgggaaaggcaaaaggagaaggaaagtcagagaggaagggaaagtcagagatgcagggaggatcaaagacagagggaaagccagagagagggggaagggcagagggtgaaggagagccagacagtgaaagagagccagagagtgagggagagccagaaagtgaaacaagggctgcaggaaagcgcccagctgaggatgatatacccaggaaagccaaaagaaaaaccaacaaggggctggctcagtacctcaagcaatataaggaagccatacatgatatgaatttcagcaatgaggacatgataagagaatttgacaacatggctagggtggaggataaaaggagaaaaagcaaacagaaattgggggcgtttttgtggatgcaaagaaatttacaggaccccttctatcctaggggtccaagggaattcaggggtggctgcagggccccacgaagggacactgaagacattccttatgtgtagtgtccctggcaggcatttgtcaggccatatgttttaaccttatggtaatactttgctttagtcgttcctcctgctaccagtagcgttttgacccacctgccagtgtttgcttgctctatgtttcagtagcagattttcacacatgtgcattgcagagacgtcatgattcgtggaaaaataaagcagcttataatatc

SEQ ID NO: 2441 - DNA, 1100 bp, Homo sapiens
agcggtcgggtccgggcgcccgcgcagaatcagctgtctgagctgcccaggcggcgggggagcagcgagcgggcttcagcgagccgcaggaggcacaggcctgtcctgggtccccgcaggtctgcgcgtctgttgttcccagcgctctgagaggcctgaaaaggaagagcaacctgtccagaatccccgcaggaaaggaaaaggaggggaaatctcgacatggaaaaactcttcaatgaaaatgaaggaatgccttcgaatcaaggaaagatagacaatgaagaacagccaccgcacgagggaaagccagaagtagcttgtattctggaagacaagaagttagaaaacgagggaaacacagaaaacacgggcaagagagttgaggaaccgttaaaggataaagaaaagccagagagtgcgggaaaggcaaaaggagaaggaaagtcagagaggaagggaaagtcagagatgcagggaggatcaaagacagagggaaagccagagagagggggaagggcagagggtgaaggagagccagacagtgaaagagagccagagagtgagggagagccagaaagtgaaacaagggctgcaggaaagcgcccagctgaggatgatatacccaggaaagccaaaagaaaaaccaacaaggggctggctcagtacctcaagcaatataaggaagccatacatgatatgaatttcagcaatgaggacatgataagagaatttgacaacatggctagggtggaggataaaaggagaaaaagcaaacagaaattgggggcgtttttgtggatgcaaagaaatttacaggaccccttctatcctaggggtccaagggaattcaggggtggctgcagggccccacgaagggacactgaagacattccttatgtgtagtgtccctggcaggcatttgtcaggccatatgttttaaccttatggtaatactttgctttagtcgttcctcctgctaccagtagcgttttgacccacctgccagtgtttgcttgctctatgtttcagtagcagattttcacacatgtgcattgcagagacgtcatgattcgtggaaaaataaagcagcttataatatc

SEQ ID NO: 2442 - DNA, 1124 bp, Homo sapiens
gtgggcaccagcccccgcgcccgcccgcccgccctgcggtccggtcctggcgcccgcgcagaaccagctgtctgagctgcccgggcagcgggggagcagcgagcgggcttccgcgagccggagaaggcacaggcctgtcccgggtcccggcaggtcagtgtgaaggtctgcgcgtctgttcccagcgctctgcgaggcctaaaaaggaggagcaacctgtccagaatccctgcaggacaggaaaaggaggggaaatctcgacatggaaaaaccctacaataaaaatgaaggaaacctggaaaacgagggaaagccagaagatgaagtagagcctgatgatgaaggaaagtcagacgaggaagaaaagccagacgtggaggggaagacagaatgcgagggaaagagagaggatgagggagagccaggtgatgagggacaactggaagatgagggaagccaggaaaagcagggcaggtccgaaggtgagggcaagccacaaggcgagggcaagccagcctcccaggcaaagccagagagccagccgcgggccgccgaaaagcgcccggctgaagattatgtgccccggaaagcaaaaagaaaaacggacagggggacggacgattcccccaaggactctcaggaggacttacaggaaaggcatctgagcagtgaggagatgatgagagaatgtggagatgtgtcaagggctcaagaggagctaaggaaaaaacagaaaatgggtggttttcattggatgcaaagagatgtacaggatccattcgccccaaggggacaacggggtgtcaggggagtgaggggtggaggtaggggccagaggggcttacacgatatcccatacctttaatgcctttggccttccattctgatttctctgatgagaatattgctggccctgctttccctggtaggtatttgccaggcccaatgctttaaccttaagctgatactttgctttagatgtcagtctcgttaccagcagccttttgacccaactacggcgctctatattttagtagaggattttcacccatgtgcatggaaaagatgttcatggtacattgtaaaaaaataaaattaaaattaaaaaaagtttgcagaaccgc

SEQ ID NO: 2443 - DNA, 1113 bp, Homo sapiens
gtgggcaccagcccccgcgcccgcccgcccgccctgcggtccggtcctggcgcccgcgcagaaccagctgtctgagctgcccgggcagcgggggagcagcgagcgggcttccgcgagccggagaaggcacaggcctgtcccgggtcccggcaggtctgcgcgtctgttcccagcgctctgcgaggcctaaaaaggaggagcaacctgtccagaatccctgcaggacaggaaaaggaggggaaatctcgacatggaaaaaccctacaataaaaatgaaggaaacctggaaaacgagggaaagccagaagatgaagtagagcctgatgatgaaggaaagtcagacgaggaagaaaagccagacgtggaggggaagacagaatgcgagggaaagagagaggatgagggagagccaggtgatgagggacaactggaagatgagggaagccaggaaaagcagggcaggtccgaaggtgagggcaagccacaaggcgagggcaagccagcctcccaggcaaagccagagagccagccgcgggccgccgaaaagcgcccggctgaagattatgtgccccggaaagcaaaaagaaaaacggacagggggacggacgattcccccaaggactctcaggaggacttacaggaaaggcatctgagcagtgaggagatgatgagagaatgtggagatgtgtcaagggctcaagaggagctaaggaaaaaacagaaaatgggtggttttcattggatgcaaagagatgtacaggatccattcgccccaaggggacaacggggtgtcaggggagtgaggggtggaggtaggggccagaggggcttacacgatatcccatacctttaatgcctttggccttccattctgatttctctgatgagaatattgctggccctgctttccctggtaggtatttgccaggcccaatgctttaaccttaagctgatactttgctttagatgtcagtctcgttaccagcagccttttgacccaactacggcgctctatattttagtagaggattttcacccatgtgcatggaaaagatgttcatggtacattgtaaaaaaataaaattaaaattaaaaaaagtttgcagaaccgca

SEQ ID NO: 2444 - DNA, 1221 bp, Homo sapiens
gggagacagaacttgaggactgaggagagaggaggcccaggacagaaccctaggaacactgccactcaaggtggcagctcagcttcctggcaggcagcaccaccctgggctctggagtcaggcagagacagtcttgaaagcgggctctggagttctggggctgagcgctcttggcaaagtcgggtaccctctttgatcagctgtcacacctggcgataatggcatcagagagagataccctgcgaggatgccgtgagatgcgccaggtctgcgcgtctgttcccagcgctctgcgaggcctaaaaaggaggagcaacctgtccagaatccctgcaggaaaaggaggggaaatctcgacatggaaaaaccctacaataaaaatgaaggaaacctggaaaacgagggaaagccagaagatgaagtagagcctgatgatgaaggaaagtcagacgaggaagaaaagccagacgtggaggggaagacagaatgcgagggaaagagagaggatgagggagagccaggtgatgagggacaactggaagatgagggaagccaggaaaagcagggcaggtccgaaggtgagggcaagccacaaggcgagggcaagccagcctcccaggcaaagccagagagccagccgcgggccgccgaaaagcgcccggctgaagattatgtgccccggaaagcaaaaagaaaaacggacagggggacggacgattcccccaaggactctcaggaggacttacaggaaaggcatctgagcagtgaggagatgatgagagaatgtggagatgtgtcaagggctcaagaggagctaaggaaaaaacagaaaatgggtggttttcattggatgcaaagagatgtacaggatccattcgccccaaggggacaacggggtgtcaggggagtgaggggtggaggtaggggccagaggggcttacacgatatcccatacctttaatgcctttggccttccattctgatttctctgatgagaatattgctggccctgctttccctggtaggtatttgccaggcccaatgctttaaccttaagctgatactttgctttagatgtcagtctcgttaccagcagccttttgacccaactacggcgctctatattttagtagaggattttcacccatgtgcatggaaaagatgttcatggtacattgtaaaaaaataaaattaaaattaaaaaaagtttgcagaaccgca

SEQ ID NO: 2445 - DNA, 1511 bp, Homo sapiens
ttggtctaagacatgggctgacaaactttttccataaagggccagaaagtaaatatttcaggctttgtgggatatctatttatgatttattttactcctagtattatttcatcttttatacaggttattaaggttagtattgctgcataacaaattactccaaaatttaatcatttatattcaagaagagttcagctgctaggttcttattttgggactctcatgatgctgaggtcaagatgccagctggaggccaggcgccgcagctcacgcctgtaatcccagcgttttgggaggccaggggcctcccaaattcaaaaggaagagacaaagtccacatctgtcaatgcgaagaatggaaaggtcacatatcatatgtggagcgggacataacaacttcggaaattaaatctcttccccaggtcagtgtgcgggccttccacgctgccagcggaacactggaatggcggaaggggaacgggtacggcagggggaaaggctgggggtggggtcgggtcgagtcgagggaagctggcccgagtgtggacagagatggcggtctgcgcgtctgttgttcccagcgctctgcgaagcctgaaaaggaggagcaacctgtccagaatccccgcaggtccgtgaaagacaggaaaaggaggggaaatctcgacatggaaaaactctacagtgaaaatgaaggaatggcttcaaaccaaggaaagatggaaaatgaagaacagccacaagacgagagaaagccagaagtaacttgtactctggaagacaagaagttagaaaacgagggaaagacagaaaacaagggcaaaacaggagatgaggaaatgttaaaggataaaggaaagccagagagtgagggagaggcaaaagaaggaaagtcagagagggagggagagtcagagatggagggaggatcagagagagagggaaaaccagagatagagggaaagccagagagtgaaggagagccagggagtgaaacaagggctgcaggaaagcgcccagctgaggatgatgtacccaggaaagccaaaagaaaaactaataaggggctggctcattacctcaaggagtataaagaggccatacatgatatgaatttcagcaatgaggacatgataagagaatttgacaatatggctaaggtgcaggatgagaagagaaaaagcaaacagaaattgggggcgtttttgtggatgcaaagaaatttacaggaccccttctaccctagaggtccaagggaattcaggggtggctgcagggccccacgaagggacattgaagacattccttatgtgtagtgtccctggcaggcatttaccaggccatgtgctttaacgttacggtaatactttactttaggcatccctcctgttgctagcagccttttgacctatctgcaatgcagtgttctcagtaggaaatgttcatctgttacatggaaaaaatgttgatggtgcattgtaaaattaaaaaacacaacttgcagaaccaaa

SEQ ID NO: 2446 - DNA, 1166 bp, Homo sapiens
acgggcgcagatgtaggcaccggtccgagtgcctgccctctgtccccgcggctgggtctcgtctgctccggttcctgggctcctaattcttggtccagcttcttccaggtctgcgcgtctgttgttcccagcgctctgcgaagcctgaaaaggaggagcaacctgtccagaatccccgcaggaaaaggaggggaaatctcgacatggaaaaactctacagtgaaaatgaaggaatggcttcaaaccaaggaaagatggaaaatgaagaacagccacaagacgagagaaagccagaagtaacttgtactctggaagacaagaagttagaaaacgagggaaagacagaaaacaagggcaaaacaggagatgaggaaatgttaaaggataaaggaaaaccagagatagagggaaagccagagagtgaaggagagccagggagtgaaacaagggctgcaggaaagcgcccagctgaggatgatgtacccaggaaagccaaaagaaaaactaataaggggctggctcattacctcaaggagtataaagaggccatacatgatatgaatttcagcaatgaggacatgataagagaatttgacaatatggctaaggtgcaggatgagaagagaaaaagcaaacagaaattgggggcgtttttgtggatgcaaagaaatttacaggaccccttctaccctagaggtccaagggaattcaggggtggctgcagggccccacgaagggacattgaagacattccttatgtgtagtgtccctggcaggcatttaccaggccatgtgctttaacgttacggtaatactttactttaggcatccctcctgttgctagcagccttttgacctatctgcaatgcagtgttctcagtaggaaatgttcatctgttacatggaaaaaatgttgatggtgcattgtaaaattaaaaaacacaacttgcagaaccaaatatatggcatcagtacatttttgtaaaactacaaagatacttacctagtaatatagtatagaaaacaattctgaaagctgtgtccactaaaagattaacagtggttatctctgggtgattttttctgttcttttttgttcatctgtccatttttctcctaaaaacagatttctttagtcataaaaataataaaatataaagtattgg

SEQ ID NO: 2447 - DNA, 959 bp, Homo sapiens
gcacgggcgcagatgtaggcaccggtccgagtgcctgccctctgtccccgcggctgggtctcgtctgctccggttcctgggctcctaattcttggtccagcttcttccaggaaaaggaggggaaatctcgacatggaaaaactctacagtgaaaatgaaggaatggcttcaaaccaaggaaagatggaaaatgaagaacagccacaagacgagagaaagccagaagtaacttgtactctggaagacaagaagttagaaaacgagggaaagacagaaaacaagggcaaaacaggagatgaggaaatgttaaaggataaaggaaagccagagagtgagggagaggcaaaagaaggaaagtcagagagggagggagagtcagagatggagggaggatcagagagagagggaaaaccagagatagagggaaagccagagagtgaaggagagccagggagtgaaacaagggctgcaggaaagcgcccagctgaggatgatgtacccaggaaagccaaaagaaaaactaataaggggctggctcattacctcaaggagtataaagaggccatacatgatatgaatttcagcaatgaggacatgataagagaatttgacaatatggctaaggtgcaggatgagaagagaaaaagcaaacagaaattgggggcgtttttgtggatgcaaagaaatttacaggaccccttctaccctagaggtccaagggaattcaggggtggctgcagggccccacgaagggacattgaagacattccttatgtgtagtgtccctggcaggcatttaccaggccatgtgctttaacgttacggtaatactttactttaggcatccctcctgttgctagcagccttttgacctatctgcaatgcagtgttctcagtaggaaatgttcatctgttacatggaaaaaatgttgatggtgcattgtaaaattaaaaaacac

SEQ ID NO: 2448 - DNA, 338 bp, Homo sapiens
cttcttccaggtcagtgtgcgggccttccacgctgccagcggaacactggaatggcggaaggggaacgggtctgcgcgtctgttgttcccagcgctctgcgaagcctgaaaaggaggagcaacctgtccagaatccccgcaggaaaaggaggggaaatctcgacatggaaaaactctacagtgaaaatgaaggaatggcttcaaaccaaggaaagatggaaaatgaagaacagccacaagacgagagaaagccagaagtaacttgtactctggaagacaagaagttagaaaacgagggaaagacagaaaacaagggcaaaacaggagatgaggaaatg

SEQ ID NO: 2449 - DNA, 891 bp, Homo sapiens
tctgctccggttcctgggctcctaattcttggtccagcttcttccaggtcagtgtgcgggccttccacgctgccagcggaacactggaatggcggaaggggaacgggtacggcagggggaaaggctgggggtggggtcgggtcgagtcgagggaagctggcccgagtgtggacagagatggcggtgggaaaacggctaggggtggctgagggggagcacgtaggcagtgggcagagggtgaggaaggcgagcacccccaagtatccatgctcgctttccaggcacatcctcttctctgccctccgtccattttggagccggagatggtgggctggggccgccccagtagtgagacagtggaagtaaaccccatctgccgttcccgtgcgtagagaaaaacgttgaccgcgaggctggggaggagagttgcctctgaggaagaagggcacagagacccaaaattagtttggaaagcatcctgatttggtgcccgaggcctggaaagaaatggcggctggggtgcggcggaggtaggggaggaaaacgttggatgagaagggcctggactcaggaaagggaaccgcgtccgtgtgagcccgctgagcgcgcagaccctgcccctgtctcctgtctgtctgcaggtctgcgcgtctgttgttcccagcgctctgcgaagcctgaaaaggaggagcaacctgtccagaatccccgcaggacaggaaaaggaggggaaatctcgacatggaaaaactctacagtgaaaatgaaggaatggcttcaaaccaaggaaagatggaaaatgaagaacagccacaagacgagagaaagccagaagtaacttgtactctggaagacaagaagttagaaaacgagggaaagacagaaaacaag

SEQ ID NO: 2450 - DNA, 779 bp, Homo sapiens
tgtaggcaccggtccgagtgcctgccctctgtccccgcggctgggtctcgtctgctccggttcctgggctcctaattcttggtccagcttcttccaggtcagtgtgcgggccttccacgctgccagcggaacactggaatggcggaaggggaacggagaaaaacgttgaccgcgaggctggggaggagagttgcctctgaggaagaagggcacagagacccaaaattagtttggaaagcatcctgatttggtgcccgaggcctggaaagaaatggcggctggggtgcggcggaggtaggggaggaaaacgttggatgagaagggcctggactcaggaaagggaaccgcgtccgtgtgagcccgctgagcgcgcagaccctgcccctgtctcctgtctgtctgcaggtctgcgcgtctgttgttcccagcgctctgcgaagcctgaaaaggaggagcaacctgtccagaatccccgcaggacaggaaaaggaggggaaatctcgacatggaaaaactctacagtgaaaatgaaggaatggcttcaaaccaaggaaagatggaaaatgaagaacagccacaagacgagagaaagccagaagtaacttgtactctggaagacaagaagttagaaaacgagggaaagacagaaaacaagggcaaaacaggagatgaggaaatgttaaaggataaaggaaagccagagagtgagggagaggcaaaagaaggaaagtcagagagggagggagagtcagagatggagggaggatcagagagagagg

SEQ ID NO: 2451 - DNA, 1135 bp, Homo sapiens
gggctgcggcattcacgtgatctgcacgggcgcagatgtaggcaccggtccgagtgcctgccctctgtccccgcggctgggtctcgtctgctccggttcctgggctcctaattcttggtccagcttcttccaggtcagtgtgcgggccttccacgctgccagcggaacactggaatggcggaaggggaacgggtctgcgcgtctgttgttcccagcgctctgcgaagcctgaaaaggaggagcaacctgtccagaatccccgcaggacaggaaaaggaggggaaatctcgacatggaaaaactctacagtgaaaatgaaggaatggcttcaaaccaaggaaagatggaaaatgaagaacagccacaagacgagagaaagccagaagtaacttgtactctggaagacaagaagttagaaaacgagggaaagacagaaaacaagggcaaaacaggagatgaggaaatgttaaaggataaaggaaagccagagagtgagggagaggcaaaagaaggaaagtcagagagggagggagagtcagagatggagggaggatcagagagagagggaaaaccagagatagagggaaagccagagagtgaaggagagccagggagtgaaacaagggctgcaggaaagcgcccagctgaggatgatgtacccaggaaagccaaaagaaaaactaataaggggctggctcattacctcaaggagtataaagaggccatacatgatatgaatttcagcaatgaggacatgataagagaatttgacaatatggctaaggtgcaggatgagaagagaaaaagcaaacagaaattgggggcgtttttgtggatgcaaagaaatttacaggaccccttctaccctagaggtccaagggaattcaggggtggctgcagggccccacgaagggacattgaagacattccttatgtgtagtgtccctggcaggcatttaccaggccatgtgctttaacgttacggtaatactttactttaggcatccctcctgttgctagcagccttttgacctatctgcaatgcagtgttctcagtaggaaatgttcatctgttacatggaaaaaatgttgatggtgcattgtaaaattaaaaaacacaacttgcagaaccaaa

SEQ ID NO: 2452 - DNA, 566 bp, Homo sapiens
ggcctggactcaggaaagggaaccgcgtccgtgtgagcccgctgagcgcgcagaccctgcccctgtctcctgtctgtctgcaggtctgcgcgtctgttgttcccagcgctctgcgaagcctgaaaaggaggagcaacctgtccagaatccccgcaggaaaaggaggggaaatctcgacatggaaaaactctacagtgaaaatgaaggaatggcttcaaaccaaggaaagatggaaaatgaagaacagccacaagacgagagaaagccagaagtaacttgtactctggaagacaagaagttagaaaacgagggaaagacagaaaacaagggcaaaacaggagatgaggaaatgttaaaggataaaggaaagccagagagtgagggagaggcaaaagaaggaaagtcagagagggagggagagtcagagatggagggaggatcagagagagagggaaaaccagagatagagggaaagccagagagtgaaggagagccagggagtgaaacaagggctgcaggaaagcgcccagctgaggatgatgtacccaggaaagccaaaagaaaaa

SEQ ID NO: 2453 - DNA, 1266 bp, Homo sapiens
ctgcacgggcgcagatgtaggcaccggtccgagtgcctgccctctgtccccgcggctgggtctcgtctgctccggttcctgggctcctaattcttggtccagcttcttccaggtctgcgcgtctgttgttcccagcgctctgcgaagcctgaaaaggaggagcaacctgtccagaatccccgcaggacaggaaaaggaggggaaatctcgacatggaaaaactctacagtgaaaatgaaggaatggcttcaaaccaaggaaagatggaaaatgaagaacagccacaagacgagagaaagccagaagtaacttgtactctggaagacaagaagttagaaaacgagggaaagacagaaaacaagggcaaaacaggagatgaggaaatgttaaaggataaaggaaagccagagagtgagggagaggcaaaagaaggaaagtcagagagggagggagagtcagagatggagggaggatcagagagagagggaaaaccagagatagagggaaagccagagagtgaaggagagccagggagtgaaacaagggctgcaggaaagcgcccagctgaggatgatgtacccaggaaagccaaaagaaaaactaataaggggctggctcattacctcaaggagtataaagaggccatacatgatatgaatttcagcaatgaggacatgataagagaatttgacaatatggctaaggtgcaggatgagaagagaaaaagcaaacagaaattgggggcgtttttgtggatgcaaagaaatttacaggaccccttctaccctagaggtccaagggaattcaggggtggctgcagggccccacgaagggacattgaagacattccttatgtgtagtgtccctggcaggcatttaccaggccatgtgctttaacgttacggtaatactttactttaggcatccctcctgttgctagcagccttttgacctatctgcaatgcagtgttctcagtaggaaatgttcatctgttacatggaaaaaatgttgatggtgcattgtaaaattaaaaaacacaacttgcagaaccaaatatatggcatcagtacatttttgtaaaactacaaagatacttacctagtaatatagtatagaaaacaattctgaaagctgtgtccactaaaagattaacagtggttatctctgggtgattttttctgttcttttttgttcatctgtccatttttctcctaaaaacagatttctttagtcataaaaataataaaatataaagtattggaaaa

SEQ ID NO: 2454 - DNA, 1571 bp, Homo sapiens
gcaccggtccgagtgcctgccctctgtccccgcggctgggtctcgtctgctccggttcctgggctcctaattcttggtccagcttcttccaggcacatcctcttctctgccctccgtccattttggagccggagatggtgggctggggccgccccagtagtgagacagtggaagtaaaccccatctgccgttcccgtgcgtagagaaaaacgttgaccgcgaggctggggaggagagttgcctctgaggaagaagggcacagagacccaaaattagtttggaaagcatcctgatttggtgcccgaggcctggaaagaaatggcggctggggtgcggcggaggtaggggaggaaaacgttggatgagaagggcctggactcaggaaagggaaccgcgtccgtgtgagcccgctgagcgcgcagaccctgcccctgtctcctgtctgtctgcaggtctgcgcgtctgttgttcccagcgctctgcgaagcctgaaaaggaggagcaacctgtccagaatccccgcaggacaggaaaaggaggggaaatctcgacatggaaaaactctacagtgaaaatgaaggaatggcttcaaaccaaggaaagatggaaaatgaagaacagccacaagacgagagaaagccagaagtaacttgtactctggaagacaagaagttagaaaacgagggaaagacagaaaacaagggcaaaacaggagatgaggaaatgttaaaggataaaggaaagccagagagtgagggagaggcaaaagaaggaaagtcagagagggagggagagtcagagatggagggaggatcagagagagagggaaaaccagagatagagggaaagccagagagtgaaggagagccagggagtgaaacaagggctgcaggaaagcgcccagctgaggatgatgtacccaggaaagccaaaagaaaaactaataaggggctggctcattacctcaaggagtataaagaggccatacatgatatgaatttcagcaatgaggacatgataagagaatttgacaatatggctaaggtgcaggatgagaagagaaaaagcaaacagaaattgggggcgtttttgtggatgcaaagaaatttacaggaccccttctaccctagaggtccaagggaattcaggggtggctgcagggccccacgaagggacattgaagacattccttatgtgtagtgtccctggcaggcatttaccaggccatgtgctttaacgttacggtaatactttactttaggcatccctcctgttgctagcagccttttgacctatctgcaatgcagtgttctcagtaggaaatgttcatctgttacatggaaaaaatgttgatggtgcattgtaaaattaaaaaacacaacttgcagaaccaaatatatggcatcagtacatttttgtaaaactacaaagatacttacctagtaatatagtatagaaaacaattctgaaagctgtgtccactaaaagattaacagtggttatctctgggtgattttttctgttcttttttgttcatctgtccatttttctcctaaaaacagatttcttta

SEQ ID NO: 2455 - DNA, 681 bp, Homo sapiens
gcagatgtaggcaccggtccgagtgcctgccctctgtccccgcggctgggtctcgtctgctccggttcctgggctcctaattcttggtccagcttcttccaggcacatcctcttctctgccctccgtccattttggagccggagatggtgggctggggccgccccagtagtgagacagtggaagtaaaccccatctgccgttcccgtgcgtagagaaaaacgttgaccgcgaggctggggaggagagttgcctctgaggaagaagggcacagagacccaaaattagtttggaaagcatcctgatttggtgcccgaggcctggaaagaaatggcggctggggtgcggcggaggtctgcgcgtctgttgttcccagcgctctgcgaagcctgaaaaggaggagcaacctgtccagaatccccgcaggacaggaaaaggaggggaaatctcgacatggaaaaactctacagtgaaaatgaaggaatggcttcaaaccaaggaaagatggaaaatgaagaacagccacaagacgagagaaagccagaagtaacttgtactctggaagacaagaagttagaaaacgagggaaagacagaaaacaagggcaaaacaggagatgaggaaatgttaaaggataaaggaaagccagagagtgagggagaggcaaaagaaggaaagtcaga

SEQ ID NO: 2456 - DNA, 1008 bp, Homo sapiens
cgcggctgggtctcgtctgctccggttcctgggctcctaattcttggtccagcttcttccaggtctgcgcgtctgttgttcccagcgctctgcgaagcctgaaaaggaggagcaacctgtccagaatccccgcaggaaaaggaggggaaatctcgacatggaaaaactctacagtgaaaatgaaggaatggcttcaaaccaaggaaagatggaaaatgaagaacagccacaagacgagagaaagccagaagtaacttgtactctggaagacaagaagttagaaaacgagggaaagacagaaaacaagggcaaaacaggagatgaggaaatgttaaaggataaaggaaagccagagagtgagggagaggcaaaagaaggaaagtcagagagggagggagagtcagagatggagggaggatcagagagagagggaaaaccagagatagagggaaagccagagagtgaaggagagccagggagtgaaacaagggctgcaggaaagcgcccagctgaggatgatgtacccaggaaagccaaaagaaaaactaataaggggctggctcattacctcaaggagtataaagaggccatacatgatatgaatttcagcaatgaggacatgataagagaatttgacaatatggctaaggtgcaggatgagaagagaaaaagcaaacagaaattgggggcgtttttgtggatgcaaagaaatttacaggaccccttctaccctagaggtccaagggaattcaggggtggctgcagggccccacgaagggacattgaagacattccttatgtgtagtgtccctggcaggcatttaccaggccatgtgctttaacgttacggtaatactttactttaggcatccctcctgttgctagcagccttttgacctatctgcaatgcagtgttctcagtaggaaatgttcatctgttacatggaaaaaatgttgatggtgcattgtaaaattaaaaaacacaacttgcagaaccaaatatatggc

SEQ ID NO: 2457 - DNA, 1168 bp, Homo sapiens
agtgggctggctcctgacgcactttctgcgggtgggaggggaactagggacccgagcccactggtgacgtttttctcacgtgatctgaagccgacgtgtgcagaagtccctctcctccaggtaccagatccctgtttccgtggaggaaggcagacttcagactgaaggacagagaaggcaactgccctacagccctgcaggtcttcaagtctgtggttgtgggcactaacccagacaagaaaaggaaagacctgcagtatcggtgcaggaaaggcaaagaagggaacatctcaacatggaaaagctctacaaagaaaatgaaggaaagccagagaatgaaagaaacctagaaagtgagggaaagccagaggatgagggaagtacagaagatgaaggaaagtcagacgaggaagaaaagccggacatggaggggaagacagaatgcgagggaaagcgagaggatgagggagagccaggtgatgagggacaactggaagatgagggaaaccaggaaaagcagggcaagtctgaaggtgaggacaagccacaaagtgagggcaagccagcctcccaggccaagccagagagccagccgcgggccgccgaaaagcgcccggctgaagattatgtgccccggaaagcaaaaagaaaaaccgacagggggacggacgattcccccaaggactctcaggaggacttacaagaaaggcatctgagcagtgaggagatgatgagagaatgtggagatgtgtcaagggctcaggaggagctaaggaaaaaacagaaaatgggtggttttcattggatgcaaagagatgtacaggatccattcgccccaaggggccaacggggtgtgaggggagtgaggggcggaggtaggggccagaaagacttagaagatgtcccatatgtttaatgtctttggcctttaattctgatttctctgatgggaatattgccagtcctgcttttcctggcaggcatttgccggcctatgtgctttaaccttaagctgatactttcctttaggtgtcactcttgttaccagcagacttttgacccaactacagtgctctgtcttttagtagaggattttcacccatgtgcatggaataaatgttcatggtacattgtaaaataacaataaaaaagagttttcagaaccatg

SEQ ID NO: 2458 - DNA, 983 bp, Homo sapiens
gggagagacaacttgaggactgaggagagaggaggcccaggacagaaccccaggaacaccgccactcaaggtggcagctcagcttcctggcaggcaccactaccccccgggctctggagtcaggcagagccggtattgaaagtgggctgtggagttctggggctaagcgctcttggcaaagtcgggtaccctctctgatcagctgtcacacctggcgataatgggcatcagagagagatgccttgcgaggatgctgtgagctgcgtcaggtctgcgcgtctgttgttcccagcgctcttggaggcctgcaaaggaagagcaacctgtccagactccccgcaggaaaaagagaaatctcgacatggaaaaaccctacaataaaaatgaaggaaacctggaaaacgagggaaagccagaagatgaagtagagcctgatgatgaaggaaagtcagacgaggaagaaaagccagacgcggaggggaagacagaatgcgagggaaagcgaaaggctgagggagagccaggtgatgagggacaactggaagataagggaagccaggaaaagcagggcaagtccgaaggtgagggcaagccacaaggcgagggcaagccagcctcccaggcaaagccagagggccagccgcgggccgccgaaaagcgcccggctggagattatgtgccccggaaagcaaaaagaaaaacagacagggggacggacgattcccccaaggactctcaggaggacttacaggaaaggcatctgagcagtgaggagatgatgagagaatgtggagatgtgtcaagggctcaggaggagctaaggaaaaaacagaaaatgggtggttttcattggatgcaaagagatgtacaggatccattcgcccaaggggacaacggggtgtcaggggagtgaggggtggaggtaggggccaaagaggcttacacgatatcccatacctttaatgcctttggccttccattct

SEQ ID NO: 2459 - DNA, 1106 bp, Homo sapiens
gtgggcaccagcccccgcgcccgcccgcccgcccagcggtccggtccaggcgcccgcgcagaatcagctgtctgagctgcccaggcggcgggggagcagcgagcgggcttcagcgagccgcaggaggcacaggcctgtcctgggtccccgcaggtctgcgcgtctgttgttcccagcgctcttggaggcctgcaaaggaagagcaacctgtccagactccccgcaggacaggaaaaagagaaatctcgacatggaaaaaccctacaataaaaatgaaggaaacctggaaaacgagggaaagccagaagatgaagtagagcctgatgatgaaggaaagtcagacgaggaagaaaagccagacgcggaggggaagacagaatgcgagggaaagcgaaaggctgagggagagccaggtgatgagggacaactggaagataagggaagccaggaaaagcagggcaagtccgaaggtgagggcaagccacaaggcgagggcaagccagcctcccaggcaaagccagagggccagccgcgggccgccgaaaagcgcccggctggagattatgtgccccggaaagcaaaaagaaaaacagacagggggacggacgattcccccaaggactctcaggaggacttacaggaaaggcatctgagcagtgaggagatgatgagagaatgtggagatgtgtcaagggctcaggaggagctaaggaaaaaacagaaaatgggtggttttcattggatgcaaagagatgtacaggatccattcgcccaaggggacaacggggtgtcaggggagtgaggggtggaggtaggggccaaagaggcttacacgatatcccatacctttaatgcctttggccttccattctgacttctctgatgagattattgtcaaccctgctttccctggtagatatttgccaggcccaatgctttaaccttaagctgatatttttgctttagatgtcaatctcgttaccagcagccttttgacccaactacagcgctctatattttagtagaggattttcacccatgtgcatggaaaagatgttcatgacacattgtaaaaaataaataaataaagaacagtttgcagaacc

SEQ ID NO: 2460 - DNA, 600 bp, Homo sapiens
atggaaaaaccctacaataaaaatgaaggaaacctggaaaacgagggaaagccagaagatgaagtagagcctgatgatgaaggaaagtcagacgaggaagaaaagccagacgcggaggggaagacagaatgcgagggaaagcgaaaggctgagggagagccaggtgatgagggacaactggaagataagggaagccaggaaaagcagggcaagtccgaaggtgagggcaagccacaaggcgagggcaagccagcctcccaggcaaagccagagggccagccgcgggccgccgaaaagcgcccggctggagattatgtgccccggaaagcaaaaagaaaaacagacagggggacggacgattcccccaaggactctcaggaggacttacaggaaaggcatctgagcagtgaggagatgatgagagaatgtggagatgtgtcaagggctcaggaggagctaaggaaaaaacagaaaatgggtggttttcattggatgcaaagagatgtacaggatccattcccaaggggacaacggggtgtcaggggagtgaggggtggaggtaggggccaaagaggcttacacgatatcccatacctttaa

SEQ ID NO: 2461 - DNA, 1131 bp, Homo sapiens
acgtgaccaggagtcgacgtgtgcagaagtccttatagtccagggcctgtttccctgtagcagctccttattgctggagaaggagaaaagtgcccaagatcctttcaggattaatttattcaaaaaggaaataaaaaatactcaatatgcaaaagtcttgtgaagaaaatgagggaaaaccacagaacatgccaaaggccgaggaagatcgccctttggaggatgtaccacaggaggcagaaggaaatcctcaaccttccgaagaaggcgtaagccaggaagcagaaggaaaccccagaggagggccgaatcagcctggccagggatttaaagaggacacacccgttaggcatttggaccctgaagaaatgataagaggagtagatgagcttgaaaggcttagggaagagataagaagagtaagaaacaagtttgtgatgatgcattggaagcaaagacattcacgcagccgtccttatcctgtgtgctttaggccttgaattcatttttgcctaatattaaaatctggccccagctttctttctgttagcattttctgatgtatctttgacctccattttacttttaatcatctgatgaaattttgttttaggtaatttccttggtaccagcatctcattggattttggattttgacccattttccaggtctatttttcaattggaaactttcacacatttgcatgggaatatgttcattccatgttgtaaagtaaaacataacaggttatggcaaagcagcatatttaatatcagctcacatatgtaggataaaattccaaactttgtgtgtgtgcgtgtgtgtatacatacatccatataacatatatcacaaacttaaccaagcttatttctgtgtggtgtgaaattttatttgttttcttctttttgttctttttgcttatatgtactttttaatgaacacgtgtctcacacacaaaaagaattaaggattttttttacaagtaagagtcaaataatttgcaaccagcttatgagggcaatgggggcacctaaactcttgatgaaagaactttaaaaagaaatgtaaacctcaaattacctctggatctcttagccagaggaataaactggcaattattacagata

SEQ ID NO: 2462 - DNA, 1222 bp, Homo sapiens
agtgatgacgcgactctcacgtgaccaggagtcgacgtgtgcagaagtccttatagtccagggcctgtttccctgtagcagctccttattgctggagaaggagaaaagtgcccaagatcctttcaggatatttggttttttgggcgcgacacaaatcgaggtgagggaagagagaggaaaatcccctgaatccctgcaggattaatttattcaaaaaggaaataaaaaatactcaatatgcaaaagtcttgtgaagaaaatgagggaaaaccacagaacatgccaaaggccgaggaagatcgccctttggaggatgtaccacaggaggcagaaggaaatcctcaaccttccgaagaaggcgtaagccaggaagcagaaggaaaccccagaggagggccgaatcagcctggccagggatttaaagaggacacacccgttaggcatttggaccctgaagaaatgataagaggagtagatgagcttgaaaggcttagggaagagataagaagagtaagaaacaagtttgtgatgatgcattggaagcaaagacattcacgcagccgtccttatcctgtgtgctttaggccttgaattcatttttgcctaatattaaaatctggccccagctttctttctgttagcattttctgatgtatctttgacctccattttacttttaatcatctgatgaaattttgttttaggtaatttccttggtaccagcatctcattggattttggattttgacccattttccaggtctatttttcaattggaaactttcacacatttgcatgggaatatgttcattccatgttgtaaagtaaaacataacaggttatggcaaagcagcatatttaatatcagctcacatatgtaggataaaattccaaactttgtgtgtgtgcgtgtgtgtatacatacatccatataacatatatcacaaacttaaccaagcttatttctgtgtggtgtgaaattttatttgttttcttctttttgttctttttgcttatatgtactttttaatgaacacgtgtctcacacacaaaaagaattaaggattttttttacaagtaagagtcaaataatttgcaaccagcttatgagggcaatgggggcacctaaactcttgatgaaagaactttaaaaagaaatgtaaacctcaaattacctctggatctcttagccagaggaataaactggcaattattacagata

SEQ ID NO: 2463 - DNA, 449 bp, Homo sapiens
gactctcacgtgaccaggagtcgacgtgtgcagaagtccttatagtccagggcctgtttccctgtagcagctccttattgctggagaaggagaaaagtgcccaagatcctttcaggatatttggttttttgggcgcgacacaaatcgaggtgagggaagagagaggaaaatcccctgaatccctgcaggattaatttattcaaaaaggaaataaaaaatactcaatatgcaaaagtcttgtgaagaaaatgagggaaaaccacagaacatgccaaaggccgaggaagatcgccctttggaggatgtaccacaggaggacacacccgttaggcatttggaccctgaagaaatgataagaggagtagatgagcttgaaaggcttagggaagagataagaagagtaagaaacaagtttgtgatgatgcattggaagcaaagacattcacgca

SEQ ID NO: 2464 - DNA, 1351 bp, Homo sapiens
cccgccagctcgcggagccgctctgccccgcgccctagcccgcgcctgcagcccgcccaggcggagtcagcccgcgctccgcccgccgcgatccgagctcggaggttcggactccgggctcgccgccccccgggccggctccgcgccccgcactcccggcgcccagcgccccgcgccccggcgggcggagcgcaccatgccgcagctggactccggcgggggcggcgcgggcggcggcgacgacctcggcgcgccggacgagctgctggccttccaggatgaaggcgaggagcaggacgacaagagccgcgacagcgccgccggtcccgagcgcgacctggccgagctcaagtcgtcgctcgtgaacgagtccgagggcgcggccggcggcgcagggatcccgggggtcccgggggccggcgccggggcccgcggcgaggccgaggctctcgggcgggaacacgctgcgcagagactcttcccggacaaacttccagagcccctggaggacggcctgaaggccccggagtgcaccagcggcatgtacaaagagaccgtctactccgccttcaatctgctcatgcattacccacccccctcgggagcagggcagcacccccagccgcagcccccgctgcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggttcacccacccatccttgatgctaggttctggtgtacctggtcacccagcagccatcccccacccggccattgtgcccccctcagggaagcaggagctgcagcccttcgaccgcaacctgaagacacaagcagagtccaaggcagagaaggaggccaagaagccaaccatcaagaagcccctcaatgccttcatgctgtacatgaaggagatgagagccaaggtcattgcagagtgcacacttaaggagagcgctgccatcaaccagatcctgggccgcaggtggcacgcgctgtcgcgagaagagcaggccaagtactatgagctggcccgcaaggagaggcagctgcacatgcagctatacccaggctggtcagcgcgggacaactacgggaagaagaagaggcggtcgagggaaaagcaccaagaatccaccacagagacaaactggcccagagaactcaaggatggtaatggacaagagtcactgtccatgtcttcttcctctagcccagcttga

SEQ ID NO: 2465 - DNA, 1294 bp, Homo sapiens
cccgccagctcgcggagccgctctgccccgcgccctagcccgcgcctgcagcccgcccaggcggagtcagcccgcgctccgcccgccgcgatccgagctcggaggttcggactccgggctcgccgccccccgggccggctccgcgccccgcactcccggcgcccagcgccccgcgccccggcgggcggagcgcaccatgccgcagctggactccggcgggggcggcgcgggcggcggcgacgacctcggcgcgccggacgagctgctggccttccaggatgaaggcgaggagcaggacgacaagagccgcgacagcgccgccggtcccgagcgcgacctggccgagctcaagtcgtcgctcgtgaacgagtccgagggcgcggccggcggcgcagggatcccgggggtcccgggggccggcgccggggcccgcggcgaggccgaggctctcgggcgggaacacgctgcgcagagactcttcccggacaaacttccagagcccctggaggacggcctgaaggccccggagtgcaccagcggcatgtacaaagagaccgtctactccgccttcaatctgctcatgcattacccacccccctcgggagcagggcagcacccccagccgcagcccccgctgcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggttcacccacccatccttgatgctaggttctggtgtacctggtcacccagcagccatcccccacccggccattgtgcccccctcagggaagcaggagctgcagcccttcgaccgcaacctgaagacacaagcagagtccaaggcagagaaggaggccaagaagccaaccatcaagaagcccctcaatgccttcatgctgtacatgaaggagatgagagccaaggtcattgcagagtgcacacttaaggagagcgctgccatcaaccagatcctgggccgcaggtggcacgcgctgtcgcgagaagagcaggccaagtactatgagctggcccgcaaggagaggcagctgcacatgcagctatacccaggctggtcagcgcgggacaactacgggaagaagaagaggcggtcgagggaaaagcaccaagaatccaccacagataactctcttcactattcctag

SEQ ID NO: 2466 - DNA, 3045 bp, Homo sapiens
cccgccagctcgcggagccgctctgccccgcgccctagcccgcgcctgcagcccgcccaggcggagtcagcccgcgctccgcccgccgcgatccgagctcggaggttcggactccgggctcgccgccccccgggccggctccgcgccccgcactcccggcgcccagcgccccgcgccccggcgggcggagcgcaccatgccgcagctggactccggcgggggcggcgcgggcggcggcgacgacctcggcgcgccggacgagctgctggccttccaggatgaaggcgaggagcaggacgacaagagccgcgacagcgccgccggtcccgagcgcgacctggccgagctcaagtcgtcgctcgtgaacgagtccgagggcgcggccggcggcgcagggatcccgggggtcccgggggccggcgccggggcccgcggcgaggccgaggctctcgggcgggaacacgctgcgcagagactcttcccggacaaacttccagagcccctggaggacggcctgaaggccccggagtgcaccagcggcatgtacaaagagaccgtctactccgccttcaatctgctcatgcattacccacccccctcgggagcagggcagcacccccagccgcagcccccgctgcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggttcacccacccatccttgatgctaggttctggtgtacctggtcacccagcagccatcccccacccggccattgtgcccccctcagggaagcaggagctgcagcccttcgaccgcaacctgaagacacaagcagagtccaaggcagagaaggaggccaagaagccaaccatcaagaagcccctcaatgccttcatgctgtacatgaaggagatgagagccaaggtcattgcagagtgcacacttaaggagagcgctgccatcaaccagatcctgggccgcaggtggcacgcgctgtcgcgagaagagcaggccaagtactatgagctggcccgcaaggagaggcagctgcacatgcagctatacccaggctggtcagcgcgggacaactacgggaagaagaagaggcggtcgagggaaaagcaccaagaatccaccacaggaggaaaaagaaatgcattcggtacttacccggagaaggccgctgccccagccccgttccttccgatgacagtgctctaggctgccccgggtccccagctccccaggactcaccctcataccatctgctgccccgcttccccacagaactgcttactagccctgcggagccggcacctacatccccaggtctctccactgctctcagcctcccaaccccagggcccccacaggccccccgcagcaccctgcagagcacacaggtacagcaacaggaatctcagagacaggtggcctagcaggcacaggacacctggccgcctccaggagcctaccccctgaaagtgacagagacccagatctcatggaaactggccaggggtcctgttaacgtcatctcagggtccagaccctgaagatttcagaggctgcaggacttctgcctgaacctggggtcatcgattcaaactgctccaagtggtgggaatcagatctgtcttgatgtgtcatctaattaagggaatcccttgtacctatggctgcctgcatctattctttgtaccatctgtcttgccagccagaagcctctgcctccctagcttttctgctataggtcagagatgggctgaactgagcctagctaccttctctacccatctcccccatcccccactgccacaccctccccattcagacacttcatggaccaagaatgagctggtttgtcaaacaacatgtgagcatggtcacaagcacaaagctcaagatgacagctcttctaaggaaatggagaagctctgtttataaaaacaaaaacaaaaccagctgctactcataagttggaccagaggaagccccttactatgatctcaggagcttgcaagaagcaggaaggggaatggaataggttaagtttaggcctatcaacctaagcaacagaaataatctgacactaccttatcaggcaaattggggaggggagggtgtatctagctctagttcaaattatttggaagtgttccctgagaaacccaccagcctaagaagctctggccccaggcttgtcactagcagctgcagtcaacagttcaaagaagtcatggcccaaatccagtgtgcacccctccccattcacagagcctttttcacaattccatttccagttcatctatggcagtccagccagctcctgggcagcttgagagggcaaacccaaaacctcatgacagccagagcctgtctttcagcattcagtccgcctggccggctccagtttccccatggggctgcgggacagaggaccattacaactagatcaaggagcccagaaaacctccagtagtggacaacaggttttcaccatagcctacgttaacccatttttgagccaagcttcaaccctcagccttgaaaaacaagtctttaatttaatttttgttttttgcctaaatccaaagaaaaagggctgccgggccaggcgcggtggctcacgcctgtaatcccagcactttggcaggccgaggcaggtggatcacctgacgtcagtagtttgagaccagcctggccaacatggtgaaaccctgtatctactaaaaatacaaaaattagccggacgtggtggtgcgcgcatgtaatcccagctactcgggaggctgaggcggaagaatcacttgaacccgggaggcggaggttccagtgagccgagatggcgctattgcactccagtctgggtaacagggagactgcatctcaaaaaaaaaaaaaaaaaaaaaaaa

SEQ ID NO: 2467 - DNA, 3346 bp, Homo sapiens
cccgccagctcgcggagccgctctgccccgcgccctagcccgcgcctgcagcccgcccaggcggagtcagcccgcgctccgcccgccgcgatccgagctcggaggttcggactccgggctcgccgccccccgggccggctccgcgccccgcactcccggcgcccagcgccccgcgccccggcgggcggagcgcaccatgccgcagctggactccggcgggggcggcgcgggcggcggcgacgacctcggcgcgccggacgagctgctggccttccaggatgaaggcgaggagcaggacgacaagagccgcgacagcgccgccggtcccgagcgcgacctggccgagctcaagtcgtcgctcgtgaacgagtccgagggcgcggccggcggcgcagggatcccgggggtcccgggggccggcgccggggcccgcggcgaggccgaggctctcgggcgggaacacgctgcgcagagactcttcccggacaaacttccagagcccctggaggacggcctgaaggccccggagtgcaccagcggcatgtacaaagagaccgtctactccgccttcaatctgctcatgcattacccacccccctcgggagcagggcagcacccccagccgcagcccccgctgcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggttcacccacccatccttgatgctaggttctggtgtacctggtcacccagcagccatcccccacccggccattgtgcccccctcagggaagcaggagctgcagcccttcgaccgcaacctgaagacacaagcagagtccaaggcagagaaggaggccaagaagccaaccatcaagaagcccctcaatgccttcatgctgtacatgaaggagatgagagccaaggtcattgcagagtgcacacttaaggagagcgctgccatcaaccagatcctgggccgcaggtggcacgcgctgtcgcgagaagagcaggccaagtactatgagctggcccgcaaggagaggcagctgcacatgcagctatacccaggctggtcagcgcgggacaactacgggaagaagaagaggcggtcgagggaaaagcaccaagaatccaccacagaccctggctcgcctaagaaatgccgtgctcgctttggcctcaaccagcagacggattggtgtggtccgtgcaggaggaaaaagaaatgcattcggtacttacccggagaaggccgctgccccagccccgttccttccgatgacagtgctctaggctgccccgggtccccagctccccaggactcaccctcataccatctgctgccccgcttccccacagaactgcttactagccctgcgcggcacctacatccccaggtctctccactgctctcagcctcccaaccccagggcccccacaggccccccgcagcaccctgcagagcacacaggtacagcaacaggaatctcagagacaggtggcctagcaggcacaggacacctggccgcctccaggagcctaccccctgaaagtgacagagacccagatctcatggaaactggccaggggtcctgttaacgtcatctcagggtccagaccctgaagatttcagaggctgcaggacttctgcctgaacctggggtcatcgattcaaactgctccaagtggtgggaatcagatctgtcttgatgtgtcatctaattaagggaatcccttgtacctatggctgcctgcatctattctttgtaccatctgtcttgccagccagaagcctctgcctccctagcttttctgctataggtcagagatgggctgaactgagcctagctaccttctctacccatctcccccatcccccactgccacaccctccccattcagacacttcatggaccaagaatgagctggtttgtcaaacaacatgtgagcatggtcacaagcacaaagctcaagatgacagctcttctaaggaaatggagaagctctgtttataaaaacaaaaacaaaaccagctgctactcataagttggaccagaggaagccccttactatgatctcaggagcttgcaagaagcaggaaggggaatggaataggttaagtttaggcctatcaacctaagcaacagaaataatctgacactaccttatcaggcaaattggggaggggagggtgtatctagctctagttcaaattatttggaagtgttccctgagaaacccaccagcctaagaagctctggccccaggcttgtcactagcagctgcagtcaacagttcaaagaagtcatggcccaaatccagtgtgcacccctccccattcacagagcctttttcacaattccatttccagttcatctatggcagtccagccagctcctgggcagcttgagagggcaaacccaaaacctcatgacagccagagcctgtctttcagcattcagtccgcctggccggctccagtttccccatggggctgcgggacagaggaccattacaactagatcaaggagcccagaaaacctccagtagtggacaacaggttttcaccatagcctacgttaacccatttttgagccaagcttcaaccctcagccttgaaaaacaagtctttaatttaatttttgttttttgcctaaatccaaagaaaaagggctgccgggccaggcgcggtggctcacgcctgtaatcccagcactttggcaggccgaggcaggtggatcacctgacgtcagtagtttgagaccagcctggccaacatggtgaaaccctgtatctactaaaaatacaaaaattagccggacgtggtggtgcgcgcatgtaatcccagctactcgggaggctgaggcggaagaatcacttgaacccgggaggcggaggttccagtgagccgagatggcgctattgcactccagtctgggtaacagggagactgcatctcaaaaaaaaaaaaaaaaaaaaaaaagggctgtccatgtattcacacacccctcaaaaaaagcctttagttcctactttagccactggtttctcagaatccaaagatcacatattctagtgtaacactgcaagaagtcttgagaaaaagattattgtagtgttcaaaatatttttgtattgttaatgcatcatcatagaaaaacttttaaacatgagaataaagatactttttactgggtttgtttttcaaagcctga

SEQ ID NO: 2468 - DNA, 2929 bp, Homo sapiens
atccccgcctcccctcctgcccaggtgactgactaatccgccgccttcaggagacagaattggccaaggcctgaaggccccggagtgcaccagcggcatgtacaaagagaccgtctactccgccttcaatctgctcatgcattacccacccccctcgggagcagggcagcacccccagccgcagcccccgctgcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggttcacccacccatccttgatgctaggttctggtgtacctggtcacccagcagccatcccccacccggccattgtgcccccctcagggaagcaggagctgcagcccttcgaccgcaacctgaagacacaagcagagtccaaggcagagaaggaggccaagaagccaaccatcaagaagcccctcaatgccttcatgctgtacatgaaggagatgagagccaaggtcattgcagagtgcacacttaaggagagcgctgccatcaaccagatcctgggccgcaggtggcacgcgctgtcgcgagaagagcaggccaagtactatgagctggcccgcaaggagaggcagctgcacatgcagctatacccaggctggtcagcgcgggacaactacgggaagaagaagaggcggtcgagggaaaagcaccaagaatccaccacagaccctggctcgcctaagaaatgccgtgctcgctttggcctcaaccagcagacggattggtgtggtccgtgcagataactctcttcactattcctaggaggaaaaagaaatgcattcggtacttacccggagaaggccgctgccccagccccgttccttccgatgacagtgctctaggctgccccgggtccccagctccccaggactcaccctcataccatctgctgccccgcttccccacagaactgcttactagccctgcggagccggcacctacatccccaggtctctccactgctctcagcctcccaaccccagggcccccacaggccccccgcagcaccctgcagagcacacaggtacagcaacaggaatctcagagacaggtggcctagcaggcacaggacacctggccgcctccaggagcctaccccctgaaagtgacagagacccagatctcatggaaactggccaggggtcctgttaacgtcatctcagggtccagaccctgaagatttcagaggctgcaggacttctgcctgaacctggggtcatcgattcaaactgctccaagtggtgggaatcagatctgtcttgatgtgtcatctaattaagggaatcccttgtacctatggctgcctgcatctattctttgtaccatctgtcttgccagccagaagcctctgcctccctagcttttctgctataggtcagagatgggctgaactgagcctagctaccttctctacccatctcccccatcccccactgccacaccctccccattcagacacttcatggaccaagaatgagctggtttgtcaaacaacatgtgagcatggtcacaagcacaaagctcaagatgacagctcttctaaggaaatggagaagctctgtttataaaaacaaaaacaaaaccagctgctactcataagttggaccagaggaagccccttactatgatctcaggagcttgcaagaagcaggaaggggaatggaataggttaagtttaggcctatcaacctaagcaacagaaataatctgacactaccttatcaggcaaattggggaggggagggtgtatctagctctagttcaaattatttggaagtgttccctgagaaacccaccagcctaagaagctctggccccaggcttgtcactagcagctgcagtcaacagttcaaagaagtcatggcccaaatccagtgtgcacccctccccattcacagagcctttttcacaattccatttccagttcatctatggcagtccagccagctcctgggcagcttgagagggcaaacccaaaacctcatgacagccagagcctgtctttcagcattcagtccgcctggccggctccagtttccccatggggctgcgggacagaggaccattacaactagatcaaggagcccagaaaacctccagtagtggacaacaggttttcaccatagcctacgttaacccatttttgagccaagcttcaaccctcagccttgaaaaacaagtctttaatttaatttttgttttttgcctaaatccaaagaaaaagggctgccgggccaggcgcggtggctcacgcctgtaatcccagcactttggcaggccgaggcaggtggatcacctgacgtcagtagtttgagaccagcctggccaacatggtgaaaccctgtatctactaaaaatacaaaaattagccggacgtggtggtgcgcgcatgtaatcccagctactcgggaggctgaggcggaagaatcacttgaacccgggaggcggaggttccagtgagccgagatggcgctattgcactccagtctgggtaacagggagactgcatctcaaaaaaaaaaaaaaaaaaaaaaaagggctgtccatgtattcacacacccctcaaaaaaagcctttagttcctactttagccactggtttctcagaatccaaagatcacatattctagtgtaacactgcaagaagtcttgagaaaaagattattgtagtgttcaaaatatttttgtattgttaatgcatcatcatagaaaaacttttaaacatgagaataaagatactttttactgggtttgtttttcaaagcctga

SEQ ID NO: 2469 - DNA, 1306 bp, Homo sapiens
cccgccagctcgcggagccgctctgccccgcgccctagcccgcgcctgcagcccgcccaggcggagtcagcccgcgctccgcccgccgcgatccgagctcggaggttcggactccgggctcgccgccccccgggccggctccgcgccccgcactcccggcgcccagcgccccgcgccccggcgggcggagcgcaccatgccgcagctggactccggcgggggcggcgcgggcggcggcgacgacctcggcgcgccggacgagctgctggccttccaggatgaaggcgaggagcaggacgacaagagccgcgacagcgccgccggtcccgagcgcgacctggccgagctcaagtcgtcgctcgtgaacgagtccgagggcgcggccggcggcgcagggatcccgggggtcccgggggccggcgccggggcccgcggcgaggccgaggctctcgggcgggaacacgctgcgcagagactcttcccggacaaacttccagagcccctggaggacggcctgaaggccccggagtgcaccagcggcatgtacaaagagaccgtctactccgccttcaatctgctcatgcattacccacccccctcgggagcagggcagcacccccagccgcagcccccgctgcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggttcacccacccatccttgatgctaggttctggtgtacctggtcacccagcagccatcccccacccggccattgtgcccccctcagggaagcaggagctgcagcccttcgaccgcaacctgaagacacaagcagagtccaaggcagagaaggaggccaagaagccaaccatcaagaagcccctcaatgccttcatgctgtacatgaaggagatgagagccaaggtcattgcagagtgcacacttaaggagagcgctgccatcaaccagatcctgggccgcaggtggcacgcgctgtcgcgagaagagcaggccaagtactatgagctggcccgcaaggagaggcagctgcacatgcagctatacccaggctggtcagcgcgggacaactacgggaagaagaagaggcggtcgagggaaaagcaccaagaatccaccacagatgggatccctgcctgtaccatcctgagcccttaa

SEQ ID NO: 2470 - DNA, 2815 bp, Homo sapiens
gcccaggtgactgactaatccgccgccttcaggagacagaattggccaaggcctgaaggccccggagtgcaccagcggcatgtacaaagagaccgtctactccgccttcaatctgctcatgcattacccacccccctcgggagcagggcagcacccccagccgcagcccccgctgcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggttcacccacccatccttgatgctaggttctggtgtacctggtcacccagcagccatcccccacccggccattgtgcccccctcagggaagcaggagctgcagcccttcgaccgcaacctgaagacacaagcagagtccaaggcagagaaggaggccaagaagccaaccatcaagaagcccctcaatgccttcatgctgtacatgaaggagatgagagccaaggtcattgcagagtgcacacttaaggagagcgctgccatcaaccagatcctgggccgcaggtggcacgcgctgtcgcgagaagagcaggccaagtactatgagctggcccgcaaggagaggcagctgcacatgcagctatacccaggctggtcagcgcgggacaactacgggaagaagaagaggcggtcgagggaaaagcaccaagaatccaccacaggaggaaaaagaaatgcattcggtacttacccggagaaggccgctgccccagccccgttccttccgatgacagtgctctaggctgccccgggtccccagctccccaggactcaccctcataccatctgctgccccgcttccccacagaactgcttactagccctgcggagccggcacctacatccccaggtctctccactgctctcagcctcccaaccccagggcccccacaggccccccgcagcaccctgcagagcacacaggtacagcaacaggaatctcagagacaggtggcctagcaggcacaggacacctggccgcctccaggagcctaccccctgaaagtgacagagacccagatctcatggaaactggccaggggtcctgttaacgtcatctcagggtccagaccctgaagatttcagaggctgcaggacttctgcctgaacctggggtcatcgattcaaactgctccaagtggtgggaatcagatctgtcttgatgtgtcatctaattaagggaatcccttgtacctatggctgcctgcatctattctttgtaccatctgtcttgccagccagaagcctctgcctccctagcttttctgctataggtcagagatgggctgaactgagcctagctaccttctctacccatctcccccatcccccactgccacaccctccccattcagacacttcatggaccaagaatgagctggtttgtcaaacaacatgtgagcatggtcacaagcacaaagctcaagatgacagctcttctaaggaaatggagaagctctgtttataaaaacaaaaacaaaaccagctgctactcataagttggaccagaggaagccccttactatgatctcaggagcttgcaagaagcaggaaggggaatggaataggttaagtttaggcctatcaacctaagcaacagaaataatctgacactaccttatcaggcaaattggggaggggagggtgtatctagctctagttcaaattatttggaagtgttccctgagaaacccaccagcctaagaagctctggccccaggcttgtcactagcagctgcagtcaacagttcaaagaagtcatggcccaaatccagtgtgcacccctccccattcacagagcctttttcacaattccatttccagttcatctatggcagtccagccagctcctgggcagcttgagagggcaaacccaaaacctcatgacagccagagcctgtctttcagcattcagtccgcctggccggctccagtttccccatggggctgcgggacagaggaccattacaactagatcaaggagcccagaaaacctccagtagtggacaacaggttttcaccatagcctacgttaacccatttttgagccaagcttcaaccctcagccttgaaaaacaagtctttaatttaatttttgttttttgcctaaatccaaagaaaaagggctgccgggccaggcgcggtggctcacgcctgtaatcccagcactttggcaggccgaggcaggtggatcacctgacgtcagtagtttgagaccagcctggccaacatggtgaaaccctgtatctactaaaaatacaaaaattagccggacgtggtggtgcgcgcatgtaatcccagctactcgggaggctgaggcggaagaatcacttgaacccgggaggcggaggttccagtgagccgagatggcgctattgcactccagtctgggtaacagggagactgcatctcaaaaaaaaaaaaaaaaaaaaaaaagggctgtccatgtattcacacacccctcaaaaaaagcctttagttcctactttagccactggtttctcagaatccaaagatcacatattctagtgtaacactgcaagaagtcttgagaaaaagattattgtagtgttcaaaatatttttgtattgttaatgcatcatcatagaaaaacttttaaacatgagaataaagatactttttactgggtttgtttttcaaagcctga

SEQ ID NO: 2471 - DNA, 3330 bp, Homo sapiens
ccgccagctcgcggagccgctctgccccgcgccctagcccgcgcctgcagcccgcccaggcggagtcagcccgcgctccgcccgccgcgatccgagctcggaggttcggactccgggctcgccgccccccgggccggctccgcgccccgcactcccggcgcccagcgccccgcgccccggcgggcggagcgcaccatgccgcagctggactccggcgggggcggcgcgggcggcggcgacgacctcggcgcgccggacgagctgctggccttccaggatgaaggcgaggagcaggacgacaagagccgcgacagcgccgccggtcccgagcgcgacctggccgagctcaagtcgtcgctcgtgaacgagtccgagggcgcggccggcggcgcagggatcccgggggtcccgggggccggcgccggggcccgcggcgaggccgaggctctcgggcgggaacacgctgcgcagagactcttcccggacaaacttccagagcccctggaggacggcctgaaggccccggagtgcaccagcggcatgtacaaagagaccgtctactccgccttcaatctgctcatgcattacccacccccctcgggagcagggcagcacccccagccgcagcccccgctgcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggttcacccacccatccttgatgctaggttctggtgtacctggtcacccagcagccatcccccacccggccattgtgcccccctcagggaagcaggagctgcagcccttcgaccgcaacctgaagacacaagcagagtccaaggcagagaaggaggccaagaagccaaccatcaagaagcccctcaatgccttcatgctgtacatgaaggagatgagagccaaggtcattgcagagtgcacacttaaggagagcgctgccatcaaccagatcctgggccgcaggtggcacgcgctgtcgcgagaagagcaggccaagtactatgagctggcccgcaaggagaggcagctgcacatgcagctatacccaggctggtcagcgcgggacaactacgggaagaagaagaggcggtcgagggaaaagcaccaagaatccaccacagaccctggctcgcctaagaaatgccgtgctcgctttggcctcaaccagcagacggattggtgtggtccgtgcaggaggaaaaagaaatgcattcggtacttacccggagaaggccgctgccccagccccgttccttccgatgacagtgctctaggctgccccgggtccccagctccccaggactcaccctcataccatctgctgccccgcttccccacagaactgcttactagccctgcggagccggcacctacatccccaggtctctccactgctctcagcctcccaaccccagggcccccacaggccccccgcagcaccctgcagagcacacaggtacagcaacaggaatctcagagacaggtggcctagcaggcacaggacacctggccgcctccaggagcctaccccctgaaagtgacagagacccagatctcatggaaactggccaggggtcctgttaacgtcatctcagggtccagaccctgaagatttcagaggctgcaggacttctgcctgaacctggggtcatcgattcaaactgctccaagtggtgggaatcagatctgtcttgatgtgtcatctaattaagggaatcccttgtacctatggctgcctgcatctattctttgtaccatctgtcttgccagccagaagcctctgcctccctagcttttctgctataggtcagagatgggctgaactgagcctagctaccttctctacccatctcccccatcccccactgccacaccctccccattcagacacttcatggaccaagaatgagctggtttgtcaaacaacatgtgagcatggtcacaagcacaaagctcaagatgacagctcttctaaggaaatggagaagctctgtttataaaaacaaaaacaaaaccagctgctactcataagttggaccagaggaagccccttactatgatctcaggagcttgcaagaagcaggaaggggaatggaataggttaagtttaggcctatcaacctaagcaacagaaataatctgacactaccttatcaggcaaattggggaggggagggtgtatctagctctagttcaaattatttggaagtgttccctgagaaacccaccagcctaagaagctctggccccaggcttgtcactagcagctgcagtcaacagttcaaagaagtcatggcccaaatccagtgtgcacccctccccattcacagagcctttttcacaattccatttccagttcatctatggcagtccagccagctcctgggcagcttgagagggcaaacccaaaacctcatgacagccagagcctgtctttcagcattcagtccgcctggccggctccagtttccccatggggctgcgggacagaggaccattacaactagatcaaggagcccagaaaacctccagtagtggacaacaggttttcaccatagcctacgttaacccatttttgagccaagcttcaaccctcagccttgaaaaacaagtctttaatttaatttttgttttttgcctaaatccaaagaaaaagggctgccgggccaggcgcggtggctcacgcctgtaatcccagcactttggcaggccgaggcaggtggatcacctgacgtcagtagtttgagaccagcctggccaacatggtgaaaccctgtatctactaaaaatacaaaaattagccggacgtggtggtgcgcgcatgtaatcccagctactcgggaggctgaggcggaagaatcacttgaacccgggaggcggaggttccagtgagccgagatggcgctattgcactccagtctgggtaacagggagactgcatctcaaaaaaaaaaaaaaaaaaaaaaaagggctgtccatgtattcacacacccctcaaaaaaagcctttagttcctactttagccactggtttctcagaatccaaagatcacatattctagtgtaacactgcaagaagtcttgagaaaaagattattgtagtgttcaaaatatttttgtattgttaatgcatcatcatagaaaaacttttaaacatgagaataaagatactttttactggg

SEQ ID NO: 2472 - DNA, 1198 bp, Homo sapiens
atccccgcctcccctcctgcccaggtgactgactaatccgccgccttcaggagacagaattggccaaggcctgaaggccccggagtgcaccagcggcatgtacaaagagaccgtctactccgccttcaatctgctcatgcattacccacccccctcgggagcagggcagcacccccagccgcagcccccgctgcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggttcacccacccatccttgatgctaggttctggtgtacctggtcacccagcagccatcccccacccggccattgtgcccccctcagggaagcaggagctgcagcccttcgaccgcaacctgaagacacaagcagagtccaaggcagagaaggaggccaagaagccaaccatcaagaagcccctcaatgccttcatgctgtacatgaaggagatgagagccaaggtcattgcagagtgcacacttaaggagagcgctgccatcaaccagatcctgggccgcaggtggcacgcgctgtcgcgagaagagcaggccaagtactatgagctggcccgcaaggagaggcagctgcacatgcagctatacccaggctggtcagcgcgggacaactacgggaagaagaagaggcggtcgagggaaaagcaccaagaatccaccacagaccctggctcgcctaagaaatgccgtgctcgctttggcctcaaccagcagacggattggtgtggtccgtgcaggaggaaaaagaaatgcattcggtacttacccggagaaggccgctgccccagccccgttccttccgatgacagtgctctaggctgccccgggtccccagctccccaggactcaccctcataccatctgctgccccgcttccccacagaactgcttactagccctgcggagccggcacctacatccccaggtctctccactgctctcagcctcccaaccccagggcccccacaggccccccgcagcaccctgcagagcacacaggtacagcaacaggaatctcagagacaggtggcctag

SEQ ID NO: 2473 - DNA, 584 bp, Homo sapiens
gcgccgccccagttgcgcgcggccctcggggtctccagcgcgcagagcgtccctgccccggcgtcggccccgacccccgcggtcccaccgcccctcactcccctccggttctccctccaggctctcgggcgggaacacgctgcgcagagactcttcccggacaaacttccagagcccctggaggacggcctgaaggccccggagtgcaccagcggcatgtacaaagagaccgtctactccgccttcaatctgctcatgcattacccacccccctcgggagcagggcagcacccccagccgcagcccccgctgcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggttcacccacccatccttgatgctaggttctggtgtacctggtcacccagcagccatcccccacccggccattgtgcc

SEQ ID NO: 2474 - DNA, 1254 bp, Homo sapiens
gcccaggtgactgactaatccgccgccttcaggagacagaattggccaaggcctgaaggccccggagtgcaccagcggcatgtacaaagagaccgtctactccgccttcaatctgctcatgcattacccacccccctcgggagcagggcagcacccccagccgcagcccccgctgcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggttcacccacccatccttgatgctaggttctggtgtacctggtcacccagcagccatcccccacccggccattgtgcccccctcagggaagcaggagctgcagcccttcgaccgcaacctgaagacacaagcagagtccaaggcagagaaggaggccaagaagccaaccatcaagaagcccctcaatgccttcatgctgtacatgaaggagatgagagccaaggtcattgcagagtgcacacttaaggagagcgctgccatcaaccagatcctgggccgcaggtggcacgcgctgtcgcgagaagagcaggccaagtactatgagctggcccgcaaggagaggcagctgcacatgcagctatacccaggctggtcagcgcgggacaactacgggaagaagaagaggcggtcgagggaaaagcaccaagaatccaccacagagacaaactggcccagagaactcaaggatggtaatggacaagagtcactgtccatgtcttcttcctctagcccagcttgaggactgggatggctgggcaaggaagccataggcattgcggccccttgccttggtgcagatgtgagtcccacaaacacatctggagaagctcaaaggccgggactgggagatgactcccttggaagacaggagagatgactcccttggaagacagatgacagcccataggcctagtgacaaaaggcccctttgccaccttgtggctgttctgggaactgcacctgtcctaggtctgggccagaccaagcagaatggcagtctgaggacactgacttaccacccaagtcccaggaagagaggacaaggaatcagccaggcctgtgcaaaggcagcattttttggttgtggtgtatgactatgaattc

SEQ ID NO: 2475 - DNA, 539 bp, Homo sapiens
acttccggtgccctgacctttataggagtaaacagacccccgccatccccgcctcccctcctgcccaggcctgaaggccccggagtgcaccagcggcatgtacaaagagaccgtctactccgccttcaatctgctcatgcattacccacccccctcgggagcagggcagcacccccagccgcagcccccgctgcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggttcacccacccatccttgatgctaggttctggtgtacctggtcacccagcagccatcccccacccggccattgtgcccccctcagggaagcaggagctgcagcccttcgaccgcaacctgaagacacaagcagagtccaaggcagagaagg

SEQ ID NO: 2476 - DNA, 2968 bp, Homo sapiens
ggccaggggctgggacgccccggcggagcaggcggcggcggtggcgagttggggagccctaggctcggcgctgccggaggggcccgagccgagccgcctgcgccccggccgggcagcgccgggcccgcttcccgcggggccacgccctgtcaaactttgttgcggcggctagcgcagcgggcccgcaagcgggcgggaggggcgccgggccgggccgggcagggcgcgggcggctaggggctccgagagcggcggccccggcccgcggccccaccatgccccagctcggcggcgggggcggcggcggcggcggcggcagcgggggaggcggcggctccagcgccggggcggccggcggaggggacgacctcggggcgaacgacgagctgatccccttccaggacgaggggggcgaggagcaggagccgagcagcgatagcgcctcggcgcagcgggacctagacgaggtcaagtcgtccctggtcaacgagtcggagaaccagagcagcagctcggactcggaggcggagaggcgcccgcagcccgtccgggacactttccagaagccgcgggactatttcgccgaagtgagaaggcctcaggacagcgcgttctttaaaggacccccgtaccctgggtaccccttcctgatgatcccggacctgagcagcccgtacctctccaacggacccctgtctcccggaggagcgcgcacctacctgcagatgaaatggcccctcctcgatgtcccctccagcgccacagtcaaggacacgaggtcaccatctccagcacacttgtctaataaagttcctgtcgttcagcacccgcatcacatgcatccgctgactcccctcatcacctacagcaatgaccacttctcccccggctcccctcccacccacctctccccagagatcgatccaaagacaggaatcccccggccccctcacccatccgagctgtcaccgtattacccactctctcccggagctgtcggacaaatcccccaccccctcggctggctcgtcccacagcaaggccagcccatgtactcccttcctcccggtggcttccggcacccttaccccgccctcgccatgaacgcctcgatgtccagcctggtctccagtcggttctctcctcacatggtggctcctgcccaccctggcctgcccacctcagggatcccccaccctgccatcgtctcccccatcgtcaagcaggaaccggcaccccccagcctgagccctgcagtgagcgtgaaatcaccagtcaccgtgaaaaaggaggaggaaaagaagccccacgtgaagaagcctctgaatgccttcatgttgtatatgaaggagatgagggccaaggtggtggctgagtgcaccctgaaggaaagtgcagccattaaccagatccttggaagaaagtggcacaacctgtctcgagaagaacaggccaagtactacgagctggcccggaaggagcggcagcttcactcgcagctctacccaacctggtcagcccgggacaactatggtaagaaaaagaagaggaagagagaaaagcagctgtcccagacacagtcacagcagcaagtccaggaggcagagggtgccctggcctccaagagcaagaagccatgtgttcagtacctgccccccgagaagccctgtgacagccctgcctcctcccacgggagcatgctggactccccggccactccctctgcagctttggcctcaccagctgcccctgctgccacccattcggagcaagcccagcccctctccctcaccaccaaaccagaaacccgggcccagctggctctccactctgccgccttcctgtcggctaaggctgcagcctcctcctctgggcagatgggcagccagcctcccctcctgtcccggcccctcccccttgggtccatgcccacagctctgctggcctctcccccgtccttccccgccacgctccatgcccaccaggccctcccggtgctacaggcccagcctctttccctggtcaccaagtctgcccactaagctccccccgacccctgcaggctgtcacatgactcattgagtagtaatgattcagaagaaaaagaaaaaggagactttattggtcaatatttgaccactctggactgttctgtaaagtggctggtaacaacagcactttacagtttgtagatgtaaccagtagctgatcttaaggcttttttaaaaaacaaaacaaaacaacaaaaaaaaatctttataagaaagagaactgaaaagtagcgtgctattcgtcctgtaggtgctgtggtggatggacctgggcagagggcacttctctctcttacctctcttgcactttctgtctcctgtctcttctcgcccctgccgcctgccccagcttccccgactccatctgcagctctgccattgtgacatttcctgttacccagcccaagttttcatcgtctgctcaataccgtgggttcttcttcgtcctctgtcctctgcccagtgtgaggccatcaccatgtgagaagacatcttggcctgatttgctgccaccagcgtcccctccctcagtgggcccgaactcgccagccccagctttcagtggagaaagcggtcctctgaaatggtttcctcccaacccccgcatttaaagggactcaaggtgcctgccacttcctcagcgaagaagtctgtgttcctccccgtccttgccagtggcgatcatcccttcacaatcccagagtggcaggcgggaccggccccatggtctggctcctgtcacctgggtccgtgccagcacaatctgccaaagttctagagaccctgttcccttccccatcacctcacatgcttcttctgtgtgtatttctttttgtttttatggtttttggagcaatttaaactcccagttgtttattttcacaaaagaaaataaaattgcagttgcaagacctttt

SEQ ID NO: 2477 - DNA, 2140 bp, Homo sapiens
cacacacacacacacacacacacacacacacacacacacacacacatacacacgcccggggaggcaggccggagagacctccctcccgcccctcccgcccgcctccctcccctcgccgccgccgccgccgccagcatctgggaccggccgattctgcacctccgtccggcgctgccctttgattcggatttccatcttgcattctccggctgatcgcgggacctggctcgtgcagaggaggggggccgatcgctatggagtatttcatggtgcccactcagaaggtgccctctttgcaacatttcaggaaaacagagaaagaagtgataggagggctctgtagccttgccaacattccactaacccccgagactcagcgggaccaggagcggcggattcggcgggagatcgccaacagcaacgagcggagacgcatgcagagcatcaacgcgggattccagtccctcaagaccctcatcccccacacagacggagagaagctcagcaaggcagccattctccagcagacagccgagtacatcttctccctggagcaggagaagaccaggctcttgcagcagaacacacagctcaagcgcttcatccaggagctgagcggctcgtcccccaagcgacggcgggcagaggacaaggacgaaggcataggctccccggacatctgggaggacgagaaggcggaggacctgcggcgggagatgattgagctgcggcagcagctggacaaggagcgctcggtgcgcatgatgctggaggagcaggtgcgctcgctggaggcccacatgtacccggaaaagctcaaggtgattgcgcagcaggtgcagctgcagcagcagcaggaacaggtgaggctgctgcaccaggagaagctggagcgggaacagcagcagctgcggacccagcttctgccccctccggcccccacccaccaccccacggtgatcgtgccagcaccgcctcctcctccctcccaccacatcaatgtcgtcaccatgggcccctcctcggtcatcaactctgtttccacatcccggcaaaatctggacaccatcgtgcaggcaatccagcacatcgagggcacccaggaaaagcaggagctggaggaggagcagcggcgagctgtcatcgtgaagcctgtccgcagctgcccggaggcccccacctctgacaccgcctccgactccgaggcctcagacagtgacgccatggaccagagccgggaggagccgtcgggggacggggagcttccctgactacccccccagccctcctctcccttctgggggctggagggagccggggcagccacagggagagacatgggcgaatgagtgagaaatttttacaaaattacgatgtcatttgggtctcttttatgacctctttttcaatactgtaaatcgacctttgaacgaagccactcaacccgaggtcccggggctggggtgtcgcagagcgtgtgggagcatcggcaccccagggcggggcctcggccccgggggctggaggaagctgacacggagatgcctggcctctctctgccaaaaagcattttttcctttaaatatgttttttaagaacagggaaaattaaacaaaaccccaggttatttcttccctgcccagagccagcctgggattgtcagccttcaatcccctttccttcctctttttgggttttcttctttctcctttaagcacttacatggttgggggtaagactaggctggggcattctgggggcccggaggtctccgttgcttcttggttggggtttgctgctgctgtgcccccctcccccttccccatctcggcactagaattcgccactctcccaccccccagcccccacctctgcctccaggtctcatcttccaccccaaaaatgtctgtctctctctttttgttttgtttgttgttggttttttatttctttttggtttgctttctgtttttgttttgtttttcttttttttctttcttttttttttttttttacaattttgaggtcttcgtgttcaaggagaagctattatattttgttaagaaagtggggagaaaaaaaccaagaggccaccgtgcctttgtaaagaaacaaaataaagtttgtactttgtttttta

SEQ ID NO: 2478 - DNA, 2354 bp, Homo sapiens
ggccgggcgggcatgggccttcccggcccggagctgggagtcgaaggggcgggaggcgtgatggtgaactcgcaagaagtttgagggacgcgcgggccccgcgcccactccccctccaccggacacggctggggccggcgatgcctgagagggggtcggaggacgcagtgaacatatatgcatgtacagtgtggatcctcatctgagaggagggagatgaaaacacacccacctcacaggctgttgtgaggactaagggtgcggcagtgcctggtacatgggagccagcgccggcagccaccatggcgtcacgcatagggttgcgcatgcagctcatgcgggagcaggcgcagcaggaggagcagcgggagcgcatgcagcaacaggctgtcatgcattacatgcagcagcagcagcagcagcaacagcagcagctcggagggccgcccaccccggccatcaatacccccgtccacttccagtcgccaccacctgtgcctggggaggtgttgaaggtgcagtcctacctggagaatcccacatcctaccatctgcagcagtcgcagcatcagaaggtgcgggagtacctgtccgagacctatgggaacaagtttgctgcccacatcagcccagcccagggctctccgaaacccccaccagccgcctccccaggggtgcgagctggacacgtgctgtcctcctccgctggcaacagtgctcccaatagccccatggccatgctgcacattggctccaaccctgagagggagttggatgatgtcattgacaacattatgcgtctggacgatgtccttggctacatcaatcctgaaatgcagatgcccaacacgctacccctgtccagcagccacctgaatgtgtacagcagcgacccccaggtcacagcctccctggtgggcgtcaccagcagctcctgccctgcggacctgacccagaagcgagagctcacagatgctgagagcagggccctggccaaggagcggcagaagaaagacaatcacaacttaattgaaaggagacgaaggttcaacatcaatgaccgcatcaaggagttgggaatgctgatccccaaggccaatgacctggacgtgcgctggaacaagggcaccatcctcaaggcctctgtggattacatccggaggatgcagaaggacctgcaaaagtccagggagctggagaaccactctcgccgcctggagatgaccaacaagcagctctggctccgtatccaggagctggagatgcaggctcgagtgcacggcctccctaccacctccccgtccggcatgaacatggctgagctggcccagcaggtggtgaagcaggagctgcctagcgaagagggcccaggggaggccctgatgctgggggctgaggtccctgaccctgagccactgccagctctgcccccgcaagccccgctgcccctgcccacccagccaccatccccattccatcacctggacttcagccacagcctgagctttgggggcagggaggacgagggtcccccgggctaccccgaacccctggcgccggggcatggctccccattccccagcctgtccaagaaggatctggacctcatgctcctggacgactcactgctaccgctggcctctgatccacttctgtccaccatgtcccccgaggcctccaaggccagcagccgccggagcagcttcagcatggaggagggcgatgtgctgtgaccctggctgcccctgtgccagggaacaggggccggcctgggggctgggagggccaggggcacctccctcccacccttcaggctgcactgtgtgtgaagtagccacctgccctgcctccctcctccccgttggcccctgtttggacttagtgcctgtctggcagcctgtggggtcaggagaagcacccccagggcagccctcttgactggcgcagtgggaagaggccttcagcccctctcccggagatggaatcgcggggcagggaggggcagggtgttctagaggtgagaagagggcctggtggagattccctgtcttctgagcccgagcccctcattaccagtgaaggacatgcttgaggggttcgggaagctcctcatctgaggcaactggtcctgggggtgctcaggcctgcctttttgggactcagatggcaggaggtccaccccgcagcctggtcctcggctctcccacaggtgggcaccccccactttggtgctaatagctctccaccaggtggtgtgagcgcgggggctgccagaagcgggaggggtcactgccggaagagcagctgccctccgacccctcactttgtgcctttagtaaacactgtgctttgta

SEQ ID NO: 2479 - DNA, 2315 bp, Homo sapiens
ctgcaatgagtgaagaagacagaaccttcagttttggtccaggaaccaggaaacttggattcatgtctcagctgtcacccgcttgctcagtgaccttgggcaaatctcttcccctctcagggctcggtgtcttctcctctaaaatggatgcggtcccagtcattctggcctccccctgccagcccctgtgctttgaggaggacacgtgcctcatatacctgctgccccttctcatccacagggagccagcgccggcagccaccatggcgtcacgcatagggttgcgcatgcagctcatgcgggagcaggcgcagcaggaggagcagcgggagcgcatgcagcaacaggctgtcatgcattacatgcagcagcagcagcagcagcaacagcagcagctcggagggccgcccaccccggccatcaatacccccgtccacttccagtcgccaccacctgtgcctggggaggtgttgaaggtgcagtcctacctggagaatcccacatcctaccatctgcagcagtcgcagcatcagaaggtgcgggagtacctgtccgagacctatgggaacaagtttgctgcccacatcagcccagcccagggctctccgaaacccccaccagccgcctccccaggggtgcgagctggacacgtgctgtcctcctccgctggcaacagtgctcccaatagccccatggccatgctgcacattggctccaaccctgagagggagttggatgatgtcattgacaacattatgcgtctggacgatgtccttggctacatcaatcctgaaatgcagatgcccaacacgctacccctgtccagcagccacctgaatgtgtacagcagcgacccccaggtcacagcctccctggtgggcgtcaccagcagctcctgccctgcggacctgacccagaagcgagagctcacagatgctgagagcagggccctggccaaggagcggcagaagaaagacaatcacaacttaattgaaaggagacgaaggttcaacatcaatgaccgcatcaaggagttgggaatgctgatccccaaggccaatgacctggacgtgcgctggaacaagggcaccatcctcaaggcctctgtggattacatccggaggatgcagaaggacctgcaaaagtccagggagctggagaaccactctcgccgcctggagatgaccaacaagcagctctggctccgtatccaggagctggagatgcaggctcgagtgcacggcctccctaccacctccccgtccggcatgaacatggctgagctggcccagcaggtggtgaagcaggagctgcctagcgaagagggcccaggggaggccctgatgctgggggctgaggtccctgaccctgagccactgccagctctgcccccgcaagccccgctgcccctgcccacccagccaccatccccattccatcacctggacttcagccacagcctgagctttgggggcagggaggacgagggtcccccgggctaccccgaacccctggcgccggggcatggctccccattccccagcctgtccaagaaggatctggacctcatgctcctggacgactcactgctaccgctggcctctgatccacttctgtccaccatgtcccccgaggcctccaaggccagcagccgccggagcagcttcagcatggaggagggcgatgtgctgtgaccctggctgcccctgtgccagggaacaggggccggcctgggggctgggagggccaggggcacctccctcccacccttcaggctgcactgtgtgtgaagtagccacctgccctgcctccctcctccccgttggcccctgtttggacttagtgcctgtctggcagcctgtggggtcaggagaagcacccccagggcagccctcttgactggcgcagtgggaagaggccttcagcccctctcccggagatggaatcgcggggcagggaggggcagggtgttctagaggtgagaagagggcctggtggagattccctgtcttctgagcccgagcccctcattaccagtgaaggacatgcttgaggggttcgggaagctcctcatctgaggcaactggtcctgggggtgctcaggcctgcctttttgggactcagatggcaggaggtccaccccgcagcctggtcctcggctctcccacaggtgggcaccccccactttggtgctaatagctctccaccaggtggtgtgagcgcgggggctgccagaagcgggaggggtcactgccggaagagcagctgccctccgacccctcactttgtgcctttagtaaacactgtgctttgta

SEQ ID NO: 2480 - DNA, 2188 bp, Homo sapiens
gaggagaaagtagagaatgatgcctccgcaccctgtgaacttccaacaagggaaggtgacatgaaaggagctcagacaatttctgtccagcaacatgacagcaagctcaggctgggagccagcgccggcagccaccatggcgtcacgcatagggttgcgcatgcagctcatgcgggagcaggcgcagcaggaggagcagcgggagcgcatgcagcaacaggctgtcatgcattacatgcagcagcagcagcagcagcaacagcagcagctcggagggccgcccaccccggccatcaatacccccgtccacttccagtcgccaccacctgtgcctggggaggtgttgaaggtgcagtcctacctggagaatcccacatcctaccatctgcagcagtcgcagcatcagaaggtgcgggagtacctgtccgagacctatgggaacaagtttgctgcccacatcagcccagcccagggctctccgaaacccccaccagccgcctccccaggggtgcgagctggacacgtgctgtcctcctccgctggcaacagtgctcccaatagccccatggccatgctgcacattggctccaaccctgagagggagttggatgatgtcattgacaacattatgcgtctggacgatgtccttggctacatcaatcctgaaatgcagatgcccaacacgctacccctgtccagcagccacctgaatgtgtacagcagcgacccccaggtcacagcctccctggtgggcgtcaccagcagctcctgccctgcggacctgacccagaagcgagagctcacagatgctgagagcagggccctggccaaggagcggcagaagaaagacaatcacaacttaattgaaaggagacgaaggttcaacatcaatgaccgcatcaaggagttgggaatgctgatccccaaggccaatgacctggacgtgcgctggaacaagggcaccatcctcaaggcctctgtggattacatccggaggatgcagaaggacctgcaaaagtccagggagctggagaaccactctcgccgcctggagatgaccaacaagcagctctggctccgtatccaggagctggagatgcaggctcgagtgcacggcctccctaccacctccccgtccggcatgaacatggctgagctggcccagcaggtggtgaagcaggagctgcctagcgaagagggcccaggggaggccctgatgctgggggctgaggtccctgaccctgagccactgccagctctgcccccgcaagccccgctgcccctgcccacccagccaccatccccattccatcacctggacttcagccacagcctgagctttgggggcagggaggacgagggtcccccgggctaccccgaacccctggcgccggggcatggctccccattccccagcctgtccaagaaggatctggacctcatgctcctggacgactcactgctaccgctggcctctgatccacttctgtccaccatgtcccccgaggcctccaaggccagcagccgccggagcagcttcagcatggaggagggcgatgtgctgtgaccctggctgcccctgtgccagggaacaggggccggcctgggggctgggagggccaggggcacctccctcccacccttcaggctgcactgtgtgtgaagtagccacctgccctgcctccctcctccccgttggcccctgtttggacttagtgcctgtctggcagcctgtggggtcaggagaagcacccccagggcagccctcttgactggcgcagtgggaagaggccttcagcccctctcccggagatggaatcgcggggcagggaggggcagggtgttctagaggtgagaagagggcctggtggagattccctgtcttctgagcccgagcccctcattaccagtgaaggacatgcttgaggggttcgggaagctcctcatctgaggcaactggtcctgggggtgctcaggcctgcctttttgggactcagatggcaggaggtccaccccgcagcctggtcctcggctctcccacaggtgggcaccccccactttggtgctaatagctctccaccaggtggtgtgagcgcgggggctgccagaagcgggaggggtcactgccggaagagcagctgccctccgacccctcactttgtgcctttagtaaacactgtgctttgta

SEQ ID NO: 2481 - DNA, 2331 bp, Homo sapiens
gtggagtgacagccggagcccgggcgccgggcgcggggctcggtgacagcggaggcggcggcccgggcgggacgcagggagcggccgcggcgccgacggcggcgggaagggcggacggggcgggcctccctggtggcacggggccggagcaggccgggagcaggtggcgggcacagcttgcgggccaggcacccgaacttgcgacaagttgccggagccgcggggcgcgggcggcggacagattgaccttcagagcgagggagccagcgccggcagccaccatggcgtcacgcatagggttgcgcatgcagctcatgcgggagcaggcgcagcaggaggagcagcgggagcgcatgcagcaacaggctgtcatgcattacatgcagcagcagcagcagcagcaacagcagcagctcggagggccgcccaccccggccatcaatacccccgtccacttccagtcgccaccacctgtgcctggggaggtgttgaaggtgcagtcctacctggagaatcccacatcctaccatctgcagcagtcgcagcatcagaaggtgcgggagtacctgtccgagacctatgggaacaagtttgctgcccacatcagcccagcccagggctctccgaaacccccaccagccgcctccccaggggtgcgagctggacacgtgctgtcctcctccgctggcaacagtgctcccaatagccccatggccatgctgcacattggctccaaccctgagagggagttggatgatgtcattgacaacattatgcgtctggacgatgtccttggctacatcaatcctgaaatgcagatgcccaacacgctacccctgtccagcagccacctgaatgtgtacagcagcgacccccaggtcacagcctccctggtgggcgtcaccagcagctcctgccctgcggacctgacccagaagcgagagctcacagatgctgagagcagggccctggccaaggagcggcagaagaaagacaatcacaacttaattgaaaggagacgaaggttcaacatcaatgaccgcatcaaggagttgggaatgctgatccccaaggccaatgacctggacgtgcgctggaacaagggcaccatcctcaaggcctctgtggattacatccggaggatgcagaaggacctgcaaaagtccagggagctggagaaccactctcgccgcctggagatgaccaacaagcagctctggctccgtatccaggagctggagatgcaggctcgagtgcacggcctccctaccacctccccgtccggcatgaacatggctgagctggcccagcaggtggtgaagcaggagctgcctagcgaagagggcccaggggaggccctgatgctgggggctgaggtccctgaccctgagccactgccagctctgcccccgcaagccccgctgcccctgcccacccagccaccatccccattccatcacctggacttcagccacagcctgagctttgggggcagggaggacgagggtcccccgggctaccccgaacccctggcgccggggcatggctccccattccccagcctgtccaagaaggatctggacctcatgctcctggacgactcactgctaccgctggcctctgatccacttctgtccaccatgtcccccgaggcctccaaggccagcagccgccggagcagcttcagcatggaggagggcgatgtgctgtgaccctggctgcccctgtgccagggaacaggggccggcctgggggctgggagggccaggggcacctccctcccacccttcaggctgcactgtgtgtgaagtagccacctgccctgcctccctcctccccgttggcccctgtttggacttagtgcctgtctggcagcctgtggggtcaggagaagcacccccagggcagccctcttgactggcgcagtgggaagaggccttcagcccctctcccggagatggaatcgcggggcagggaggggcagggtgttctagaggtgagaagagggcctggtggagattccctgtcttctgagcccgagcccctcattaccagtgaaggacatgcttgaggggttcgggaagctcctcatctgaggcaactggtcctgggggtgctcaggcctgcctttttgggactcagatggcaggaggtccaccccgcagcctggtcctcggctctcccacaggtgggcaccccccactttggtgctaatagctctccaccaggtggtgtgagcgcgggggctgccagaagcgggaggggtcactgccggaagagcagctgccctccgacccctcactttgtgcctttagtaaacactgtgctttg

SEQ ID NO: 2482 - DNA, 2595 bp, Homo sapiens
agatgcggatgcgctcggttagaacgcagttcttggtgccacgactgggagacagtcctcaggccctcccctcagggagctcactgtccggggagggacagccagcaatagttcctggccggccaggagaggcagaggcagaggaagggaagggtcagctgccttgaggtccctgcctgctaacctgacggtatgctttcaccatgccggtgaccccagccccaggaccacgagcaactcgcctggctcccttctctccgtctgcctcctggccgcggggcccggagagctgggagccagagggtgtaaatgaagggcagagctgtttgggtgactccatgctctgcttctccccgagggaagccaatggtgcttaccatttacaaggcttgttacagctgcagggttattttgtcctcaactcagctctgggagacggagccaaatggggacccaggtatcttggttccgggtgccctggaaggagttcaggggatagggcaggggacaccctaggtgggcactgaatctagggagagccaactgggcttttacgggctaatggcctggtgactcacagtcagaggtgggcagggagtgggccagggcaggcaggagcccttccagggtcccacgtgcgctgtcacaggcctcctcagcctgtttctggaaagctgagaagtaggtggaaggggactcccacccctcaagtctggctgccctttgagggtctagctcttggccctgagccctcctggggctctgtttatgactgtaattgcatcattagccagagttaatagagttacttagcacctgcccccacagggagtagcccagccaccccctgggttctgtctcttccttttcaaagtcaactcggtttctgcaggcaacaggggtttccccaaccacagctgtcatgaaaaccaggttgggcctttgtcctggggatggagggcagtcagcacttggggcctggcttggggctgccctggagatgaccatggaaattgggttggcctcctctgatcggagggtgggagttcagggttcccagagctgccagaaatgttcacgtcccaggacgcagtgaacatatatgcatgtacagtgtggatcctcatctgagaggagggagatgaaaacacacccacctcacaggctgttgtgaggactaagggtgcggcagtgcctggtacatgggagccagcgccggcagccaccatggcgtcacgcatagggttgcgcatgcagctcatgcgggagcaggcgcagcaggaggagcagcgggagcgcatgcagcaacaggctgtcatgcattacatgcagcagcagcagcagcagcaacagcagcagctcggagggccgcccaccccggccatcaatacccccgtccacttccagtcgccaccacctgtgcctggggaggtgttgaaggtgcagtcctacctggagaatcccacatcctaccatctgcagcagtcgcagcatcagaaggtgcgggagtacctgtccgagacctatgggaacaagtttgctgcccacatcagcccagcccagggctctccgaaacccccaccagccgcctccccaggggtgcgagctggacacgtgctgtcctcctccgctggcaacagtgctcccaatagccccatggccatgctgcacattggctccaaccctgagagggagttggatgatgtcattgacaacattatgcgtctggacgatgtccttggctacatcaatcctgaaatgcagatgcccaacacgctacccctgtccagcagccacctgaatgtgtacagcagcgacccccaggtcacagcctccctggtgggcgtcaccagcagctcctgccctgcggacctgacccagaagcgagagctcacagatgctgagagcagggccctggccaaggagcggcagaagaaagacaatcacaacttaattgaaaggagacgaaggttcaacatcaatgaccgcatcaaggagttgggaatgctgatccccaaggccaatgacctgtgagcaggtttctgagggggagggtgatgggtctgggtgggcagcagctgacaagtattatctgccctcagccccatgctagttactaggatgggaggagaattccttctagaagttcatctatttgagaaaagatctctccctctcccaaatcaggaaagaatcaggaaagctcaagacagatgagtttctgtcctggaagtgaggctgaggtcaagggaggcttcttggaggagcagtcatgctgagaaagttttcttaaggccattgggctggcagacaagaggccgggctcacgcctataatcccagcactgtgggaagctgaggcaggcagatcacttgaggtcatgagttcaagaccagcctggccaacatggcgaaaccccatctctactaaaaatacaaaacttagctgggcacagtggtgtgtgcctacagtgccagctactagggaggctgagacaggagaattgattgaactcaggaggtggaggtagcagtgagccgagatctcgctactgcactgcattccagcctgggcaacagaacgagactccatctc

SEQ ID NO: 2483 - DNA, 2187 bp, Homo sapiens
gaggagaaagtagagaatgatgcctccgcaccctgtgaacttccaacaagggaaggtgacatgaaaggagctcagacaatttctgtccagcaacatgacagcaagctcaggctgggagccagcgccggcagccaccatggcgtcacgcatagggttgcgcatgcagctcatgcgggagcaggcgcagcaggaggagcagcgggagcgcatgcagcaacaggctgtcatgcattacatgcagcagcagcagcagcagcaacagcagcagctcggagggccgcccaccccggccatcaatacccccgtccacttccagtcgccaccacctgtgcctggggaggtgttgaaggtgcagtcctacctggagaatcccacatcctaccatctgcagcagtcgcagcatcagaaggtgcgggagtacctgtccgagacctatgggaacaagtttgctgcccacatcagcccagcccagggctctccgaaacccccaccagccgcctccccaggggtgcgagctggacacgtgctgtcctcctccgctggcaacagtgctcccaatagccccatggccatgctgcacattggctccaaccctgagagggagttggatgatgtcattgacaacattatgcgtctggacgatgtccttggctacatcaatcctgaaatgcagatgcccaacacgctacccctgtccagcagccacctgaatgtgtacagcagcgacccccaggtcacagcctccctggtgggcgtcaccagcagctcctgccctgcggacctgacccagaagcgagagctcacagatgctgagagcagggccctggccaaggagcggcagaagaaagacaatcacaacttaattgaaaggagacgaaggttcaacatcaatgaccgcatcaaggagttgggaatgctgatccccaaggccaatgacctggacgtgcgctggaacaagggcaccatcctcaaggcctctgtggattacatccggaggatgcagaaggacctgcaaaagtccagggagctggagaaccactctcgccgcctggagatgaccaacaagcagctctggctccgtatccaggagctggagatgcaggctcgagtgcacggcctccctaccacctccccgtccggcatgaacatggctgagctggcccagcaggtggtgaagcaggagctgcctagcgaagagggcccaggggaggccctgatgctgggggctgaggtccctgaccctgagccactgccagctctgcccccgcaagccccgctgcccctgcccacccagccaccatccccattccatcacctggacttcagccacagcctgagctttgggggcagggaggacgagggtcccccgggctaccccgaacccctggcgccggggcatggctccccattccccagcctgtccaagaaggatctggacctcatgctcctggacgactcactgctaccgctggcctctgatccacttctgtccaccatgtcccccgaggcctccaaggccagcagccgccggagcagcttcagcatggaggagggcgatgtgctgtgaccctggctgcccctgtgccagggaacaggggccggcctgggggctgggagggccaggggcacctccctcccacccttcaggctgcactgtgtgtgaagtagccacctgccctgcctccctcctccccgttggcccctgtttggacttagtgcctgtctggcagcctgtggggtcaggagaagcacccccagggcagccctcttgactggcgcagtgggaagaggccttcagcccctctcccggagatggaatcgcggggcagggaggggcagggtgttctagaggtgagaagagggcctggtggagattccctgtcttctgagcccgagcccctcattaccagtgaaggacatgcttgaggggttcgggaagctcctcatctgaggcaactggtcctgggggtgctcaggcctgcctttttgggactcagatggcaggaggtccaccccgcagcctggtcctcggctctcccacaggtgggcaccccccactttggtgctaatagctctccaccaggtggtgtgagcgcgggggctgccagaagcgggaggggtcactgccggaagagcagctgccctccgacccctcactttgtgcctttagtaaacactgtgctttgt

SEQ ID NO: 2484 - DNA, 1022 bp, Homo sapiens
tgttgggtaggctgcggtgtgggactgtgccgtcggggcgcagttccctctgtgctgtgagtaatcctcggccgcatttgcagctcccaggggattgtgcaacttcctctccagctgaggtgcagggggctgggtgagaaacagcagccgccggggaaatgaggaaactgagcccggccctggggctggggtgcggccctgggctccggcccctggaggagctgagcattccaggggcctccttccagggggctgccctctcgaagggagccagcgccggcagccaccatggcgtcacgcatagggttgcgcatgcagctcatgcgggagcaggcgcagcaggaggagcagcgggagcgcatgcagcaacaggctgtcatgcattacatgcagcagcagcagcagcagcaacagcagcagctcggagggccgcccaccccggccatcaatacccccgtccacttccagtcgccaccacctgtgcctggggaggtgttgaaggtgcagtcctacctggagaatcccacatcctaccatctgcagcagtcgcagcatcagaaggtgcgggagtacctgtccgagacctatgggaacaagtttgctgcccacatcagcccagcccagggctctccgaaacccccaccagccgcctccccaggggtgcgagctggacacgtgctgtcctcctccgctggcaacagtgctcccaatagccccatggccatgctgcacattggctccaaccctgagagggagttggatgatgtcattgacaacattatgcgtctggacgatgtccttggctacatcaatcctgaaatgcagatgcccaacacgctacccctgtccagcagccacctgaatgtgtacagcagcgacccccaggtcacagcctccctggtgggcgtcaccagcagctcctgccctgcggacctgacccagaagcgagagctcacagatgctgagagcagggccctggccaaggagcggcagaagaaagacaatcacaacttaattgaaag

SEQ ID NO: 2485 - DNA, 914 bp, Homo sapiens
gcttcacgcacggctgccccgagctgctccgggctgcgcgagcaggttcgcgccgcagccgcctggcgcgccccagccccgcgccccggggagccagcgccggcagccaccatggcgtcacgcatagggttgcgcatgcagctcatgcgggagcaggcgcagcaggaggagcagcgggagcgcatgcagcaacaggctgtcatgcattacatgcagcagcagcagcagcagcaacagcagcagctcggagggccgcccaccccggccatcaatacccccgtccacttccagtcgccaccacctgtgcctggggaggtgttgaaggtgcagtcctacctggagaatcccacatcctaccatctgcagcagtcgcagcatcagaaggtgcgggagtacctgtccgagacctatgggaacaagtttgctgcccacatcagcccagcccagggctctccgaaacccccaccagccgcctccccaggggtgcgagctggacacgtgctgtcctcctccgctggcaacagtgctcccaatagccccatggccatgctgcacattggctccaaccctgagagggagttggatgatgtcattgacaacattatgcgtctggacgatgtccttggctacatcaatcctgaaatgcagatgcccaacacgctacccctgtccagcagccacctgaatgtgtacagcagcgacccccaggtcacagcctccctggtgggcgtcaccagcagctcctgccctgcggacctgacccagaagcgagagctcacagatgctgagagcagggccctggccaaggagcggcagaagaaagacaatcacaacttaattgaaaggagacgaaggttcaacatcaatgaccgcatcaaggagttgggaatgctgatccccaaggccaatgacct

SEQ ID NO: 2486 - DNA, 984 bp, Homo sapiens
ggtgtgagctgacgagagcttcaggtgggagcctctcccggcagtgaatctgagggttgggagggatttccggacccagagggaagatattttggggccgagggcctttccagaacccatgaaatcacacaccctgctgcgaccagactgaccctccctagttgatggttcttttttggacatcctaggcctgcttgggattctggccccatgatttagggtttctttggagcccatctgagcctggggggccctgtggtggtggaagaggtccagcctgcggtggtgaaagagggagccagcgccggcagccaccatggcgtcacgcatagggttgcgcatgcagctcatgcgggagcaggcgcagcaggaggagcagcgggagcgcatgcagcaacaggctgtcatgcattacatgcagcagcagcagcagcagcaacagcagcagctcggagggccgcccaccccggccatcaatacccccgtccacttccagtcgccaccacctgtgcctggggaggtgttgaaggtgcagtcctacctggagaatcccacatcctaccatctgcagcagtcgcagcatcagaaggtgcgggagtacctgtccgagacctatgggaacaagtttgctgcccacatcagcccagcccagggctctccgaaacccccaccagccgcctccccaggggtgcgagctggacacgtgctgtcctcctccgctggcaacagtgctcccaatagccccatggccatgctgcacattggctccaaccctgagagggagttggatgatgtcattgacaacattatgcgtctggacgatgtccttggctacatcaatcctgaaatgcagatgcccaacacgctacccctgtccagcagccacctgaatgtgtacagcagcgacccccaggtcacagcctccctggtgggcgtcaccagcagctcctgccctgcggacctgacccagaagcgagagctcac

SEQ ID NO: 2487 - DNA, 340 bp, Homo sapiens
gttgatgtctgcttttcagtgtactgctgcctctctctgctctcagttcccctgaacatgtctgaagtgggccggtctagctgactcgagggacccatgtcacagggagccagcgccggcagccaccatggcgtcacgcatagggttgcgcatgcagctcatgcgggagcaggcgcagcaggaggagcagcgggagcgcatgcagcaacaggctgtcatgcattacatgcagcagcagcagcagcagcaacagcagcagctcggagggccgcccaccccggccatcaatacccccgtccacttccagtcgccaccacctgtgcctggggaggtgttgaag

SEQ ID NO: 2488 - DNA, 2098 bp, Homo sapiens
ggccgggcgggcatgggccttcccggcccggagctgggagtcgaaggggcgggaggcgtgatggtgaactcgcaagaagtttgagggacgcgcgggccccgcgcccactccccctccaccggacacggctggggccggcgatgcctgagagggggtcggaggacgcagtgaacatatatgcatgtacagtgtggatcctcatctgagaggagggagatgaaaacacacccacctcacaggctgttgtgaggactaagggtgcggcagtgcctggtacatgggagccagcgccggcagccaccatggcgtcacgcatagggttgcgcatgcagctcatgcgggagcaggcgcagcaggaggagcagcgggagcgcatgcagcaacaggctgtcatgcattacatgcagcagcagcagcagcagcaacagcagcagctcggagggccgcccaccccggccatcaatacccccgtccacttccagtcgccaccacctgtgcctggggaggtgttgaagttggatgatgtcattgacaacattatgcgtctggacgatgtccttggctacatcaatcctgaaatgcagatgcccaacacgctacccctgtccagcagccacctgaatgtgtacagcagcgacccccaggtcacagcctccctggtgggcgtcaccagcagctcctgccctgcggacctgacccagaagcgagagctcacagatgctgagagcagggccctggccaaggagcggcagaagaaagacaatcacaacttaattgaaaggagacgaaggttcaacatcaatgaccgcatcaaggagttgggaatgctgatccccaaggccaatgacctggacgtgcgctggaacaagggcaccatcctcaaggcctctgtggattacatccggaggatgcagaaggacctgcaaaagtccagggagctggagaaccactctcgccgcctggagatgaccaacaagcagctctggctccgtatccaggagctggagatgcaggctcgagtgcacggcctccctaccacctccccgtccggcatgaacatggctgagctggcccagcaggtggtgaagcaggagctgcctagcgaagagggcccaggggaggccctgatgctgggggctgaggtccctgaccctgagccactgccagctctgcccccgcaagccccgctgcccctgcccacccagccaccatccccattccatcacctggacttcagccacagcctgagctttgggggcagggaggacgagggtcccccgggctaccccgaacccctggcgccggggcatggctccccattccccagcctgtccaagaaggatctggacctcatgctcctggacgactcactgctaccgctggcctctgatccacttctgtccaccatgtcccccgaggcctccaaggccagcagccgccggagcagcttcagcatggaggagggcgatgtgctgtgaccctggctgcccctgtgccagggaacaggggccggcctgggggctgggagggccaggggcacctccctcccacccttcaggctgcactgtgtgtgaagtagccacctgccctgcctccctcctccccgttggcccctgtttggacttagtgcctgtctggcagcctgtggggtcaggagaagcacccccagggcagccctcttgactggcgcagtgggaagaggccttcagcccctctcccggagatggaatcgcggggcagggaggggcagggtgttctagaggtgagaagagggcctggtggagattccctgtcttctgagcccgagcccctcattaccagtgaaggacatgcttgaggggttcgggaagctcctcatctgaggcaactggtcctgggggtgctcaggcctgcctttttgggactcagatggcaggaggtccaccccgcagcctggtcctcggctctcccacaggtgggcaccccccactttggtgctaatagctctccaccaggtggtgtgagcgcgggggctgccagaagcgggaggggtcactgccggaagagcagctgccctccgacccctcactttgtgcctttagtaaacactgtgctttgt

SEQ ID NO: 2489 - DNA, 377 bp, Homo sapiens
ttgaggtccctgcctgctaacctgacgtgtggatcctcatctgagaggagggagatgaaaacacacccacctcacaggctgttgtgaggactaagggtgcggcagtgcctggtacatgggagccagcgccggcagccaccatggcgtcacgcatagggttgcgcatgcagctcatgcgggagcaggcgcagcaggaggagcagcgggagcgcatgcagcaacaggctgtcatgcattacatgcagcagcagcagcagcagcaacagcagcagctcggagggccgcccaccccggccatcaatacccccgtccacttccagtcgccaccacctgtgcctggggaggtgttgaaggtgcagtcctacctggagaatccc

SEQ ID NO: 2490 - DNA, 281 bp, Homo sapiens
ggccgggcgggcatgggccttcccggcccggagctgggagtcgaaggggcgggaggcgtgatggtgaactcgcaagaagtttgagggacgcgcgggccccgcgcccactccccctccaccggacacggctggggccggcgatgcctgagagggggtcggagggagccagcgccggcagccaccatggcgtcacgcatagggttgcgcatgcagctcatgcgggagcaggcgcagcaggaggagcagcgggagcgcatgcagcaacaggctgtcatgcatta

SEQ ID NO: 2491 - DNA, 168 bp, Homo sapiens
agctccagccgtcgttctctcgcctgtctgttctggggacggttcagcgcggagcttctgcactcaacttgagcgcagtttttggcttagagctcgctggggaagtgcagggagccagcgccggcagccaccatggcgtcacgcatagggttgcgcatgcagctcatg

SEQ ID NO: 2492 - DNA, 365 bp, Homo sapiens
ggtgtgagctgacgagagcttcaggcctgcttgggattctggccccatgatttagggtttctttggagcccatctgagcctggggggccctgtggtggtggaagaggtccagcctgcggtggtgaaagagggagccagcgccggcagccaccatggcgtcacgcatagggttgcgcatgcagctcatgcgggagcaggcgcagcaggaggagcagcgggagcgcatgcagcaacaggctgtcatgcattacatgcagcagcagcagcagcagcaacagcagcagctcggagggccgcccaccccggccatcaatacccccgtccacttccagtcgccaccacctgtgcctggggaggtgttgaag

SEQ ID NO: 2493 - DNA, 223 bp, Homo sapiens
gcagttcttggtgccacgactgggagacagtcctcaggccctcccctcagggagctcactgtccggggagggacagccagcaatagttcctggccggccaggagaggcagaggcagaggaagggaagggtcagctgccttgaggtccctgcctgctaacctgacgggagccagcgccggcagccaccatggcgtcacgcatagggttgcgcatgcagctcatg

SEQ ID NO: 2494 - DNA, 6628 bp, Homo sapiens
gtttactttggttgtcccttctggcatggtgcatatgttatgggaagagggattataatttggtgctgtttgtagagatgacaacactgataaaatccactcattgctggtcccagcacacctggaaagttctgcaaggcctcagctacagaaagcccagagacagaaagtaaactctttcatgacccttgatcatcagatcatcaatccaactcttaaatggtcacaacctgcagtgccaagtggtgggcctcttgtgcagcatgcacacacaactctggacagtgatgctggcctcacagaaaacccactcaccaagttactagctattgggaaagaagatgacaatgcacaatggcatatggaggacgttattgaggatataatcggtatggaatcaagttttaaagaggaaggagcagactctcctctgctaatgcaaagaacattatctggaagtattttggatgtgtatagcggtgaacaaggaatttcaccaattaacatggggcttacaagtgcttcttgtccaagtagtctaccaatgaaaagagaaattacagaaactgacactagagctttagcaaaagagagacaaaaaaaggacaaccacaacctcattgaaagaagaagaaggtataatattaattaccgaatcaaggagcttggcactcttattccaaagtctaatgatcctgatatgcgctggaacaaaggaaccattctaaaagcatcagtggagtacatcaagtggctacaaaaagaacaacagagagcccgagaattggaacacagacagaagaaattagagcaggctaacaggcgacttctacttcggattcaggaactagaaattcaggctcgtactcatggtctgccaaccctggcttcacttggcacggttgatttaggtgctcatgtcaccaaacagcagagccatcctgagcagaattcagtagactattgccaacaactgactgtgtctcaggggccaagccctgagctctgtgatcaagctatagccttttctgatcctttgtcatacttcacagatttatcatttagtgctgcattgaaagaggaacaaagattggatggcatgctattggatgacacaatctctccatttggaacagatcctctgctatctgccacttcccctgcagtttccaaagaaagcagtaggagaagtagctttagctcagatgatggtgatgaattataagaaataaacagacccaattcatcaactggaaagcaattctatgctggtgctatgcaattatgctctgtgtttcatatgttgctttggcttattttttttcttaaaggaatgtgttgttcatgaaaaactgatagaagcaacagaagaattcgcaggaagaaaaatcatagtgttaatgaattattgagggcgaaaaaaaggtgttttcttctttgactacggagtccaaatccacttaaattctgttttcctgaaaagaggtacagcataagaaatagctctttattgatgttttaaaagcagcaacttggtggtgtactactggaactaatgactgcaaagtgttaaacgactgaaatatacaaacagtctcttagttactcatttccatcttctcttcaactttcacatcagtcttccggaatcaagatcaacatatcaggtggtcattgcctttctccattgtctagtagacatgtctaaagttcaaactttataggataaataaatgtataatagattatctgtcacttgtggttgaaaggcaaatctacaataaatgtgagaattttccacaataaaatatggataacttataaaaacattggttactaaaattagatcctcattttattgtagttggttcaattacactaattctaaaagcatccatgcatatttatatctccagtctctgttcaggaaaaggaacatattgaatattttcctcaggaatatggaccagaattgtatcccttcacacaaacatacacatacacatatgcacatcattcaggtagtatatgttcttttgttttcttcatgcttctgactgcatcagaatcacattccaaattctcttttcttatgaagaagagatgtcagatcatcaattttagtaaataaaatataaaatgtccccctgcaaggacagttttcaggtacttaaaacttttcatcagtattggacagaaatcaattagttgttgatttggtttttctccaaatggataaaatattgaaaattgaattgccaattgacaaaataattattacaacaaactatttcttattattttcagttctgagaggaacgtaaggttctatttctataaacacttagagtgtcctatgatctttggttgcactgttagcatttattataagcacttataactatgatgcttcatttagatttttatctcttgcgcttgttttaggttaggaaattaagttaccaagcacgttgctctgtgctggacctccaagagtgatcatccgatcaatgagtattcatggaggcatactcagaactgcagtgagtcctgagaaaatgtagaagagttgaaaaagatatggtcttactcctaaggtagttaatgagaatgcatgaaaaacaaaaacaaaagatagaagacatatagaataaaaaatctaagcataaactgtaaatacagaaggtcagagaaaatgaaaatgactgacaaactttatgggaacagcagaatttgacttctctttgaaaggcattaattgagtgaaagtgagggcatataaaggaataataccaaccaaatgataaaagtgagaataataggggaagtatctttataggactttaattagaaagatctggatgccctagaagatgtctgttggggagttctgaagcataagactgacaacaggttgtgaaggcccttagaaaactatggtgaaataatatagtattaatataatagaaacaaatctttttagtagcagggaggatgctaaaaactaaaatatatattactaatgagtgagatgtaatctttcatgaatattaagctttgggataaattttgaaaggatcttttagttgcttctcacatggaaaatatgtcactatgaaatgtgagaccctaatgctgataaaagtagaaaaatagtaaatcattatggtataataattatctcaggcttagcttgtatcatttgctcagaatttggagaattaaaataattttattgtttgacatggaaaaataattactaacttctgggtacagtcattaaagcctgatagataaattcatctgaaatatgccatgtgaaacagctattagatacatcttctcaataattttcaagacgatattacatacttttaattttataacaaaattccacttcattatctgagttgataatttgattaaatgttaaaaattatagataaggaatatattttggagttcatagaaaacacaccactttattagatagagactggcttcagttctcattttatctgctcttctcatttcttcatattttgagtagacttgcactgatgatgtcattactcagtcattattttctgttctgttaaggtacaactactgggccttgaaatctatccttcacaatcttggctgagataaggacttggcacaggatgatagagcctggacacaagagatctggagagggaactgctatttgctgctacattcagattatgagatgtcagggaactgtaaaaagggtaatgaatttttaaagagagtaaagagttatgctgtgtcccggtcaactgaaatacattaaaaattaattagatggtagttcttaactttttaaggcagataccttgagaatctagtgagttatagaccctctccctagaaaagtatagaactgtttatatggacaataattcacatgcattcagagatcttagggatctcctgaatgttttcttggatcccaagtgaaaaattcctgaatcaggtctcttaggtgtgcggttaatgtcatgtataacaatggggggacccttacttatctaaatataattatcccaatcctaataatgatgaggttgcataggaaagtaatagtgtaccaaactttagattattcactaaaaaagttgttcatttatgaagtagtcgtttatcaaacatgtcctccccactcagcaaactatgccttctatttattatatatgggtcagtttcactataattactgagtgttataaacatctgaccataacattttgaaatgatgcaaataaatttccaaacaaaaatagtgtgaatttaaaagcaaattatttgagtatctaagaaacaagatagacttctagaaaaatttgactctctagaatatttcttgcagaaatgagatttttcataatagtaaaagaggcatatgtttatcaaacaatgctgtcacaaaaagcatcaactgtaatgggactattaatgcataattattgatttattcattcaattaatatacaattatcccttttcatttaaagatttaattcataattacaattataataaaacttcctttaaagtaagatacaataattttattgtttttcattcttttttcaacaaaatatcccatccaatcattttttatattattaaatattggctgctttttcttggattcacattaaacagccctttccaacttccaattgtcttaaaataatgatgacctcctgtgagtagatacagctctttacaatttttttctttagtgccttttcttcttgaatttttcctatatcaaatggagaatatatgtacagatggtattttctcagtttataggcatatcagtgaccatggctttctttatataggtttttaaaaaagccctaaataataaatagccagatgagctggggacattgagaaatagccttcctcttcctttttcaactcatttttttcccacctacatgactgtaaatcaaatatttaatagctcttacttaaaaaaacagatacaaagaatgtcttgatttggtgtgctcatttaccataatgtcatgaggggaattagatttcacaactttaaaaggaatatatttttattttattttgaaaaactgagtcatataggaattttcttatacttcaaggcatcatggaaacacttttttcctgtttggatattgtggaatttaaacgttcaaataaataaatggcataactaagtgttccaaatttttttacaatgtctttgaccctattcaaacactttaggtatttactgaccgtctgatgtgtaagatgtggaataaaactggaatcaattaattatttcactgtgttatcagcgcaagatcaaccatctgggtttcttaaagacacccgaaggattgaattttgtttcagtattgataatggcatagtctctatgtgctacatggaattacatcatttatccctccagtgccctatatgttgataagtatgtcagtttgacttagtatacatatatacagagatttcattacatttacctaataaatacaaaatacatttcgagtgttactgatctcctatgttacatgagcctcctgtaatcattgtgcattgatgttccaatgttttattgtttgtatgaattttaatttgaaaacaaggaaacaatccaaaagcagaaaaaatagcttttcttaaaattttcagtgctacattttccctctgaggtccatagagatttgaatgtataggagattatccgaaaacagctattttgattaaaaaatatatctcccaggattcaaccaacttaatgatgaagtactattgtctactgctttatacataaaagggaactttttatctgcttgtaaagggatttttatgtgtatttctgcataatcagatgacttctattgtgttttctactgatgaaattctctgtaaaatgtctttttcttacattatccaacaggcataaagaataacagtaaagacttttgtgtttgtaatactacctcttttatccctgcactactgttttattgcaaaaattctatattgtcactgtattttttccatagaatataaattttgttcttgtgctaaagctggtagtttatgtagcagacaaaatatacaaataaaagaagagactgattttgctgaaagaattatatataatcaagaagttacatattgttctttaaatatgatactgaattttaaaagcaaacgaaattcaagaatcttatctaacagcatagcagttgcttatggcatacaaggctaaaattaattcagctatttaatcttaataattattatgtagttaaaaatctttgactttaatagtgttttacatatacaaatagctgaagtaacattcctataattttaatctgacattggttagatcaagaaaacattgttaataagactgtagaatttgtaattattgctatttttcatttttaataacaaagtaatgtgtcttattttctaagaaaatggagaactttggtgtactttaatacatacaaaaatctttgtaaaaataccttaaaatgtaccaatattttctttgcatatattaaatgaaagactataattatgaaatgtt

SEQ ID NO: 2495 - DNA, 6605 bp, Homo sapiens
acttctcttttctctttcctcaactaactggattccaaccagcccaaagtattcattactcacggctagatcgtttactttggttgtcccttctggcatggtgcatatgttatgggaagagggattataatttggtgctgtttgtagagatgacaacactgataaaatccactcattgctggtcccagcacacctggaaagttctgcaaggcctcagctacagaaagcccagagacagaaagtaaactctttcatgacccttgatcatcagatcatcaatccaactcttaaatggtcacaacctgcagtgccaagtggtgggcctcttgtgcagcatgcacacacaactctggacagtgatgctggcctcacagaaaacccactcaccaagttactagctattgggaaagaagatgacaatgcacaatggcatttatctggaagtattttggatgtgtatagcggtgaacaaggaatttcaccaattaacatggggcttacaagtgcttcttgtccaagtagtctaccaatgaaaagagaaattacagaaactgacactagagctttagcaaaagagagacaaaaaaaggacaaccacaacctcattgaaagaagaagaaggtataatattaattaccgaatcaaggagcttggcactcttattccaaagtctaatgatcctgatatgcgctggaacaaaggaaccattctaaaagcatcagtggagtacatcaagtggctacaaaaagaacaacagagagcccgagaattggaacacagacagaagaaattagagcaggctaacaggcgacttctacttcggattcaggaactagaaattcaggctcgtactcatggtctgccaaccctggcttcacttggcacggttgatttaggtgctcatgtcaccaaacagcagagccatcctgagcagaattcagtagactattgccaacaactgactgtgtctcaggggccaagccctgagctctgtgatcaagctatagccttttctgatcctttgtcatacttcacagatttatcatttagtgctgcattgaaagaggaacaaagattggatggcatgctattggatgacacaatctctccatttggaacagatcctctgctatctgccacttcccctgcagtttccaaagaaagcagtaggagaagtagctttagctcagatgatggtgatgaattataagaaataaacagacccaattcatcaactggaaagcaattctatgctggtgctatgcaattatgctctgtgtttcatatgttgctttggcttattttttttcttaaaggaatgtgttgttcatgaaaaactgatagaagcaacagaagaattcgcaggaagaaaaatcatagtgttaatgaattattgagggcgaaaaaaaggtgttttcttctttgactacggagtccaaatccacttaaattctgttttcctgaaaagaggtacagcataagaaatagctctttattgatgttttaaaagcagcaacttggtggtgtactactggaactaatgactgcaaagtgttaaacgactgaaatatacaaacagtctcttagttactcatttccatcttctcttcaactttcacatcagtcttccggaatcaagatcaacatatcaggtggtcattgcctttctccattgtctagtagacatgtctaaagttcaaactttataggataaataaatgtataatagattatctgtcacttgtggttgaaaggcaaatctacaataaatgtgagaattttccacaataaaatatggataacttataaaaacattggttactaaaattagatcctcattttattgtagttggttcaattacactaattctaaaagcatccatgcatatttatatctccagtctctgttcaggaaaaggaacatattgaatattttcctcaggaatatggaccagaattgtatcccttcacacaaacatacacatacacatatgcacatcattcaggtagtatatgttcttttgttttcttcatgcttctgactgcatcagaatcacattccaaattctcttttcttatgaagaagagatgtcagatcatcaattttagtaaataaaatataaaatgtccccctgcaaggacagttttcaggtacttaaaacttttcatcagtattggacagaaatcaattagttgttgatttggtttttctccaaatggataaaatattgaaaattgaattgccaattgacaaaataattattacaacaaactatttcttattattttcagttctgagaggaacgtaaggttctatttctataaacacttagagtgtcctatgatctttggttgcactgttagcatttattataagcacttataactatgatgcttcatttagatttttatctcttgcgcttgttttaggttaggaaattaagttaccaagcacgttgctctgtgctggacctccaagagtgatcatccgatcaatgagtattcatggaggcatactcagaactgcagtgagtcctgagaaaatgtagaagagttgaaaaagatatggtcttactcctaaggtagttaatgagaatgcatgaaaaacaaaaacaaaagatagaagacatatagaataaaaaatctaagcataaactgtaaatacagaaggtcagagaaaatgaaaatgactgacaaactttatgggaacagcagaatttgacttctctttgaaaggcattaattgagtgaaagtgagggcatataaaggaataataccaaccaaatgataaaagtgagaataataggggaagtatctttataggactttaattagaaagatctggatgccctagaagatgtctgttggggagttctgaagcataagactgacaacaggttgtgaaggcccttagaaaactatggtgaaataatatagtattaatataatagaaacaaatctttttagtagcagggaggatgctaaaaactaaaatatatattactaatgagtgagatgtaatctttcatgaatattaagctttgggataaattttgaaaggatcttttagttgcttctcacatggaaaatatgtcactatgaaatgtgagaccctaatgctgataaaagtagaaaaatagtaaatcattatggtataataattatctcaggcttagcttgtatcatttgctcagaatttggagaattaaaataattttattgtttgacatggaaaaataattactaacttctgggtacagtcattaaagcctgatagataaattcatctgaaatatgccatgtgaaacagctattagatacatcttctcaataattttcaagacgatattacatacttttaattttataacaaaattccacttcattatctgagttgataatttgattaaatgttaaaaattatagataaggaatatattttggagttcatagaaaacacaccactttattagatagagactggcttcagttctcattttatctgctcttctcatttcttcatattttgagtagacttgcactgatgatgtcattactcagtcattattttctgttctgttaaggtacaactactgggccttgaaatctatccttcacaatcttggctgagataaggacttggcacaggatgatagagcctggacacaagagatctggagagggaactgctatttgctgctacattcagattatgagatgtcagggaactgtaaaaagggtaatgaatttttaaagagagtaaagagttatgctgtgtcccggtcaactgaaatacattaaaaattaattagatggtagttcttaactttttaaggcagataccttgagaatctagtgagttatagaccctctccctagaaaagtatagaactgtttatatggacaataattcacatgcattcagagatcttagggatctcctgaatgttttcttggatcccaagtgaaaaattcctgaatcaggtctcttaggtgtgcggttaatgtcatgtataacaatggggggacccttacttatctaaatataattatcccaatcctaataatgatgaggttgcataggaaagtaatagtgtaccaaactttagattattcactaaaaaagttgttcatttatgaagtagtcgtttatcaaacatgtcctccccactcagcaaactatgccttctatttattatatatgggtcagtttcactataattactgagtgttataaacatctgaccataacattttgaaatgatgcaaataaatttccaaacaaaaatagtgtgaatttaaaagcaaattatttgagtatctaagaaacaagatagacttctagaaaaatttgactctctagaatatttcttgcagaaatgagatttttcataatagtaaaagaggcatatgtttatcaaacaatgctgtcacaaaaagcatcaactgtaatgggactattaatgcataattattgatttattcattcaattaatatacaattatcccttttcatttaaagatttaattcataattacaattataataaaacttcctttaaagtaagatacaataattttattgtttttcattcttttttcaacaaaatatcccatccaatcattttttatattattaaatattggctgctttttcttggattcacattaaacagccctttccaacttccaattgtcttaaaataatgatgacctcctgtgagtagatacagctctttacaatttttttctttagtgccttttcttcttgaatttttcctatatcaaatggagaatatatgtacagatggtattttctcagtttataggcatatcagtgaccatggctttctttatataggtttttaaaaaagccctaaataataaatagccagatgagctggggacattgagaaatagccttcctcttcctttttcaactcatttttttcccacctacatgactgtaaatcaaatatttaatagctcttacttaaaaaaacagatacaaagaatgtcttgatttggtgtgctcatttaccataatgtcatgaggggaattagatttcacaactttaaaaggaatatatttttattttattttgaaaaactgagtcatataggaattttcttatacttcaaggcatcatggaaacacttttttcctgtttggatattgtggaatttaaacgttcaaataaataaatggcataactaagtgttccaaatttttttacaatgtctttgaccctattcaaacactttaggtatttactgaccgtctgatgtgtaagatgtggaataaaactggaatcaattaattatttcactgtgttatcagcgcaagatcaaccatctgggtttcttaaagacacccgaaggattgaattttgtttcagtattgataatggcatagtctctatgtgctacatggaattacatcatttatccctccagtgccctatatgttgataagtatgtcagtttgacttagtatacatatatacagagatttcattacatttacctaataaatacaaaatacatttcgagtgttactgatctcctatgttacatgagcctcctgtaatcattgtgcattgatgttccaatgttttattgtttgtatgaattttaatttgaaaacaaggaaacaatccaaaagcagaaaaaatagcttttcttaaaattttcagtgctacattttccctctgaggtccatagagatttgaatgtataggagattatccgaaaacagctattttgattaaaaaatatatctcccaggattcaaccaacttaatgatgaagtactattgtctactgctttatacataaaagggaactttttatctgcttgtaaagggatttttatgtgtatttctgcataatcagatgacttctattgtgttttctactgatgaaattctctgtaaaatgtctttttcttacattatccaacaggcataaagaataacagtaaagacttttgtgtttgtaatactacctcttttatccctgcactactgttttattgcaaaaattctatattgtcactgtattttttccatagaatataaattttgttcttgtgctaaagctggtagtttatgtagcagacaaaatatacaaataaaagaagagactgattttgctgaaagaattatatataatcaagaagttacatattgttctttaaatatgatactgaattttaaaagcaaacgaaattcaagaatcttatctaacagcatagcagttgcttatggcatacaaggctaaaattaattcagctatttaatcttaataattattatgtagttaaaaatctttgactttaatagtgttttacatatacaaatagctgaagtaacattcctataattttaatctgacattggttagatcaagaaaacattgttaataagactgtagaatttgtaattattgctatttttcatttttaataacaaagtaatgtgtcttattttctaagaaaatggagaactttggtgtactttaatacatacaaaaatctttgtaaaaataccttaaaatgtaccaatattttctttgcatatattaaatgaaagactataattat

SEQ ID NO: 2496 - DNA, 2704 bp, Homo sapiens
atcgtttactttggttgtcccttctggcatggtgcatatgttatgggaagagggattataatttggtgctgtttgtagagatgacaacactgataaaatccactcattgctggtcccagcacacctggaaagttctgcaaggcctcagctacagaaagcccagagacagaaagtaaactctttcatgacccttgatcatcagatcatcaatccaactcttaaatggtcacaacctgcagtgccaagtggtgggcctcttgtgcagcatgcacacacaactctggacagtgatgctggcctcacagaaaacccactcaccaagttactagctattgggaaagaagatgacaatgcacaatggcatttatctggaagtattttggatgtgtatagcggtgaacaaggaatttcaccaattaacatggggcttacaagtgcttcttgtccaagtagtctaccaatgaaaagagaaattacagaaactgacactagagctttagcaaaagagagacaaaaaaaggacaaccacaacctcattgaaagaagaagaaggtataatattaattaccgaatcaaggagcttggcactcttattccaaagtctaatgatcctgatatgcgctggaacaaaggaaccattctaaaagcatcagtggagtacatcaagtggctacaaaaagaacaacagagagcccgagaattggaacacagacagaagaaattagagcaggctaacaggcgacttctacttcggattcaggtttttataagaatgtagccatgagtcacatagcttacacatgactcagctgtcatcagttttcttcattggtctcatttattttttctcttattaacaattatttttccttttgaaggataattttactgctttttagaagttcgtgaattgggttgtttcaattaggatttgactagaaatccaggatcaagatggctgaatatgtatatatgtatatatgtatatacacatatatgtgtatatatgtgtgtatgtgtgcatgtatatatatatacacatatataatgacaacaaattacaaaatgcataaaatataactcatttcataaatgcacacattattatcctaatcaaataataatactaagtaaaacatttgtttctctacattatattggacattaaattctcccctccttctttcatttctttccaacattgctatggatttcattgcctcaaggcatgttgtgacagtgtatattaagtcacttctcatctgttcatataatccaaaatatcaaaatatgggcttttataactctcaagattttttaaaaatgtgagtatgcttagcaccaggtaaaacatttactgtttccatgaaaaggtcctgcatttacagtgagaaattaatcaggaagaataaatagatgactttctgctatctccaaatggctatattgtagtctgagccactatggaaccatcatcagtcataacctttgtagaacaatgagaccaaacttaaaaaaaagtctgagtaattttctcagagttatttttcatgcatcagaaatgtatcaatttcattatttgcaaagattattcataatttgtattgtattactcttcattttaaatgcttgttaatattttgattctatgtctggcttattctctagtgttaaatccaatttcaaagacattatttaatgattttcgtttgaaattacaggaactagaaattcaggctcgtactcatggtctgccaaccctggcttcacttggcacggttgatttaggtgctcatgtcaccaaacagcagagccatcctgagcagaattcagtagactattgccaacaactgactgtgtctcaggggccaagccctgagctctgtgatcaagctatagccttttctgatcctttgtcatacttcacagatttatcatttagtgctgcattgaaagaggaacaaagattggatggcatgctattggatgacacaatctctccatttggaacagatcctctgctatctgccacttcccctgcagtttccaaagaaagcagtaggagaagtagctttagctcagatgatggtgatgaattataagaaataaacagacccaattcatcaactggaaagcaattctatgctggtgctatgcaattatgctctgtgtttcatatgttgctttggcttattttttttcttaaaggaatgtgttgttcatgaaaaactgatagaagcaacagaagaattcgcaggaagaaaaatcatagtgttaatgaattattgagggcgaaaaaaaggtgttttcttctttgactacggagtccaaatccacttaaattctgttttcctgaaaagaggtacagcataagaaatagctctttattgatgttttaaaagcagcaacttggtggtgtactactggaactaatgactgcaaagtgttaaacgactgaaatatacaaacagtctcttagttactcatttccatcttctcttcaactttcacatcagtcttccggaatcaagatcaacatatcaggtggtcattgcctttctccattgtctagtagacatgtctaaagttcaaactttataggataaataaatgtataatagattatctgtcacttgtggttgaaaggcaaatctacaataaatgtgagaattttccacaataaaatatggataacttataaaaa

SEQ ID NO: 2497 - DNA, 6246 bp, Homo sapiens
atgatgaaggagaaagagaaaaccattgctattgtgaaggttatagacacttcaaagttaaaactgttatctggaagtattttggatgtgtatagcggtgaacaaggaatttcaccaattaacatggggcttacaagtgcttcttgtccaagtagtctaccaatgaaaagagaaattacagaaactgacactagagctttagcaaaagagagacaaaaaaaggacaaccacaacctcattgaaagaagaagaaggtataatattaattaccgaatcaaggagcttggcactcttattccaaagtctaatgatcctgatatgcgctggaacaaaggaaccattctaaaagcatcagtggagtacatcaagtggctacaaaaagaacaacagagagcccgagaattggaacacagacagaagaaattagagcaggctaacaggcgacttctacttcggattcaggaactagaaattcaggctcgtactcatggtctgccaaccctggcttcacttggcacggttgatttaggtgctcatgtcaccaaacagcagagccatcctgagcagaattcagtagactattgccaacaactgactgtgtctcaggggccaagccctgagctctgtgatcaagctatagccttttctgatcctttgtcatacttcacagatttatcatttagtgctgcattgaaagaggaacaaagattggatggcatgctattggatgacacaatctctccatttggaacagatcctctgctatctgccacttcccctgcagtttccaaagaaagcagtaggagaagtagctttagctcagatgatggtgatgaattataagaaataaacagacccaattcatcaactggaaagcaattctatgctggtgctatgcaattatgctctgtgtttcatatgttgctttggcttattttttttcttaaaggaatgtgttgttcatgaaaaactgatagaagcaacagaagaattcgcaggaagaaaaatcatagtgttaatgaattattgagggcgaaaaaaaggtgttttcttctttgactacggagtccaaatccacttaaattctgttttcctgaaaagaggtacagcataagaaatagctctttattgatgttttaaaagcagcaacttggtggtgtactactggaactaatgactgcaaagtgttaaacgactgaaatatacaaacagtctcttagttactcatttccatcttctcttcaactttcacatcagtcttccggaatcaagatcaacatatcaggtggtcattgcctttctccattgtctagtagacatgtctaaagttcaaactttataggataaataaatgtataatagattatctgtcacttgtggttgaaaggcaaatctacaataaatgtgagaattttccacaataaaatatggataacttataaaaacattggttactaaaattagatcctcattttattgtagttggttcaattacactaattctaaaagcatccatgcatatttatatctccagtctctgttcaggaaaaggaacatattgaatattttcctcaggaatatggaccagaattgtatcccttcacacaaacatacacatacacatatgcacatcattcaggtagtatatgttcttttgttttcttcatgcttctgactgcatcagaatcacattccaaattctcttttcttatgaagaagagatgtcagatcatcaattttagtaaataaaatataaaatgtccccctgcaaggacagttttcaggtacttaaaacttttcatcagtattggacagaaatcaattagttgttgatttggtttttctccaaatggataaaatattgaaaattgaattgccaattgacaaaataattattacaacaaactatttcttattattttcagttctgagaggaacgtaaggttctatttctataaacacttagagtgtcctatgatctttggttgcactgttagcatttattataagcacttataactatgatgcttcatttagatttttatctcttgcgcttgttttaggttaggaaattaagttaccaagcacgttgctctgtgctggacctccaagagtgatcatccgatcaatgagtattcatggaggcatactcagaactgcagtgagtcctgagaaaatgtagaagagttgaaaaagatatggtcttactcctaaggtagttaatgagaatgcatgaaaaacaaaaacaaaagatagaagacatatagaataaaaaatctaagcataaactgtaaatacagaaggtcagagaaaatgaaaatgactgacaaactttatgggaacagcagaatttgacttctctttgaaaggcattaattgagtgaaagtgagggcatataaaggaataataccaaccaaatgataaaagtgagaataataggggaagtatctttataggactttaattagaaagatctggatgccctagaagatgtctgttggggagttctgaagcataagactgacaacaggttgtgaaggcccttagaaaactatggtgaaataatatagtattaatataatagaaacaaatctttttagtagcagggaggatgctaaaaactaaaatatatattactaatgagtgagatgtaatctttcatgaatattaagctttgggataaattttgaaaggatcttttagttgcttctcacatggaaaatatgtcactatgaaatgtgagaccctaatgctgataaaagtagaaaaatagtaaatcattatggtataataattatctcaggcttagcttgtatcatttgctcagaatttggagaattaaaataattttattgtttgacatggaaaaataattactaacttctgggtacagtcattaaagcctgatagataaattcatctgaaatatgccatgtgaaacagctattagatacatcttctcaataattttcaagacgatattacatacttttaattttataacaaaattccacttcattatctgagttgataatttgattaaatgttaaaaattatagataaggaatatattttggagttcatagaaaacacaccactttattagatagagactggcttcagttctcattttatctgctcttctcatttcttcatattttgagtagacttgcactgatgatgtcattactcagtcattattttctgttctgttaaggtacaactactgggccttgaaatctatccttcacaatcttggctgagataaggacttggcacaggatgatagagcctggacacaagagatctggagagggaactgctatttgctgctacattcagattatgagatgtcagggaactgtaaaaagggtaatgaatttttaaagagagtaaagagttatgctgtgtcccggtcaactgaaatacattaaaaattaattagatggtagttcttaactttttaaggcagataccttgagaatctagtgagttatagaccctctccctagaaaagtatagaactgtttatatggacaataattcacatgcattcagagatcttagggatctcctgaatgttttcttggatcccaagtgaaaaattcctgaatcaggtctcttaggtgtgcggttaatgtcatgtataacaatggggggacccttacttatctaaatataattatcccaatcctaataatgatgaggttgcataggaaagtaatagtgtaccaaactttagattattcactaaaaaagttgttcatttatgaagtagtcgtttatcaaacatgtcctccccactcagcaaactatgccttctatttattatatatgggtcagtttcactataattactgagtgttataaacatctgaccataacattttgaaatgatgcaaataaatttccaaacaaaaatagtgtgaatttaaaagcaaattatttgagtatctaagaaacaagatagacttctagaaaaatttgactctctagaatatttcttgcagaaatgagatttttcataatagtaaaagaggcatatgtttatcaaacaatgctgtcacaaaaagcatcaactgtaatgggactattaatgcataattattgatttattcattcaattaatatacaattatcccttttcatttaaagatttaattcataattacaattataataaaacttcctttaaagtaagatacaataattttattgtttttcattcttttttcaacaaaatatcccatccaatcattttttatattattaaatattggctgctttttcttggattcacattaaacagccctttccaacttccaattgtcttaaaataatgatgacctcctgtgagtagatacagctctttacaatttttttctttagtgccttttcttcttgaatttttcctatatcaaatggagaatatatgtacagatggtattttctcagtttataggcatatcagtgaccatggctttctttatataggtttttaaaaaagccctaaataataaatagccagatgagctggggacattgagaaatagccttcctcttcctttttcaactcatttttttcccacctacatgactgtaaatcaaatatttaatagctcttacttaaaaaaacagatacaaagaatgtcttgatttggtgtgctcatttaccataatgtcatgaggggaattagatttcacaactttaaaaggaatatatttttattttattttgaaaaactgagtcatataggaattttcttatacttcaaggcatcatggaaacacttttttcctgtttggatattgtggaatttaaacgttcaaataaataaatggcataactaagtgttccaaatttttttacaatgtctttgaccctattcaaacactttaggtatttactgaccgtctgatgtgtaagatgtggaataaaactggaatcaattaattatttcactgtgttatcagcgcaagatcaaccatctgggtttcttaaagacacccgaaggattgaattttgtttcagtattgataatggcatagtctctatgtgctacatggaattacatcatttatccctccagtgccctatatgttgataagtatgtcagtttgacttagtatacatatatacagagatttcattacatttacctaataaatacaaaatacatttcgagtgttactgatctcctatgttacatgagcctcctgtaatcattgtgcattgatgttccaatgttttattgtttgtatgaattttaatttgaaaacaaggaaacaatccaaaagcagaaaaaatagcttttcttaaaattttcagtgctacattttccctctgaggtccatagagatttgaatgtataggagattatccgaaaacagctattttgattaaaaaatatatctcccaggattcaaccaacttaatgatgaagtactattgtctactgctttatacataaaagggaactttttatctgcttgtaaagggatttttatgtgtatttctgcataatcagatgacttctattgtgttttctactgatgaaattctctgtaaaatgtctttttcttacattatccaacaggcataaagaataacagtaaagacttttgtgtttgtaatactacctcttttatccctgcactactgttttattgcaaaaattctatattgtcactgtattttttccatagaatataaattttgttcttgtgctaaagctggtagtttatgtagcagacaaaatatacaaataaaagaagagactgattttgctgaaagaattatatataatcaagaagttacatattgttctttaaatatgatactgaattttaaaagcaaacgaaattcaagaatcttatctaacagcatagcagttgcttatggcatacaaggctaaaattaattcagctatttaatcttaataattattatgtagttaaaaatctttgactttaatagtgttttacatatacaaatagctgaagtaacattcctataattttaatctgacattggttagatcaagaaaacattgttaataagactgtagaatttgtaattattgctatttttcatttttaataacaaagtaatgtgtcttattttctaagaaaatggagaactttggtgtactttaatacatacaaaaatctttgtaaaaataccttaaaatgtaccaatattttctttgcatatattaaatgaaagactataattatgaaatgtt

SEQ ID NO: 2498 - DNA, 1245 bp, Homo sapiens
gaaaaagaggagaagtgggagtaaacagaaagataatgcttatggtacatacaaaacaaatggagagattgagtctcacggattcttcgcctgagccaccagcaaagagtcctatcaatgatttagttccctagagaaaatcagaaagtaaaagtgagaagaaaagaagagaaatatgttacaagctttaactggacttcaatttcagctgaaagaacaattaggagaaaaggagagaagacttcaaatcagccaggaaatcagtgcccatagaacagagttccacatgcagttttcatacaaaccagtgttgcatagacttgtcccagcaagaccacaaatttattcaagtcaattaccatcctttaccagggtcccagcacacctggaaagttctgcaaggcctcagctacagaaagcccagagacagaaagtaaactctttcatgacccttgatcatcagatcatcaatccaactcttaaatggtcacaacctgcagtgccaagtggtgggcctcttgtgcagcatgcacacacaactctggacagtgatgctggcctcacagaaaacccactcaccaagttactagctattgggaaagaagatgacaatgcacaatggcatatggaggacgttattgaggatataatcggtatggaatcaagttttaaagaggaaggagcagactctcctctgctaatgcaaagaacattatctggaagtattttggatgtgtatagcggtgaacaaggaatttcaccaattaacatggggcttacaagtgcttcttgtccaagtagtctaccaatgaaaagagaaattacagaaactgacactagagctttagcaaaagagagacaaaaaaaggacaaccacaacctcattgaaagaagaagaaggtataatattaattaccgaatcaaggagcttggcactcttattccaaagtctaatgatcctgatatgcgctggaacaaaggaaccattctaaaagcatcagtggagtacatcaagtggctacaaaaagaacaacagagagcccgagaattggaacacagacagaagaaattagagcaggctaacaggcgacttctacttcggattcaggtttttataagaatgtagccatgagtcacatagcttacacatgactcagctgtcatcagttttcttcattggtctcatttattttttctcttattaacaattatttttccttttgaaggataattttactgcttttt

SEQ ID NO: 2499 - DNA, 2453 bp, Homo sapiens
cgggccgggggtcgcctcccgcctcccgcctcccgcctcccgccgcccgccgcccgcgtcgccctcgccgccgttgggccgcgccgcgccgccatgtcgggccccggaccgcgggagccgccgccggaggcaggcgcggcaggcggcgaggcggccgtcgagggcgcgggcggcggggacgcggcgctgggcgagccggggctgagcttcacgaccaccgacctgagcctggtggagatgacggaggtggagtacacgcagctgcagcacatcctctgctcgcacatggaggcggcggctgacggcgagctcgagacgcgcctcaactcggcgctgctggcggcggcgggcccgggcgcaggcgcgggcggcttcgcggcgggcggtcaggggggcgcggcgcccgtgtaccccgtgctgtgcccgtccgcgctggcggccgacgcgccctgcctgggccacatcgacttccaggagctgcgcatgatgctgctaagcgaggcgggcgcggcggagaagacgtcgggcggcggggacggagcgagggcccgggccgacggcgccgccaaggagggcgcgggcgcggctgcggctgcggctggacccgacggcgcgcccgaggcccgggccaagccggccgtgcgcgtccgcctggaggaccgcttcaacagcatccccgccgagccgccgcccgcgccgcgcggccccgagccccccgagccgggcggggcgctcaacaatttggtaactctcattcgacatccatctgaactaatgaatgttcctcttcagcaacaaaacaaatgtacagcattagtgaaaaataaaactgcggctacaactactgctttgcaatttacatacccactgtttactacaaatgcttgctctactagtggaaattctaatctttcacagacacagagttctagtaactcatgttctgtacttgaagctgccaagcaccaggatattggattgcctagagcattttctttctgttatcagcaagaaattgaatccactaaacagacgttaggtagtagaaacaaagttttgcctgagcaagtttggattaaagtgggagaagcagcgctatgcaaacaagcactgaagaggaatcggagtagaatgcgtcagttggacacaaatgtagagcgaagagcccttggagagattcagaatgtgggcgaaggtgccaccgccacacaaggcgcttggcagtcctcggagtcctcacaggcaaacctgggggagcaggcccagagtgggccccagggaggaaggtctcaacgtagggagaggcataaccgaatggaaagagatagaaggcgcagaatccgcatttgctgtgatgagttgaatctcttagtgccgttctgcaatgccgagactgacaaggccacaactctgcagtggaccacagcattcctgaaatacatccaggaaagacatggagattctcttaaaaaggttctaagcacaaactccagatacgtcatgttatggacttgcttcctgaagatgaaatcagcagttgatggaaagaatccacaacacgcctacagaacagcaaatcacaaatggctgtgtctccacgaagccaggagctttgcatttgaagtttctatctgggctcatttccagctgttcagggttcggattcctgaaggcttccttagcatttaactcattctttgttgactgaaggcactggcactgtttctccacacgcaaactgatctttgtcataaatcacttttataatgagagagcagcctggacacattgccacaccttccccattctccagctcttccttggtgatggagaagttatctccgcatgggcagggacagaaatatgtctccgagtcctcgtcatattggaagtcctcgatttccacctcgtcatgaaatactgccatggtcagcgggggttgctgaaggggtgacgccccagcagtccgagaccagctccgagggtctaacttctccggagccggcccaggctctgactttcatttaattgtcctgaaaggtgaattctatcttgccaaataggcaagtgttttttatatgtaggctttaggtgtcagaatataggaaattatcaaaatgtggggtcattttaaattgcatcctaaaaccttttaaaatttgggaagaagctgggcgtcgtagctcacgcctgtaatcccagcactttgggaagctgaggtgggcagattacctgaggtcaggagttcgagaccagcctggccaatacggtgtgacccccgtctctactaaaaatacaaaaattagccgggcgtggtggtacatgcctgtaatcccagctactcaggaggctgaggtgggagaatcagttgaacccaggaggcaaaggttgcagtgagctgagatcgtgccattgcaccccagtctgggcgacaagagtgaaactccatatcc

SEQ ID NO: 2500 - DNA, 2456 bp, Homo sapiens
cgggccgggggtcgcctcccgcctcccgcctcccgcctcccgccgcccgccgcccgcgtcgccctcgccgccgttgggccgcgccgcgccgccatgtcgggccccggaccgcgggagccgccgccggaggcaggcgcggcaggcggcgaggcggccgtcgagggcgcgggcggcggggacgcggcgctgggcgagccggggctgagcttcacgaccaccgacctgagcctggtggagatgacggaggtggagtacacgcagctgcagcacatcctctgctcgcacatggaggcggcggctgacggcgagctcgagacgcgcctcaactcggcgctgctggcggcggcgggcccgggcgcaggcgcgggcggcttcgcggcgggcggtcaggggggcgcggcgcccgtgtaccccgtgctgtgcccgtccgcgctggcggccgacgcgccctgcctgggccacatcgacttccaggagctgcgcatgatgctgctaagcgaggcgggcgcggcggagaagacgtcgggcggcggggacggagcgagggcccgggccgacggcgccgccaaggagggcgcgggcgcggctgcggctgcggctggacccgacggcgcgcccgaggcccgggccaagccggccgtgcgcgtccgcctggaggaccgcttcaacagcatccccgccgagccgccgcccgcgccgcgcggccccgagccccccgagccgggcggggcgctcaacaatttggtaactctcattcgacatccatctgaactaatgaatgttcctcttcagcaacaaaacaaatgtacagcattagtgaaaaataaaactgcggctacaactactgctttgcaatttacatacccactgtttactacaaatgcttgctctactagtggaaattctaatctttcacagacacagagttctagtaactcatgttctgtacttgaagctgccaagcaccaggatattggattgcctagagcattttctttctgttatcagcaagaaattgaatccactaaacagacgttaggtagtagaaacaaagttttgcctgagcaagtttggattaaagtgggagaagcagcgctatgcaaacaagcactgaagaggaatcggagtagaatgcgtcagttggacacaaatgtagagcgaagagcccttggagagattcagaatgtgggcgaaggtgccaccgccacacaaggcgcttggcagtcctcggagtcctcacaggcaaacctgggggagcaggcccagagtgggccccagggaggaaggtctcaacgtagggagaggcataaccgaatggaaagagatagaaggcgcagaatccgcatttgctgtgatgagttgaatctcttagtgccgttctgcaatgccgagactgacaaggccacaactctgcagtggaccacagcattcctgaaatacatccaggaaagacatggagattctcttaaaaaggaatttgagagcgtattttgcggtaaaactggccgaaggctaaagctgaccagaccggactccttggtgacctgtcctgcacaggggagtttacagagcagcccctcgatggagatcaagtgatcggactgaacaggaatcctcggggggtgaacagccattccttcgtgacctgtgcacgccttctgcaaccctggagctctgctcggctagtctgactcgaaaagggcgtgactcaagctgacgggactccagtagggactttgagagcacattttgtaaaaatatttatctagacgcaaatgcttatccatgaatgtcctcttagaccatttggggatgaagccatcttaataattagtaataattaattagtaataattagtaagcattttctcaatgctctgattccatcatgttttcttaacatgataacttaaaaaattgacatcctttgtactttctttaatcttaaaaagtacacggctttttacttatttaccttttaaatatgcccctttagcaattggaacaagttaaattgttaactaaaaacagtttggaaattttatttcattcgttatatcacacccccttgtcatgactctgagtcacgtgctgctgtattgcaacgtgcaggaccattttaaacctgtgtgctaaaaattttccagatacttgctttaaagctacttttgtccacaaatgaaatactgtcacagtagacgcttaaatgccacgttttcataccaagagtcattcattacttcatgtgtcacaaactgtggtgtttggaattgggtttttcaatgagtggctttacttatcaatcacaacaggtaatagcaatagacgttagtgcaatacaaagtcaccctcaataaatactgttaattggagatgtgagtttgtacacaaaacatcagactagacctttgtatgggagagaatttactgtacattaaattctttattttttgtta

SEQ ID NO: 2501 - DNA, 2159 bp, Homo sapiens
agcttccagagccaaggccttccgccgagttggtttttgggttgttgatcgcggtggccgggcggtctgcggtcgggctgagacacgcggagcaatggcgacctttgtgagcgagctggaggcggccaagaagaacttaagcgaggccctgggggacaacgtgaaacaatactgggctaacctaaagctgtggttcaagcagaagatcagcaaagaggagtttgaccttgaagctcatagacttctcacacaggataatgtccattctcacaatgatttcctcctggccattctcacgcgttgtcagattttggtttctacaccagatggtgctggatctttgccttggccagggggttccgcagcaaaacctggaaaacccaagggaaagaaaaagctttcttctgttcgtcagaaatttgatcatagattccagcctcaaaatcctctctcaggagcccagcaatttgtggcaaaggatccccaagatgatgacgacttgaaactttgttcccacacaatgatgcttcccactcgaggccagcttgaagggagaatgatagtgactgcttatgagcatgggctggacaatgtcaccgaggaggctgtttcagctgttgtctatgctgtggagaatcaccttaaagatatactgacgtcagttgtgtcaagaaggaaagcttatcggttacgagatggtcattttaaatatgcctttggcagtaacgtgaccccgcagccatacctgaagaatagtgtagtagcttacaacaacttaatagaaagccctccagcttttactgctccctgtgctggtcagaatccagcttctcacccaccccctgatgatgctgagcagcaggctgcactcctgctggcatgctccggagacactctacctgcatctttgcctccggtgaacatgtacgatctttttgaagctttgcaggtgcacagggaagtcatccctacacatactgtctatgctcttaacattgaaaggatcatcacgaaactctggcatccaaatcatgaagagctgcagcaagacaaagttcaccgccagcgcttggcagccaaggaggggcttttgctgtgctaaattaggatttgagggtgtgggaccctcaccgaattcattgattactgaaaattgaatgttttttgggtccacatttcaaggctgaagtgtatagtgtatatataacctttcctatggaaatgtgacattgagtacattttgtgttgctgttgtgaagccattaatataaatctttggtaatgacccatatctctatatgtatgtgttcccagttgtgggagcaggcactaatgaaatcctgtgcctggaatggagatatttaggtacctgaggcttagtgtcctgtggtctgcatgtaagatagatgacatcctagaacaaagaagctgttttaacttaatccccctgatcagcaggatatctgtgtgttcagtgacatcatacattctgtatctagaagtctaaaatttctgcctttctcctaaagaatgtgttcttgcattttggttgaaataacctacacagtgttaaaaatcagatacctcctttagtgaccagttcaaattttaatagcgataggtagcccctgagaaatttatcactataactccacaggaaatatgacttggaagtgctctgtgtactaaacaaaataaagcccctctttgcatttaaaaccaaagtcaaaacaaaactcttgtaatgcaattaattaactttatgtcttcccatgactcaagttttgttaaatatgcccaaaaactttgattggcagtttcttcggttaattattcctatagaatgtattttaagaaatctatacaaattggatatatgcttggtaattctccagtttctaggaggtacctatttctaccgtttcaagtgatgaagtgaaaataatttacattcgatagtgttactgataacaaacctacttaagagatatgttgctttttacttaagggatagtgttgatagataaattagaatgtatagataggtttgtgaaagtctaaataatggttgtatagatatgtatatatggttcacatatctggatctgtgtatttgattttgtactttaaatgtgacaaataaaccttttgggagaaaa

SEQ ID NO: 2502 - DNA, 1838 bp, Homo sapiens
tttcccgctcagccctggagcgcgtagctctaccaagaatggccactgtgccagatgcccctgaccagcgttgcccatttgaatttcctagcaggccccccaaagtaggtatttcagtaccctgttagagctgaggcgcaggtaaaatgactggcccaggccggtcccaccccgtaaggatttgaacgttggctccacaactcgggagcctgcgcctttcctcctcccaacgtggactcctgcccggcgaagtgcctcacttccttctcccgggagtcatcaagctttggtgtatgtgttggccggttctgaagtcttgaagaagctctgctgaggaagaccaaagcagcactcgttgccaattagggaatggaccgtttgggtccctttagcaatgatccctctgataagccaccttgccgaggctgctcctcctacctcatggagccttatatcaagtgtgctgaatgtgggccacctccttttttcctctgcttgcagtgtttcactcgaggctttgagtacaagaaacatcaaagcgatcatacttatgaaataatgacttcagattttcctgtccttgatcccagctggactgctcaagaagaaatggcccttttagaagctgtgatggactgtggctttggaaattggcaggatgtagccaatcaaatgtgcaccaagaccaaggaggagtgtgagaagcactatatgaagcatttcatcaataaccctctgtttgcatctaccctgctgaacctgaaacaagcagaggaagcaaaaactgctgacacagccattccatttcactctacagatgaccctccccgacctacctttgactccttgctttctcgggacatggccgggtacatgccagctcgagcagatttcattgaggaatttgacaattatgcagaatgggacttgagagacattgattttgttgaagatgactcggacattttacatgctctgaagatggctgtggtagatatctatcattccaggttaaaggagagacaaagacgaaaaaaaattataagagaccatggattaatcaaccttagaaagtttcaattaatggaacggcggtatcccaaggaggtccaggacctgtatgaaacaatgaggcgatttgcaagaattgtggggccagtggaacatgacaaattcattgaaagccatgcattggaatttgaactccgaagggaaatcaagaggctccaagaatacaggacagcaggcattaccaatttttgtagtgccagaacctacgatcacctcaagaagacacgggaggaagagcgccttaaacgcactatgctctcagaagttctccagtatatccaggacagtagtgcttgccagcagtggctccgccggcaagctgacattgattccggcctgagtccttccattccaatggcttcgaattcaggtagacggagtgcaccacccttgaacctcactggcctccctggcacagagaagctgaatgaaaaagaaaaggagctctgtcagatggtgaggttggtccctggagcctatttagaatacaaatctgctctattgaacgaatgtaacaagcaaggaggcttaagactggcgcaggcaagagcactcatcaagatagatgtgaacaaaacccggaaaatctatgatttcctcatcagagaaggatacatcactaaaggctaaggctccaagagcttgggatcagaagtcagaagtttggaatgtggtgggtcaaaggacaatatgggtgggcattctggagagttgtttttcagctgaattctcatggtgaaaacaggggaaaggacaaaggaaacctt

SEQ ID NO: 2503 - DNA, 1751 bp, Homo sapiens
ccgggggcgcgcacgcaaagcccggaggcgcgcgcgaccggcggctctttggcgcggattagggggtctcggcgagggagtcatcaagctttggtgtatgtgttggccggttctgaagtcttgaagaagctctgctgaggaagaccaaagcagcactcgttgccaattagggaatggaccgtttgggtccctttagcaatgatccctctgataagccaccttgccgaggctgctcctcctacctcatggagccttatatcaagtgtgctgaatgtgggccacctccttttttcctctgcttgcagtgtttcactcgaggctttgagtacaagaaacatcaaagcgatcatacttatgaaataatgacttcagattttcctgtccttgatcccagctggactgctcaagaagaaatggcccttttagaagctgtgatggactgtggctttggaaattggcaggatgtagccaatcaaatgtgcaccaagaccaaggaggagtgtgagaagcactatatgaagcatttcatcaataaccctctgtttgcatctaccctgctgaacctgaaacaagcagaggaagcaaaaactgctgacacagccattccatttcactctacagatgaccctccccgacctacctttgactccttgctttctcgggacatggccgggtacatgccagctcgagcagatttcattgaggaatttgacaattatgcagaatgggacttgagagacattgattttgttgaagatgactcggacattttacatgctctgaagatggctgtggtagatatctatcattccaggttaaaggagagacaaagacgaaaaaaaattataagagaccatggattaatcaaccttagaaagtttcaattaatggaacggcggtatcccaaggaggtccaggacctgtatgaaacaatgaggcgatttgcaagaattgtggggccagtggaacatgacaaattcattgaaagccatgcattggaatttgaactccgaagggaaatcaagaggctccaagaatacaggacagcaggcattaccaatttttgtagtgccagaacctacgatcacctcaagaagacacgggaggaagagcgccttaaacgcactatgctctcagaagttctccagtatatccaggacagtagtgcttgccagcagtggctccgccggcaagctgacattgattccggcctgagtccttccattccaatggcttcgaattcaggtagacggagtgcaccacccttgaacctcactggcctccctggcacagagaagctgaatgaaaaagaaaaggagctctgtcagatggtgaggttggtccctggagcctatttagaatacaaatctgctctattgaacgaatgtaacaagcaaggaggcttaagactggcgcaggcaagagcactcatcaagatagatgtgaacaaaacccggaaaatctatgatttcctcatcagagaaggatacatcactaaaggctaaggctccaagagcttgggatcagaagtcagaagtttggaatgtggtgggtcaaaggacaatatgggtgggcattctggagagttgtttttcagctgaattctcatggtgaaaacaggggaaaggacaaaggaaaccttaagttgtattgtctactttcttctccatcctgctttaaaacactcctgttgttggtattatgctgcagagttgtgtgctacataagctattattaaatgtgagtgggca

SEQ ID NO: 2504 - DNA, 1304 bp, Homo sapiens
tttcccgctcagccctggagcgcgtagctctaccaagaatggccactgtgccagatgcccctgaccagcgttgcccatttgaatttcctagcaggccccccaaagtaggtatttcagtaccctgttagagctgaggcgcaggtaaaatgactggcccaggccggtcccaccccgtaaggatttgaacgttggctccacaactcgggagcctgcgcctttcctcctcccaacgtggactcctgcccggcgaagtgcctcacttccttctcccgggagtcatcaagctttggtgtatgtgttggccggttctgaagtcttgaagaagctctgctgaggaagaccaaagcagcactcgttgccaattagggaatggaccgtttgggtccctttagcaatgatccctctgataagccaccttgccgaggctgctcctcctacctcatggagccttatatcaagtgtgctgaatgtgggccacctccttttttcctctgcttgcagtgtttcactcgaggctttgagtacaagaaacatcaaagcgatcatacttatgaaataatgacttcagattttcctgtccttgatcccagctggactgctcaagaagaaatggcccttttagaagctgtgatggactgtggctttggaaattggcaggatgtagccaatcaaatgtgcaccaagaccaaggaggagtgtgagaagcactatatgaagcatttcatcaataaccctctgtttgcatctaccctgctgaacctgaaacaagcagaggaagcaaaaactgctgacacagccattccatttcactctacagatgaccctccccgacctacctttgactccttgctttctcgggacatggccgggtacatgccagctcgagcagatttcattgaggaatttgacaattatgcagaatgggacttgagagacattgattttgttgaagatgactcggacattttacatgctctgaagatggctgtggtagatatctatcattccaggttaaaggagagacaaagacgaaaaaaaattataagagaccatggattaatcaaccttagaaagtttcaattaatggaacggcggtatcccaaggaggtccaggacctgtatgaaacaatgaggcgatttgcaagaattgtggggccagtggaacatgacaaattcattgaaagccatgcatgtaggtggtttttgagccttgagcagtatttgtgtgtgtatatttatataaataggagagataatggtgtgttttatgtgaagttctataaataaataaatggatatttctc

SEQ ID NO: 2505 - DNA, 2200 bp, Homo sapiens
caaagcccggaggcgcgcgcgaccggcggctctttggcgcggttctgaagtcttgaagaagccaccttgccgaggctgctcctcctacctcatggagccttatatcaagtgtgctgaatgtgggccacctccttttttcctctgcttgcagtgtttcactcgaggctttgagtacaagaaacatcaaagcgatcatacttatgaaataatgacttcagattttcctgtccttgatcccagctggactgctcaagaagaaatggcccttttagaagctgtgatggactgtggctttggaaattggtaagagcttggtgttaagagttgtcctgccctagtggactcagagaagaagctgttgttgaagagtaaaggaaggaacctcaggaagagaaagtatgtgttgctttcctatcaacccatgatttagaggcaggatgtagccaatcaaatgtgcaccaagaccaaggaggagtgtgagaagcactatatgaagcatttcatcaataaccctctgtttgcatctaccctgctgaacctgaaacaagcagaggaagcaaaaactgctgacacagccattccatttcactctacagatgaccctccccgacctacctttgactccttgctttctcgggacatggccgggtacatgccagctcgagcagatttcattgaggaatttgacaattatgcagaatgggacttgagagacattgattttgttgaagatgactcggacattttacatgctctgaagatggctgtggtagatatctatcattccaggttaaaggagagacaaagacgaaaaaaaattataagagaccatggattaatcaaccttagaaagtttcaattaatggaacggcggtatcccaaggaggtccaggacctgtatgaaacaatgaggcgatttgcaagaattgtggggccagtggaacatgacaaattcattgaaagccatgcattggaatttgaactccgaagggaaatcaagaggctccaagaatacaggacagcaggcattaccaatttttgtagtgccagaacctacgatcacctcaagaagacacgggaggaagagcgccttaaacgcactatgctctcagaagttctccagtatatccaggacagtagtgcttgccagcagtggctccgccggcaagctgacattgattccggcctgagtccttccattccaatggcttcgaattcaggtagacggagtgcaccacccttgaacctcactggcctccctggcacagagaagctgaatgaaaaagaaaaggagctctgtcagatggtgaggttggtccctggagcctatttagaatacaaatctgctctattgaacgaatgtaacaagcaaggaggcttaagactggcgcaggcaagagcactcatcaagatagatgtgaacaaaacccggaaaatctatgatttcctcatcagagaaggatacatcactaaaggctaaggctccaagagcttgggatcagaagtcagaagtttggaatgtggtgggtcaaaggacaatatgggtgggcattctggagagttgtttttcagctgaattctcatggtgaaaacaggggaaaggacaaaggaaaccttaagttgtattgtctactttcttctccatcctgctttaaaacactcctgttgttggtattatgctgcagagttgtgtgctacataagctattattaaatgtgagtgggcattcattcctaacacctcttgtaactaaaagaaccatagtacctcacatcacagtgctggtagaaatggaactaaaccacagtctgtaatcccaggagtccagctcagatccttatattgcgaggtaagtttgctgattatctgtcttgccttcaaacactgcagacagatttaaaataaagagaaaggttttagagcataagaaagctctcgttgaaggattttttaagctgacaacttttttttttttttttgaggcagaggttgcagcgagctgagatcacgccactgtgctccagcctgggcaacaaagtgagactctgtctcaaaaaaaaaaaaacaaaaaaaaacctttaatgtctggctttgtactttgcagtctgcctgtctaatctgcagtagtcttttgaggaggtggcaccggatataacatgtctctgttatttttagaattaattaaaatgttttgctattt

SEQ ID NO: 2506 - DNA, 2520 bp, Homo sapiens
tttcccgctcagccctggagcgcgtagctctaccaagaatggccactgtgccagatgcccctgaccagcgttgcccatttgaatttcctagcaggccccccaaagtaggtatttcagtaccctgttagagctgaggcgcaggtaaaatgactggcccaggccggtcccaccccgtaaggatttgaacgttggctccacaactcgggagcctgcgcctttcctcctcccaacgtggactcctgcccggcgaagtgcctcacttccttctcccgggagtcatcaagctttggtgtatgtgttggccggttctgaagtcttgaagaagctctgctgaggaagaccaaagcagcactcgttgccaattagggaatggaccgtttgggtccctttagcaatgatccctctgataagccaccttgccgaggctgctcctcctacctcatggagccttatatcaagtgtgctgaatgtgggccacctccttttttcctctgcttgcagtgtttcactcgaggctttgagtacaagaaacatcaaagcgatcatacttatgaaataatgacttcagattttcctgtccttgatcccagctggactgctcaagaagaaatggcccttttagaagctgtgatggactgtggctttggaaattggcaggatgtagccaatcaaatgtgcaccaagaccaaggaggagtgtgagaagcactatatgaagcatttcatcaataaccctctgtttgcatctaccctgctgaacctgaaacaagcagaggaagcaaaaactgctgacacagccattccatttcactctacagatgaccctccccgacctacctttgactccttgctttctcgggacatggccgggtacatgccagctcgagcagatttcattgaggaatttgacaattatgcagaatgggacttgagagacattgattttgttgaagatgactcggacattttacatgctctgaagatggctgtggtagatatctatcattccaggttaaaggagagacaaagacgaaaaaaaattataagagaccatggattaatcaaccttagaaagtttcaattaatggaacggcggtatcccaaggaggtccaggacctgtatgaaacaatgaggcgatttgcaagaattgtggggccagtggaacatgacaaattcattgaaagccatgcattggaatttgaactccgaagggaaatcaagaggctccaagaatacaggacagcaggcattaccaatttttgtagtgccagaacctacgatcacctcaagaagacacgggaggaagagcgccttaaacgcactatgctctcagaagttctccagtatatccaggacagtagtgcttgccagcagtggctccgccggcaagctgacattgattccggcctgagtccttccattccaatggcttcgaattcaggtagacggagtgcaccacccttgaacctcactggcctccctggcacagagaagctgaatgaaaaagaaaaggagctctgtcagatggtgaggttggtccctggagcctatttagaatacaaatctgctctattgaacgaatgtaacaagcaaggaggcttaagactggcgcaggcaagagcactcatcaagatagatgtgaacaaaacccggaaaatctatgatttcctcatcagagaaggatacatcactaaaggctaaggctccaagagcttgggatcagaagtcagaagtttggaatgtggtgggtcaaaggacaatatgggtgggcattctggagagttgtttttcagctgaattctcatggtgaaaacaggggaaaggacaaaggaaaccttaagttgtattgtctactttcttctccatcctgctttaaaacactcctgttgttggtattatgctgcagagttgtgtgctacataagctattattaaatgtgagtgggcattcattcctaacacctcttgtaactaaaagaaccatagtacctcacatcacagtgctggtagaaatggaactaaaccacagtctgtaatcccaggagtccagctcagatccttatattgcgaggtaagtttgctgattatctgtcttgccttcaaacactgcagacagatttaaaataaagagaaaggttttagagcataagaaagctctcgttgaaggattttttaagctgacaactttttttttttttttttgagacagagtttgctcttgtcctccaggctggagtgtgatggcaagatctcagctcactacaacctctgcctcccaggagaattgcttgaacacaggaggcagaggttgcagcgagctgagatcacgccactgtgctccagcctgggcaacaaagtgagactctgtctcaaaaaaaaaaaaacaaaaaaaaacctttaatgtctggctttgtactttgcagtctgcctgtctaatctgcagtagtcttttgaggaggtggcaccggatataacatgtctctgttatttttagaattaattaaaatgttttgctatttaa

SEQ ID NO: 2507 - DNA, 7373 bp, Homo sapiens
ggagggggcgaggatggggagcaatgcaaagctctgctcgccccccatctcaccccccaagcggatactggtcttctcgtcggattgcccatgcacttgttgcagaaacagccaaggccctggctgtggagaatgctgaaggaagaagacgcagaagcaggacgaccctgaaagattcagcctcttcatcctcaaacaggaccaggcctcctcttcccacctgtccagcagcatgaaagcagcatgattggccgaccgcaggagaagcccccagaaccaggcccccaactcagccatctgcggaggtcaaggtgtgagcgacgtctcctcaccacagtgctgtgtggtctatacctcagccagggagaggatgtgaaaccccccgccctgcacatgagtggtacaggccaacaggaacacctggctccagccacgttcacagacatgtcagccgtggagtagtgctgacacttttctctcagcttctcagggtttcagtccttttgggtttgttttatttaccttttttatggttttgtggctggacgttcacaaccaaggcagacagcatgggtgaccagcaactgtacaagaccaaccatgtggcccatggtagtgagaaccttttctaccaacagccaccacttggcgtccacagcgggctgaaccacaactatgggaatgcagttacagggggcggaatggatgcccctcaggcctcgccaatctccccccacttccctcaagatacacgggatggtctgggcttgcctgttggctccaaaaaccttggccaaatggatacctcgaggcagggagggtggggaagtcatgcagggcctggaaaccatgtccagctacgtggaaacctggccaactcaaacatgatgtggggggcaccagcccaggctgagcccactgatggctaccaatacacctactcccaggccagcgagatccggacccagaagcttaccagcggtgtcttacacaagctggactctttcacccaggtgtttgccaaccaaaacctgcgaattcaggtcaacaatatggcccaggtgctgcacactcagtcagcagtgatggatggagcccctgacagtgctctccgccagctgctgtctcagaagcccatggagcccccagcaccggctatcccttcccgctaccagcaggtgccccagcagcctcaccctggtttcactggtgggctgtccaaaccagctcttcaggtcgggcagcaccctacccaagggcacctgtattatgactaccagcagcctctggctcaggtgccagtgcagggaggacagccactgcaggccccacagatgctgtcacagcacatgcaacagatgcagcagcaccagtattacccaccgcagcaacagcagcaagccgggcaacagcgtatctccatgcaagaaatacagacgcagccgcaacaaattcgcccatcacagccacagccgccgccacagcagcagcagccgcagcagctacagctgcagcagcggcagggttcaatgcagatacctcagtattatcagccccaacccatgatgcagcacttgcaagagcagcagcagcaacagatgcacctgcagcctccttcttatcacagggaccctcaccagtataccccagagcaggcacacactgtccagctgattcccctgggctccatgtcccagtactactaccaggagccccagcagccctacagccaccccctctaccagcagagccacctgtcccagcaccagcagcgtgaggacagtcagctgaagacctactctagtgacagacaggcccaggccatgctgagctcccatggggacctggggcctcctgacacaggaatgggagacccagcgagctcagatctgacccgggtcagcagcaccctcccccatcgccccctcctatcccccagtgggatccacctcaacaacatggggcctcagcatcagcagctgtctcccagtgccatgtggccccagatgcacctacctgatgggagagcccagccagggtcccctgagtcaagtggccaacccaaaggagcgtttggggagcagtttgatgccaagaacaagctgacatgctccatctgcctgaaggagttcaagaacctgcctgccctgaatggccacatgcggtcccacgggggaatgagggcctcccccaacctcaaacaggaaatccccaggaagcatcagccgagtgtgcccaaagccgaggagcccctcaagaccgtgcaggagaagaaaaagttccggcaccggccggaacctctcttcatcccgccgccgccctcctacaacccgaaccccgctgcctcctactcgggcgccaccctgtaccagagccagctgcgctccccgcgcgtcctcggggaccacctgctcctggaccccacccacgagctgcccccttacacgcccccacccatgctgagcccggtgcgccagggctcggggctcttcagcaatgtcctcatctccggccacggccctggcgcccacccgcagctgcccctgacgcccctgacgcccacaccacgggtgctgctgtgtcgctccaacagcatcgatggcagcaacgtgacggtcaccccagggcctggagagcagactgtagatgttgaaccacgcatcaacattggcttgagattccaagcagaaatccctgaactccaagatatctctgccctggcccaggacacacacaaggccacactggtatggaagccctggccagaactagaaaaccatgacctccagcaaagagtggagaatcttctgaatttgtgctgttccagtgcattgccaggtggagggaccaattctgaatttgctttgcactctctgtttgaggccaaaggtgatgtgatggttgctctggaaatgctgctactgcggaagcctgtcaggttaaaatgtcatcctttagcaaattaccactatgccggttcggacaagtggacctccctagaaagaaaactgtttaacaaagcactagccacttacagcaaagactttatttttgtacagaagatggtgaagtccaagacggtggctcagtgcgtggagtactactacacgtggaaaaagatcatgcggctggggcggaaacaccggacacgcctggcagaaatcatcgacgattgtgtgacaagtgaagaagaagaagagttagaggaggaggaggaggaggacccggaagaagataggaaatccacaaaagaagaagagagtgaggtgccgaagtccccggagccaccacccgtccccgtcctggctcccacggaggggccgcccctgcaggccctgggccagccctcaggctccttcatctgtgaaatgcccaactgtggggctgactgtagatgtcatgtcactccctttcttccccaggtgttcagctcccgacaggcactgaatggccatgcccgcatccacgggggcaccaaccaggtgaccaaggcccgaggtgccatcccctctgggaagcagaagcctggtggcacccagagtgggtactgttcggtaaagagctcaccctctcacagcaccaccagcggcgagacagaccccaccaccatcttcccctgcaaggagtgtggcaaagtcttcttcaagatcaaaagccgaaatgcacacatgaaaactcacaggcagcaggaggaacaacagaggcaaaaggctcagaaggcggcttttgcagctgagatggcagccacgattgagaggactacggggcccgtgggggcgccggggctgctgcccctggaccagctgagtctgatcaaacccatcaaggatgtggacatcctcgacgacgacgtcgtccagcagttgggaggtgtcatggaagaggctgaagttgtggacaccgatcttctcttggatgatcaagattcagtcttgcttcagggtgacgcagaactataaagccctgtgtgtcacttagagacagtgaaaacccacggcctccatcttcattaatcaggaaacctggactgcctgcttgttttgtaacccttttaaactacctgttttaaaagtggtcattttattcaggtttagaaaaaaaaatcctatttcttttccttttatttaaaaaaatttgtttttgtggggggttgggggaataaataattggcacaactatctttaagaggtgtttcatctgggctaccttctcatgaaatcattcccagtagggactgaagctgaccttcatgttccattgcattcagatgtcaaccatcccggttgccttttatcccaaagcttgctgtgagtgtgtgtgtgtgagacgcaggcgaccctcttagtactggggtcttggggccaacttttcccatcaagcgttactttgattctgttctgacctcattccatagtttgcagtgagcatggcatctttgcctggagatactatgctaggggcagctttccaggggcaaagcaagccctcgtgttacacggctctcctccagctcacacgacatgtgaggagatgaccaaatgtgaaaacaggtttcccctgtgttgcccgtcatcctttggcccgttcacaggaatggagtactgtataattttaggctttcattcccagcagtgtttactgaggacctggttttctagaacaggtgtgtcctgtcctcttccatgttccctgggggctggtcagctccaagttgtgggtggcagagctgtgtttcagcatgaactgactagagacccatctggaggcaaatattaagttgccaggactgctttcacttcagggtgattgaaggacacatattgaagtacctagaatgccagaaagtgttctattgcccaaaaaacaaatcagaaaagcctattcttttttgcaacgctgttaatgattagtggagttctgaaattactttgtgccacttggaagtactgtgaaaccgcattcactgggattttgctgtaattcacatccgctggactgaagtttaccttgatgttagctataagaaatagttttctaacacatacgatagcaaatacaagacaaatagcattgaaggccaacaaaaatggcttcagatacaccttagctataatgtttgcattcaaacaatgaatgtattcatcacaagtcacttaccaaagcacttctagacttctccaacctccatgactttgctctgcttcctcctgtccctgtcagcagggttgctgtttgtacttgaaggtaataaacctgtaatccttcaaaaatgccatttagccccaggcttctgagctgagtcagactgacccatcccaccgttagggcaaaagtcaggctgggacacagcgccagtacagagaggatcctgcttcatgcaactccccttttggagttaatgcagcgtgatttcctgggccggtgttttcaggcatcgcccaccccaggtatgctggttcccagctccacgtaggtgtgcctatcacgctgggccactttgctgacaacattcatagcttgacatgagagagaatatcagcagaagcatgagagtaggacctgacgtctttgactctgcaaaagcatttagcacacactcatgggggggaactggctgtgagccacagcagccccacacagacagtggtctctgaacttcaggaaagccatggacagaaaaaaaaataaaattcttttccatcattctattttcaaagaggtcttggcgttttcctacatcttttgtttagagggggaaaaaagtttcatttgctgccatttcagaaaggttatgctatcctgttttatccaagcagttgtgagtcaggaactgcctgggcagtgtgcatcaactttgtggccgaaccattacagctgtcatatccttggctgatcgtctctcccagggactactgccctccacttagtgtctgagggtaagcctagaagggtgctgctattgggtctatggaagcttatctatcaaaggagcaaacatccagaaaagtgtttataaagcaaatgtattgcctctgtttagagatttgcccagctgttccagttttaaacattaaaaaataaactcagttgccatggcaaaaatagaatgcacagcttacttataattttccatgcagtatagcataaggatttttgacttgaaacaaccaaagaactcctccttaacgagacagttcaaattcctgaattagtatttcttgactatcaacttaaagaatggacttcctagtacaatgttgcacttatttttttttctgaaataattctgcctgcatgtatgtgttgtgttttagcttctccccttaccccaccccaaagatcttttcttcctaatggttaatgtctcaactcggttactgtttactatcagatggtttttcattagtgaatttagacctctttgagaaagcttgtatataaaaagttaacagatatattttatggaaaaacccatcttattttcaaatatatttaactgctgttatattttattagaggaaggttgtaaatattttctaggagttctattgtaaagaaaagtatttttgaaaaaaattaatgtaataaaaaggaaaacatttttaaatagtggttgtgattgcttcctgttctggcttcgttatgttctattctcagcagatgaattgcatgccttccatatcaggatgtaatttattcaggtttgcactattataagttgacatcataatatctagtgtgcttaactgtattttcccggaatgcaagtcccttggtccatattaaagcactatgtatagcatattcataatttttcttttgtaacgtgtgtatttttaataaggattttatgtaacattttggcaacaagaggaccgtattttctagtgaattttataataacattttgctaaaaatgtttcttcctaggtcagtttttgttaaggtgaaccaaaagtcttattttaccaggggtttaaaaaaagtttgaagcttgaaagcaaagttatatttaaacatcatatgtaacaaataaataaagatgttttatagacttgtcctaaaaaggtgcattccttaaaaaaaaaaaaaagaaaaaaaaaggaaactggggcattctaggttgtttcccctccaagtgataagctttttttttttcttaattatcacaatgcttcttcaaaaagggaaccagggaaattttatttaacacattctaatcattagcctctcagaaagttattacagttcctatagatgggcattcatcaaatggagatgtaaccaaacagacactgtcatatttatttgtgaaaacctgattcaatattgcatcagctgctctgaaaataaaatattaatcttttgcgttt

SEQ ID NO: 2508 - DNA, 7286 bp, Homo sapiens
ggcgaggatggggagcaatgcaaagctctgctcgccccccatctcaccccccaagcggatactggtcttctcgtcggattgcccatgcacttgttgcagaaacagccaaggccctggctgtggagaatgctgaaggaagaagacgcagaagcaggacgaccctgaaagattcagcctcttcatcctcaaacaggaccaggcctcctcttcccacctgtccagcagcatgaaagcagcatgattggccgaccgcaggagaagcccccagaaccaggcccccaactcagccatctgcggaggtcaaggtgtgagcgacgtctcctcaccacagtgctgtgtggtctatacctcagccagggagaggatgtgaaaccccccgccctgcacatgagtggtacaggccaacaggaacacctggctccagccacgttcacagacatgtcagccgtggagtagtgctgacacttttctctcagcttctcagggtttcagtccttttgggtttgttttatttaccttttttatggttttgtggctggacgttcacaaccaaggcagacagcatgggtgaccagcaactgtacaagaccaaccatgtggcccatggtagtgagaaccttttctaccaacagccaccacttggcgtccacagcgggctgaaccacaactatgggaatgcagttacagggggcggaatggatgcccctcaggcctcgccaatctccccccacttccctcaagatacacgggatggtctgggcttgcctgttggctccaaaaaccttggccaaatggatacctcgaggcagggagggtggggaagtcatgcagggcctggaaaccatgtccagctacgtggaaacctggccaactcaaacatgatgtggggggcaccagcccaggctgagcccactgatggctaccaatacacctactcccaggccagcgagatccggacccagaagcttaccagcggtgtcttacacaagctggactctttcacccaggtgtttgccaaccaaaacctgcgaattcaggtcaacaatatggcccaggtgctgcacactcagtcagcagtgatggatggagcccctgacagtgctctccgccagctgctgtctcagaagcccatggagcccccagcaccggctatcccttcccgctaccagcaggtgccccagcagcctcaccctggtttcactggtgggctgtccaaaccagctcttcaggtcgggcagcaccctacccaagggcacctgtattatgactaccagcagcctctggctcaggtgccagtgcagggaggacagccactgcaggccccacagatgctgtcacagcacatgcaacagatgcagcagcaccagtattacccaccgcagcaacagcagcaagccgggcaacagcgtatctccatgcaagaaatacagacgcagccgcaacaaattcgcccatcacagccacagccgccgccacagcagcagcagccgcagcagctacagctgcagcagcggcagggttcaatgcagatacctcagtattatcagccccaacccatgatgcagcacttgcaagagcagcagcagcaacagatgcacctgcagcctccttcttatcacagggaccctcaccagtataccccagagcaggcacacactgtccagctgattcccctgggctccatgtcccagtactactaccaggagccccagcagccctacagccaccccctctaccagcagagccacctgtcccagcaccagcagcgtgaggacagtcagctgaagacctactctagtgacagacaggcccaggccatgctgagctcccatggggacctggggcctcctgacacaggaatgggagacccagcgagctcagatctgacccgggtcagcagcaccctcccccatcgccccctcctatcccccagtgggatccacctcaacaacatggggcctcagcatcagcagctgtctcccagtgccatgtggccccagatgcacctacctgatgggagagcccagccagggtcccctgagtcaagtggccaacccaaaggagcgtttggggagcagtttgatgccaagaacaagctgacatgctccatctgcctgaaggagttcaagaacctgcctgccctgaatggccacatgcggtcccacgggggaatgagggcctcccccaacctcaaacaggaggaaggagagaaggtcctgccgcctcagccccagccaccactgccgcctccgcctccgcctccgccgccaccacagctccctcccgaggcagaaagcctcacgcctatggtcatgcccgtgtctgtccctgtcaagcttctcccgcccaagcccagctctcaggggttcaccaacagcaccgttgccgccccctccgccagagacaagccagccagctcgatgtcggacgacgagatgcctgtgctcgaaatccccaggaagcatcagccgagtgtgcccaaagccgaggagcccctcaagaccgtgcaggagaagaaaaagttccggcaccggccggaacctctcttcatcccgccgccgccctcctacaacccgaaccccgctgcctcctactcgggcgccaccctgtaccagagccagctgcgctccccgcgcgtcctcggggaccacctgctcctggaccccacccacgagctgcccccttacacgcccccacccatgctgagcccggtgcgccagggctcggggctcttcagcaatgtcctcatctccggccacggccctggcgcccacccgcagctgcccctgacgcccctgacgcccacaccacgggtgctgctgtgtcgctccaacagcatcgatggcagcaacgtgacggtcaccccagggcctggagagcagactgtagatgttgaaccacgcatcaacattggcttgagattccaagcagaaatccctgaactccaagatatctctgccctggcccaggacacacacaaggccacactggtatggaagccctggccagaactagaaaaccatgacctccagcaaagagtggagaatcttctgaatttgtgctgttccagtgcattgccaggtggagggaccaattctgaatttgctttgcactctctgtttgaggccaaaggtgatgtgatggttgctctggaaatgctgctactgcggaagcctgtcaggttaaaatgtcatcctttagcaaattaccactatgccggttcggacaagtggacctccctagaaagaaaactgtttaacaaagcactagccacttacagcaaagactttatttttgtacagaagatggtgaagtccaagacggtggctcagtgcgtggagtactactacacgtggaaaaagatcatgcggctggggcggaaacaccggacacgcctggcagaaatcatcgacgattgtgtgacaagtgaagaagaagaagagttagaggaggaggaggaggaggacccggaagaagataggaaatccacaaaagaagaagagagtgaggtgccgaagtccccggagccaccacccgtccccgtcctggctcccacggaggggccgcccctgcaggccctgggccagccctcaggctccttcatctgtgaaatgcccaactgtggggctgtgttcagctcccgacaggcactgaatggccatgcccgcatccacgggggcaccaaccaggtgaccaaggcccgaggtgccatcccctctgggaagcagaagcctggtggcacccagagtgggtactgttcggtaaagagctcaccctctcacagcaccaccagcggcgagacagaccccaccaccatcttcccctgcaaggagtgtggcaaagtcttcttcaagatcaaaagccgaaatgcacacatgaaaactcacaggcagcaggaggaacaacagaggcaaaaggctcagaaggcggcttttgcagctgagatggcagccacgattgagaggactacggggcccgtgggggcgccggggctgctgcccctggaccagctgagtctgatcaaacccatcaaggatgtggacatcctcgacgacgacgtcgtccagcagttgggaggtgtcatggaagaggctgaagttgtggacaccgatcttctcttggatgatcaagattcagtcttgcttcagggtgacgcagaactataaagccctgtgtgtcacttagagacagtgaaaacccacggcctccatcttcattaatcaggaaacctggactgcctgcttgttttgtaacccttttaaactacctgttttaaaagtggtcattttattcaggtttagaaaaaaaaatcctatttcttttccttttatttaaaaaaatttgtttttgtggggggttgggggaataaataattggcacaactatctttaagaggtgtttcatctgggctaccttctcatgaaatcattcccagtagggactgaagctgaccttcatgttccattgcattcagatgtcaaccatcccggttgccttttatcccaaagcttgctgtgagtgtgtgtgtgtgagacgcaggcgaccctcttagtactggggtcttggggccaacttttcccatcaagcgttactttgattctgttctgacctcattccatagtttgcagtgagcatggcatctttgcctggagatactatgctaggggcagctttccaggggcaaagcaagccctcgtgttacacggctctcctccagctcacacgacatgtgaggagatgaccaaatgtgaaaacaggtttcccctgtgttgcccgtcatcctttggcccgttcacaggaatggagtactgtataattttaggctttcattcccagcagtgtttactgaggacctggttttctagaacaggtgtgtcctgtcctcttccatgttccctgggggctggtcagctccaagttgtgggtggcagagctgtgtttcagcatgaactgactagagacccatctggaggcaaatattaagttgccaggactgctttcacttcagggtgattgaaggacacatattgaagtacctagaatgccagaaagtgttctattgcccaaaaaacaaatcagaaaagcctattcttttttgcaacgctgttaatgattagtggagttctgaaattactttgtgccacttggaagtactgtgaaaccgcattcactgggattttgctgtaattcacatccgctggactgaagtttaccttgatgttagctataagaaatagttttctaacacatacgatagcaaatacaagacaaatagcattgaaggccaacaaaaatggcttcagatacaccttagctataatgtttgcattcaaacaatgaatgtattcatcacaagtcacttaccaaagcacttctagacttctccaacctccatgactttgctctgcttcctcctgtccctgtcagcagggttgctgtttgtacttgaaggtaataaacctgtaatccttcaaaaatgccatttagccccaggcttctgagctgagtcagactgacccatcccaccgttagggcaaaagtcaggctgggacacagcgccagtacagagaggatcctgcttcatgcaactccccttttggagttaatgcagcgtgatttcctgggccggtgttttcaggcatcgcccaccccaggtatgctggttcccagctccacgtaggtgtgcctatcacgctgggccactttgctgacaacattcatagcttgacatgagagagaatatcagcagaagcatgagagtaggacctgacgtctttgactctgcaaaagcatttagcacacactcatgggggggaactggctgtgagccacagcagccccacacagacagtggtctctgaacttcaggaaagccatggacagaaaaaaaaataaaattcttttccatcattctattttcaaagaggtcttggcgttttcctacatcttttgtttagagggggaaaaaagtttcatttgctgccatttcagaaaggttatgctatcctgttttatccaagcagttgtgagtcaggaactgcctgggcagtgtgcatcaactttgtggccgaaccattacagctgtcatatccttggctgatcgtctctcccagggactactgccctccacttagtgtctgagggtaagcctagaagggtgctgctattgggtctatggaagcttatctatcaaaggagcaaacatccagaaaagtgtttataaagcaaatgtattgcctctgtttagagatttgcccagctgttccagttttaaacattaaaaaataaactcagttgccatggcaaaaatagaatgcacagcttacttataattttccatgcagtatagcataaggatttttgacttgaaacaaccaaagaactcctccttaacgagacagttcaaattcctgaattagtatttcttgactatcaacttaaagaatggacttcctagtacaatgttgcacttatttttttttctgaaataattctgcctgcatgtatgtgttgtgttttagcttctccccttaccccaccccaaagatcttttcttcctaatggttaatgtctcaactcggttactgtttactatcagatggtttttcattagtgaatttagacctctttgagaaagcttgtatataaaaagttaacagatatattttatggaaaaacccatcttattttcaaatatatttaactgctgttatattttattagaggaaggttgtaaatattttctaggagttctattgtaaagaaaagtatttttgaaaaaaattaatgtaataaaaaggaaaacatttttaaatagtggttgtgattgcttcctgttctggcttcgttatgttctattctcagcagatgaattgcatgccttccatatcaggatgtaatttattcaggtttgcactattataagttgacatcataatatctagtgtgcttaactgtattttcccggaatgcaagtcccttggtccatattaaagcactatgtatagcatattcataatttttcttttgtaacgtgtgtatttttaataaggattttatgtaacattttggcaacaagaggaccgtattttctagtgaattttataataacattttgctaaaaatgtttcttcctaggtcagtttttgttaaggtgaaccaaaagtcttattttaccaggggtttaaaaaaagtttgaagcttgaaagcaaagttatatttaaacatcatatgtaacaaataaataaagatgttttatagacttgtcctaaaaaggtgcattcctt

SEQ ID NO: 2509 - DNA, 7646 bp, Homo sapiens
ggagggggcgaggatggggagcaatgcaaagctctgctcgccccccatctcaccccccaagcggatactggtcttctcgtcggattgcccatgcacttgttgcagaaacagccaaggccctggctgtggagaatgctgaaggaagaagacgcagaagcaggacgaccctgaaagattcagcctcttcatcctcaaacaggaccaggcctcctcttcccacctgtccagcagcatgaaagcagcatgattggccgaccgcaggagaagcccccagaaccaggcccccaactcagccatctgcggaggtcaaggtgtgagcgacgtctcctcaccacagtgctgtgtggtctatacctcagccagggagaggatgtgaaaccccccgccctgcacatgagtggtacaggccaacaggaacacctggctccagccacgttcacagacatgtcagccgtggagtagtgctgacacttttctctcagcttctcagggtttcagtccttttgggtttgttttatttaccttttttatggttttgtggctggacgttcacaaccaaggcagacagcatgggtgaccagcaactgtacaagaccaaccatgtggcccatggtagtgagaaccttttctaccaacagccaccacttggcgtccacagcgggctgaaccacaactatgggaatgcagttacagggggcggaatggatgcccctcaggcctcgccaatctccccccacttccctcaagatacacgggatggtctgggcttgcctgttggctccaaaaaccttggccaaatggatacctcgaggcagggagggtggggaagtcatgcagggcctggaaaccatgtccagctacgtggaaacctggccaactcaaacatgatgtggggggcaccagcccaggctgagcccactgatggctaccaatacacctactcccaggccagcgagatccggacccagaagcttaccagcggtgtcttacacaagctggactctttcacccaggtgtttgccaaccaaaacctgcgaattcaggtcaacaatatggcccaggtgctgcacactcagtcagcagtgatggatggagcccctgacagtgctctccgccagctgctgtctcagaagcccatggagcccccagcaccggctatcccttcccgctaccagcaggtgccccagcagcctcaccctggtttcactggtgggctgtccaaaccagctcttcaggtcgggcagcaccctacccaagggcacctgtattatgactaccagcagcctctggctcaggtgccagtgcagggaggacagccactgcaggccccacagatgctgtcacagcacatgcaacagatgcagcagcaccagtattacccaccgcagcaacagcagcaagccgggcaacagcgtatctccatgcaagaaatacagacgcagccgcaacaaattcgcccatcacagccacagccgccgccacagcagcagcagccgcagcagctacagctgcagcagcggcagggttcaatgcagatacctcagtattatcagccccaacccatgatgcagcacttgcaagagcagcagcagcaacagatgcacctgcagcctccttcttatcacagggaccctcaccagtataccccagagcaggcacacactgtccagctgattcccctgggctccatgtcccagtactactaccaggagccccagcagccctacagccaccccctctaccagcagagccacctgtcccagcaccagcagcgtgaggacagtcagctgaagacctactctagtgacagacaggcccaggccatgctgagctcccatggggacctggggcctcctgacacaggaatgggagacccagcgagctcagatctgacccgggtcagcagcaccctcccccatcgccccctcctatcccccagtgggatccacctcaacaacatggggcctcagcatcagcagctgtctcccagtgccatgtggccccagatgcacctacctgatgggagagcccagccagggtcccctgagtcaagtggccaacccaaaggagcgtttggggagcagtttgatgccaagaacaagctgacatgctccatctgcctgaaggagttcaagaacctgcctgccctgaatggccacatgcggtcccacgggggaatgagggcctcccccaacctcaaacaggaggaaggagagaaggtcctgccgcctcagccccagccaccactgccgcctccgcctccgcctccgccgccaccacagctccctcccgaggcagaaagcctcacgcctatggtcatgcccgtgtctgtccctgtcaagcttctcccgcccaagcccagctctcaggggttcaccaacagcaccgttgccgccccctccgccagagacaagccagccagctcgatgtcggacgacgagatgcctgtgctcgtgaggatgaccctctctcccccacactcaccccaaggggctgccccccgcacgcctgctgaaatccccaggaagcatcagccgagtgtgcccaaagccgaggagcccctcaagaccgtgcaggagaagaaaaagttccggcaccggccggaacctctcttcatcccgccgccgccctcctacaacccgaaccccgctgcctcctactcgggcgccaccctgtaccagagccagctgcgctccccgcgcgtcctcggggaccacctgctcctggaccccacccacgagctgcccccttacacgcccccacccatgctgagcccggtgcgccagggctcggggctcttcagcaatgtcctcatctccggccacggccctggcgcccacccgcagctgcccctgacgcccctgacgcccacaccacgggtgctgctgtgtcgctccaacagcatcgatggcagcaacgtgacggtcaccccagggcctggagagcagactgtagatgttgaaccacgcatcaacattggcttgagattccaagcagaaatccctgaactccaagatatctctgccctggcccaggacacacacaaggccacactggtatggaagccctggccagaactagaaaaccatgacctccagcaaagagtggagaatcttctgaatttgtgctgttccagtgcattgccaggtggagggaccaattctgaatttgctttgcactctctgtttgaggccaaaggtgatgtgatggttgctctggaaatgctgctactgcggaagcctgtcaggttaaaatgtcatcctttagcaaattaccactatgccggttcggacaagtggacctccctagaaagaaaactgtttaacaaagcactagccacttacagcaaagactttatttttgtacagaagatggtgaagtccaagacggtggctcagtgcgtggagtactactacacgtggaaaaagatcatgcggctggggcggaaacaccggacacgcctggcagaaatcatcgacgattgtgtgacaagtgaagaagaagaagagttagaggaggaggaggaggaggacccggaagaagataggaaatccacaaaagaagaagagagtgaggtgccgaagtccccggagccaccacccgtccccgtcctggctcccacggaggggccgcccctgcaggccctgggccagccctcaggctccttcatctgtgaaatgcccaactgtggggctgtgttcagctcccgacaggcactgaatggccatgcccgcatccacgggggcaccaaccaggtgaccaaggcccgaggtgccatcccctctgggaagcagaagcctggtggcacccagagtgggtactgttcggtaaagagctcaccctctcacagcaccaccagcggcgagacagaccccaccaccatcttcccctgcaaggagtgtggcaaagtcttcttcaagatcaaaagccgaaatgcacacatgaaaactcacaggcagcaggaggaacaacagaggcaaaaggctcagaaggcggcttttgcagctgagatggcagccacgattgagaggactacggggcccgtgggggcgccggggctgctgcccctggaccagctgagtctgatcaaacccatcaaggatgtggacatcctcgacgacgacgtcgtccagcagttgggaggtgtcatggaagaggctgaagttgtggacaccgatcttctcttggatgatcaagattcagtcttgcttcagggtgacgcagaactataaagccctgtgtgtcacttagagacagtgaaaacccacggcctccatcttcattaatcaggaaacctggactgcctgcttgttttgtaacccttttaaactacctgttttaaaagtggtcattttattcaggtttagaaaaaaaaatcctatttcttttccttttatttaaaaaaatttgtttttgtggggggttgggggaataaataattggcacaactatctttaagaggtgtttcatctgggctaccttctcatgaaatcattcccagtagggactgaagctgaccttcatgttccattgcattcagatgtcaaccatcccggttgccttttatcccaaagcttgctgtgagtgtgtgtgtgtgagacgcaggcgaccctcttagtactggggtcttggggccaacttttcccatcaagcgttactttgattctgttctgacctcattccatagtttgcagtgagcatggcatctttgcctggagatactatgctaggggcagctttccaggggcaaagcaagccctcgtgttacacggctctcctccagctcacacgacatgtgaggagatgaccaaatgtgaaaacaggtttcccctgtgttgcccgtcatcctttggcccgttcacaggaatggagtactgtataattttaggctttcattcccagcagtgtttactgaggacctggttttctagaacaggtgtgtcctgtcctcttccatgttccctgggggctggtcagctccaagttgtgggtggcagagctgtgtttcagcatgaactgactagagacccatctggaggcaaatattaagttgccaggactgctttcacttcagggtgattgaaggacacatattgaagtacctagaatgccagaaagtgttctattgcccaaaaaacaaatcagaaaagcctattcttttttgcaacgctgttaatgattagtggagttctgaaattactttgtgccacttggaagtactgtgaaaccgcattcactgggattttgctgtaattcacatccgctggactgaagtttaccttgatgttagctataagaaatagttttctaacacatacgatagcaaatacaagacaaatagcattgaaggccaacaaaaatggcttcagatacaccttagctataatgtttgcattcaaacaatgaatgtattcatcacaagtcacttaccaaagcacttctagacttctccaacctccatgactttgctctgcttcctcctgtccctgtcagcagggttgctgtttgtacttgaaggtaataaacctgtaatccttcaaaaatgccatttagccccaggcttctgagctgagtcagactgacccatcccaccgttagggcaaaagtcaggctgggacacagcgccagtacagagaggatcctgcttcatgcaactccccttttggagttaatgcagcgtgatttcctgggccggtgttttcaggcatcgcccaccccaggtatgctggttcccagctccacgtaggtgtgcctatcacgctgggccactttgctgacaacattcatagcttgacatgagagagaatatcagcagaagcatgagagtaggacctgacgtctttgactctgcaaaagcatttagcacacactcatgggggggaactggctgtgagccacagcagccccacacagacagtggtctctgaacttcaggaaagccatggacagaaaaaaaaataaaattcttttccatcattctattttcaaagaggtcttggcgttttcctacatcttttgtttagagggggaaaaaagtttcatttgctgccatttcagaaaggttatgctatcctgttttatccaagcagttgtgagtcaggaactgcctgggcagtgtgcatcaactttgtggccgaaccattacagctgtcatatccttggctgatcgtctctcccagggactactgccctccacttagtgtctgagggtaagcctagaagggtgctgctattgggtctatggaagcttatctatcaaaggagcaaacatccagaaaagtgtttataaagcaaatgtattgcctctgtttagagatttgcccagctgttccagttttaaacattaaaaaataaactcagttgccatggcaaaaatagaatgcacagcttacttataattttccatgcagtatagcataaggatttttgacttgaaacaaccaaagaactcctccttaacgagacagttcaaattcctgaattagtatttcttgactatcaacttaaagaatggacttcctagtacaatgttgcacttatttttttttctgaaataattctgcctgcatgtatgtgttgtgttttagcttctccccttaccccaccccaaagatcttttcttcctaatggttaatgtctcaactcggttactgtttactatcagatggtttttcattagtgaatttagacctctttgagaaagcttgtatataaaaagttaacagatatattttatggaaaaacccatcttattttcaaatatatttaactgctgttatattttattagaggaaggttgtaaatattttctaggagttctattgtaaagaaaagtatttttgaaaaaaattaatgtaataaaaaggaaaacatttttaaatagtggttgtgattgcttcctgttctggcttcgttatgttctattctcagcagatgaattgcatgccttccatatcaggatgtaatttattcaggtttgcactattataagttgacatcataatatctagtgtgcttaactgtattttcccggaatgcaagtcccttggtccatattaaagcactatgtatagcatattcataatttttcttttgtaacgtgtgtatttttaataaggattttatgtaacattttggcaacaagaggaccgtattttctagtgaattttataataacattttgctaaaaatgtttcttcctaggtcagtttttgttaaggtgaaccaaaagtcttattttaccaggggtttaaaaaaagtttgaagcttgaaagcaaagttatatttaaacatcatatgtaacaaataaataaagatgttttatagacttgtcctaaaaaggtgcattccttaaaaaaaaaaaaaagaaaaaaaaaggaaactggggcattctaggttgtttcccctccaagtgataagctttttttttttcttaattatcacaatgcttcttcaaaaagggaaccagggaaattttatttaacacattctaatcattagcctctcagaaagttattacagttcctatagatgggcattcatcaaatggagatgtaaccaaacagacactgtcatatttatttgtgaaaacctgattcaatattgcatcagctgctctgaaaataaaatattaatcttttgcgttt

SEQ ID NO: 2510 - DNA, 2382 bp, Homo sapiens
atgagccgcgcgcctctgccgagcgcagccaactaaatcggcttggatgattcgcgacctgagcaagatgtacccgcagaccagacacccagcaccgcatcagcctgctcaaccctttaaatttacaatttccgaatcctgtgatcggattaaggaagagtttcagtttttacaggctcaataccacagtctgaagctggaatgtgagaaactcgccagtgagaagacagagatgcagcggcattatgtcatgtattatgaaatgtcctatgggttgaatatagaaatgcacaagcaggcagagattgtcaagaggctgaatgctatctgtgcacaagtcattcctttcctgtcccaagagcaacaactccaggcccagcatttatcacatggacatggtctccccgtacctctgactccacacccttcagggctccagccccctgccattccacccatcggtagcagtgccgggcttctggccctctccagtgctctaggaggtcagtcccatcttccaattaaagatgagaagaagcaccatgacaatgatcaccaaagagacagagactccatcaagagctcttcagtatccccatcagccagtttccgaggtgctgagaagcacagaaactccgcagactactcctcagagagcaaaaagcagaaaactgaagaaaaggaaattgcagctcgttatgacagcgatggtgagaaaagtgatgacaacttggtggttgacgtttccaatgaggatccatcttcccctcgagggagcccagcacattcccccagagagaatggcctagacaagacacgcctgctcaagaaagatgccccgattagtccagcctctattgcatcttccagcagtactccctcctccaaatccaaagaacttagccttaatgaaaaatctactactcccgtctcaaagtccaatacccctactccacgaactgatgcgcccaccccaggcagtaactctactcccggattgaggcctgtacctggaaaaccaccaggagttgaccctttggcctcaagcctaaggaccccaatggcagtaccttgtccatatccaactccatttgggattgtgccccatgctggaatgaacggagagctgaccagccccggagcggcctacgctgggctccacaacatctcccctcagatgagcgcagctgctgccgccgccgctgctgctgctgcctatgggagatcaccagtggtgggatttgatccacaccatcacatgcgtgtgccagcaatacctccaaacctgacaggcattccaggaggaaaaccagcatactccttccatgttagcgcagatggtcagatgcagcctgtcccttttccacccgacgccctcatcggacctggaatcccccggcatgctcgccagatcaacaccctcaaccacggggaggtggtgtgcgcggtgaccatcagcaaccccacgagacacgtgtacacgggtgggaagggctgcgtcaaggtctgggacatcagccacccaggcaataagagtcctgtctcccagctcgactgtctgaacagggataactacatccgttcctgcagattgctccctgatggtcgcaccctaattgttggaggggaagccagtactttgtccatttgggacctggcggctccaaccccacgcatcaaggcagagctgacatcctcggcccccgcctgctatgccctggccatcagccccgattccaaggtctgcttctcatgctgcagcgacggcaacatcgctgtgtgggatctgcacaaccagaccttggtgaggcaattccagggccacacagatggagccagctgtattgacatttctaatgatggcaccaagctctggacaggtggtttggacaacacggtcaggtcctgggacctgcgcgaggggcggcagctgcagcagcacgacttcacctcccagatcttttctctgggctactgcccaactggagagtggcttgcagtggggatggagaacagcaatgtggaagttttgcatgtcaccaagccagacaaataccaactacatcttcatgagagctgtgtgctgtcgctcaagtttgcccattgtggcaaatggtttgtaagcactggaaaggacaaccttctgaatgcctggagaacaccttatggggccagtatattccagtccaaagaatcctcatcggtgcttagctgtgacatctccgtggacgacaaatacattgtcactggctctggggataagaaggccacagtttatgaagttatttattaaagacaaatcttcatgcagactggacttctcctcctggtagcactttgctctgtcatcctttttgttcacccccatccccgcatctaaaa

SEQ ID NO: 2511 - DNA, 4845 bp, Homo sapiens
acagagcgtgttgttagagctgtgctgagcgggtgtttgggttgttggctgctttcttccccctttctcacacacttgtatattattttgaggtggtgttcgcagagtttgaaaggagagagaattaaaaaaaaaagccgcaagcgtttcactcttttatttttataatccccttcaatttggggttaaaaaaaagacaagaaaacaggaaggaagagaaataaggaaatgagatgtggtaaaagaagctaaaaggtgccttttaaaagatcgttgctgtgaagtgaaaaaaatctccagagaaaccaaaaagcaccgccgagacctcttccgaaccaaaggagtttgtgtttgcttttagggaagaagaaagatcattcattcggaggaataacaaccaattaaaagacaaataaaaaaagtttggagtgggacgcagagcgagcgagaggagctgccggcgggcggtggggcgcggagcccgcactttcccggccgggtgagcggcggccgcggcgccgggctcggcgggtgcgcctcggcggagcgaacgtcggagcgttgccttgggagacgcgcgccggacaatgcccgcggcgggccagtgacgcccgcggggaatgcggagcggcccggcagccggcacccagccgccgccgcgcgttcctgccgcccgtgtcacgcgagacccggcgggggccgggaccgcccgagccgcccctcagaccgagccggccgcctccgctgccgcggccgcctcctcttcggggtcattaaagccaatgagccgcgcgcctctgccgagcgcagccaactaaatcggcttggatgattcgcgacctgagcaagatgtacccgcagaccagacacccagcaccgcatcagcctgctcaaccctttaaatttacaatttccgaatcctgtgatcggattaaggaagagtttcagtttttacaggctcaataccacagtctgaagctggaatgtgagaaactcgccagtgagaagacagagatgcagcggcattatgtcatgtattatgaaatgtcctatgggttgaatatagaaatgcacaagcaggcagagattgtcaagaggctgaatgctatctgtgcacaagtcattcctttcctgtcccaagagcaccagcaacaagtggtgcaggctgtggaacgggccaagcaggtgaccatggcagaactgaacgccatcattgggcaacaactccaggcccagcatttatcacatggacatggtctccccgtacctctgactccacacccttcagggctccagccccctgccattccacccatcggtagcagtgccgggcttctggccctctccagtgctctaggaggtcagtcccatcttccaattaaagatgagaagaagcaccatgacaatgatcaccaaagagagagagacaaactcaaccacaaaagtttatccccatcagccagtttccgaggtgctgagaagcacagaaactccgcagactactcctcagagagcaaaaagcagaaaactgaagaaaaggaaattgcagctcgttatgacagcgatggtgagaaaagtgatgacaacttggtggttgacgtttccaatgaggatccatcttcccctcgagggagcccagcacattcccccagagagaatggcctagacaagacacgcctgctcaagaaagatgccccgattagtccagcctctattgcatcttccagcagtactccctcctccaaatccaaagaacttagccttaagagggatatggggaaattgagtgaaacacgtcttagcgaagatgaacaatgcacattggggttacagagatggttttgtcgcctgtggtttatgaatgaaaaatctactactcccgtctcaaagtccaatacccctactccacgaactgatgcgcccaccccaggcagtaactctactcccggattgaggcctgtacctggaaaaccaccaggagttgaccctttggcctcaagcctaaggaccccaatggcagtaccttgtccatatccaactccatttgggattgtgccccatgctggaatgaacggagagctgaccagccccggagcggcctacgctgggctccacaacatctcccctcagatgagcgcagctgctgccgccgccgctgctgctgctgcctatgggagatcaccagtggtgggatttgatccacaccatcacatgcgtgtgccagcaatacctccaaacctgacaggcattccaggaggaaaaccagcatactccttccatgttagcgcagatggtcagatgcagcctgtcccttttccacccgacgccctcatcggacctggaatcccccggcatgctcgccagatcaacaccctcaaccacggggaggtggtgtgcgcggtgaccatcagcaaccccacgagacacgtgtacacgggtgggaagggctgcgtcaaggtctgggacatcagccacccaggcaataagagtcctgtctcccagctcgactgtctgaacagggataactacatccgttcctgcagattgctccctgatggtcgcaccctaattgttggaggggaagccagtactttgtccatttgggacctggcggctccaaccccacgcatcaaggcagagctgacatcctcggcccccgcctgctatgccctggccatcagccccgattccaaggtctgcttctcatgctgcagcgacggcaacatcgctgtgtgggatctgcacaaccagaccttggtgaggcaattccagggccacacagatggagccagctgtattgacatttctaatgatggcaccaagctctggacaggtggtttggacaacacggtcaggtcctgggacctgcgcgaggggcggcagctgcagcagcacgacttcacctcccagatcttttctctgggctactgcccaactggagagtggcttgcagtggggatggagaacagcaatgtggaagttttgcatgtcaccaagccagacaaataccaactacatcttcatgagagctgtgtgctgtcgctcaagtttgcccattgtggcaaatggtttgtaagcactggaaaggacaaccttctgaatgcctggagaacaccttatggggccagtatattccagtccaaagaatcctcatcggtgcttagctgtgacatctccgtggacgacaaatacattgtcactggctctggggataagaaggccacagtttatgaagttatttattaaagacaaatcttcatgcagactggacttctcctcctggtagcactttgctctgtcatcctttttgttcacccccatccccgcatctaaaaccaaggatttcagatactcattgcagttgtggagtttaatcccctttcttaacctcacttcccacttgctattgaattgtgaatagtcattaaaaacctgtgataccaaatcttcagctgtctacttggaagaacatggaataagcatacttaacagtgaaaagaatctttaattatgtattatatctgtaatatatttattttgtttaaagaaggctttctaacaatgactgactaaataaagctgtctgctcctgcattgataatgaaggtgcgttgtatttgatacccctccccccctttttttggcaaaggaggggaaaggaaggtttaaaataattgatttaaaatgtcactaagtgtagactgatgactgtatagagatgtgaaatgtataattacacatggaagcaatatgttgctgtgttgttattaggttttttttgtttttgttttctacatcttttaaagacttttggaaatttggctgaacaattagaacacaacaggccaactcatactcatttggatctatttagacaacgttaaccaatatatctatagctttagattatattcgataaaagtaattggactttttttctttttttgactcgttgacaagtgtctttgtaatatgtttttagttccctttttttgttgtattataggcagatgaacaaattaaatttggcctcaaagagagaacttactcccttctggatatttttgccacatttctttgcaaaaggagatatatatatctttagtcagttttgttgttatgagaaattatgggttattttgtggcatgctctttgggagctgcacagttatggggaggactcccactgctgtgcaagttaagtcttttacaaaacaaggacagcagaggagggtttgcagagacctccctctgaaaaacacaaagaatggactctctcctgggatgaggacttgctttctttacctccggttctttccatgtcttagttggatgtccctgaaatggacacaggctgtgccattgtgccagaaacattgtgttatcttttatgttgttgttgttgctgttaaactataatatgtgacttctttttttattattttttgtttgaatgctttaaaaatcttttaagtctgtggatctgctgatgtacagtgcctttgctgctatggatcaaaatcaaaagaaccgtgtagatatactttattgtataagtagaaaattacttaatttcatactagaaatggatggatgctgcaagttgaaatggactgtccattgacgttcctaatgtggtagcagaaaaaaaaaaatggtgtcttaagtgcttagtgtttgatgtcattaacagtttcgtaaaactctacagtgtagaaagattttgatactaaactgtgcgttgtacatagttctaatgcattgtattgaccaccagtacttctataatggtagattgtttgtgaattcagacttttaagcattaaacataaataacttctagta

SEQ ID NO: 2512 - DNA, 2817 bp, Homo sapiens
gttcctgccgcccgtgtcacgcgagacccggcgggggccgggaccgcccgagccgcccctcagaccgagccggccgcctccgctgccgcggccgcctcctcttcggggtcattaaagccaatgagccgcgcgcctctgccgagcgcagccaactaaatcggcttggatgattcgcgacctgagcaagatgtacccgcagaccagacacccagcaccgcatcagcctgctcaaccctttaaatttacaatttccgaatcctgtgatcggattaaggaagagtttcagtttttacaggctcaataccacagtctgaagctggaatgtgagaaactcgccagtgagaagacagagatgcagcggcattatgtcatgtattatgaaatgtcctatgggttgaatatagaaatgcacaagcaggcagagattgtcaagaggctgaatgctatctgtgcacaagtcattcctttcctgtcccaagagcaccagcaacaagtggtgcaggctgtggaacgggccaagcaggtgaccatggcagaactgaacgccatcattgggcagcaacaactccaggcccagcatttatcacatggacatggtctccccgtacctctgactccacacccttcagggctccagccccctgccattccacccatcggtagcagtgccgggcttctggccctctccagtgctctaggaggtcagtcccatcttccaattaaagatgagaagaagcaccatgacaatgatcaccaaagagacagagactccatcaagcaaaactacttgctgctcataatggatgaaattggagaccaaagaggaagaaccttctgggttcctgtcagtctaaatcctgattttaaaagacattcacctgccatgctagtgttgtgtgcttctactgagctcttcagtatccccatcagccagtttccgaggtgctgagaagcacagaaactccgcagactactcctcagagagcaaaaagcagaaaactgaagaaaaggaaattgcagctcgttatgacagcgatggtgagaaaagtgatgacaacttggtggttgacgtttccaatgaggatccatcttcccctcgagggagcccagcacattcccccagagagaatggcctagacaagacacgcctgctcaagaaagatgccccgattagtccagcctctattgcatcttccagcagtactccctcctccaaatccaaagaacttagccttaatgaaaaatctactactcccgtctcaaagtccaatacccctactccacgaactgatgcgcccaccccaggcagtaactctactcccggattgaggcctgtacctggaaaaccaccaggagttgaccctttggcctcaagcctaaggaccccaatggcagtaccttgtccatatccaactccatttgggattgtgccccatgctggaatgaacggagagctgaccagccccggagcggcctacgctgggctccacaacatctcccctcagatgagcgcagctgctgccgccgccgctgctgctgctgcctatgggagatcaccagtggtgggatttgatccacaccatcacatgcgtgtgccagcaatacctccaaacctgacaggcattccaggaggaaaaccagcatactccttccatgttagcgcagatggtcagatgcagcctgtcccttttccacccgacgccctcatcggacctggaatcccccggcatgctcgccagatcaacaccctcaaccacggggaggtggtgtgcgcggtgaccatcagcaaccccacgagacacgtgtacacgggtgggaagggctgcgtcaaggtctgggacatcagccacccaggcaataagagtcctgtctcccagctcgactgtctgaacagggataactacatccgttcctgcagattgctccctgatggtcgcaccctaattgttggaggggaagccagtactttgtccatttgggacctggcggctccaaccccacgcatcaaggcagagctgacatcctcggcccccgcctgctatgccctggccatcagccccgattccaaggtctgcttctcatgctgcagcgacggcaacatcgctgtgtgggatctgcacaaccagaccttggtgaggcaattccagggccacacagatggagccagctgtattgacatttctaatgatggcaccaagctctggacaggtggtttggacaacacggtcaggtcctgggacctgcgcgaggggcggcagctgcagcagcacgacttcacctcccagatcttttctctgggctactgcccaactggagagtggcttgcagtggggatggagaacagcaatgtggaagttttgcatgtcaccaagccagacaaataccaactacatcttcatgagagctgtgtgctgtcgctcaagtttgcccattgtggcaaatggtttgtaagcactggaaaggacaaccttctgaatgcctggagaacaccttatggggccagtatattccagtccaaagaatcctcatcggtgcttagctgtgacatctccgtggacgacaaatacattgtcactggctctggggataagaaggccacagtttatgaagttatttattaaagacaaatcttcatgcagactggacttctcctcctggtagcactttgctctgtcatcctttttgttcacccccatccccgcatctaaaaccaaggatttcagatactcattgcagttgtggagtttaatcccctttcttaacctcacttcccacttgctattgaattgtgaatagtcattaaaaacctgtgatacc

SEQ ID NO: 2513 - DNA, 2793 bp, Homo sapiens
gccgccgcgcgttcctgccgcccgtgtcacgcgagacccggcgggggccgggaccgcccgagccgcccctcagaccgagccggccgcctccgctgccgcggccgcctcctcttcggggtcattaaagccaatgagccgcgcgcctctgccgagcgcagccaactaaatcggcttggatgattcgcgacctgagcaagatgtacccgcagaccagacacccagcaccgcatcagcctgctcaaccctttaaatttacaatttccgaatcctgtgatcggattaaggaagagtttcagtttttacaggctcaataccacagtctgaagctggaatgtgagaaactcgccagtgagaagacagagatgcagcggcattatgtcatgtattatgaaatgtcctatgggttgaatatagaaatgcacaagcaggcagagattgtcaagaggctgaatgctatctgtgcacaagtcattcctttcctgtcccaagagcaccagcaacaagtggtgcaggctgtggaacgggccaagcaggtgaccatggcagaactgaacgccatcattgggcaacaactccaggcccagcatttatcacatggacatggtctccccgtacctctgactccacacccttcagggctccagccccctgccattccacccatcggtagcagtgccgggcttctggccctctccagtgctctaggaggtcagtcccatcttccaattaaagatgagaagaagcaccatgacaatgatcaccaaagagacagagactccatcaagagctcttcagtatccccatcagccagtttccgaggtgctgagaagcacagaaactccgcagactactcctcagagagcaaaaagcagaaaactgaagaaaaggaaattgcagctcgttatgacagcgatggtgagaaaagtgatgacaacttggtggttgacgtttccaatgaggatccatcttcccctcgagggagcccagcacattcccccagagagaatggcctagacaagacacgcctgctcaagaaagatgccccgattagtccagcctctattgcatcttccagcagtactccctcctccaaatccaaagaacttagccttaagagggatatggggaaattgagtgaaacacgtcttagcgaagatgaacaatgcacattggggttacagagatggttttgtcgcctgtggtttatgaatgaaaaatctactactcccgtctcaaagtccaatacccctactccacgaactgatgcgcccaccccaggcagtaactctactcccggattgaggcctgtacctggaaaaccaccaggagttgaccctttggcctcaagcctaaggaccccaatggcagtaccttgtccatatccaactccatttgggattgtgccccatgctggaatgaacggagagctgaccagccccggagcggcctacgctgggctccacaacatctcccctcagatgagcgcagctgctgccgccgccgctgctgctgctgcctatgggagatcaccagtggtgggatttgatccacaccatcacatgcgtgtgccagcaatacctccaaacctgacaggcattccaggaggaaaaccagcatactccttccatgttagcgcagatggtcagatgcagcctgtcccttttccacccgacgccctcatcggacctggaatcccccggcatgctcgccagatcaacaccctcaaccacggggaggtggtgtgcgcggtgaccatcagcaaccccacgagacacgtgtacacgggtgggaagggctgcgtcaaggtctgggacatcagccacccaggcaataagagtcctgtctcccagctcgactgtctgaacagggataactacatccgttcctgcagattgctccctgatggtcgcaccctaattgttggaggggaagccagtactttgtccatttgggacctggcggctccaaccccacgcatcaaggcagagctgacatcctcggcccccgcctgctatgccctggccatcagccccgattccaaggtctgcttctcatgctgcagcgacggcaacatcgctgtgtgggatctgcacaaccagaccttggtgaggcaattccagggccacacagatggagccagctgtattgacatttctaatgatggcaccaagctctggacaggtggtttggacaacacggtcaggtcctgggacctgcgcgaggggcggcagctgcagcagcacgacttcacctcccagatcttttctctgggctactgcccaactggagagtggcttgcagtggggatggagaacagcaatgtggaagttttgcatgtcaccaagccagacaaataccaactacatcttcatgagagctgtgtgctgtcgctcaagtttgcccattgtggcaaatggtttgtaagcactggaaaggacaaccttctgaatgcctggagaacaccttatggggccagtatattccagtccaaagaatcctcatcggtgcttagctgtgacatctccgtggacgacaaatacattgtcactggctctggggataagaaggccacagtttatgaagttatttattaaagacaaatcttcatgcagactggacttctcctcctggtagcactttgctctgtcatcctttttgttcacccccatccccgcatctaaaaccaaggatttcagatactcattgcagttgtggagtttaatcccctttcttaacctcacttcccacttgctattgaattgtgaatagtcattaaaaacctgtgataccaaa

SEQ ID NO: 2514 - DNA, 4542 bp, Homo sapiens
acagagcgtgttgttagagctgtgctgagcgggtgtttgggttgttggctgctttcttccccctttctcacacacttgtatattattttgaggtggtgttcgcagagtttgaaaggagagagaattaaaaaaaaaagccgcaagcgtttcactcttttatttttataatccccttcaatttggggttaaaaaaaagacaagaaaacaggaaggaagagaaataaggaaatgagatgtggtaaaagaagctaaaaggtgccttttaaaagatcgttgctgtgaagtgaaaaaaatctccagagaaaccaaaaagcaccgccgagacctcttccgaaccaaaggagtttgtgtttgcttttagggaagaagaaagatcattcattcggaggaataacaaccaattaaaagacaaataaaaaaagtttggagtgggacgcagagcgagcgagaggagctgccggcgggcggtggggcgcggagcccgcactttcccggccgggtgagcggcggccgcggcgccgggctcggcgggtgcgcctcggcggagcgaacgtcggagcgttgccttgggagacgcgcgccggacaatgcccgcggcgggccagtgacgcccgcggggaatgcggagcggcccggcagccggcacccagccgccgccgcgcgttcctgccgcccgtgtcacgcgagacccggcgggggccgggaccgcccgagccgcccctcagaccgagccggccgcctccgctgccgcggccgcctcctcttcggggtcattaaagccaatgagccgcgcgcctctgccgagcgcagccaactaaatcggcttggatgattcgcgacctgagcaagatgtacccgcagaccagacacccagcaccgcatcagcctgctcaaccctttaaatttacaatttccgaatcctgtgatcggattaaggaagagtttcagtttttacaggctcaataccacagtctgaagctggaatgtgagaaactcgccagtgagaagacagagatgcagcggcattatgtcatgtattatgaaatgtcctatgggttgaatatagaaatgcacaagcaggcagagattgtcaagaggctgaatgctatctgtgcacaagtcattcctttcctgtcccaagagcaccagcaacaagtggtgcaggctgtggaacgggccaagcaggtgaccatggcagaactgaacgccatcattgggcaacaactccaggcccagcatttatcacatggacatggtctccccgtacctctgactccacacccttcagggctccagccccctgccattccacccatcggtagcagtgccgggcttctggccctctccagtgctctaggaggtcagtcccatcttccaattaaagatgagaagaagcaccatgacaatgatcaccaaagagagagagacaaactcaaccacaaaagtttatccccatcagccagtttccgaggtgctgagaagcacagaaactccgcagactactcctcagagagcaaaaagcagaaaactgaagaaaaggaaattgcagctcgttataatgaaaaatctactactcccgtctcaaagtccaatacccctactccacgaactgatgcgcccaccccaggcagtaactctactcccggattgaggcctgtacctggaaaaccaccaggagttgaccctttggcctcaagcctaaggaccccaatggcagtaccttgtccatatccaactccatttgggattgtgccccatgctggaatgaacggagagctgaccagccccggagcggcctacgctgggctccacaacatctcccctcagatgagcgcagctgctgccgccgccgctgctgctgctgcctatgggagatcaccagtggtgggatttgatccacaccatcacatgcgtgtgccagcaatacctccaaacctgacaggcattccaggaggaaaaccagcatactccttccatgttagcgcagatggtcagatgcagcctgtcccttttccacccgacgccctcatcggacctggaatcccccggcatgctcgccagatcaacaccctcaaccacggggaggtggtgtgcgcggtgaccatcagcaaccccacgagacacgtgtacacgggtgggaagggctgcgtcaaggtctgggacatcagccacccaggcaataagagtcctgtctcccagctcgactgtctgaacagggataactacatccgttcctgcagattgctccctgatggtcgcaccctaattgttggaggggaagccagtactttgtccatttgggacctggcggctccaaccccacgcatcaaggcagagctgacatcctcggcccccgcctgctatgccctggccatcagccccgattccaaggtctgcttctcatgctgcagcgacggcaacatcgctgtgtgggatctgcacaaccagaccttggtgaggcaattccagggccacacagatggagccagctgtattgacatttctaatgatggcaccaagctctggacaggtggtttggacaacacggtcaggtcctgggacctgcgcgaggggcggcagctgcagcagcacgacttcacctcccagatcttttctctgggctactgcccaactggagagtggcttgcagtggggatggagaacagcaatgtggaagttttgcatgtcaccaagccagacaaataccaactacatcttcatgagagctgtgtgctgtcgctcaagtttgcccattgtggcaaatggtttgtaagcactggaaaggacaaccttctgaatgcctggagaacaccttatggggccagtatattccagtccaaagaatcctcatcggtgcttagctgtgacatctccgtggacgacaaatacattgtcactggctctggggataagaaggccacagtttatgaagttatttattaaagacaaatcttcatgcagactggacttctcctcctggtagcactttgctctgtcatcctttttgttcacccccatccccgcatctaaaaccaaggatttcagatactcattgcagttgtggagtttaatcccctttcttaacctcacttcccacttgctattgaattgtgaatagtcattaaaaacctgtgataccaaatcttcagctgtctacttggaagaacatggaataagcatacttaacagtgaaaagaatctttaattatgtattatatctgtaatatatttattttgtttaaagaaggctttctaacaatgactgactaaataaagctgtctgctcctgcattgataatgaaggtgcgttgtatttgatacccctccccccctttttttggcaaaggaggggaaaggaaggtttaaaataattgatttaaaatgtcactaagtgtagactgatgactgtatagagatgtgaaatgtataattacacatggaagcaatatgttgctgtgttgttattaggttttttttgtttttgttttctacatcttttaaagacttttggaaatttggctgaacaattagaacacaacaggccaactcatactcatttggatctatttagacaacgttaaccaatatatctatagctttagattatattcgataaaagtaattggactttttttctttttttgactcgttgacaagtgtctttgtaatatgtttttagttccctttttttgttgtattataggcagatgaacaaattaaatttggcctcaaagagagaacttactcccttctggatatttttgccacatttctttgcaaaaggagatatatatatctttagtcagttttgttgttatgagaaattatgggttattttgtggcatgctctttgggagctgcacagttatggggaggactcccactgctgtgcaagttaagtcttttacaaaacaaggacagcagaggagggtttgcagagacctccctctgaaaaacacaaagaatggactctctcctgggatgaggacttgctttctttacctccggttctttccatgtcttagttggatgtccctgaaatggacacaggctgtgccattgtgccagaaacattgtgttatcttttatgttgttgttgttgctgttaaactataatatgtgacttctttttttattattttttgtttgaatgctttaaaaatcttttaagtctgtggatctgctgatgtacagtgcctttgctgctatggatcaaaatcaaaagaaccgtgtagatatactttattgtataagtagaaaattacttaatttcatactagaaatggatggatgctgcaagttgaaatggactgtccattgacgttcctaatgtggtagcagaaaaaaaaaaatggtgtcttaagtgcttagtgtttgatgtcattaacagtttcgtaaaactctacagtgtagaaagattttgatactaaactgtgcgttgtacatagttctaatgcattgtattgaccaccagtacttctataatggtagattgtttgtgaattcagacttttaagcattaaacataaataacttctagta

SEQ ID NO: 2515 - DNA, 3695 bp, Homo sapiens
ggagagctcgccagagcgctcgcatggcgggccggtgattgtagtcaatctggccgtattctcaggcagggtcgcccggggcggactacatctcccgggatgctgcgcggccgccccgcggaagattgtgaatatgtatcagaatgttaatgattagctgctgctaaatttggtcaaagaagtcacctacacagagcgtgttgttagagctgtgctgagcgggtgtttgggttgttggctgctttcttccccctttctcacacacttgtatattattttgaggtggtgttcgcagagtttgaaaggagagagaattaaaaaaaaaagccgcaagcgtttcactcttttatttttataatccccttcaatttggggttaaaaaaaagacaagaaaacaggaaggaagagaaataaggaaatgagatgtggtaaaagaagctaaaaggtgccttttaaaagatcgttgctgtgaagtgaaaaaaatctccagagaaaccaaaaagcaccgccgagacctcttccgaaccaaaggagtttgtgtttgcttttagggaagaagaaagatcattcattcggaggaataacaaccaattaaaagacaaataaaaaaagtttggagtgggacgcagagcgagcgagaggagctgccggcgggcggtggggcgcggagcccgcactttcccggccgggtgagcggcggccgcggcgccgggctcggcgggtgcgcctcggcggagcgaacgtcggagcgttgccttgggagacgcgcgccggacaatgcccgcggcgggccagtgacgcccgcggggaatgcggagcggcccggcagccggcacccagccgccgccgcgcgttcctgccgcccgtgtcacgcgagacccggcgggggccgggaccgcccgagccgcccctcagaccgagccggccgcctccgctgccgcggccgcctcctcttcggggtcattaaagccaatgagccgcgcgcctctgccgagcgcagccaactaaatcggcttggatgattcgcgacctgagcaagatgtacccgcagaccagacacccagcaccgcatcagcctgctcaaccctttaaatttacaatttccgaatcctgtgatcggattaaggaagagtttcagtttttacaggctcaataccacagtctgaagctggaatgtgagaaactcgccagtgagaagacagagatgcagcggcattatgtcatgtattatgaaatgtcctatgggttgaatatagaaatgcacaagcaggcagagattgtcaagaggctgaatgctatctgtgcacaagtcattcctttcctgtcccaagagcaccagcaacaagtggtgcaggctgtggaacgggccaagcaggtgaccatggcagaactgaacgccatcattgggcaacaactccaggcccagcatttatcacatggacatggtctccccgtacctctgactccacacccttcagggctccagccccctgccattccacccatcggtagcagtgccgggcttctggccctctccagtgctctaggaggtcagtcccatcttccaattaaagatgagaagaagcaccatgacaatgatcaccaaagagacagagactccatcaagagctcttcagtatccccatcagccagtttccgaggtgctgagaagcacagaaactccgcagactactcctcagagagcaaaaagcagaaaactgaagaaaaggaaattgcagctcgttatgacagcgatggtgagaaaagtgatgacaacttggtggttgacgtttccaatgaggatccatcttcccctcgagggagcccagcacattcccccagagagaatggcctagacaagacacgcctgctcaagaaagatgccccgattagtccagcctctattgcatcttccagcagtactccctcctccaaatccaaagaacttagccttaatgaaaaatctactactcccgtctcaaagtccaatacccctactccacgaactgatgcgcccaccccaggcagtaactctactcccggattgaggcctgtacctggaaaaccaccaggagttgaccctttggcctcaagcctaaggaccccaatggcagtaccttgtccatatccaactccatttgggattgtgccccatgctggaatgaacggagagctgaccagccccggagcggcctacgctgggctccacaacatctcccctcagatgagcgcagctgctgccgccgccgctgctgctgctgcctatgggagatcaccagtggtgggatttgatccacaccatcacatgcgtgtgccagcaatacctccaaacctgacaggcattccaggaggaaaaccagcatactccttccatgttagcgcagatggtcagatgcagcctgtcccttttccacccgacgccctcatcggacctggaatcccccggcatgctcgccagatcaacaccctcaaccacggggaggtggtgtgcgcggtgaccatcagcaaccccacgagacacgtgtacacgggtgggaagggctgcgtcaaggtctgggacatcagccacccaggcaataagagtcctgtctcccagctcgactgtctgaacagggataactacatccgttcctgcagattgctccctgatggtcgcaccctaattgttggaggggaagccagtactttgtccatttgggacctggcggctccaaccccacgcatcaaggcagagctgacatcctcggcccccgcctgctatgccctggccatcagccccgattccaaggtctgcttctcatgctgcagcgacggcaacatcgctgtgtgggatctgcacaaccagaccttggtgaggcaattccagggccacacagatggagccagctgtattgacatttctaatgatggcaccaagctctggacaggtggtttggacaacacggtcaggtcctgggacctgcgcgaggggcggcagctgcagcagcacgacttcacctcccagatcttttctctgggctactgcccaactggagagtggcttgcagtggggatggagaacagcaatgtggaagttttgcatgtcaccaagccagacaaataccaactacatcttcatgagagctgtgtgctgtcgctcaagtttgcccattgtggcaaatggtttgtaagcactggaaaggacaaccttctgaatgcctggagaacaccttatggggccagtatattccagtccaaagaatcctcatcggtgcttagctgtgacatctccgtggacgacaaatacattgtcactggctctggggataagaaggccacagtttatgaagttatttattaaagacaaatcttcatgcagactggacttctcctcctggtagcactttgctctgtcatcctttttgttcacccccatccccgcatctaaaaccaaggatttcagatactcattgcagttgtggagtttaatcccctttcttaacctcacttcccacttgctattgaattgtgaatagtcattaaaaacctgtgataccaaatcttcagctgtctacttggaagaacatggaataagcatacttaacagtgaaaagaatctttaattatgtattatatctgtaatatatttattttgtttaaagaaggctttctaacaatgactgactaaataaagctgtctgctcctgcattgataa

SEQ ID NO: 2516 - DNA, 1470 bp, Homo sapiens
acagagcgtgttgttagagctgtgctgagcgggtgtttgggttgttggctgctttcttccccctttctcacacacttgtatattattttgaggtggtgttcgcagagtttgaaaggagagagaattaaaaaaaaaagccgcaagcgtttcactcttttatttttataatccccttcaatttggggttaaaaaaaagacaagaaaacaggaaggaagagaaataaggaaatgagatgtggtaaaagaagctaaaaggtgccttttaaaagatcgttgctgtgaagtgaaaaaaatctccagagaaaccaaaaagcaccgccgagacctcttccgaaccaaaggagtttgtgtttgcttttagggaagaagaaagatcattcattcggaggaataacaaccaattaaaagacaaataaaaaaagtttggagtgggacgcagagcgagcgagaggagctgccggcgggcggtggggcgcggagcccgcactttcccggccgggtgagcggcggccgcggcgccgggctcggcgggtgcgcctcggcggagcgaacgtcggagcgttgccttgggagacgcgcgccggacaatgcccgcggcgggccagtgacgcccgcggggaatgcggagcggcccggcagccggcacccagccgccgccgcgcgttcctgccgcccgtgtcacgcgagacccggcgggggccgggaccgcccgagccgcccctcagaccgagccggccgcctccgctgccgcggccgcctcctcttcggggtcattaaagccaatgagccgcgcgcctctgccgagcgcagccaactaaatcggcttggatgattcgcgacctgagcaagatgtacccgcagaccagacacccagcaccgcatcagcctgctcaaccctttaaatttacaatttccgaatcctgtgatcggattaaggaagagtttcagtttttacaggctcaataccacagtctgaagctggaatgtgagaaactcgccagtgagaagacagagatgcagcggcattatgtcatgtattatgaaatgtcctatgggttgaatatagaaatgcacaagcaggcagagattgtcaagaggctgaatgctatctgtgcacaagtcattcctttcctgtcccaagagcaccagcaacaagtggtgcaggctgtggaacgggccaagcaggtgaccatggcagaactgaacgccatcattggggagaaaaagaataaaagtgacacacctggatcattaaagcagcaacaactccaggcccagcatttatcacatggacatggtctccccgtacctctgactccacacccttcagggctccagccccctgccattccacccatcggtagcagtgccgggcttctggccctctccagtgctctaggaggtcagtcccatcttccaattaaagatgagaagaagcaccatgacaatgatcaccaaagaggtgagtaa

SEQ ID NO: 2517 - DNA, 1845 bp, Homo sapiens
gcccgccccctttacgtcgtgctctgaggaggccaggagatttctggcggcgccggcgccattttgctggagcctgcgaccgagtgggagtggagtggagcggctgtggttgccgactctttcctcttccccacggtccagtcagcgggttaattaggccatcggccctcgagccgagacttgtctcttatttagttctggggagcgcctcgtcgacatgagtgatgtggaggaaaacaacttcgagggcagagagtctcgctctcagtcaaaatctccaacgggaactcctgctcgtgtaaaatcggagagcaggtcaggatctcgtagtccatcaagggtttccaaacactctgaatcccattctcgatcaagatcaaaatccaggtcgaggtcaaggagacattctcatagacgttacactcgatccagatcccactctcactctcataggagacgatctcgaagtagatcatatacaccagaataccggcggcgaaggagccgaagccattctccaatgtctaaccggagaagacatactggcagcagggcaaatccagatcccaacacttgccttggagtgtttggcctcagtttgtacacaacagagagggatcttcgtgaagtattttctcgatatggaccattgagtggtgtcaatgtggtttatgatcagcgaactgggcgatctcgaggatttgcttttgtgtattttgagagaatagatgactcaaaggaggctatggaaagggcaaatggaatggagctggatggtagaagaattcgggtggattattctataaccaagagagcgcacacaccaacaccaggcatctacatgggcagaccaactcatagtggtgggggtggtggaggaggcggcggcggtggaggtggaggtggtggcagacgtcgagattcttactatgatagaggatatgatcgtgggtatgacagatatgaagactatgattaccgatacagaagacgatcaccttctccttattatagtcgatatagatcacgatcaagatctcgttcctacagcccaagacgctattgataacggaatggttgcaattaaggacattttttttcctcttttttttttttttttttttaattctgagatttccccaagctgtggattcttcctactccttaagaaaaaaactttggtttatttagcatctacacttttgtcagttgtgttgctgttttccacccattttattatactcttaaaagatgtaattgttgtcattttgaacagttaaacatcttgagtataaaaagaaccccaatgttatgttatgctttgtaaatttttttttttgcttttacctagataaacttctagctaatcaaataaggaaagaaactgtctttttaaagcttcttttgtgttagatactgtattagagatctgcatttatcatgagttcctttttttttttaactttatttttgggaaagtaacacatgaagtagttcagtcatgtcaggtttgtctggggtggaatggaacagtcaggtagttgaaagtttttttttagagatgaaaagcttgtgaactcctgtaaaacatgctgtatttgaaatacatctgttaaaacttaaaaactaaagtgtgattttttttgttgttgttaagtttattgaagtttattcccttaatcagtgaaggacaacccttatttattacctagagcagttgtataattcgctgttagaaattttggtattgggacagtggataagcaggttatcacatagcatagaattcttaaaagatacatgtggggaaaagtagtctcaaataaaagctaatttctttgaaaa

SEQ ID NO: 2518 - DNA, 1824 bp, Homo sapiens
atttctggcggcgccggcgccattttgctggagcctgcgaccgagtgggagtggagtggagcggctgtggttgccgactctttcctcttccccacggtccagtcagcgggttaattaggccatcggccctcgagccgagacttgtctcttatttagttctggggagcgcctcgtcgacatgagtgatgtggaggaaaacaacttcgagggcagatgagcggccgcgtctctgttggaaccggcggcgttgcgtctaaaaaggcgaaagccttgaggttgaaggtgggacgagcctaatgaagtggttaatgttcgtgaagaaattgaagagttttttccaagaatgtggaagataaatcaagataaaagaaggctaatgaaaagtattaaagatcagaaaattaaaattgaatgggggaaaaaattgaacagaagattggtcagatagaagcacttgaatatttttttaaggctattttgaattgtttgaattggggaagaatacacgaagtatgaaaaatgaaaaactcaatgaagaatgaagagaagtagaaagcaagagtgaagtagaattaaaagaatctggaagaatgaatgggtcctaggagtctcgctctcagtcaaaatctccaacgggaactcctgctcgtgtaaaatcggagagcaggtcaggatctcgtagtccatcaagggtttccaaacactctgaatcccattctcgatcaagatcaaaatccaggtcgaggtcaaggagacattctcatagacgttacactcgatccagatcccactctcactctcataggagacgatctcgaagtagatcatatacaccagaataccggcggcgaaggagccgaagccattctccaatgtctaaccggagaagacatactggcagcagggcaaatccagatcccaacacttgccttggagtgtttggcctcagtttgtacacaacagagagggatcttcgtgaagtattttctcgatatggaccattgagtggtgtcaatgtggtttatgatcagcgaactgggcgatctcgaggatttgcttttgtgtattttgagagaatagatgactcaaaggaggctatggaaagggcaaatggaatggagctggatggtagaagaattcgggtggattattctataaccaagagagcgcacacaccaacaccaggcatctacatgggcagaccaactcatagtggtgggggtggtggaggaggcggcggcggtggaggtggaggtggtggcagacgtcgagattcttactatgatagaggatatgatcgtgggtatgacagatatgaagactatgattaccgatacagacgatcaccttctccttattatagtcgatatagatcacgatcaagatctcgttcctacagcccaagacgctattgataacggaatggttgcaattaaggacattttttttcctcttttttttttttttttttttaattctgagatttccccaagctgtggattcttcctactccttaagaaaaaaactttggtttatttagcatctacacttttgtcagttgtgttgctgttttccacccattttattatactcttaaaagatgtaattgttgtcattttgaacagttaaacatcttgagtataaaaagaaccccaatgttatgttatgctttgtaaatttttttttttgcttttacctagataaacttctagctaatcaaataaggaaagaaactgtctttttaaagcttcttttgtgttagatactgtattagagatctgcatttatcatgagttcctttttttttttaactttatttttggg

SEQ ID NO: 2519 - DNA, 1402 bp, Homo sapiens
gctggagcctgcgaccgagtgggagtggagtggagcggctgtggttgccgactctttcctcttccccacggtccagtcagcgggttaattaggccatcggccctcgagccgagacttgtctcttatttagttctggggagcgcctcgtcgacatgagtgatgtggaggaaaacaacttcgagggcagagttaatgttcgtgaagaaattgaagagttttttccaagaatgtggaagataaatcaagataaaagaaggctaatgaaaagtattaaagatcagaaaattaaaattgaatgggggaaaaaattgaacagaagattggtcagatagaagcacttgaatatttttttaaggctattttgaattgtttgaattggggaagaatacacgaagtatgaaaaatgaaaaactcaatgaagaatgaagagaagtagaaagcaagagtgaagtagaattaaaagaatctggaagaatgaatgggtcctaggagtctcgctctcagtcaaaatctccaacgggaactcctgctcgtgtaaaatcggagagcaggtcaggatctcgtagtccatcaagggtttccaaacactctgaatcccattctcgatcaagatcaaaatccaggtcgaggtcaaggagacattctcatagacgttacactcgatccagatcccactctcactctcataggagacgatctcgaagtagatcatatacaccagaataccggcggcgaaggagccgaagccattctccaatgtctaaccggagaagacatactggcagcagggcaaatccagatcccaacacttgccttggagtgtttggcctcagtttgtacacaacagagagggatcttcgtgaagtattttctcgatatggaccattgagtggtgtcaatgtggtttatgatcagcgaactgggcgatctcgaggatttgcttttgtgtattttgagagaatagatgactcaaaggaggctatggaaagggcaaatggaatggagctggatggtagaagaattcgggtggattattctataaccaagagagcgcacacaccaacaccaggcatctacatgggcagaccaactcatagtggtgggggtggtggaggaggcggcggcggtggaggtggaggtggtggcagacgtcgagattcttactatgatagaggatatgatcgtgggtatgacagatatgaagactatgattaccgatacagaagacgatcaccttctccttattatagtcgatatagatcacgatcaagatctcgttcctacagcccaagacgctattgataacggaatggttgcaattaaggacattttttttcctcttttttttttttttttttttaattctgagatttccccaagctgtggattcttcctactcctt

SEQ ID NO: 2520 - DNA, 2959 bp, Homo sapiens
ggcgcgcgggcgagcggttgtgcttgtgcttgtggcgcgtggtgcgggtttcggcggcggctgaggaagaagcgcgggcggcgccttcgggaggcgagcaggcagcagttggccgtgccgtagcagcgtcccgcgcgcggcgggcagcggcccaggaggcgcgtggcggcgctcggcctcgcggcggcggcggcggcagcggcccagcagttggcggcgagcgcgtctgcgcctgcgcggcgggccccgcgcccctcctccccccctgggcgcccccggcggcgtgtgaatggcggcctccgcggcggcagcctcggcagcagcggcctcggccgcctctggcagcccgggcccgggcgagggctccgctggcggcgaaaagcgctccaccgccccttcggccgcagcctcggcctctgcctcagccgcggcgtcgtcgcccgcggggggcggcgccgaggcgctggagctgctggagcactgcggcgtgtgcagagagcgcctgcgacccgagagggagccccgcctgctgccctgtttgcactcggcctgtagtgcctgcttagggcccgcggcccccgccgccgccaacagctcgggggacggcggggcggcgggcgacggcaccgtggtggactgtcccgtgtgcaagcaacagtgcttctccaaagacatcgtggagaattatttcatgcgtgatagtggcagcaaggctgccaccgacgcccaggatgcgaaccagtgctgcactagctgtgaggataatgccccagccaccagctactgtgtggagtgctcggagcctctgtgtgagacctgtgtagaggcgcaccagcgggtgaagtacaccaaggaccatactgtgcgctctactgggccagccaagtctcgggatggtgaacgtactgtctattgcaacgtacacaagcatgaaccccttgtgctgttttgtgagagctgtgatactctcacctgccgagactgccagctcaatgcccacaaggaccaccagtaccagttcttagaggatgcagtgaggaaccagcgcaagctcctggcctcactggtgaagcgccttggggacaaacatgcaacattgcagaagagcaccaaggaggttcgcagctcaatccgccaggtgtctgacgtacagaagcgtgtgcaagtggatgtcaagatggccatcctgcagatcatgaaggagctgaataagcggggccgtgtgctggtcaatgatgcccagaaggtgactgaggggcagcaggagcgcctggagcggcagcactggaccatgaccaagatccagaagcaccaggagcacattctgcgctttgcctcttgggctctggagagtgacaacaacacagcccttttgctttctaagaagttgatctacttccagctgcaccgggccctcaagatgattgtggatcccgtggagccacatggcgagatgaagtttcagtgggacctcaatgcctggaccaagagtgccgaggcctttggcaagattgtggcagagcgtcctggcactaactcaacaggccctgcacccatggcccctccaagagccccagggcccctgagcaagcagggctctggcagcagccagcccatggaggtgcaggaaggctatggctttgggtcaggagatgatccctactcaagtgcagagccccatgtgtcaggtgtgaaacggtcccgctcaggtgagggcgaggtgagcggccttatgcgcaaggtgccacgagtgagccttgaacgcctggacctggacctcacagctgacagccagccacccgtcttcaaggtcttcccaggcagtaccactgaggactacaaccttattgttattgaacgtggcgctgccgctgcagctaccggccagccagggactgcgcctgcaggaacccctggtgccccacccctggctggcatggccattgtcaaggaggaggagacggaggctgccattggagcccctcctactgccactgagggccctgagaccaaacctgtgcttatggctcttgcggagggtcctggtgctgagggtccccgcctggcctcacctagtggcagcaccagctcagggctggaggtggtggctcctgagggtacctcagccccaggtggtggcccgggaaccctggatgacagtgccaccatttgccgtgtctgccagaagccaggcgatctggttatgtgcaaccagtgtgagttttgtttccacctggactgtcacctgccggccctgcaggatgtaccaggggaggagtggagctgctcactctgccatgtgctccctgacctgaaggaggaggatggcagcctcagcctggatggtgcagacagcactggcgtggtggccaagctctcaccagccaaccagcggaaatgtgagcgtgtactgctggccctattctgtcacgaaccctgccgccccctgcatcagctggctaccgactccaccttctccctggaccagcccggtggcaccctggatctgaccctgatccgtgcccgcctccaggagaagttgtcacctccctacagctccccacaggagtttgcccaggatgtgggccgcatgttcaagcaattcaacaagttaactgaggacaaggcagacgtgcagtccatcatcggcctgcagcgcttcttcgagacgcgcatgaacgaggccttcggtgacaccaagttctctgctgtgctggtggagcccccgccgatgagcctgcctggtgctggcctgagttcccaggagctgtctggtggccctggtgatggcccctgaggctggagcccccatggccagcccagcctggctctgttctctgtcctgtcaccccatccccactcccctggtggcctgactcccactccctggtggccccatcccccagttcctcacgatatggtttttacttctgtggatttaataaaaacttcaccagtt

SEQ ID NO: 2521 - DNA, 2713 bp, Homo sapiens
ggcgcgcgggcgagcggttgtgcttgtgcttgtggcgcgtggtgcgggtttcggcggcggctgaggaagaagcgcgggcggcgccttcgggaggcgagcaggcagcagttggccgtgccgtagcagcgtcccgcgcgcggcgggcagcggcccaggaggcgcgtggcggcgctcggcctcgcggcggcggcggcggcagcggcccagcagttggcggcgagcgcgtctgcgcctgcgcggcgggccccgcgcccctcctccccccctgggcgcccccggcggcgtgtgaatggcggcctccgcggcggcagcctcggcagcagcggcctcggccgcctctggcagcccgggcccgggcgagggctccgctggcggcgaaaagcgctccaccgccccttcggccgcagcctcggcctctgcctcagccgcggcgtcgtcgcccgcggggggcggcgccgaggcgctggagctgctggagcactgcggcgtgtgcagagagcgcctgcgacccgagagggagccccgcctgctgccctgtttgcactcggcctgtagtgcctgcttagggcccgcggcccccgccgccgccaacagctcgggggacggcggggcggcgggcgacggcaccgggccagccaagtctcgggatggtgaacgtactgtctattgcaacgtacacaagcatgaaccccttgtgctgttttgtgagagctgtgatactctcacctgccgagactgccagctcaatgcccacaaggaccaccagtaccagttcttagaggatgcagtgaggaaccagcgcaagctcctggcctcactggtgaagcgccttggggacaaacatgcaacattgcagaagagcaccaaggaggttcgcagctcaatccgccaggtgtctgacgtacagaagcgtgtgcaagtggatgtcaagatggccatcctgcagatcatgaaggagctgaataagcggggccgtgtgctggtcaatgatgcccagaaggtgactgaggggcagcaggagcgcctggagcggcagcactggaccatgaccaagatccagaagcaccaggagcacattctgcgctttgcctcttgggctctggagagtgacaacaacacagcccttttgctttctaagaagttgatctacttccagctgcaccgggccctcaagatgattgtggatcccgtggagccacatggcgagatgaagtttcagtgggacctcaatgcctggaccaagagtgccgaggcctttggcaagattgtggcagagcgtcctggcactaactcaacaggccctgcacccatggcccctccaagagccccagggcccctgagcaagcagggctctggcagcagccagcccatggaggtgcaggaaggctatggctttgggtcaggagatgatccctactcaagtgcagagccccatgtgtcaggtgtgaaacggtcccgctcaggtgagggcgaggtgagcggccttatgcgcaaggtgccacgagtgagccttgaacgcctggacctggacctcacagctgacagccagccacccgtcttcaaggtcttcccaggcagtaccactgaggactacaaccttattgttattgaacgtggcgctgccgctgcagctaccggccagccagggactgcgcctgcaggaacccctggtgccccacccctggctggcatggccattgtcaaggaggaggagacggaggctgccattggagcccctcctactgccactgagggccctgagaccaaacctgtgcttatggctcttgcggagggtcctggtgctgagggtccccgcctggcctcacctagtggcagcaccagctcagggctggaggtggtggctcctgagggtacctcagccccaggtggtggcccgggaaccctggatgacagtgccaccatttgccgtgtctgccagaagccaggcgatctggttatgtgcaaccagtgtgagttttgtttccacctggactgtcacctgccggccctgcaggatgtaccaggggaggagtggagctgctcactctgccatgtgctccctgacctgaaggaggaggatggcagcctcagcctggatggtgcagacagcactggcgtggtggccaagctctcaccagccaaccagcggaaatgtgagcgtgtactgctggccctattctgtcacgaaccctgccgccccctgcatcagctggctaccgactccaccttctccctggaccagcccggtggcaccctggatctgaccctgatccgtgcccgcctccaggagaagttgtcacctccctacagctccccacaggagtttgcccaggatgtgggccgcatgttcaagcaattcaacaagttaactgaggacaaggcagacgtgcagtccatcatcggcctgcagcgcttcttcgagacgcgcatgaacgaggccttcggtgacaccaagttctctgctgtgctggtggagcccccgccgatgagcctgcctggtgctggcctgagttcccaggagctgtctggtggccctggtgatggcccctgaggctggagcccccatggccagcccagcctggctctgttctctgtcctgtcaccccatccccactcccctggtggcctgactcccactccctggtggccccatcccccagttcctcacgatatggtttttacttctgtggatttaataaaaacttcaccagtt

SEQ ID NO: 2522 - DNA, 1901 bp, Homo sapiens
ggggagctatgaaccttaagattagaccactaactcgaatctaaatgagctgcccttgtctcctacaaaagaaaagttgggcaggtagggtattctaatgagggtttctctttctcttaagcaaatgatgatcaaagttaactgacaaactgtcacggaatctgccagacctcactctggccttgctgcttctctccagctcctgaacttttctttcttccatcatgctctgagcccattccttgaaaactaaaaggtccctgactcccagtctgcagccatcctgggcctgctgagctctgattcaagtgcctgcctctgccccttggtgggctgaagcttcatggaggtatccaccaacccctcctccaacatcgatccaggcgactatgttgaaatgaatgattcaatcacccacctaccctctaaagtggtgatacaagatattactatggagctacactgccctctgtgcaatgattggttccgagacccactgatgctaagctgtggccacaacttctgtgaagcctgtatccaagacttttggaggctgcaagcaaaggaaacattctgtcctgagtgtaagatgctatgtcagtataacaactgtacattcaaccctgtactggacaagttggtagagaagattaagaagttacccttactcaagggccatccacagtgcccagagcatggagagaacctgaaactgttcagtaaaccagatgggaaactgatctgctttcaatgcaaggatgctcggttgtctgtggggcagtctaaggagttcctgcaaatctctgatgctgtccatttcttcacggaggagcttgccatccaacagggtcaactggagacaactctgaaggagcttcagaccctgaggaacatgcagaaggaagctattgctgctcacaaggaaaacaagctacatctgcagcaacatgtgtccatggagtttctaaagctgcatcagttcctgcacagcaaagaaaaggacattttaactgagctccgggaagaggggaaagccttgaatgaggagatggagttgaatctgagccagcttcaggagcaatgtctcttagccaaggatatgttggtgagcattcaggcaaagacggaacaacagaactccttcgactttctcaaagacatcacaactctcttacatagcttggagcaaggaatgaaggtgctggcaaccagagagcttatttccagaaagctgaacctgggccagtacaaaggtcctatccagtacatggtatggagggaaatgcaggacactctctgcccaggcctgtctccactaactctggaccctaaaacagctcacccaaatctggtgctctccaaaagccaaaccagcgtctggcatggtgacattaagaagataatgcctgatgatcctgagaggtttgactcaagtgtggctgtactgggctcaagaggcttcacctctggaaagtggtactgggaagtagaagtagcaaagaagacaaaatggacagttggagttgtcagagaatccatcattcggaagggcagctgtcctctaactcctgagcaaggattctggcttttaagactaaggaaccaaactgatctaaaggctctggatttgccttctttcagtctgacactgactaacaacctcgacaaggtgggcatatacctggattatgaaggaggacagttgtccttctacaatgctaaaaccatgactcacatttacaccttcagtaacactttcatggagaaactttatccctacttctgcccctgccttaatgatggtggagagaataaagaaccattgcacatcttacatccacagtaatgagtcataatattatacaaattcagagtgttattaaagaggtattgaaatattt

SEQ ID NO: 2523 - DNA, 1222 bp, Homo sapiens
gaacttttctttcttccatcatgctctgagcccattccttgaaaactaaaaggtccctgactcccagtctgcagccatcctgggcctgctgagctctgattcaagtgcctgcctctgccccttggtgggctgaagcttcatggaggaggagcttgccatccaacagggtcaactggagacaactctgaaggagcttcagaccctgaggaacatgcagaaggaagctattgctgctcacaaggaaaacaagctacatctgcagcaacatgtgtccatggagtttctaaagctgcatcagttcctgcacagcaaagaaaaggacattttaactgagctccgggaagaggggaaagccttgaatgaggagatggagttgaatctgagccagcttcaggagcaatgtctcttagccaaggatatgttggtgagcattcaggcaaagacggaacaacagaactccttcgactttctcaaagacatcacaactctcttacatagcttggagcaaggaatgaaggtgctggcaaccagagagcttatttccagaaagctgaacctgggccagtacaaaggtcctatccagtacatggtatggagggaaatgcaggacactctctgcccaggcctgtctccactaactctggaccctaaaacagctcacccaaatctggtgctctccaaaagccaaaccagcgtctggcatggtgacattaagaagataatgcctgatgatcctgagaggtttgactcaagtgtggctgtactgggctcaagaggcttcacctctggaaagtggtactgggaagtagaagtagcaaagaagacaaaatggacagttggagttgtcagagaatccatcattcggaagggcagctgtcctctaactcctgagcaaggattctggcttttaagactaaggaaccaaactgatctaaaggctctggatttgccttctttcagtctgacactgactaacaacctcgacaaggtgggcatatacctggattatgaaggaggacagttgtccttctacaatgctaaaaccatgactcacatttacaccttcagtaacactttcatggagaaactttatccctacttctgcccctgccttaatgatggtggagagaataaagaaccattgcacatcttacatccacagtaatgagtcataatattatacaaattcagagtgttattaaagaggtattgaaatatttta

SEQ ID NO: 2524 - DNA, 5691 bp, Homo sapiens
ctgttttctcctttttgttgttattatcaccaattatctctttatacattgcatatccattaacacacataactattgttttgtgcatttgtcttttatattgaataggggaaaaagaggagttagaaaccaaaaactgcaatattggactttacctatgtagctactttttcactggtctctacttctttatatggcttggagatacttcctagtttcctttcatttcaacatgtaggactccttttagcatttcttctagagcagatctactagcattttttgtagattaagactactagacaactccttcagtttttgtttatctgggaatgtcttaattcctcttttcatgaatatataattctttatttttaaaaaattttaattaaaaaaaagtagaaacagggtcttgccatgttgttcctgggctcaaatgatctgcccaccttggcctcccaaagtgttgggattacaggtgtgagctactgtgcctggctggatacagaactcttagttaacagtttttttctttcggcagttcagatatgtcatctctctccttcttggctttcatattttctgaaaagaaatcagctagtaatcttactgagaatcccttgtatgtgaagagtcatttctctcttgctgctttcaagattccttccttgtcattggacacttcaattataatgtgtctcattgtggatctctttgaatttatcctgcttggagtttgttgagcttcttggatgtaaaatttcatcatattttggaagttttcagccattactttttcaaaaatttttttttttgagacagagtttcactcttgttgcccaagctggggtgcagtggagtgatctcagcttactataacctccacctcccaggtcaagcaattctcctgtctcaacctcccaagtagcagggattaccagtgcctgccgccatgaccagctaattttttgtatttttagtagagacagggtttcaccatgttggccaggctggtctctaactcctgacctcaggtggtccacctgcctcggcaccccaaagtattgggattacaggcttgagccgcagtgcccggctgcttcaaacattctttctgcatttttctcctttctttctgaaattcttattatgtctgtttgatagtgtcttgtggatctcttaggctcagttcattgttggtcattcctttttttttttttttttctgagatggagtgtcattgttgttgcccaggctagagtgcaatggcgtggtcttggcttactgcaacctctgcctcctgggttcaagcaattcttctgcctcagcctcccaagtagctaggattacaggcgcctgccaccacacccagctaatttttgtatttttagtagagatttttagtagagatggctaaccatcctgtgttagccaggatggtctaaatctcctgacctcgtgatctgcccgccttggcctcccaaaatgctgggattacaggcatgagccactgcgcctggcctgaaatgtgtttttttaaaaaggagtgaaggggaccctggatggttgacgatatcacactactgactaaggaatctgattgattttccaattctttgtatataatttctagaaaacaaaaataaaataaaggtaataactagtagagcagaagttgaaaaataaaactttcaaaagacacttggggaaagtgggtaaagagagagatgtacaacaaagtacatttctttgatttagtactgtttcttcctctgccttgattctttattaaagtttaaatagcatcatacgctataatttcagaaaacactcaagttactggttcactttcaaaggagagattatgtgcttttactttagttgtaccaattttcagctcctttaggaatggcgccatcatcctggagtgttaaaatgggcaacaagaaagataaactcattttagctgttcttttctaaaggtatccaccaacccctcctccaacatcgatccaggcgactatgttgaaatgaatgattcaatcacccacctaccctctaaagtggtgatacaagatattactatggagctacactgccctctgtgcaatgattggttccgagacccactgatgctaagctgtggccacaacttctgtgaagcctgtatccaagacttttggaggctgcaagcaaaggaaacattctgtcctgagtgtaagatgctatgtcagtataacaactgtacattcaaccctgtactggacaagttggtagagaagattaagaagttacccttactcaagggccatccacagtgcccagagcatggagagaacctgaaactgttcagtaaaccagatgggaaactgatctgctttcaatgcaaggatgctcggttgtctgtggggcagtctaaggagttcctgcaaatctctgatgctgtccatttcttcacggaggagcttgccatccaacagggtcaactggagacaactctgaaggagcttcagaccctgaggaacatgcagaaggaagctattgctgctcacaaggtgaggagcaagaaagaggggttatgagatagaactggaacacaccctccatgtaacttcagctatgggtacaaaggtgcctaacatatattatctacacactaaatggtacctaggctatggaattggaaaactgagtctgtagggtggaaaggaatatggtggtggagtaggttcctaatagctgatcaacagagcagattaacctttcccctaatatgctgatcttttcgatagttcagtcaccaggtgactgtcgtggcgttgaaatgtgtctggtctttggctttatctatggcaaaaaaaaaaaaggaacttattagaaaaaaatcaatcactaaagattgctatgtccaaagaaatacctttatttcctttgagtttataaccagacacctctggactaggtctctaaggtcataggcttttcccagctgatttgatcttcttagcttcctccaagctaaataaagctattgtctgcactttcaacttcataggcactctaggacaacattaatggctagagctttggcaaatcagtccctagattgggggtgctaaattggaagttctgtttctttattcattattctatggagaagagccttctcaggtatttggcatctggaagaaaaaaatatgcagactcagggaaagaagaaggatatatggaagtaatgatgtcttcagaaaatcttgttccttttgtaaaagttcctattagtgtgagcattcattcattcatttaacaaatatttattgagtgggtcaggcataatactagatattggggatgggagacagctgttaattaaataatcccatgagtaataataaaataacaactgtgataagtactataactgaaagtatagggtatgatgatagcatataaatggagaacataatctagactgggggaggggtgttctctgaagaagtcacattaaaaattgagaattgaaggataagtaacttatccaagtgaactgggtgagtggggatatgaaggaggtagcctggagaagaatgttctaggaatagaaaagagtatctggaaaagtcctgagatggaaagttagctgctatgttaaacagagaaaaggccaataaagctggaacatgctaagcaagatgatattgatgaggtggatatgggctcactgtaacctcatactcttgggctcaagagatcttcccacctcagcctcctgagtatctgggactagtttgccacacatggctaattattttatttttggagagactgggtctcactatgttgcccagtcttgaactcctgttccaagcaatcctcccagcttggcctctataagtgttggaattacaggtatgagccactgtgcccagccaagactatcttaaggtgcaataataattatggaccatgggatccaagctagataagagaggacatgaaggtagaagttcctgaatagaaatggagggatcggtgaataggaggtttcaatgagatccaataattgttgcaataggagtatctgagtgagcctggtgcataaaaagttattttggagatgatacaattgctgggggtgataaaatcctaggtgagactataggaatgaatcaataaatgtggaaatcactagaaatgaggagaatgaggaactgagaagccaggatgtcaaatagtttaactgtgaggatgttgaggtaacccaaggaaaaagctgcaagtgtaacagtggcattcccccagttctgatttctaggtaaggacagttcttccagcctcccaatacccccagtctaacagtaccacttggcagcttttggattaccaatctaggagggtattatctttcattctagaatgtttgactaactccacagtcttatttaatatggcattggttaccatctcagtactgcaataggaaactggaggtcacttttgcctatttcatcctgaactattaaattagttggaaaaggagtaagtctcccaaaggactcattttagtatgactgaatttgatattcagtagccatttgtatgcatttttctgtgatggtatttaccaagtgtgtgagtgttggtggtgtgggcccccatccccaagcactagtctctgcaataaccatggtgataatcatggaggtttccaggaaaacaagctacatctgcagcaacatgtgtccatggagtttctaaagctgcatcagttcctgcacagcaaagaaaaggacattttaactgagctccgggaagaggggaaagccttgaatgaggagatggagttgaatctgagccagcttcaggagcaatgtctcttagccaaggatatgttggtgagcattcaggcaaagacggaacaacagaactccttcgactttctcaaagacatcacaactctcttacatagcttggagcaaggaatgaaggtgctggcaaccagagagcttatttccagaaagctgaacctgggccagtacaaaggtcctatccagtacatggtatggagggaaatgcaggacactctctgcccaggcctgtctccactaactctggaccctaaaacagctcacccaaatctggtgctctccaaaagccaaaccagcgtctggcatggtgacattaagaagataatgcctgatgatcctgagaggtttgactcaagtgtggctgtactgggctcaagaggcttcacctctggaaagtggtactgggaagtagaagtagcaaagaagacaaaatggacagttggagttgtcagagaatccatcattcggaagggcagctgtcctctaactcctgagcaaggattctggcttttaagactaaggaaccaaactgatctaaaggctctggatttgccttctttcagtctgacactgactaacaacctcgacaaggtgggcatatacctggattatgaaggaggacagttgtccttctacaatgctaaaaccatgactcacatttacaccttcagtaacactttcatggagaaactttatccctacttctgcccctgccttaatgatggtggagagaataaagaaccattgcacatcttacatccacagtaatgagtcataatattatacaaattcagagtgttattaaagaggtattgaaatattt

SEQ ID NO: 2525 - DNA, 1211 bp, Homo sapiens
acctcactctggccttgctgcttctctccagctcctgaacttttctttcttccatcatgctctgagcccattccttgaaaactaaaaggtccctgactcccagtctgcagccatcctgggcctgctgagctctgattcaagtgcctgcctctgccccttggtgggctgaagcttcatggaggaggagcttgccatccaacagggtcaactggagacaactctgaaggagcttcagaccctgaggaacatgcagaaggaagctattgctgctcacaaggtttccaggaaaacaagctacatctgcagcaacatgtgtccatggagtttctaaagctgcatcagttcctgcacagcaaagaaaaggacattttaactgagctccgggaagaggggaaagccttgaatgaggagatggagttgaatctgagccagcttcaggagcaatgtctcttagccaaggatatgttggacatcacaactctcttacatagcttggagcaaggaatgaaggtgctggcaaccagagagcttatttccagaaagctgaacctgggccagtacaaaggtcctatccagtacatggtatggagggaaatgcaggacactctctgcccaggcctgtctccactaactctggaccctaaaacagctcacccaaatctggtgctctccaaaagccaaaccagcgtctggcatggtgacattaagaagataatgcctgatgatcctgagaggtttgactcaagtgtggctgtactgggctcaagaggcttcacctctggaaagtggtactgggaagtagaagtagcaaagaagacaaaatggacagttggagttgtcagagaatccatcattcggaagggcagctgtcctctaactcctgagcaaggattctggcttttaagactaaggaaccaaactgatctaaaggctctggatttgccttctttcagtctgacactgactaacaacctcgacaaggtgggcatatacctggattatgaaggaggacagttgtccttctacaatgctaaaaccatgactcacatttacaccttcagtaacactttcatggagaaactttatccctacttctgcccctgccttaatgatggtggagagaataaagaaccattgcacatcttacatccacagtaatgagtcataatattatacaaattcagagtgttattaaagaggtattgaaatat

SEQ ID NO: 2526 - DNA, 2486 bp, Homo sapiens
agtgttttagcctatccagttccgggagtttgcacgcagacgctctgcttcgtgaccttggctctgctctgtgggcgccgcccccagcctgggcgcgtccatcgtcgagtaccttctcctctgcctccccctccctctgcttctatctctctccaattgccctccctggcctgcggccgcccggtcctccttcccagcccagtgcagccaggcacccgggttcggcttgctcaggtctctgtccgggactgggaagccacggagggccgggaaagtggcacactcctggagctcaagcttcctactctctcatcgctgaataactaccgggcaggactgggtggaacagacagcatatttaggtcattgatgggctgctgggtggatggagctggaaagtgatgggcactgctttctggggctgcccaggttccttccgagggctcgcttttcctgggcagagcgggaaagaggaggggcaggccggtcgcgaaacgcaaatagtcgagaatagcgatccggggagaagcaggtgtctgtggggcccaagagaagtaccatctcgagcatccttagtccagaaatggggagctatgaaccttaagattagaccactaactcgaatctaaatgagctgcccttgtctcctacaaaagaaaagttgggcaggtagggtattctaatgagggtttctctttctcttaagcaaatgatgatcaaagttaactgacaaactgtcacggaatctgccagacctcactctggccttgctgcttctctccagctcctgaacttttctttcttccatcatgctctgagcccattccttgaaaactaaaaggtccctgactcccagtctgcagccatcctgggcctgctgagctctgattcaagtgcctgcctctgccccttggtgggctgaagcttcatggaggtatccaccaacccctcctccaacatcgatccaggcgactatgttgaaatgaatgattcaatcacccacctaccctctaaagtggtgatacaagatattactatggagctacactgccctctgtgcaatgattggttccgagacccactgatgctaagctgtggccacaacttctgtgaagcctgtatccaagacttttggaggctgcaagcaaaggaaacattctgtcctgagtgtaagatgctatgtcagtataacaactgtacattcaaccctgtactggacaagttggtagagaagattaagaagttacccttactcaagggccatccacagtgcccagagcatggagagaacctgaaactgttcagtaaaccagatgggaaactgatctgctttcaatgcaaggatgctcggttgtctgtggggcagtctaaggagttcctgcaaatctctgatgctgtccatttcttcacggaggagcttgccatccaacagggtcaactggagacaactctgaaggagcttcagaccctgaggaacatgcagaaggaagctattgctgctcacaaggaaaacaagctacatctgcagcaacatgtgtccatggagtttctaaagctgcatcagttcctgcacagcaaagaaaaggacattttaactgagctccgggaagaggggaaagccttgaatgaggagatggagttgaatctgagccagcttcaggagcaatgtctcttagccaaggatatgttggtgagcattcaggcaaagacggaacaacagaactccttcgactttctcaaagacatcacaactctcttacatagcttggagcaaggaatgaaggtgctggcaaccagagagcttatttccagaaagctgaacctgggccagtacaaaggtcctatccagtacatggtatggagggaaatgcaggacactctctgcccaggcctgtctccactaactctggaccctaaaacagctcacccaaatctggtgctctccaaaagccaaaccagcgtctggcatggtgacattaagaagataatgcctgatgatcctgagaggtttgactcaagtgtggctgtactgggctcaagaggcttcacctctggaaagtggtactgggaagtagaagtagcaaagaagacaaaatggacagttggagttgtcagagaatccatcattcggaagggcagctgtcctctaactcctgagcaaggattctggcttttaagactaaggaaccaaactgatctaaaggctctggatttgccttctttcagtctgacactgactaacaacctcgacaaggtgggcatatacctggattatgaaggaggacagttgtccttctacaatgctaaaaccatgactcacatttacaccttcagtaacactttcatggagaaactttatccctacttctgcccctgccttaatgatggtggagagaataaagaaccattgcacatcttacatccacagtaatgagtcataatattatacaaattcagagtgttattaaagaggtattgaaatattt

SEQ ID NO: 2527 - DNA, 1262 bp, Homo sapiens
acctcactctggccttgctgcttctctccagctcctgaacttttctttcttccatcatgctctgagcccattccttgaaaactaaaaggtccctgactcccagtctgcagccatcctgggcctgctgagctctgattcaagtgcctgcctctgccccttggtgggctgaagcttcatggaggaggagcttgccatccaacagggtcaactggagacaactctgaaggagcttcagaccctgaggaacatgcagaaggaagctattgctgctcacaaggtttccaggaaaacaagctacatctgcagcaacatgtgtccatggagtttctaaagctgcatcagttcctgcacagcaaagaaaaggacattttaactgagctccgggaagaggggaaagccttgaatgaggagatggagttgaatctgagccagcttcaggagcaatgtctcttagccaaggatatgttggtgagcattcaggcaaagacggaacaacagaactccttcgactttctcaaagacatcacaactctcttacatagcttggagcaaggaatgaaggtgctggcaaccagagagcttatttccagaaagctgaacctgggccagtacaaaggtcctatccagtacatggtatggagggaaatgcaggacactctctgcccaggcctgtctccactaactctggaccctaaaacagctcacccaaatctggtgctctccaaaagccaaaccagcgtctggcatggtgacattaagaagataatgcctgatgatcctgagaggtttgactcaagtgtggctgtactgggctcaagaggcttcacctctggaaagtggtactgggaagtagaagtagcaaagaagacaaaatggacagttggagttgtcagagaatccatcattcggaagggcagctgtcctctaactcctgagcaaggattctggcttttaagactaaggaaccaaactgatctaaaggctctggatttgccttctttcagtctgacactgactaacaacctcgacaaggtgggcatatacctggattatgaaggaggacagttgtccttctacaatgctaaaaccatgactcacatttacaccttcagtaacactttcatggagaaactttatccctacttctgcccctgccttaatgatggtggagagaataaagaaccattgcacatcttacatccacagtaatgagtcataatattatacaaattcagagtgttattaaagaggtattgaaatat

SEQ ID NO: 2528 - DNA, 2327 bp, Homo sapiens
cgtgcaacacgtgggggcggtgccggtcggagggctcctagtgcgccaggttgtgggaagtgaggctggcggtggcgacaaccgaggaggaggggcgggacgccgtggagcacggcgaccggctgagcgtcatggagggctcaggggagcagccgggcccacaaccacagcatcccggagaccaccgcatccgcgacggcgacttcgtggtgctgaaacgtgaagatgtgtttaaagcagtacaagtccagcggagaaaaaaagtaactttcgaaaaacagtggttctacctggataacgtcattggccatagttatggaactgcatttgaagtgaccagtggaggaagtctacagcccaagaagaagagggaagagcctactgcagagactaaagaagcgggcactgataatcgaaatatagttgatgatgggaaatctcagaaacttactcaagatgacataaaagctttgaaggacaagggcattaaaggagaggaaatagttcagcagttaattgaaaatagtacaacattccgagacaagacagaatttgcccaagataaatatattaaaaagaagaaaaaaaaatatgaagccatcattactgttgtgaagccatccacccgtattctttcaattatgtattatgcaagagaacctggaaaaattaaccacatgagatacgatacactagcccagatgttgacgttgggaaatatccgtgctggcaacaaaatgattgtgatggaaacgtgtgcaggcttggtgctgggtgcaatgatggaacgaatgggaggttttggctccattattcagctataccctggaggaggacctgttcgggcagcaacagcatgttttggatttcccaaatcttttctcagtggtctttatgaattccctctcaacaaagtggacagtcttctacatggaacattttctgccaagatgttatcttcagagccaaaagacagtgctttggttgaagaaagtaatggcacactggaggaaaaacaggcttctgaacaagagaatgaagacagcatggcagaggccccagagagcaaccacccagaagaccaggaaacaatggaaacaatttctcaagatccagaacataaggggcctaaagagagaggaagcaaaaaagattatattcaggaaaaacagaggagacaagaagagcagaggaaaagacatttagaggctgccgctctgctgagtgaaagaaacgcagatggtttaattgtagctagtcgtttccaccccactcccctgctgctgtctttgctggactttgtggccccttcaaggccgtttgtggtctactgtcagtacaaagagcctctgttggaatgctacacaaaactgcgggagaggggaggggtcatcaacctcaggctgtctgaaacctggctcagaaattatcaggttttgccagatcgaagtcatcctaaactgctgatgagtggaggtgggggttatcttctctccggcttcaccgttgccatggacaaccttaaagcagacaccagcctcaaatctaatgcaagcactttagaatcacacgagactgaggagcctgcagctaaaaaacgaaaatgcccagagtctgactcttaacccttttgagaattgctctgaattttgttctcaggcattatacagttagtaattaaactttaaatgccattactacttgttttttcatatcccaagaataagaacatgtctatgtacccgtttctaggaaggaggagtatatgccttttgtctatttctgacacagatgcatttggtctgtcaaaactgcaaccatggggtatgtagtatgaccaactgcatttaacaaaactcctctaagtacttctaaatattctgtgcaaatatcttgagaacttcaacatcctaaaaatgtgtttctacaagactttatattttaagctaagtggaataatacaacgtaactaaaacatggcgggtaccgaaaggagggcaattcatggaagaaatttcctctgttcattccgttctcttcaacctaagcaatatggatgtgtgagtgtgtgatttattatggtaccaaaaatgtccaccttctttcctgcagcggaataagcttttttgaaatgctgaggttttattttaatagttgacaacctgggaaagttctgagtatttattttactgctcttttttgtgcatagaaaggtttagtagggtacttttttgcattaatttgccaatactcttattctttgttctaaataaagtgactagaatttttgtgtactattcaattaaaggaaacaaatgtcttttccc

SEQ ID NO: 2529 - DNA, 1474 bp, Homo sapiens
atggagggctcaggggagcagccgggcccacaaccacagcatcccggagaccaccgcatccgcgacggcgacttcgtggtgctgaaacgtgaagatgtgtttaaagcagtacaagtccagcggagaaaaaaagtaactttcgaaaaacagtggttctacctggataacgtcattggccatagttatggaactgcatttgaagtgaccagtggaggaagtctacagcccaagaagaagagggaagagcctactgcaggaaatagttcagcagttaattgaaaatagtacaacattccgagacaagacagaatttgcccaagataaatatattaaaaagaagaaaaaaaaatatgaagccatcattactgttgtgaagccatccacccgtattctttcaattatgtattatgcaagagaacctggaaaaattaaccacatgagatacgatacactagcccagatgttgacgttgggaaatatccgtgctggcaacaaaatgattgtgatggaaacgtgtgcaggcttggtgctgggtgcaatgatggaacgaatgggaggttttggctccattattcagctataccctggaggaggacctgttcgggcagcaacagcatgttttggatttcccaaatcttttctcagtggtctttatgaattccctctcaacaaagtggacagtcttctacatggaacattttctgccaagatgttatcttcagagccaaaagacagtgctttggttgaagaaagtaatggcacactggaggaaaaacaggcttctgaacaagagaatgaagacagcatggcagaggccccagagagcaaccacccagaagaccaggaaacaatggaaacaatttctcaagatccagaacataaggggcctaaagagagaggaagcaaaaaagattatattcaggaaaaacagaggagacaagaagagcagaggaaaagacatttagaggctgccgctctgctgagtgaaagaaacgcagatggtttaattgtagctagtcgtttccaccccactcccctgctgctgtctttgctggactttgtggccccttcaaggccgtttgtggtctactgtcagtacaaagagcctctgttggaatgctacacaaaactgcgggagaggggaggggtcatcaacctcaggctgtctgaaacctggctcagaaattatcaggttttgccagatcgaagtcatcctaaactgctgatgagtggaggtgggggttatcttctctccggcttcaccgttgccatggacaaccttaaagcagacaccagcctcaaatctaatgcaagcactttagaatcacacgagactgaggagcctgcagctaaaaaacgaaaatgcccagagtctgactcttaacccttttgagaattgctctgaattttgttctcaggcattatacagttagtaattaaactttaaatgccattactacttgttttttcatat

SEQ ID NO: 2530 - DNA, 1043 bp, Homo sapiens
gccgcgcgtcgcggaggcacgtgtggagccccggcagcaggagcgtcgcaggtccttggcccttgccagacattagcaccatgagcttcgtggcatacgaggagctgatcaaggagggtgacacggccatcctgtcactgggccatggtgcaatggtggcggtgcgtgtgcagcgtggggcacagacccagacccggcatggtgtcctgcggcactcagttgaccttatcggccgccccttcggctccaaggtgacgtgcggccgaggtggctgggtgtatgtgctgcaccccacgcccgagctctggacgctgaacctgccgcaccgcacgcagatcctctactccacagacatcgccctcatcaccatgatgttggagcttcggcccggctctgtggtctgtgagtctggcaccggcagtggctctgtgtcccacgccatcatccgcaccattgcacccacgggtcacctgcacacggtggagttccaccagcagcgggcagagaaggcccgggaggagttccaggagcaccgtgtgggccgctgggtgactgtgcgcacccaggacgtgtgccgcagtggctttggcgtgagccacgtggccgacgccgtcttcctggacatcccatcaccctgggaggccgtgggccacgcctgggacgccctcaaggtcgaaggcgggcgcttctgctccttctcaccgtgcatcgagcaggtgcaacgcacatgccaggcgctggcagcgcgcggcttctcagagctgagcaccctggaggtgctgccacaggtctacaacgtgcgcactgtcagcctgccaccgcccgacctgggcacaggcacagatggccctgccggctccgacaccagccccttccgcagcggcacgcccatgaaggaggccgtgggccacaccggctacctgaccttggccagaagctggggtgagctgacccagaatccctgccctgctctccccagcgctaggagaccaggccagcccaggaaccagggaggtgaccctgctctctggcctcctggctga

SEQ ID NO: 2531 - DNA, 3229 bp, Homo sapiens
ggagccggaagtgttgtggccgccgccgccgcgcgtcgcggaggcacgtgtggagccccggcagcaggagcgtcgcaggtccttggcccttgccagacattagcaccatgagcttcgtggcatacgaggagctgatcaaggagggtgacacggccatcctgtcactgggccatggtgcaatggtggcggtgcgtgtgcagcgtggggcacagacccagacccggcatggtgtcctgcggcactcagttgaccttatcggccgccccttcggctccaaggtgacgtgcggccgaggtggctgggtgtatgtgctgcaccccacgcccgagctctggacgctgaacctgccgcaccgcacgcagatcctctactccacagacatcgccctcatcaccatgatgttggagcttcggcccggctctgtggtctgtgagtctggcaccggcagtggctctgtgtcccacgccatcatccgcaccattgcacccacgggtcacctgcacacggtggagttccaccagcagcgggcagagaaggcccgggaggagttccaggagcaccgtgtgggccgctgggtgactgtgcgcacccaggacgtgtgccgcagtggctttggcgtgagccacgtggccgacgccgtcttcctggacatcccatcaccctgggaggccgtgggccacgcctgggacgccctcaaggtcgaaggcgggcgcttctgctccttctcaccgtgcatcgagcaggtgcaacgcacatgccaggcgctggcagcgcgcggcttctcagagctgagcaccctggaggtgctgccacaggtctacaacgtgcgcactgtcagcctgccaccgcccgacctgggcacaggcacagatggccctgccggctccgacaccagccccttccgcagcggcacgcccatgaaggaggccgtgggccacaccggctacctgaccttcgccaccaagaccccaggctagggggccgcctcccagggcaccagggagctgggagcactgaagggctgggcagggaggccagaggcaccttatatggtcagcgatgcctgccagacacagacggtggggtggggcttgggggcctcctgggtggccagagtgggacagcaggaagggcggctgtgatggaggagcagtgctggggctgggcctcagccattcctgtccagccctgtggcccatcccagctgctgtttgttgccaatatgaagtatccactgccacaggctcccctgggtgttgaagccaaagggtgcaggtgggggagtctgaccccctcccaggtgggcctaagcaggaagggggtggaggagggaggggggcattgaccctgagaccacgctgcgtctgacccctgggcccccacggccctggctgccccacggggcctgagaccatctcgtgcttctccagtccccgggccgaggctccagccttggccagaagctggggtgagctgacccagaatccctgccctgctctccccagcgctaggagaccaggccagcccaggaaccagggaggtgaccctgctctctggcctcctggctgatgtcacagcactgagctcagcccaggccttcgtccactcatgtccaagaggcggggcatcccccacccagccagagcccctgacatgggctgcactcgctgaggccaggcagcgctgcggagaggagcggcagagtgggttgtctgccgcaggcaaccaggcaagtgtgtcggggctggggtgtgaatgccagcctgtgagtcccggaactatgtgggtacccctacccctcacagaagccaagggcatggaggaggtccctccacagtgacaacggtgtggggtaggggaggtgcattcaggacaccacccagggacagtgcctatgtgatcacctcttaaaggctaagcttaggggcatttcccaaagtggggacagagggcaggacgcccaggctgggggctctcctcgcccgccctggtgtctgacagcctcaaggaaggagcagtgcctgtgtcagccatggggcccttggagctgccgctggtgcctagggggcctgggtttctgcccaggcagccagtggctgttgggagcctctgtttcccctgtgctgggggccttgagtgctatgctagcaggggcctggccccaagtgtgagtgatgagcaataaacgtaccgtccccctctgttctgagtgatccctagcagccaaggccacccccagctgctgtctaggccagccctacctgcgctctgcccctggtccctgctcctccctgtcctggtttggcatgataggcgctccagtctccaggacaaaggggcaaatgtgtggccacccccatctggctgcagaaaaggccactccttcctggggttggggtggtccaggagtgctgggccttcttccacagtcctgggctggaattcagtgtggctgcctgggttacttgtatgcgcccctgaaggaagggtccactccaggccgcctggtccctgcgaagtgtcacactgtgggtcaccgggggctgtggctaatgtggtccgggaggcctgtgtccctgagagttgctcagccctgctccgagggcttgtcctctccttccaggacccagcttcccttctaaccttgttactcacctggggcacagaggaggggcccccagtcaggttcaacatggaagtgggtgaccctaatgccaggagctttggggtcaggctgtccctggggtgtcatgaactgggtgacgcacacccctgagatctcagttcccccaagcctgccctgcccctcctggccacagcaaaggcctgcatggtgtctgatgggtggacaccgggaggtgtttctttgaggcgcagctccatggtttataggacacataggcctcaggcaccgtagggtccaggttgtgcccattttccagccggggctggttgccctggtggcagccctgggtgagtcaccagggtccgcacatggagagcgggaggtcccagcccacccttagttgtcacatgggacagagttgctgtgtcaatcccctcggccctgctgctctgccctgcacacaggcccccatgatgaccttgagcctccaggcatccacccccaccgtatggccctctagacccagctgggcctcaccccactccctcagcttggatcctcacgtggcctggagccagcattaaactcctgtatgtccttcaa

SEQ ID NO: 2532 - DNA, 4111 bp, Homo sapiens
ggaggggtggtgctagacgtttcgggcagagctcggccgctgcggaggacaaggaactctccctctcccactagtctgacttcttccaaaatgagcggcctggatgggggcaacaagctccctctcgcccaaaccggcggcctggctgctcccgaccatgcctcaggagatccggaccgagaccagtgccaagggctccgtgaagaaaccgaggcgacacaggtgatggcgaacacaggtgggggcagcctggagaccgttgcggaggggggtgcatcccaggatcctgtcgactgtggccccgcgctccgcgtcccagttgccgggagtcgcggcggtgcagcgaccaaagccgggcaggaggatgctccaccttctacgaaaggtctggaagcagcctctgccgccgaggctgctgacagcagccagaaaaatggctgtcagcttggagagccccgtggccctgctgggcagaaggctctagaagcctgtggcgcagggggcttggggtctcagatgataccggggaagaaggccaaggaagtgacgactaaaaaacgcgccatctcggcagcagtggaaaaggagggagaagcaggggcggcgatggaggaaaagaaggtagtgcagaaggaaaaaaaggtggcaggaggggtgaaagaggagacacggcccagggccccgaagatcaataactgcatggactcactggaggccatcgatcaagagttgtcaaacgtaaatgcccaggctgacagggccttccttcagcttgagcgcaagtttggccgcatgcgaaggctccacatgcagcgcagaagtttcattatccagaatatcccaggtttctgggttactgcctttcgaaaccacccccagctgtcacctatgatcagtggccaagatgaagacatgctgaggtacatgatcaatttggaggtggaggagcttaaacaccccagagcaggctgcaaattcaagttcatctttcagggcaacccctacttccgaaatgaggggcttgtcaaggaatatgaacgcagatcctctggccgggtggtgtctctttccactccaatccgctggcaccgaggccaagacccccaggctcatatccacagaaaccgggaagggaacactatccctagtttcttcaactggttttcagaccacagccttctagaattcgacagaattgcagagattatcaaaggagaactgtggcccaatcccctacaatactacctgatgggtgaagggccccgtagaggaattcgaggcccaccaaggcagccagtggagagcgccagatccttcaggttccagtctggctaatctctgtcctgtgagaagcttctgcacaagtttccttaccacctcctcttggacctatgcttggccaacagcatgcagtcttccatctgctttctcttcatactgtggattatcttttcctttggttctaaatcttcagtaatcggttgcaagattgttggcttacctgcctgtgccattcttcctctgggccttcatgcttttctgcattgtgttaacatgtttcaagtgcatggccttctacggcttctatgccaagcgtatgatactatagatatagtgtaccatactgcctttctttgcatggcttggaccctatctgtgaccatgctcttctcccaatttaagtggttctgtaccacaaagaatcttgatacattttcacaaataactgattgggcttcatactttatgctggctgtgtcctgatacccatgtacttatggtaagctatttgggtattaccactgcaagacaaaactgatatcttaacccggccatcaacccaaattggacattccagactaccaccaactggatcccagctgccttcctgggcttgtgccatccaccctactggttatctgatagaacaagctggtggctgatgggtgactgctaggcgtgactgaggtaatagatgaaaagtgttctatgttatcacattggttttcctgtacctttggttactctacgtcatgaccagctgctggtgagtatgaagcctgtgctatagcccacccctactcactctcaccttctggttgaactttgcttaggccaccattgtctgcctcatcaggaactatctgtagacgtagctcccagggagctcacagcaacaccccctaccaccaggatgggcagtaatatgtgacagagcccaaagcaaggctggaacgcagtcccttccagcttagtctttctgactcctagccaacaaaccatccttaatgtgagcaacttctttaggcatttcctcttttccccgcctgcacccactctgaacatgacaaaagttgccagagttggggcattgaggaagagatatttctggaatgtgagacttgttatgcctctgtctctttctctccctcctcctcccctctccctccccctctccctcccatcccttttcttccctttcactctgaagcagttttagcttattaacagaaaacaaaactggcaaagcaggctttttgtttaatttgctctttccctgattgtgttcagagagaaaggttatgattaaatgggctccagatctcttattgcccttattcctccaccccacttcttttagcaaggtctgaaagtttcaaagggagacctataggttaattgtttagttataggcagtgttaaattaggcagattttgacatatttatctttttaccccatccattctaccaaaacctgtgtatttcttgagtttttagtttgagaagctggaaagagagagaagggcctcacagtgatgggttcaggacgggtcaaaggcaaaggcctttgtgatgtgagcaaaggcaaccaaaacttagcctcactccacttttctaaagatggaaattcttttttgggccttggactgcttctagggtagcattttgtaggtcactcttctcctttgtactattttgtttctgccctgatgtcccttgggtctccatcctactgcctggctttcttggccctcatttctcagcttctgcatttccttccctgctcctaacaaatgaagaagcaggctgcagcctgcattgtggaagatctccagcctccttgtaggggataaggggatgtgcagcatctgtgtggattttcacggacaagttccagtaggtgggacagtgatgccgtcaaggcttagttatgatcatgtgtggtgataaagaccatccaccatcacccttttcccctttggttttgaaggccttgccctaagctacctgagggtttaggaggtctgaacacacacagtggagaggttaatctaggttgggaaactgagtaaaagtccagagcaggaatgagcctgctgtggcgtgggtttggaaaggctcacaggaaagaacctgcaggatcaggggtgggaggggaggcccctgaggtgctctccagggaagaggggctggggtttaaatagcatgcttggaggaagattttccttcaatttttcctaagtccttgaattcaccagtagatttttgtaaacaaaatgtaagtcgatgttttctctcaattatcctaggagtgacctttatatgtgtggaagattaatggtatatgctccttatgtcactgtttttgagtaaaatccatttcctttctctgtttcagcctatgacaaaattgatgtttacaggcctgctttttgcttataattgacaacatgtgcaaaaataccaaatttgtgtcctgtgcagtatgaagaattcagtgaatattcattaatgtattagcttgttttgctctctgttcatatatggctctattcttagaaatataatttgaatgtgatctttcaatagtctgaatattttacaaattatagctatgtcttgtgaaaataacctcaaaaagaaaaatacgactctgttgtcttacttgatatttcttgccctagtaatgtacttgacatttatgttcctaagcagtgtaagtaccagtagaatttctctgtcaaactcaatgatcatttagtacttttgtcttctcccatgtgcttgaaggaaaaataaagtgtcactaccgtatttcttgttttcatc

SEQ ID NO: 2533 - DNA, 4460 bp, Homo sapiens
gacgtcggcggttgccgtggagagacccgctcggtcccgaccgagagctggcgtcaggagccgcagggtcacagcgtgtctttgaagctgcctccgccgccaccatgagcggccgaagtcggggtcgaaagtcctcccgcgccaaaaaccggggcaaaggccgcgccaaagcccgagtccgccctgctccggacgacgccccgcgcgacccggacccttcacagtaccagagtctcggggaagacacccaggcggcacaggtgcaggctggcgcggggtggggtggcctggaagccgctgcgtccgcgcagctcctccggctcggggaggaggccgcctgccggctccccctggactgtggcctcgcgctgcgggcccgagctgcgggggaccacgggcaggccgcggccaggcccggcccggggaaggccgcatctctctcggagcgcctggccgcagacactgtcttcgtgggaacagcgggaaccgtgggaaggccgaaaaatgccccccgcgttggaaaccggcgtggccctgccgggaagaaggccccagaaacctgtagcaccgcggggagggggcctcaggtcatagctggtgggaggcagaagaaaggggcggcaggggagaatacctcggtgtcagctggggaggaaaagaaggaagagagggatgcagggtcggggcccccagcgacggaaggcagcatggatacgctggagaacgtgcagctgaagctggagaacatgaacgcccaggcggacagggcctaccttcggctctccaggaagtttgggcagttgcgactgcagcacttggagcgcaggaaccacctcatccaaaatatcccgggcttctgggggcaagcatttcagaaccatccccagctagcatcctttctgaatagccaagagaaagaggtactgagctacttaaacagcttggaagtggaagagctcggccttgccagattgggctacaaaatcaagttctacttcgatcgcaacccgtatttccaaaataaggtgctcatcaaggaatatgggtgtggtccttctggccaggtggtgtctcgttctactccaatccagtggctcccagggcatgatctccagtccctaagccagggaaacccagaaaacaaccgtagtttctttgggtggttttcaaaccacagctccattgagtctgacaagattgtggagataatcaacgaagaattgtggcccaatcccttgcagttctaccttttgagtgaaggggctcgtgtagagaaaggaaaggaaaaagaaggcaggcaaggtccaggaaagcagccaatggagactactcagcctggggtgagccaatccaactgatcctgcacaagtctccctgctacctcctgctgggctgctcctggttgactacatatttggctctctgccttctcttcatgttggcctctgtgtactatagaccctttggactttagttacaagaatatggcatttatgatcatgttcttttgcctcccatagcctcttgcttttctacgttagtgtcacatgttatgtgatcgcacccggactgttcatatgttaagcacacatactttagatgtgtgctccctgttatctacattgcctggaccttgttcttggctctggcctttcctacttgtctttaacatggacactcatgagtcatcctccaggacgaccagtgcatcctcaagctctgctccttcagggccagtgacttgctgggcttcgtgttcatgctggccatgcatgtcatctatgcaagcgtttccattgccactgcagaatgaagccagtgcacatggtattagtcatcagccagaacttcctgttctgtgggtctggggtcaccagctgagatgtcacctgctttatttctggctttggcctgtggtctgtgatacccatcctgcttgatgttctgcagaatggcacttgactgctgggcatgcatgaagttaagggcaagaaacagtatgccatgtgttctgtaccatcatgtgtctcttcttgcttctgggcccttctactggtgaactttcatcaagatctgcgccatgccgtgtcactatcaagccattaagttttgtctgggttgctgtcagccccagttggcttcctggtcaacaaggacctcaagaactgcctgtggaccgaggccccctaccagtgcatgagacacacacctaccctccccagctttccaggaaccctactggctgccagactgatgggcgggctggtatgtgtggacatgtgttcactgtcattatgctgtggctccaggtgagggtgaggactgggcctatatagaatccagataccattgtcaacttcccttattcccgtctaagatgtgagcagagtgccatagtaggggttctgggaagaggtatttctgatttgtgggcctctgcttgcttgacttcaggtcacttatacttcttattttgcttgcctgccttcatccctcatttcctccctctcattcttctttcctccctccctttcctggtagcctcctttcctcctcttctgccttccccttccttctttccttattcttttttattttgtttaaatagtaccacagagaaaacaactgaaaaaccacatttttctacatacagctggggaggtagctgagaacttggcactgcgcacacatactaggttgaaagagagttgaggaaaccagaaggccaagtggatctgctggcaaaccctgaacctgtctcctgcgcttgctctacagttctgaagttgaaaatccttttcatgcctagcatctgcttgagttataaaccccaaggcagccatgtcatagactagtgtttactcttgttttgactttgttttaatgcttcctaagacccaagtgcctcctgctgtttcctcctttgtggtagcctctggccatctggacctcaatccccagctttcccactttcagcagtcctttgctctctttgcttctacctcaaatagccccaggagtgggctttagtctccaatatggagcatctcaagcttctcctgggggatggggattgggatgggcagaatctgttttggatctccgggttatttccagtgggtgtaaaagcagagctgggcctttccctctcttatccctgagggtgggtaagaaggactgtatctacacctgttcttccctaccttctcttttgttagggaggcctcattctaagttcctcaagagagtccttggcttaaagctgtagcaagggtgtgctaggtgggggatttggagcaaaaccgtcgagtaggcatgatactggtatggagtgggcctgcaaaatcagacagaaatggcttgagaagccgcagggggagcatgcctgtctctcagtgatagagtatgggagggacctccctagcttggaaaatgagaattgaaggggttatgaacaaataggatgcctagttgaggatgttcccaaagttttgtccaatcttatcattagtagattttataagccacagagacaaaccagaaacggaataatgttactttggatgctttatttttttgttctaggtgtggctttgtacatgcagaagaatgctatatgctgcacattttgcctttaaagtcttacgactttccccattttagtctaatgggaagatacagatgtgcaagtctgcttttttgttttttgttattatttttttttttttgctctgtgttatggacattttcagacatgcacagaagtggagaggatggtccttggaccccatgtgtccatcacctagctgcatcacttatcagctatggtcaacctggtttcatctgtatctctctcttttcacctgtattgtttattgaaaatccaagacactatgccaatgcaaccgtgactactttgggagattggtagtctcttttgatggtgatagtgatggggtgcactatcataatcacatcaggtctgctttttgcttttaatgttaactaatgaagttccagagatgggccttagaaatgtgttttaagaattaacaaggagtctcaaaaagaaatgagagggatgcttcctttcccttgcatctacaaaacaagagagagactgttctgttgtaaaactctttcaaaaattctgatatggtaaggtacttgagacccttcaccagaatgtcaatctttttttctgtgtaacatggaaacttgtgtgaccattagcattgttatcagcttgtactggtctcataactctggttttggaagaataatttggaaattgttgctgtgttctgtgaaaataacctccccaaaataattagtaactggttgttctacttggtaatttgacaccctgttaataacgcaattatttctgtgttcttaaacagtataaatagttgtaagtttgcatgcatgatggaaaaataaaaacctgtatctctgtt

SEQ ID NO: 2534 - DNA, 3095 bp, Homo sapiens
gagactgaagagtgggcggcgcaaatgggcgaggtgtttactcgccattttgtgtgaggaacgttgacgctacctacctctggcctggcctctacccactgctgccctggccgctaccaacatgagcctcccggagagtcctcacagccccgctactctcgactatgctctggaagacccgcaccagggccagaggtcccgagaaaagagcaaggcgacagaggtaatggcagatatgtttgatggccgcttggagccaatcgtgttcccaccgccccggcttccagaggagggggtcgcgccccaggatcccgcagatggtggccatactttccacatcttggtcgatgcgggtcgcagtcatggagccatcaaagcggggcaggaagtgactccaccacccgcggagggcctagaagcggcctctgcctcgctgacaactgacggcagcctcaaaaatggctttccgggtgaagagacgcacggcctaggtggggagaaggctctagaaacctgtggggcagggaggtcggagtctgaagtgattgcagaggggaaggccgaggacgtgaagcctgaggagtgtgccatgttctcagccccagtggatgagaagccaggaggcgaagaaatggacgtggcggaagaaaacagagcaatagatgaggtaaacagggaggcagggcctgggcccgggcccgggcccctgaacgtgggtctccacctgaaccccctggagtccatccagctggaactggactccgtgaatgcagaggctgacagggcgctcctgcaggtggagcgcaggtttgggcagattcatgaatactacctggagcagaggaatgacatcattcgcaatatcccgggcttctgggtcactgctttccgccaccacccacagctgtctgccatgattagaggccaagatgccgagatgttaagctacttaaccaatttggaagtgaaggagctcagacaccctaggacaggctgcaagtttaagttcttctttcaaagaaacccttacttcagaaacaagctgattgtaaaggtgtatgaggtcagatccttcggccaagtggtgtctttttccactctaatcatgtggcgccggggccatggaccccagtccttcattcataggaaccgacatgtcatctgcagcttcttcacctggttttcagaccacagccttccagagtccgacaggattgctcagattattaaagaggacctctggtcaaatccactgcagtactacctgttgggtgaagacgcccatagagctagacgtcgcctggtaagggagccagtggagatccccaggccctttgggttccagtgtggttaacctttgcctttggaattactcctgcagaaggttgcctgccaccaccagctggacctgagcttgggcaacagcattaggtatgccctttactttttttgttctgactttcctgtaccctctgtttaaactttccgttctctcaacctgaagattgagaccttggtggctgtgctgctcccctttcacctggtcgtcttgctattctgcattaacatcacatgctcccagccgatgggtcacatccttctaagcgaagcgaatgatgctgtaggttacactgtatttacctttgtttggactcggtttgttcccaggacctctggtctggctcctcctacttggatttctagctgtgtctaagaacctattcagctcaccctgctctgcatctgacagtacaggtgcatggcctgtggacaattgctgggcattaatgaagtcaagggagaacagcagggggcaagttggtctgtgtgaattatgggaccccattacttttcctgagactggtcacctattgctgcctgctactggctattcccaagtactgctacttgggcagctccctgctgagtgaacatatcccagaccattgccagctccactctctggtttctaataaacagggatctccagaacactggtggtggacacagctttcctgtcagcacacaaaagacctgttcctcttccaaaagacctctctttaccaccaccaccctcatcactcagaaaccctactgtttgttagacaggtggttgaggggacatgtcagaccctatcctcatggcaaggttaatatgttggtgttcttgacaagtaccaggctttctcagccacaaccagtggattcattcaaaatctaggtacctttatttgcctcccttcctgaacctaatgaagtgccagagtgagtgtacactttcttttctctcatctctcataaatctcttctgtcttcctttaaaaaaaacaaaagtagtagttcagaaacatccgcagaagcaggctttttagtttcttggctctctttgtcatgtccagaggcaggctgttctgtaaaatagactgccagacctcttattgcccattctcctttcttctcagcccctcacccctctttagcaattcctagagggtttaaaggactacagagctgtatggaatgaaaggtgatttctagttcagagtggatagaagaactaaagagattgtgatgggtgctctaggcagggaaaactgaacaaaaaggcagaaatgattcaggggaaaatcgggcctagaatttacactgggttgactagttatgatgggaagagaagtacttttttttagtatgcacgtagaagaatagaagatggttggagtgttaaatatgttccctagagaagggttctttgaagaaacactgcaattttgggtgttctctttcttgtttgcatatggccttacttatgtggaagattaatactgtgttataatattttctctttctgtttactgggaagattcagctgtacagattttcttttactttcaaatagaaatatttggaataatatcagtctttcttttttgtacattatgtggatatggatattcatggcagttttcagcctgttcttgtttctgttaaaaccgtatctttaacattttaatttgaataacttggtcttatctgatgcggaagactggaaactattgtgttcatgggtaaataaactacaaaatatttatggc

SEQ ID NO: 2535 - DNA, 4870 bp, Homo sapiens
cgccacgggggtcgctgtcatggcaacgcacccgctcccgcatggagggcgcgaagccgcattgtgagcgctggccctggagcccgcggccccgcggctgagagcgagcctcggtcccgctgaagctcccctgacttctgcctgctccctctcccgacgggacggaaagggccggggctcgggcatggggtcccctgcggtccgagcctgcccacggcgaagccggtgcagcctggccccgtgacccctctgaatccccgtccggccgtcgccgtgcagttgtcaagtttctgggaagattagtgggagcgcagccgcccgagcccgacggccggagggtcgcggccagtcccccttgccgggtcgccacgtcccacaaggtccttcccggccgctccgtgggaggcggggcgcaggttggagtaacagggacgggcttgagctggtacggaaccgggcaaggtgagagaagtgtcttccacgcgattcccaagcctcgctagggaatcgagggagaagaaaggttgctcagagtgataaagaacatgccgttgcaaacggaagagcaacgtgcccgaatctaggtgacaggaagggcttaggccttttcggcacgaatggagccttccagtcaacatgcttctacgtgatgcagctttatagcgcaaaaaaatgacaatgcaaggggtacaaacagccctgctagaccaacagcccgagcctcgacagtctacatccggcgccttcaagcccccaaccacacactgcgaagtgggaaaagttcccagcgcggcttggcgaacccgctaacacggcgctctcacgagctgctggaaaagaccttcgcgagagggcgcagggagtcccgctccctggagggcccgcccccttggaggggaccggaagcgcttgtcctggcccggaagcagtgctgactccgtacacgcgcgctgcggcatggcggcccaccgccccggcccgctcaagcagcagaataaagctcataaaggcggacggcatcggggtcggggatctgcacagcgggacggcaagggccgtctggcactgaaaaccctaagcaagaaggtgagaaaagaactcagcagagtcgaccagaggcatcgcgccagccagctccgaaagcagaagaaggaggcggttctggcagagaagagacagctgggtggcaaggatggccctcctcatcaggtactggtggtgcccctgcacagcagaatttccctgccagaggccatgcagctgcttcaagatagggacactggaacagtacacttgaatgaattgggaaacacccagaactttatgctgctgtgcccccgcttgaaacatcggtggtttttcacctcagcaaggccaggggatctgcacgttgtgttagacatggctaaagtagctgataccatcctgttcctccttgatccactagaaggctgggacagcaccggtgattactgtctttcctgcctctttgctcagggccttccgacctatacactagctgtccaggggatttctggcctcccactgaagaaacaaatagataccaggaagaagctaagtaaagcagtggagaagcgctttccgcatgacaaactcctcttgttagacactcaacaggaggcagggatgctgcttaggcagttggctaaccagaagcaacagcatcttgcttttcgagatcggcgggcctacctatttgcccatgctgttgattttgttcctagtgaagagaataacttggtgggcaccttgaaaatttcaggctatgttcgagggcagactctgaatgtcaataggttgctgcatatcgttggatatggtgatttccagatgaaacagatagatgcccccggagaccctttccctttaaatcctagaggaattaaaccccaaaaggacccagacatggcaatggagatttgtgctacggatgctgtagatgatatggaagaaggtcttaaagtcctaatgaaggcagaccctggtagacaggaatccttgcaagcagaggttatcccagatccaatggagggagagcaaacctggcccactgaggaggagctgagcgaggcaaaggatttcttgaaggaaagttctaaggtggtaaagaaggtccccaaaggaacatccagttaccaagctgaatggattttggatggtggcagccaaagtggtggggaaggagatgaatatgaatatgatgatatggaacatgaggattttatggaggaggaatctcaggatgagagtagtgaagaagaggaagaatatgaaactatgactattggggagtctgtgcatgatgatctgtatgataagaaagtagatgaagaagctgaggcaaaaatgttggagaaatataaacaagaaagactggaagagatgtttccagatgaagtggacacgccccgtgatgtggctgctcgaattcgatttcagaaatacagaggccttaagagcttccggacatctccatgggatcctaaggaaaaccttcctcaagattatgctcgaatatttcagtttcagaactttactaacactaggaaaagcatctttaaagaggttgaagaaaaagaggttgaaggagctgaggttggctggtatgtcacacttcatgtctctgaagtccccgtctcagtggtcgagtgcttcaggcaaggaacacccttgattgcattttctttactacctcatgaacagaagatgtcagtattgaatatggtggtgaggcgtgaccctggcaacactgaacctgtgaaagccaaggaagagctcatatttcactgtggattcaggcgcttccgagcctcacctttattctctcagcacactgcagcggacaaacataaattgcagagattcctgactgctgacatggccctggtggcgacagtctatgcgccaatcacttttcctcctgcatctgtgctgcttttcaagcaaaaaagcaatggaatgcacagcctcattgctacaggccatcttatgtcagtagatccagacagaatggtcatcaagagagttgttctgagtggtcatcctttcaaaatttttactaagatggcagtagtacgttacatgttcttcaacagagaggatgtgctgtggtttaaaccagtggaactgagaacgaagtggggccggagaggacatatcaaggaacctttaggtacccatggccacatgaaatgcagctttgatgggaagctaaaatctcaagacacagtactgatgaacctgtataaacgagtcttccccaaatggacttatgatccatatgtaccagaaccagtaccctggctgaaaagtgagatttcttcaacagtgcctcaagggggcatggagtaatggattcaaagagattctgtcttaccggtgccagtcagtactccagggatgggaggcacaagttgtgattgggcaaagtttattttctatgtcagcctgtcagtccactgccccattttgcaagacttttttttagccttgacaaaatgtctcagttaagtataaaagtttttccactacttagtccaaaaaaaactattaaatcttaatgaaatagccactctccattaagaatctgataactaagagttgacaatactaggaaacaaaatgtcttcagtatctaaagacactgaattcccaccatttccttttctgtaaattaaacagaaacagactgataagaagctggcctttcagcctgcttcacccaagttatggaggaggttaagtctacatttccaccactgagcacaatacaaatgttctttacttctggggaaacagtttgaaaatgttgagacagcacagcagccactccaacaccagctgtaggttcaatgagtagtttcatcctctcccacaccagctgggttgcacactgttgatatggaagggagtaggaattagtgaaaggggagtctagttggtttacctataaagttcagatgagaatacgtgtccagtttgaattttcttatcactgtgtacacacgcttcccaaagcttttctttaattctgactctgcttctgtcaagagggttgtcattaatacatctagggtaccctcccatgtcatgaagttacctagtcaggttcccgtgggtcacttgctactcctaagggaagtttcttctgcctaagaagttacaccatgctttgctatttcttttcttgctggagcctcaccttaatttcatcctctgtgacagtgaagatatcatccacaaggtccctgataataggccaggtgttcaagccaatgctggatttgacaccatctgctatggtttctggaggataaagattgggcatcagtttccccttcagcttggactggtagcagtcatctgcatttgagggttcagcagcatataccttcacactaggtttcagagcctgggaagaggaatattaagacatcttaacaacaaaccacaacattgcctgcatgtctaaaagaaaatatgggcctggtgtggtggctcacacctgtaatcccaacactttgggagcccgaggcgggtggatcagctgaggtcaggagttcaagaccagcctggccaacctggtgaaatgcagtgtcaactaaaaataggaaaatcagccaggcgtggtggcagacccctgtaatcccagctactcaagaggctgaggtaggagaatcacttgaacttgggaggggtaggttgcagtgagctgagatcacaccaaaatggggtggggcgcagtggctcacgcctgtaatcccagcactttgggaggccgaggtgggcggatcacgaggtagggagatcaagaccatcctggctaacacggtgaaaccccgtctctact

SEQ ID NO: 2536 - DNA, 54 bp, Homo sapiens
tgcaagcagagctgtgtaagtattgctagttgtgaggcagctgaattaaatttg

SEQ ID NO: 2537 - DNA, 3399 bp, Homo sapiens
cagtccgaggagggtcacgcaggcggcagatgccaggcgggcagccccgcccctgcgcgccgcctcagcggcgccttcaagacgctggtcccaggcacccacgcccagggcgcctcggatacccaccccctcggccccccgcacaccccggtcctcgacccctctccgcaggatggtttcccggtcctctggcgaggatcctccaaggcgtctcacatgaaccggctcagaaacgccaaaatctacgtggagagagctgtcaagcagaagaagatctttacaatccaaggctgctacccggtgatccggtgtctcttgcgccggaggggctgggtggagaagaagatggtccatcgctcaggccccaccctgctgccaccccagaaggatctggatagctcagcgatgggtgacagtgacaccactgaggatgaggatgaagatgaggacgaggagttccagccatcacagctgttcgacttcgatgatttactgaaatttgatgacctagatggaacacatgctctgatggtgggtctatgtctcaatctccggaatttgccgtggtttgatgaggttgatgccaactccttcttcccacgctgctactgcctgggggctgaggatgacaaaaaagccttcatagaggacttctggctgactgctgcccgcaacgttctcaagctggtggtgaagtctgagtggaagtcataccctattcaggcagtagaggaagaggcctcaggagacaagcagcccaagaaacaggagaaaaacccagtgttggtgtccccagagtttgtggatgaagctctgtgtgcgtgcgaggagtaccttagcaacttggcccacatggacatcgacaaggacctggaggccccgctgtacctcacccccgagggctggtccctcttcctccagcgctactaccaagtggtccacgaaggggcagaactcaggcacctcgacactcaggtccagcgctgtgaggacatcctgcagcagctgcaggccgtggtaccccagatagacatggaaggggatcgcaacatctggatcgtgaagccaggagccaagtcccgcggacgaggcatcatgtgcatggaccacctggaggagatgctgaagctggtgaacggcaaccccgtggtgatgaaggacggcaagtgggtggtgcagaagtatattgagcggcccctcctcatctttggcaccaagtttgacctcagacagtggttcctggtaactgactggaacccacttaccgtgtggttctaccgcgacagctatatccgcttttccacgcagcccttctccctgaagaacctggacaactcagtgcacctgtgcaacaactccatccagaagcacctggagaactcatgccatcggcatccactgcttccgccagacaacatgtggtctagccagaggttccaggcccacctgcaggagatgggtgccccaaatgcttggtccaccatcatcgtgcctggcatgaaggatgctgtgatccacgcacttcagacctcccaggacaccgtgcagtgtcggaaggccagctttgagctctatggcgctgacttcgtgttcggggaggacttccagccctggctgattgagatcaacgccagccccacgatggcaccctccacagcagtcactgcccggctctgtgctggcgtgcaagctgacaccctgcgcgtggtcattgaccggatgctggaccgcaactgtgacacaggagcctttgagctcatctataagcagcctgctgtggaggtgcctcaatatgtgggcatccggctcctggtagagggcttcaccatcaagaagcccatggcgatgtgtcatcggcggatgggggtccgcccagcagtccctctgctgacccagcgaggctctggggaagcccgtcaccacttccccagcctccacaccaaggcccagctgccttctccccatgtactccgacaccagggccaggtcctcagacgacagcacagcaagctggtgggcactaaggccctgtcgaccacaggcaaggccttgaggactctacccacggctaaggtcttcatttccctcccaccgaaccttgatttcaaggtggcacccagcatcctgaagccaagaaaggctcctgctctcctgtgcctccgaggcccccagctggaagtgccttgttgcctctgccctttgaagtcggaacaattcctagcacctgtcggaaggtcaaggccaaaggcaaattcaaggccagactgtgacaaacccagggctgaggcctgccccatgaagaggctgagccccctgaaacccctgccccttgttggtacattccagaggcgcaggggcctgggggatatgaagctagggaagcccctgcttcgattccccactgcccttgtcctggatccaacaccaaataaaaagaaacaagtgaagtatttggggcttgactccattgctgttggagggtcaagagtggatggggcgaggccgtgtaccccagggtccacagcaagagcctgaggccatcagcagctcctccgtgcagcgaggcccagaattcccacctaaggacagacatggggcttcctatttagggactcccccagcatctccgatccaggggtggggagcgtgagccttcactttacagatgaagaaactgagtctgaaagaggaggcatggcttacccaagatcacgtggcagtgagtcgacgcagggacatattgccagaactgccgagcactgggagccccccaaccccagagaacaagccaagctagcagaatgacacctaccgggcataggaacgttaatgccatgagacaggggaaggaattggccttgcctaaacctcagcccttctgcagagggcatgggtctatcccttcttcagcaaggggccaaggtcacctaaaaatgaaacatccaataagccacacccacctgaagaaaagtgtggcactgcttagttgtagtgggttgaactgtggtcccctgaaaagagatgtctacttggaccctgtgaatgtgaccttatgtgggaaaagagtctttgtagctgggtatggtggctcacacctgttatcccagcactttgagaggccaaggcaggagatcgcttgagcccgcaagttcaagaccagtctgggcaacatggtgaaaccgtttctacagaaaattagctgggtgtggtggcacacacctgtagtcctagctactcgggaggcctaggtgggaggattacctgagcctgggaagatcaaaactgtggtgagctgtgatcacgccactgcgctctgagcctgggagacagagtgaaaccctaaatcaaaaaaaaaaaaaaaggtctttgcagatgtaaataaatttaagatcttaaatg

SEQ ID NO: 2538 - DNA, 5638 bp, Homo sapiens
gggcccgacggcgagcggagcggccgatcagctgttgcgagcgctgcacaacaacaaaaggacttggactggccggcctgggcgcagcgacccgagggctggagccggccccgcgcctgccgtctgggtacctgaacgaggtgcagcgcagcccggccccaccgcagctacctcagcagtcccgccccgcccgcgtccttccccgccgagccggcggccgctcccttccccgcgcagccccgcacggcccgggcccacgtacaatgactcttcttgcttttcacctaagttgaataagcaccctgtgcactttaatctcctgtcggtaccattgggccaactaaagacaaggttttgaaatctcagctataaaagacatccagccaaactctcagtcttgccttaacaatgttccagaggctgaataaaatgtttgtgggtgaagtcagttcttcctccaaccaagaaccagaattcaatgagaaagaagatgatgaatggattcttgttgacttcatagatacttgcactggtttctcagcagaagaagaagaagaagaggaggacatcagtgaagagtcacctactgagcacccttcagtcttttcctgtttaccggcatctcttgagtgcttggctgatacaagtgattcctgctttctccagtttgagtcatgtccaatggaggagagctggtttatcaccccacccccatgttttactgcaggtggattaaccactatcaaggtggaaacaagtcctatggaaaaccttctcattgaacatcccagcatgtctgtctatgctgtgcataactcctgccctggtctcagtgaggccacccgtgggactgatgaattacatagcccaagtagtcccagagtggaagctcaaaatgaaatggggcagcatattcattgttatgttgcagctcttgctgctcatacaacttttctggaacaacccaagagctttcgcccttcccagtggataaaagaacacagtgaaagacagcctcttaacagaaatagccttcgtcgccaaaatcttaccagggattgccaccctcggcaagtcaagcacaatggctgggttgttcatcagccctgcccgcgtcagtacaattactaatagtttcaagttttgttggttggtttctcttggtttgtgcttacatgtatggatgtgtgtatatgtacagtgaaaatgttgtctctttacaaccaattgataaccaatcacatagttttatcagtgtatttagacactatcttgaaaatcagatttatatgctgtgtatcacataatgccttgcctttaacatttactttttttgtacactttttcagattatttctggaaacatatcaatataattacagtgtttgggggtgtctttaaatatattaggttatacattagtcagcattttaaagacatttcttcccaagtacgagaataggcatctttcattttcattttattttgtattacttaatcttttaagcaagcaaaaatttattctcagggtcagctgtacactttattgaccagtacttgataatctctctgtatatgatgaatacatttttacacactaacattagcattaacaggtgatagttgccatggatataatggaattatggctggactttcttttgaaagaaaacttgatgtattctgtgtgtatggtttttccccagattagtcatacagttcatttggaattcaggtacattaagctttagtgaagagtgcatgcagtaattccaatgtgactgcatgacgtggtacagacattacaggtgttgtagacagaggcacttgtctcgtgcagagggattaaattagacctgtgagattatatttggaaaaattcatgtctgtaactaacccattagtgcagtatttaatttgttactattccttcccgccaattctgtccactcctcacctcgcatcagctataaatttggaagtacttgtccaggcactcaagtgacttcatatttctctctgcccatgggaaaagagataggctttatatttccacagagtgaaaaatcctctgtcatggagcctgtcctgccaagtggcaagagtgtggggactgtctggtgatgatgtctttcatggcatctgagtgaagagtgacaggttggctcaacttttttctttttttttttttaattgccttgtattgtaagtattcttccctgcagtccaagtgacttttcattttttgttttaacttcaggcaaaatctttaaccactctggcctctgtttcccccaccaacggggagcagtgacatttacctccctcacagagtcactgtgaggattctatactgatttgaagtggagctgttcagaactgaaccttgtaggaaattccaagggcctttctactgaatctggtgatggggtggggccgtggcactttctctgccacagctgttcttcacagtgttggtgctaatgaggccagggtgcagggttcgattcacacgtaggccagttaacttagagaaaatctatttccttacctctagccagtcacttcctttttccgcagttgtgatgggttttgctgagccatccactctgactgatttcctctgaagtaaacatatttacaatccaaagcaattctactgacagaagtgttgccttcataatcaaacagcttgtttttccatctcctctgcaaccctaattaaatgagtacaggtctacaaaatgttttcaaggagaaaagcagcatatccttaagtgaagtattatatttttcaataaccctgtagtggcttgatgcagggaaccctgggggactttcagcgaagagctgtgctcttttctgactagattagagcgtttggagtggaagacgtcaaatgtgtagtgagatggaggttttacattgttcttctactggctgtgatgaagtgccagaatgtctctttagaacaagagttagattccccctttctccttattgccccttccgttttgacttcccctttatttatttgttgtctaattaggggccaagtctgtaaagttttgtcaaagtgagttagaagttgttttctcttactatttgtgtttaccagagttgggagataagatagtttccatgaaggtgtgtatgttttatacgatgtttgttatagggccatgcattggtaacttgaaaatagaccagcttaatgtcttcaggatgtaaaactctgaatacacggcgtctctttttcatacattgcatgtaagttgttagtacctcacaagctacagaagttcagccatgagattttgtttggcaacatgaacagatttgtgtataactgcaatggcctttttttccagatttccttattgactttttgtttgccttacctggggctagttttttatgctttgtacctagaaaacaaaaaattacattcgttgggctttttttcaaggttgggattaccacaccacctggaatatcatactgtggtttctgcctaaaattggcacatgtaagtattgaagaaaatggttatataattcagttgaaactcttggttattagatgttaggcatctcctgtatgtaagacacaaggccaaccacaacacagaacgatgttgacctgttaagtattctctgaaacatggccaaaatgcattttatgagcttttttttttgctattgtaaatattagtggtttacaatgcgctttagacatatttctttaaaatgcaagcagtgagaaataagacctctctgaattagtagctctaaactgttaacatagaatgttacttggaaaaagtctggaatatgtggtgtacacaagcagtgcttcgtgaatgagtttcttagcttttatagtgcgccatgtttctcaaagtttgtttttgttgacaaaacattttataatatatatcttatgtttattttttttctcaactaattgtgtactgcactgtaaggtgaaaattagccatccattatttatcttctgtggcaatgcatttatatggttgattgggtggggaattttttgcagaaagatgcaaagtgattgggttttcgacttcctatcgcagggagcttttaagaaatattaatttcctatacatttttccaatccccatgcaaactgttcctgtttacataccttctctgttgtatcagtactttgagtgagaagacagtttatttaaaacttgagcaggctgttcagcattgtttctgcttctgaaatctgtatagtacactggtttgtaatcattatgtcttcattgaaatccttgctacttctcttcctcctcaatgaaatacattatatattatctttatgtactcttaagaaaaacgagcaaggaagagtatcttcattattctcattttctctgagttggaaacaaaaacatgaaggactccaactagaagacagatatttacatttaaatagattagtgggaaaactttaagagtttccacatattagttttcattttttgagtcaagagactgctccttgtactgggagacactagtagtatatgtttgtaatgttactttaaaattatctttttattttataaggcccataaatactggttaaactctgttaaaagtgggccttctatcttggatggtttcactgccatcagccatgctgatatattagaaatggcatccctatctacttactttaatgcttaaaattatacataaaatgctttatttagaaaacctacatgatacagtggtgtcagccttgccatgtatcagtttcacttgaaatttgagaccaattaaatttcaactgtttagggtggagaaagaggtactggaaaacatgcagatgaggatatcttttatgtgcaacagtatcctttgcatgggaggagagttactcttgaaaggcaggcagcttaagtggacaatgttttgtatatagttgagaattttacgacacttttaaaaattgtgtaattgttaaatgtccagttttgctctgttttgcctgaagttttagtatttgttttctaggtggacctctgaaaaccaaaccagtacctggggaggttagatgtgtgtttcaggcttggagtgtatgagtggttttgcttgtattttcctccagagattttgaactttaataattgcgtgtgttttttttttttttaagtggctttgtttttttttctcaagtaaaattgtgaacatatttcctttataggggcagggcatgagttagggagactgaagagtattgtagactgtacatgtgccttcttaatgtgtttctcgacacattttttttcagtaacttgaaaattcaaaagggacatttggttaggttactgtacatcaatctatgcataaatggcagcttgttttcttgagccacggtctaaattttgtttttatagaaattttttatactgattggttcatagatggtcagttttgtacacagactgaacaatacagcactttgccaaaaatgagtgtagcattgtttaaacattgtgtgttaacacctgttctttgtaattgggttgtggtgcattttgcactacctggagttacagttttcaatctgtcagtaaataaagtgtcctttaacttca

SEQ ID NO: 2539 - DNA, 590 bp, Homo sapiens
catccagccaaactctcagtcttgccttaacaatgttccagaggctgaataaaatgtttgtgggtgaagtcagttcttcctccaaccaagaaccagaattcaatgagaaagaagatgatgaatggattcttgttgacttcatagatacttgcactggtttctcagcagaagaagaagaagaagaggaggacatcagtgaagagtcacctactgagcacccttcagtcttttcctgtttaccggcatctcttgagtgcttggctgatacaagtgattcctgctttctccagtttgagtcatgtccaatggaggagagctggtttatcaccccacccccatgttttactgcaggtggattaaccactatcaaggtggaaacaagtcctatggaaaaccttctcattgaacatcccagcatgtctgtctatgctgtgcataactcctgccctggtctcagtgaggccacccgtgggactgatgaattacatagcccaagtagtcccaggtactcacaggattgccaccctcggcaagtcaagcacaatggctgggttgttcatcagccctgcccgcgtcagtacaattactaa

SEQ ID NO: 2540 - DNA, 5631 bp, Homo sapiens
gcacaacaacaaaaggacttggactggccggcctgggcgcagcgacccgagggctggagccggccccgcgcctgccgtctgggtacctgaacgaggtgcagcgcagcccggccccaccgcagctacctcagcagtcccgccccgcccgcgtccttccccgccgagccggcggccgctcccttccccgcgcagccccgcacggcccgggcccacgtacaatgactcttcttgcttttcacctaagttgaataagcaccctgtgcactttaatctcctgtcggtaccattgggccaactaaagacaaggttttgaaatctcagctataaaagacatccagccaaactctcagtcttgccttaacaatgttccagaggctgaataaaatgtttgtgggtgaagtcagttcttcctccaaccaagaaccagaattcaatgagaaagaagatgatgaatggattcttgttgacttcatagatacttgcactggtttctcagcagaagaagaagaagaagaggaggacatcagtgaagagtcacctactgagcacccttcagtcttttcctgtttaccggcatctcttgagtgcttggctgatacaagtgattcctgctttctccagtttgagtcatgtccaatggaggagagctggtttatcaccccacccccatgttttactgcaggtggattaaccactatcaaggtggaaacaagtcctatggaaaaccttctcattgaacatcccagcatgtctgtctatgctgtgcataactcctgccctggtctcagtgaggccacccgtgggactgatgaattacatagcccaagtagtcccagggccaggaaaagctgcttataagactcacgggcacagaagtggaagctcaaaatgaaatggggcagcatattcattgttatgttgcagctcttgctgctcatacaacttttctggaacaacccaagagctttcgcccttcccagtggataaaagaacacagtgaaagacagcctcttaacagaaatagccttcgtcgccaaaatcttaccagggattgccaccctcggcaagtcaagcacaatggctgggttgttcatcagccctgcccgcgtcagtacaattactaatagtttcaagttttgttggttggtttctcttggtttgtgcttacatgtatggatgtgtgtatatgtacagtgaaaatgttgtctctttacaaccaattgataaccaatcacatagttttatcagtgtatttagacactatcttgaaaatcagatttatatgctgtgtatcacataatgccttgcctttaacatttactttttttgtacactttttcagattatttctggaaacatatcaatataattacagtgtttgggggtgtctttaaatatattaggttatacattagtcagcattttaaagacatttcttcccaagtacgagaataggcatctttcattttcattttattttgtattacttaatcttttaagcaagcaaaaatttattctcagggtcagctgtacactttattgaccagtacttgataatctctctgtatatgatgaatacatttttacacactaacattagcattaacaggtgatagttgccatggatataatggaattatggctggactttcttttgaaagaaaacttgatgtattctgtgtgtatggtttttccccagattagtcatacagttcatttggaattcaggtacattaagctttagtgaagagtgcatgcagtaattccaatgtgactgcatgacgtggtacagacattacaggtgttgtagacagaggcacttgtctcgtgcagagggattaaattagacctgtgagattatatttggaaaaattcatgtctgtaactaacccattagtgcagtatttaatttgttactattccttcccgccaattctgtccactcctcacctcgcatcagctataaatttggaagtacttgtccaggcactcaagtgacttcatatttctctctgcccatgggaaaagagataggctttatatttccacagagtgaaaaatcctctgtcatggagcctgtcctgccaagtggcaagagtgtggggactgtctggtgatgatgtctttcatggcatctgagtgaagagtgacaggttggctcaacttttttctttttttttttttaattgccttgtattgtaagtattcttccctgcagtccaagtgacttttcattttttgttttaacttcaggcaaaatctttaaccactctggcctctgtttcccccaccaacggggagcagtgacatttacctccctcacagagtcactgtgaggattctatactgatttgaagtggagctgttcagaactgaaccttgtaggaaattccaagggcctttctactgaatctggtgatggggtggggccgtggcactttctctgccacagctgttcttcacagtgttggtgctaatgaggccagggtgcagggttcgattcacacgtaggccagttaacttagagaaaatctatttccttacctctagccagtcacttcctttttccgcagttgtgatgggttttgctgagccatccactctgactgatttcctctgaagtaaacatatttacaatccaaagcaattctactgacagaagtgttgccttcataatcaaacagcttgtttttccatctcctctgcaaccctaattaaatgagtacaggtctacaaaatgttttcaaggagaaaagcagcatatccttaagtgaagtattatatttttcaataaccctgtagtggcttgatgcagggaaccctgggggactttcagcgaagagctgtgctcttttctgactagattagagcgtttggagtggaagacgtcaaatgtgtagtgagatggaggttttacattgttcttctactggctgtgatgaagtgccagaatgtctctttagaacaagagttagattccccctttctccttattgccccttccgttttgacttcccctttatttatttgttgtctaattaggggccaagtctgtaaagttttgtcaaagtgagttagaagttgttttctcttactatttgtgtttaccagagttgggagataagatagtttccatgaaggtgtgtatgttttatacgatgtttgttatagggccatgcattggtaacttgaaaatagaccagcttaatgtcttcaggatgtaaaactctgaatacacggcgtctctttttcatacattgcatgtaagttgttagtacctcacaagctacagaagttcagccatgagattttgtttggcaacatgaacagatttgtgtataactgcaatggcctttttttccagatttccttattgactttttgtttgccttacctggggctagttttttatgctttgtacctagaaaacaaaaaattacattcgttgggctttttttcaaggttgggattaccacaccacctggaatatcatactgtggtttctgcctaaaattggcacatgtaagtattgaagaaaatggttatataattcagttgaaactcttggttattagatgttaggcatctcctgtatgtaagacacaaggccaaccacaacacagaacgatgttgacctgttaagtattctctgaaacatggccaaaatgcattttatgagcttttttttttgctattgtaaatattagtggtttacaatgcgctttagacatatttctttaaaatgcaagcagtgagaaataagacctctctgaattagtagctctaaactgttaacatagaatgttacttggaaaaagtctggaatatgtggtgtacacaagcagtgcttcgtgaatgagtttcttagcttttatagtgcgccatgtttctcaaagtttgtttttgttgacaaaacattttataatatatatcttatgtttattttttttctcaactaattgtgtactgcactgtaaggtgaaaattagccatccattatttatcttctgtggcaatgcatttatatggttgattgggtggggaattttttgcagaaagatgcaaagtgattgggttttcgacttcctatcgcagggagcttttaagaaatattaatttcctatacatttttccaatccccatgcaaactgttcctgtttacataccttctctgttgtatcagtactttgagtgagaagacagtttatttaaaacttgagcaggctgttcagcattgtttctgcttctgaaatctgtatagtacactggtttgtaatcattatgtcttcattgaaatccttgctacttctcttcctcctcaatgaaatacattatatattatctttatgtactcttaagaaaaacgagcaaggaagagtatcttcattattctcattttctctgagttggaaacaaaaacatgaaggactccaactagaagacagatatttacatttaaatagattagtgggaaaactttaagagtttccacatattagttttcattttttgagtcaagagactgctccttgtactgggagacactagtagtatatgtttgtaatgttactttaaaattatctttttattttataaggcccataaatactggttaaactctgttaaaagtgggccttctatcttggatggtttcactgccatcagccatgctgatatattagaaatggcatccctatctacttactttaatgcttaaaattatacataaaatgctttatttagaaaacctacatgatacagtggtgtcagccttgccatgtatcagtttcacttgaaatttgagaccaattaaatttcaactgtttagggtggagaaagaggtactggaaaacatgcagatgaggatatcttttatgtgcaacagtatcctttgcatgggaggagagttactcttgaaaggcaggcagcttaagtggacaatgttttgtatatagttgagaattttacgacacttttaaaaattgtgtaattgttaaatgtccagttttgctctgttttgcctgaagttttagtatttgttttctaggtggacctctgaaaaccaaaccagtacctggggaggttagatgtgtgtttcaggcttggagtgtatgagtggttttgcttgtattttcctccagagattttgaactttaataattgcgtgtgttttttttttttttaagtggctttgtttttttttctcaagtaaaattgtgaacatatttcctttataggggcagggcatgagttagggagactgaagagtattgtagactgtacatgtgccttcttaatgtgtttctcgacacattttttttcagtaacttgaaaattcaaaagggacatttggttaggttactgtacatcaatctatgcataaatggcagcttgttttcttgagccacggtctaaattttgtttttatagaaattttttatactgattggttcatagatggtcagttttgtacacagactgaacaatacagcactttgccaaaaatgagtgtagcattgtttaaacattgtgtgttaacacctgttctttgtaattgggttgtggtgcattttgcactacctggagttacagttttcaatctgtcagtaaataaagtgtcctttaacttca

SEQ ID NO: 2541 - DNA, 4018 bp, Homo sapiens
cggccgcacagactcaaagccccgcgggcgagctcagcagcccggagcgaccgcggccccgccgcctcccccgcgagtcccggcgatgcggcccggcctgtgagcggccggcgaccctgggacgccccgccgcacaactacctcaacgccgtgccgcccccctcccgcccccaggtttttgcactgccatagggcgcccccgtgaggcgcttcgccccccaccatgttccagcgcctctccagcctcttcttcagcaccccctcgccccccgaagaccccgactgcccccgcgccttcgtgtcggaggaggatgaagtggacggctggctcatcattgacctgccggacagctacgcggctccacccagccccggggccgcccctgcccccgcgggccgccctccgcccgcgccctccttgatggacgagagctggtttgttacccctcccgcctgttttacggcagaggggcctggactcggtcccgcccgcctccagagcagtcccctggaggacctcctcatcgagcaccccagcatgtccgtttacgtcaccggcagcaccatagtgctagagcccgggtccccttccccgctcccggacgcggccctgcctgacggcgacctcagcgaaggggaattgacgcccgcccgccgcgagccgcgggccgcgcgccacgccgctcctctcccagcgcgggcggcgctgctggagaaggcgggccaggtgcggcggctgcagcgggcccggcagcgggcagagcgccacgcgctgagcgccaaggcggtgcagcggcagaaccgagcccgcgagagccgtccgcgccggtccaagaaccagagcagcttcatctaccagccgtgccagcgccagttcaactactgagcgtccaccggccgcgccacgaaccccttgccgatcccgatccctgtcgggctcctccgactcctcgggctggacaccgaaacctcccttcttaaagcgtgtgaggttgggtgatagccgttccttccccgacaccctcaatttccccatctctgatcctctaatctgcctctgaacccattcacccttcaccctcactcctggtccccatacccagcatctaatcatccatgccccctactcctggcccctccatcctttcttctctggtccccatccctgtctctccctttcacccttgccctccagtcctctacctctggcctgcccctatttctgaaagcttcttccagtccctgatctggctcattccccaccttcaactcccaccttacatgtctcacactatcccatggttggcattacactcactcctgttcccttattcttcattcccagtaattccctaccaaatggtggggaccctgagcccagctctgaccaggtagagcctgtgcagcctgggctgctgtcattgccctccagtaagggctcagggttttgcttttagtctccccttccttctgccttgggggcggtactctgtggagctgcttaggcctggaaaggtacagtatgtagaagaggactgtgagacgtgagttagagggagaagatggagggaatctagggaacgaggcagcctattggagatgcggacaggacagacacgttgagaagctgcagggagcagggcaccaagggagtgtgcactgtgcttgctcagagaggccaaaccctgctcccaggctgaagcctggagtctgcccccacttcccttttctataatccacccttctgcaggccctgaaatctgaagggcttagttagtaccttgccactctacccccaacacgtcacccgagtagaagctgggcaaggccctaccatcctggccgtctgttcacaagcccaaggtgctagaactagcttaggagacatgcaggccacagggcttctaggcagggaaagggcacacaccctaggtcagcgtgcagagcagtgatgctggaggacacaccatggggtgaagccatcccaaggctgacagctcagtcttcaccttgcctctggccttgtatttcacaccctgctcagtatggctagccagcagtcctgagtaggagtccaggactcccactgtctcaatctgcaaattgttcctatccaggttcagggccttcagggggcctcttttcattttctcccacaggcctctctttctttctaggttgctggggagaaatgggtaccctatgatccccctccccttctcctccagtaaatacctggaagagggaacctgaatccctgggggagacagaaggggcaggggccaccagcctccccttcttgtggtgagactgaattttgggctcagacaccagcaacagcctcttgggatgccctgagttgcttcccatttcctctttctagccgtccttttctagtgtgtgctcactcttcctaggaacttttaagacttcttggtacctatgaacataggtcctcccctcaccccaactctaggtttccaggcctcacagccaagctgaagcttggagaaaactctgcattcccatgagggcaaaggcagctgccctccctgaccctatagccccaggcctcatggggggtatgtggggaagggatggggtatccccatggatgctgggatgaggacagaggaagacctgatggggtctcctattccagggaataagccaaattaacactaaaaacggatcaaagctcccacgccagtccactagggccccagtagttgacagccttgctcctctcccaagttctccttcagaacctagttgcttttattcttccagctaccacttgggcacttcacagccagcctagggtcttcggcacctccaagagctgaatctccctccaacccttcttgcctactcctcactgccagctgggacctaggctcagtcctgtgtggtgcccatgatccttctggtgggggaagagtttaagttatagggcatttggctcaaattttaaaaggccttttgtttacctatatttctggaggctcctgtattctagaacccaatctctcacctgcttggttgcaaggctcatatttttttgtacctttcctatagattctgtagcatttgagtgtggcaatattttaattgtgtatagatttctaagaaccaacactactcagtctcctgctagtctgactcctgaagcatcagcccttgtcatactgtattgactgtgtacgtgcctttcaccttgagcatgcttcaggatttttttttaaaccacagaacttgaatacatgagggaaccagagttcaaagtcctatgcaaccttaggagggggttagagagtctgttttgattgatgttttctgaggccctagaggagtttgtatcaatttgtgagtattaatgtcagtactaccagcactttgccaaaactgtcagagggacccgtttctagagtgagtcccagttacatcaaacagtgacttccagttattccccagtaagtctgagtggttccttcaagctgggtgtctttccagcctttgccagtctagccccagcagggcaccgtgtatgaatgcagtttggtgctgttttagagtatgcctgctccccagccccctgcctggaaccctctgagcaacttgctctgacctataatgtcttaggtgcaacacggaccccaccagagctcttggatacccccctagatccatgtggctttatgtgaggggactgaatgcagacacaccatagcccccttctactactttccctctcgccctgccacctagttccacatggaaccaacaagttgagtgcatccctgttgggtgttttgtgttgagactggctgaaatgaggagactttgaccatgtgacgtgtcaacagactcaaggagacaaccacctcaactgggtcatgtggcatgcctgtgtatgtgtgtaacagaattctgattgttagactgtaatgctattcctctatgggagaaaaaaattaatataaagaaaaacaaataaaaatatatttaaagcacatga

SEQ ID NO: 2542 - DNA, 4184 bp, Homo sapiens
acaatcagctgtttgaacgttccaatttgtgccgtgagccccgccgcagcggccgcacagactcaaagccccgcgggcgagctcagcagcccggagcgaccgcggccccgccgcctcccccgcgagtcccggcgatgcggcccggcctgtgagcggccggcgaccctgggacgccccgccgcacaactacctcaacgccgtgccgcccccctcccgcccccagggaatctctggagattggttcaccttttgtggtcctgaccccttctgtcctcactgtaccttgaagtcctagagtccaataaaatcgctgcctcccagctgtttggatcacagagaggtttttgcactgccatagggcgcccccgtgaggcgcttcgccccccaccatgttccagcgcctctccagcctcttcttcagcaccccctcgccccccgaagaccccgactgcccccgcgccttcgtgtcggaggaggatgaagtggacggctggctcatcattgacctgccggacagctacgcggctccacccagccccggggccgcccctgcccccgcgggccgccctccgcccgcgccctccttgatggacgagagctggtttgttacccctcccgcctgttttacggcagaggggcctggactcggtcccgcccgcctccagagcagtcccctggaggacctcctcatcgagcaccccagcatgtccgtttacgtcaccggcagcaccatagtgctagagcccgggtccccttccccgctcccggacgcggccctgcctgacggcgacctcagcgaaggggaattgacgcccgcccgccgcgagccgcgggccgcgcgccacgccgctcctctcccagcgcgggcggcgctgctggagaaggcgggccaggtgcggcggctgcagcgggcccggcagcgggcagagcgccacgcgctgagcgccaaggcggtgcagcggcagaaccgagcccgcgagagccgtccgcgccggtccaagaaccagagcagcttcatctaccagccgtgccagcgccagttcaactactgagcgtccaccggccgcgccacgaaccccttgccgatcccgatccctgtcgggctcctccgactcctcgggctggacaccgaaacctcccttcttaaagcgtgtgaggttgggtgatagccgttccttccccgacaccctcaatttccccatctctgatcctctaatctgcctctgaacccattcacccttcaccctcactcctggtccccatacccagcatctaatcatccatgccccctactcctggcccctccatcctttcttctctggtccccatccctgtctctccctttcacccttgccctccagtcctctacctctggcctgcccctatttctgaaagcttcttccagtccctgatctggctcattccccaccttcaactcccaccttacatgtctcacactatcccatggttggcattacactcactcctgttcccttattcttcattcccagtaattccctaccaaatggtggggaccctgagcccagctctgaccaggtagagcctgtgcagcctgggctgctgtcattgccctccagtaagggctcagggttttgcttttagtctccccttccttctgccttgggggcggtactctgtggagctgcttaggcctggaaaggtacagtatgtagaagaggactgtgagacgtgagttagagggagaagatggagggaatctagggaacgaggcagcctattggagatgcggacaggacagacacgttgagaagctgcagggagcagggcaccaagggagtgtgcactgtgcttgctcagagaggccaaaccctgctcccaggctgaagcctggagtctgcccccacttcccttttctataatccacccttctgcaggccctgaaatctgaagggcttagttagtaccttgccactctacccccaacacgtcacccgagtagaagctgggcaaggccctaccatcctggccgtctgttcacaagcccaaggtgctagaactagcttaggagacatgcaggccacagggcttctaggcagggaaagggcacacaccctaggtcagcgtgcagagcagtgatgctggaggacacaccatggggtgaagccatcccaaggctgacagctcagtcttcaccttgcctctggccttgtatttcacaccctgctcagtatggctagccagcagtcctgagtaggagtccaggactcccactgtctcaatctgcaaattgttcctatccaggttcagggccttcagggggcctcttttcattttctcccacaggcctctctttctttctaggttgctggggagaaatgggtaccctatgatccccctccccttctcctccagtaaatacctggaagagggaacctgaatccctgggggagacagaaggggcaggggccaccagcctccccttcttgtggtgagactgaattttgggctcagacaccagcaacagcctcttgggatgccctgagttgcttcccatttcctctttctagccgtccttttctagtgtgtgctcactcttcctaggaacttttaagacttcttggtacctatgaacataggtcctcccctcaccccaactctaggtttccaggcctcacagccaagctgaagcttggagaaaactctgcattcccatgagggcaaaggcagctgccctccctgaccctatagccccaggcctcatggggggtatgtggggaagggatggggtatccccatggatgctgggatgaggacagaggaagacctgatggggtctcctattccagggaataagccaaattaacactaaaaacggatcaaagctcccacgccagtccactagggccccagtagttgacagccttgctcctctcccaagttctccttcagaacctagttgcttttattcttccagctaccacttgggcacttcacagccagcctagggtcttcggcacctccaagagctgaatctccctccaacccttcttgcctactcctcactgccagctgggacctaggctcagtcctgtgtggtgcccatgatccttctggtgggggaagagtttaagttatagggcatttggctcaaattttaaaaggccttttgtttacctatatttctggaggctcctgtattctagaacccaatctctcacctgcttggttgcaaggctcatatttttttgtacctttcctatagattctgtagcatttgagtgtggcaatattttaattgtgtatagatttctaagaaccaacactactcagtctcctgctagtctgactcctgaagcatcagcccttgtcatactgtattgactgtgtacgtgcctttcaccttgagcatgcttcaggatttttttttaaaccacagaacttgaatacatgagggaaccagagttcaaagtcctatgcaaccttaggagggggttagagagtctgttttgattgatgttttctgaggccctagaggagtttgtatcaatttgtgagtattaatgtcagtactaccagcactttgccaaaactgtcagagggacccgtttctagagtgagtcccagttacatcaaacagtgacttccagttattccccagtaagtctgagtggttccttcaagctgggtgtctttccagcctttgccagtctagccccagcagggcaccgtgtatgaatgcagtttggtgctgttttagagtatgcctgctccccagccccctgcctggaaccctctgagcaacttgctctgacctataatgtcttaggtgcaacacggaccccaccagagctcttggatacccccctagatccatgtggctttatgtgaggggactgaatgcagacacaccatagcccccttctactactttccctctcgccctgccacctagttccacatggaaccaacaagttgagtgcatccctgttgggtgttttgtgttgagactggctgaaatgaggagactttgaccatgtgacgtgtcaacagactcaaggagacaaccacctcaactgggtcatgtggcatgcctgtgtatgtgtgtaacagaattctgattgttagactgtaatgctattcctctatgggagaaaaaaattaatataaagaaaaacaaataaaaatatatttaaagcacatga

SEQ ID NO: 2543 - DNA, 442 bp, Homo sapiens
tcctcccgtgacccggtagccgctgtgtcggggctgggccctggggaatctctggagattggttcaccttttgtggtcctgaccccttctgtcctcactgtaccttgaagtcctagagtccaataaaatcgctgcctcccagctgtttggatcacagagaggtttttgcactgccatagggcgcccccgtgaggcgcttcgccccccaccatgttccagcgcctctccagcctcttcttcagcaccccctcgccccccgaagaccccgactgcccccgcgccttcgtgtcggaggaggatgaagtggacggctggctcatcattgacctgccggacagctacgcggctccacccagccccggggccgcccctgcccccgcgggccgccctccgcccgcgccctccttgatggacgagagctggtttgttacccctcccgcct

SEQ ID NO: 2544 - DNA, 477 bp, Homo sapiens
actcaaagccccgcgggcgagctcagcagcccggagcgaccgcggccccgccgcctcccccgcgagtcccggcgatgcggcccggcctgtgagcggccggcgaccctgggacgccccgccgcacaactacctcaacgccgtgccgcccccctcccgcccccaggtttttgcactgccatagggcgcccccgtgaggcgcttcgccccccaccatgttccagcgcctctccagcctcttcttcagcaccccctcgccccccgaagaccccgactgcccccgcgccttcgtgtcggaggaggatgaagtggacggctggctcatcattgacctgccggaggggcctggactcggtcccgcccgcctccagagcagtcccctggaggacctcctcatcgagcaccccagcatgtccgtttacgtcaccggcagcaccatagtgctagagcccgggtccccttccccgctcccggacgcgg

SEQ ID NO: 2545 - DNA, 2120 bp, Homo sapiens
cgagcctccggtggaggagagcgccttggaacgccgacctgaaaccatctctgagcccaagacctagtaagtgatgaggggagcgggagccagtccgcacggaggcagtttgataccaggtagccctgcgcgtcctgggacctgccgtggagctgggcggacgatgctgaggcagatctccaagctgcgtagccagaggagcagggcttgcgttgctgctgctgcgcggagttgcgccccagcagcggatctaacactgcaccagactgtcgcttcgaacgtgatttggggtccagggaggaaaagatggaaatgtaatgtttaactcaaatgaaaggaaataagtaagcgagaggtttgaaacaaatgaacgaaggctaaaccttctatcgaaaaatggcaacttggaagtctccttgcttcctgtattgtttatttattctaggccctaggctgaccggccagaataacagtgttgacctaaccaatgaagaaacaactgattccaccacttctaaaatcagcccatctgaagatactcagcaagaaaatggcagcatgttctctctcattacctggaatattgatggattagatctaaacaatctgtcagagagggctcgaggggtgtgttcctacttagctttgtacagcccagatgtgatatttctacaggaagttattcccccatattatagctacctaaagaagagatcaagtaattatgagattattacaggtcatgaagaaggatatttcacagctataatgttgaagaaatcaagagtgaaattaaaaagccaagagattattccttttccaagtaccaaaatgatgagaaaccttttatgtgtgcatgtgaacgtgtcaggaaatgagctttgccttatgacatcccatttggagagcaccagagggcatgctgcggaacgaatgaatcagttaaaaatggttttaaagaaaatgcaagaggctccagagtcagctacagttatatttgcaggagatacaaatctaagggatcgagaggttaccagatgtggtggtttacccaacaacattgtggatgtctgggagtttttgggcaaacctaaacattgccagtatacatgggatacacaaatgaactctaatcttggaataactgctgcttgtaaacttcgttttgatcgaatatttttcagagcagcagcagaagagggacacattattccccgaagtttggaccttcttggattagaaaaactggactgtggtagatttcctagtgatcactggggtcttctgtgcaacttagatataatattgtaaaatgcttttcaagtgtgggttttgccctgattgttgcaaatacaatttccaccttctggaaaggtaggtttgctgtggaggaaataatgtactagatcattgtcacagaaaaaccaactatgatttatggttgtgttttcagaattcaacattaaagattaatgtttatttaaacgaacacattcctgcattcaggatgtgaggccatttaataaaaagggcacaaagcctgtcagagttttcaacggtgcttatagctgccagctggattccaaacaggtaccacattgtctctgagctaatgtttatatttttccattcaggcaccgaaatagttaatatttgaaataagtcttcaaaagaaaacataagagattattgagttcttgggactggatcctttatttcataagttcagatcatcttaaatgaaaatgccatgattatctgcagttaagtagatgacagctattctacatcagacttgatttttgtcagctaattacataattggtaagctataattgaaaccttatggcttaaaattccttaactcctttttgattcatgtttgtagtcatgttgtcaacagaggcaaagttaagcttgatgatggttaaaatcggtttgatagcaccatgggacatttttctaacaaaaataaatgcatgaagagacatagccttttagttttgctaattgtgaaatggaaatgctttacaggaagtaaatgcaaattacttttaagtgtgctttaaagaaaaatattttccccacaagagaaatttaaataaagaattttatttgtt

SEQ ID NO: 2546 - DNA, 2071 bp, Homo sapiens
gcacccaccgccccggcggctcccttgcggcgcagctgcaccagttttccgagagcagcgcatttccccgccgggcggttgatgcgggagcgccatgacacaggcgcctgcgcagagccgcgcgttggcctcctgttccgcttaaaggggcggtgcagaggcggcaggaagatggagttggggagttgcctggagggcgggagggaggcggcggaggaagagggcgagcctgaggtgaaaaagcggcgacttctgtgtgtggagtttgcctcggtcgcaagctgcgatgccgcagtggctcagtgcttcctggccgagaacgactgggagatggaaagggctctgaactcctacttcgagcctccggtggaggagagcgccttggaacgccgacctgaaaccatctctgagcccaagacctatgttgacctaaccaatgaagaaacaactgattccaccacttctaaaatcagcccatctgaagatactcagcaagaaaatggcagcatgttctctctcattacctggaatattgatggattagatctaaacaatctgtcagagagggctcgaggggtgtgttcctacttagctttgtacagcccagatgtgatatttctacaggaagttattcccccatattatagctacctaaagaagagatcaagtaattatgagattattacaggtcatgaagaaggatatttcacagctataatgttgaagaaatcaagagtgaaattaaaaagccaagagattattccttttccaagtaccaaaatgatgagaaaccttttatgtgtgcatgtgaacgtgtcaggaaatgagctttgccttatgacatcccatttggagagcaccagagggcatgctgcggaacgaatgaatcagttaaaaatggttttaaagaaaatgcaagaggctccagagtcagctacagttatatttgcaggagatacaaatctaagggatcgagaggttaccagatgtggtggtttacccaacaacattgtggatgtctgggagtttttgggcaaacctaaacattgccagtatacatgggatacacaaatgaactctaatcttggaataactgctgcttgtaaacttcgttttgatcgaatatttttcagagcagcagcagaagagggacacattattccccgaagtttggaccttcttggattagaaaaactggactgtggtagatttcctagtgatcactggggtcttctgtgcaacttagatataatattgtaaaatgcttttcaagtgtgggttttgccctgattgttgcaaatacaatttccaccttctggaaaggtaggtttgctgtggaggaaataatgtactagatcattgtcacagaaaaaccaactatgatttatggttgtgttttcagaattcaacattaaagattaatgtttatttaaacgaacacattcctgcattcaggatgtgaggccatttaataaaaagggcacaaagcctgtcagagttttcaacggtgcttatagctgccagctggattccaaacaggtaccacattgtctctgagctaatgtttatatttttccattcaggcaccgaaatagttaatatttgaaataagtcttcaaaagaaaacataagagattattgagttcttgggactggatcctttatttcataagttcagatcatcttaaatgaaaatgccatgattatctgcagttaagtagatgacagctattctacatcagacttgatttttgtcagctaattacataattggtaagctataattgaaaccttatggcttaaaattccttaactcctttttgattcatgtttgtagtcatgttgtcaacagaggcaaagttaagcttgatgatggttaaaatcggtttgatagcaccatgggacatttttctaacaaaaataaatgcatgaagagacatagccttttagttttgctaattgtgaaatggaaatgctttacaggaagtaaatgcaaattacttttaagtgtgctttaaagaaaaatattttccccacaagagaaatttaaataaagaattttatttgttta

SEQ ID NO: 2547 - DNA, 1690 bp, Homo sapiens
ggggcggtgcagaggcggcaggaagatggagttggggagttgcctggagggcgggagggaggcggcggaggaagagggcgagcctgaggtgaaaaagcggcgacttctgtgtgtggagtttgcctcggtcgcaagctgcgatgccgcagtggctcagtgcttcctggccgagaacgactgggagatggaaagggctctgaactcctacttcgagccgtacagcccagatgtgatatttctacaggaagttattcccccatattatagctacctaaagaagagatcaagtaattatgagattattacaggtcatgaagaaggatatttcacagctataatgttgaagaaatcaagagtgaaattaaaaagccaagagattattccttttccaagtaccaaaatgatgagaaaccttttatgtgtgcatgtgaacgtgtcaggaaatgagctttgccttatgacatcccatttggagagcaccagagggcatgctgcggaacgaatgaatcagttaaaaatggttttaaagaaaatgcaagaggctccagagtcagctacagttatatttgcaggagatacaaatctaagggatcgagaggttaccagatgtggtggtttacccaacaacattgtggatgtctgggagtttttgggcaaacctaaacattgccagtatacatgggatacacaaatgaactctaatcttggaataactgctgcttgtaaacttcgttttgatcgaatatttttcagagcagcagcagaagagggacacattattccccgaagtttggaccttcttggattagaaaaactggactgtggtagatttcctagtgatcactggggtcttctgtgcaacttagatataatattgtaaaatgcttttcaagtgtgggttttgccctgattgttgcaaatacaatttccaccttctggaaaggtaggtttgctgtggaggaaataatgtactagatcattgtcacagaaaaaccaactatgatttatggttgtgttttcagaattcaacattaaagattaatgtttatttaaacgaacacattcctgcattcaggatgtgaggccatttaataaaaagggcacaaagcctgtcagagttttcaacggtgcttatagctgccagctggattccaaacaggtaccacattgtctctgagctaatgtttatatttttccattcaggcaccgaaatagttaatatttgaaataagtcttcaaaagaaaacataagagattattgagttcttgggactggatcctttatttcataagttcagatcatcttaaatgaaaatgccatgattatctgcagttaagtagatgacagctattctacatcagacttgatttttgtcagctaattacataattggtaagctataattgaaaccttatggcttaaaattccttaactcctttttgattcatgtttgtagtcatgttgtcaacagaggcaaagttaagcttgatgatggttaaaatcggtttgatagcaccatgggacatttttctaacaaaaataaatgcatgaagagacatagccttttagttttgctaattgtgaaatggaaatgctttacaggaagtaaatgcaaattacttttaagtgtgctttaaagaaaaatattttccccacaagagaaatttaaataaagaattttatttgttt

SEQ ID NO: 2548 - DNA, 1989 bp, Homo sapiens
atgcgggagcgccatgacacaggcgcctgcgcagagccgcgcgttggcctcctgttccgcttaaaggggcggtgcagaggcggcaggaagatggagttggggagttgcctggagggcgggagggaggcggcggaggaagagggcgagcctgaggtgaaaaagcggcgacttctgtgtgtggagtttgcctcggtcgcaagctgcgatgccgcagtggctcagtgcttcctggccgagaacgactgggagatggaaagggctctgaactcctacttcgagcctccggtggaggagagcgccttggaacgccgacctgaaaccatctctgagcccaagacctatgttgacctaaccaatgaagaaacaactgattccaccacttctaaaatcagcccatctgaagatactcagcaagaaaatggcagcatgttctctctcattacctggaatattgatggattagatctaaacaatctgtcagagagggctcgaggggtgtgttcctacttagctttgtacagcccagatgtgatatttctacaggaagttattcccccatattatagctacctaaagaagagatcaagtaattatgagattattacaggtcatgaagaaggatatttcacagctataatgttgaagaaatcaagagtgaaattaaaaagccaagagattattccttttccaagtaccaaaatgatgagaaaccttttatgtgtgcatgtgaacgtgtcaggaaatgagctttgccttatgacatcccatttggagagcaccagagggcatgctgcggaacgaatgaatcagttaaaaatggttttaaagaaaatgcaagaggctccagagtcagctacagttatatttgcaggagatacaaatctaagggatcgagaggttaccagatgtggtggtttacccaacaacattgtggatgtctgggagtttttgggcaaacctaaacattgccagtatacatgggatacacaaatgaactctaatcttggaataactgctgcttgtaaacttcgttttgatcgaatatttttcagagcagcagcagaagagggacacattattccccgaagtttggaccttcttggattagaaaaactggactgtggtagatttcctagtgatcactggggtcttctgtgcaacttagatataatattgtaaaatgcttttcaagtgtgggttttgccctgattgttgcaaatacaatttccaccttctggaaaggtaggtttgctgtggaggaaataatgtactagatcattgtcacagaaaaaccaactatgatttatggttgtgttttcagaattcaacattaaagattaatgtttatttaaacgaacacattcctgcattcaggatgtgaggccatttaataaaaagggcacaaagcctgtcagagttttcaacggtgcttatagctgccagctggattccaaacaggtaccacattgtctctgagctaatgtttatatttttccattcaggcaccgaaatagttaatatttgaaataagtcttcaaaagaaaacataagagattattgagttcttgggactggatcctttatttcataagttcagatcatcttaaatgaaaatgccatgattatctgcagttaagtagatgacagctattctacatcagacttgatttttgtcagctaattacataattggtaagctataattgaaaccttatggcttaaaattccttaactcctttttgattcatgtttgtagtcatgttgtcaacagaggcaaagttaagcttgatgatggttaaaatcggtttgatagcaccatgggacatttttctaacaaaaataaatgcatgaagagacatagccttttagttttgctaattgtgaaatggaaatgctttacaggaagtaaatgcaaattacttttaagtgtgctttaaagaaaaatattttccccacaagagaaatttaaataaagaattttatttgttt

SEQ ID NO: 2549 - DNA, 3130 bp, Homo sapiens
ggagagcgcgccacagaacgacttttacgcaggcgcagaagcctgtttcccctcacccgcggcttccaccctgcgcaggcgcaaaaagccgcgctggcaacctccgcagcggtcgcgcgcacccttcatccctcttgctgcttttgtctggcacaaccttctcaggccctccgcgaggccggccctttttttctttcactttccccacccggagagccaggtgccgagaactaggacctcgtccccttctctatcccttcccctgatccatctcgtctctgttctccttcccttttccgttcccgaagccggaaggagccgaggtacccacggaaaaagtcgaagctgtccccggagagtgaggccttcacgaagcggtggcggaaggagccgaagttctctgatcggaggcgtgagcaagtggcatctccggaaagagccgaaacacggactcgagcttaatcccaggaggggcccgagggcgagatccggaaatctccggaaagagccgaaggccgggacggttaggattgtcggaagtggccgattgcttggacagggccggcggagaagatcggagcaagtccgtggaagaagccaaagactgggacggattgaattgttggaagaacccgaactcgcagaggggactgggcgcagtggcacacgaggacacacggaaacctccgaacgttgaggagataatctcggaaaagttacggaaacctgggaagtcggcgaaaccctacgttcgggtgttttcggaagcagccgaagcggccgcctgcttcgccttcgtccagtatccggagatagccgaggcgcttcggagccaggctcggggggaggggcaagctcgcgggcgggcgggcgggtgagggggcggagcccgggcggggcggggagggctgccggaggcttgattaggtaggaggtggcgaagcgccggcggcggccggaagtagccgaagccagcggcggaagtagccgaagcggctggagcgggcggcaaggcgaggcgaaagctgcacagggccctacgcggccgcctcagcatgtcggacttcgacgagttcgagcggcagctcaacgagaataaacaagagcgggacaaggagaaccggcatcggaagcgcagccacagccgctctcggagccgggaccgcaaacgccggagccggagccgcgaccggcgcaaccgggaccagcggagcgcctcccgggacaggcgacgacgcagcaaacctttgaccagaggcgctaaagaggagcacggtggactgattcgttccccccgccacgagaagaagaagaaggtccgtaaatactgggacgtgccacccccaggctttgagcacatcaccccaatgcagtacaaggccatgcaagctgcgggtcagattccagccactgctcttctccccaccatgacccctgacggtctggctgtgaccccaacgccggtgcccgtggtcgggagccagatgaccagacaagcccggcgcctctacgtgggcaacatcccctttggcatcactgaggaggccatgatggatttcttcaacgcccagatgcgcctgggggggctgacccaggcccctggcaacccagtgttggctgtgcagattaaccaggacaagaattttgcctttttggagttccgctcagtggacgagactacccaggctatggcctttgatggcatcatcttccagggccagtcactaaagatccgcaggcctcacgactaccagccgcttcctggcatgtcagagaacccctccgtctatgtgcctggggttgtgtccactgtggtccccgactctgcccacaagctgttcatcgggggcttacccaactacctgaacgatgaccaggtcaaagagctgctgacatcctttgggcccctcaaggccttcaacctggtcaaggacagtgccacggggctctccaagggctacgccttctgtgagtacgtggacatcaacgtcacggatcaggccattgcggggctgaacggcatgcagctgggggataagaagctgctggtccagagggcgagtgtgggagccaagaatgccacgctggtgagccccccgagcaccatcaatcagacgcctgtgaccctgcaagtgccgggcttgatgagctcccaggtgcagatgggcggccacccgactgaggtcctgtgcctcatgaacatggtgctgcctgaggagctgctggacgacgaggagtatgaggagatcgtggaggacgtgcgggacgagtgcagcaagtacgggcttgtcaagtccatcgagatcccccggcctgtggacggcgtcgaggtgcccggctgcggaaagatctttgtggagttcacctctgtgtttgactgccagaaagccatgcagggcctgacgggccgcaagttcgccaacagagtggttgtcacaaaatactgtgaccccgactcttatcaccgccgggacttctggtagaggcggctgggggagggtgggggcagggctggctgggggcttctccccactcccgccccccccttatccccctctgaagacgatgggcagaggagtgacagccgcagacacacgacagccggcagcaactggaatggcagcaattaagggtggggggcgggggttggggggttggggggttagggcagggaggggactggggaagtgcgcacacagcccacacagacaacacgcacccacacagacacagagggaaggggttgggatggggacagggtgcacagcagggcggggtaggaccccagcccctcccaaaacagcctctccttctcccatagacccctttcttctccccttccccacggtaggaacatagcgtgtttatattttatggccaaactattttgaattttgttgtccggccctcagtgccctgccctctcccttaccaggaccacagctctgttccttcggcctctggtcctctctggtcccctcctgggtttcttacgtagttgatttttcctctttagtctcccccgacctgcgcccagccccgtggcccctgcccctctcctactctctgtggcagtttcatatttgctaagacgaatttgctcattaaacattttgttgtattttacttt

SEQ ID NO: 2550 - DNA, 7464 bp, Homo sapiens
gccttgcaggcgcctctggcgggcttcactgagatccgctctttcggtgctcgactcgcccgtgctgctgccgccgccgaaggaggggcaaagctcaagatggcggacaaaacgccaggcggatctcagaaggccagttcaaagacgagatcatcagatgttcattcatctggatcttcagatgcacatatggatgcatctggaccctcagatagtgatatgccaagtcggacacgacctaagagcccaagaaaacataattataggaatgaaagtgcccgtgaaagcctttgtgattctcctcatcagaatctctcaagacctcttctggaaaacaaacttaaagcattcagtattggaaaaatgagtacagctaagcgaactttaagtaaaaaggaacaggaagaattaaagaaaaaggaggatgaaaaggcagctgctgagatttatgaggagtttcttgctgcttttgaaggaagtgatggtaataaagtgaaaacatttgtgcgagggggtgttgttaatgcagctaaagaagaacatgaaacagatgaaaaaagaggtaaaatctataagccatcttcaagatttgcagatcaaaaaaatcctccaaatcagtcttccaatgaaagaccaccatctcttcttgtgatagaaaccaaaaaacctccacttaaaaaaggagagaaagaaaagaaaaaaagcaatttggaactcttcaaagaagaattaaagcaaattcaagaggaacgtgatgagagacataaaacaaaaggcagattaagtcgatttgaacctcctcagtcagattctgatggtcagcgtcgttctatggacgcgccttcaagaagaaatagatcatctggtgttcttgatgattacgcacctggctcacatgatgtaggagatccaagcactactaatttataccttggaaacattaatccacagatgaatgaagaaatgctgtgccaagaatttggaagatttggaccgttagccagtgtgaaaatcatgtggcctagaactgatgaagaaagagccagagagagaaattgcggctttgtggcctttatgaatagaagagatgctgaaagagctttaaaaaatttgaatggaaaaatgattatgtcttttgaaatgaagttaggttggggtaaagctgtacctattcctccacatccaatatacattccgccttctatgatggaacatacgcttcccccacctccatccggactgccttttaatgcgcagcctagagagcggttaaaaaaccctaatgctcctatgttaccgccacctaaaaacaaagaggattttgagaagactctgtcgcaagccatagtcaaagtggttatcccaacagaaaggaatttgctcgccctgatacatcgaatgatagagtttgttgtacgtgaagggccaatgtttgaagctatgattatgaacagagaaatcaacaatcctatgttcaggttcttatttgaaaaccagacaccagcccatgtttactataggtggaagctttattctattctgcagggagattctccaactaaatggcggacggaagattttcgtatgttcaaaaatggatctttttggaggccaccaccattaaatccgtacttgcatggaatgtcagaagagcaagaaacagaagcttttgtagaggaacctagtaaaaagggagcacttaaggaagaacagagggataaattggaagaaatcttgcggggattaactccaaggaaaaatgatattggagatgcaatggttttctgtcttaataatgctgaagctgctgaagaaatagtggattgcattactgagtcgttgtccatcttaaagacaccccttcctaaaaagattgccagattatatttggtttctgatgttttgtacaactcttcagccaaagttgctaatgcttcatattatagaaaattttttgaaacaaagttatgtcagatattttcagacctcaatgccacctatcgtacaattcaaggccatttacaatctgaaaactttaagcaacgggtaatgacttgcttcagagcatgggaagattgggcaatttatccagaaccatttttgatcaaactacaaaatattttcttaggacttgtaaatattattgaagaaaaggaaacagaggatgttccagatgaccttgatggtgcccccatcgaggaagagcttgatggtgcacctctggaagatgtagatggaattcctattgatgctactcccatcgatgatcttgatggagtccctataaaaagtcttgatgatgatcttgatggagtgcctttggatgcaactgaagactcaaaaaagaatgagcctatatttaaagttgccccatcaaaatgggaagctgtggatgaatctgaattggaagcacaggctgttacaacttctaaatgggaattatttgaccagcatgaagaatcagaagaagaagaaaatcaaaatcaagaagaagaaagtgaagatgaagaagatactcaaagttccaaatctgaagaacatcatttgtactctaatccaatcaaagaagaaatgactgagtctaagttctctaagtactctgaaatgagtgaggaaaaacgagccaaacttcgtgaaattgagctcaaagttatgaagtttcaggatgaattggaatctgggaaaagacctaaaaaaccaggccagagttttcaggagcaagtagaacactacagagataaacttcttcaacgagagaaagagaaagagttagaaagagaacgagaaagagacaagaaagataaagaaaaattggaatctcgctccaaagacaagaaggaaaaagatgagtgtactccgacaaggaaggaaaggaagaggcgacacagtacatcccccagcccatctcgcagtagcagtggtagacgagtgaaatccccatcaccaaaatcggagcgatcagagcgttcagaaagatctcataaagagagctcacggtccaggtcatctcacaaagattctcctagagatgttagcaaaaaagccaaaagatcaccatctggttcaaggacacctaaaaggtctaggcgatcacggtctagatctcctaaaaaatcaggaaagaagtccagatcccagtccagatctccacacaggtctcataaaaagtcaaagaaaaacaaacactgacgtaaatttttaagatgctgtcacttattggaaatgcgatttgttttgtgcctgaacggtctgttttttaaaaaaacaaaaaatcaaatgaaagagcattcctggggttttttgtttgtttgtgtatgcatgtgtaaactcatgagcaactgcatctgtagatctgtcattgttttatattgtgtaaattactttcattgtggctatttctcaagatgaaatttttattgttctaatggatttcatcagaaatgtgtataatggatctgctgacagtagtagtattttgttttaggatgttgtgacttagcaaaaataatacagatgtcttccccccttttgtagctttgacaatttgaattagatttcaaataaaatctgaacagaaaactataatgttgtttttttgccccaccggtgatattaagtcccttaaagtcctactgagtttcacactactgttgtgcttcttatacctgatgcactttataagccccagtgttcaagtagcttaagttttatatttactaagatgactatccaaattaagggacctgagactcctatttggtggtttgctaaccatttgcttttgataagtttctcttgggtaatactaatacccagatatcaaagactaggtagatatggcatggcgttttgttagtggaatgcctggctaaaacatttttttcacagaagcaatatgatttccatacatccaacccatgttctgagcaactacttacttttagggggaaattaaatatcttttcatttcctcttctattatgaaagaagtttatttgtaaaacaaattttctaacaaggtttggccatagaattctcttgtatgatcgttgaccttttataatcttctgtaggctatctttcaaacactggcatcagaatattttttataagtttgtgtttaaacagcttagttggtccccccccactcccaagagacttgggtttagttatagctttaagtaaaatttaaaaataaaatgtttttcaggaaacttcgtatctaatggtttgtaaattcaaggtgcaaaaagttgatttaaaccatttgcagagttgaactctattatgaaaataaatttgctacggtatgaggaagaaataaaacttgtgtaatgttggtcataatactgctataaatataataaagggttatgtagaattgaactgacactattatttgtgaatcttgatttcagttttttatgtaggcacttcatacactggtttgatgggttttttttttcctccctaaaagagaaagtagaaaactattctaacaatggattattttgatttagcttgctttttaaaaaaatcttttcaacttgttttacttaatcttgcctagtcacaaaataagatgtgcacccatggtttggagagttcctatattagctgagcagtgagatacactatttccaaacggtgcacacctacagtagctttggaaatgagccaatcactgttttacttaatggttcttatcagcatgcaaatattgcttgaaagttatttccttattcactgttttgttagtccattttgttaggaaacattaattcctaaaaatttgttcagaataattaaaagtgaacatttggtgctgatactcaaaaacctacaaatgtagccatttaaaaagtaacatgtttttctcccctgctcattgcctgggagaatggaattttatataactacctttctttgcaaaaataacggtcgtgtcgagttggtggtgattttggcattccatcttgcactggtttctagtataggcttagaaataattggtcaggtaataatctttccagtcaagttgcaagggatgcttatttctcttcaaaaaaagacatcctgcgggattgagtagaaaattttaggtcagttttgggtgcttatttgtaatatttttcctactacattggagtttagcagttctttttttctggatccagatacaagtgtcatggtttatcttacagtgggtgaaactgactttcttttggttgggtgggtgaggatttcttaggcctgatagaatatatattctgtgaagtttgttaatgtacatattagattgtattggatttttttttcttgaattgcaaatggtattattagataggttatttccagttttacttcatgacaaattacctagagtaaacctacttaatactcccatggattctatgaaagtttaatgggatcagaaattggtgacttataagggggaagatattctaccatatttttataatagcttattattcatgtttcttgtctgaaggacactcaagttacagagcaaaatttctataggttgactagaatgttcataagcatggtcttccagttgcaggaaagatcatgttctatctgtggacacttactgtcctctaccacagctacgtgccagagttgttttccacagttcttataaagggcatgacttaggctctttaccctccaacttaatgtttatacacagggattgtttactaggttaatgacatttaactcccctctcttctgtaggtgagagaaaataagtaagtcttgatctgtttcttaccaaagagagacagacctatgatggaaaatgatcacgtctctgaattttttctttaacgttatagttccttattacagatagtaagcatatgggaatttctgagctataacatgttgagaagttagaaattaaaactaacacaacaaaaggcgctgaatcaaaagatctttgcttttatttggctcagaatgtttttggcttttctgctaaagatggcagaaattactctacacagacctgatttttctttattgcagaccattcttgtgggcttaccctgagacttttatcccaattagtgaatcttggagggaatacttgcttatttatgacttaggtatttccccccaaactttaatattcttgagcacttgaaaatacttttgagaaattttaactgtgattaaatttaggtttattagaaatattctgtacacatttgcctccatggtggcgtaagttctgaaaaattatatgaccgtgacaatagtttatcatcatcattattgttattcaaaataagggtaaataaatctctgtattgccaaagtgacttaaactgttctgatgaccacacagtgtgatttctttagcagagaaagttggttttaaaaataaatagtaccacttttctaagactgtacagtttacaaataaggtttttttctttgttgttttcctcttctattaagttttagtgaaaagcctaattacagaaaattgtgcagatactagtgaagatactagtataagtttaaaggaacacgtgactgtaaaatctcacatttacaaagtgcttgatctcttcatatttcacacgcatgttttagaatagattttagggagtgtttaattcattatccttttgacttaaaatttttgttaccaacttcctaggacttagataatatataaataagtacaaatcccaggggaagtgttgtgatgctagactaaaaggtgggaatgtgctgctgttccgtgagccttgttccattgttgaaaatttgatgcctcagtgtttattcagtaccacctcatggagcttcaatgtaaatggattatatgtataattggtaatttgtatagttttgtagattgtagattaaatgcactcatcatgtcacatgtaattgtgcttggagtatttgtgttttattcttttacttcaacgggttcttgtctgttacatctctggtgatttgaaatatcaggaaagacagtttgtcagaaatgagaataatatagttgaaatcagttgggctaaaatattctacagcaagacaatttcttttgggtgaactgattctataatttacttacttttaatgtaaggattagatttattgttgagctgctttccagatcagactgtcactttatagtttttctacataaagattatatagttgcaaacaaaggttgtgaaatttcccttttgttgtttttgacttttaattaataaaagtacattgttttcatagcaaacttagactgtccatgtaattttctccatattgtttttccgatgcaagcccagttaataattagttttttagcagctttctctcaagtgaaataagtgatgtgacatgtttatcagttatggctaaaatgttacactttacatgtttaaactataatcatatgttttcatgctagatggt

SEQ ID NO: 2551 - DNA, 7420 bp, Homo sapiens
gccttgcaggcgcctctggcgggcttcactgagatccgctctttcggtgctcgactcgcccgtgctgctgccgccgccgaaggaggggcaaagctcaagatggcggacaaaacgccaggcggatctcagaaggccagttcaaagacgagatcatcagatgttcattcatctggatcttcagatgcacatatggatgcatctggaccctcagatagtgatatgccaagtcggacacgacctaagagcccaagaaaacataattataggaatgaaagtgcccgtgaaagcctttgtgattctcctcatcagaatctctcaagacctcttctggaaaacaaacttaaagcattcagtattggaaaaatgagtacagctaagcgaactttaagtaaaaaggaacaggaagaattaaagaaaaaggaggatgaaaaggcagctgctgagatttatgaggagtttcttgctgcttttgaaggaagtgatggtaataaagtgaaaacatttgtgcgagggggtgttgttaatgcagctaaagaagaacatgaaacagatgaaaaaagaggtaaaatctataagccatcttcaagatttgcagatcaaaaaaatcctccaaatcagtcttccaatgaaagaccaccatctcttcttgtgatagaaaccaaaaaacctccacttaaaaaaggagagaaagaaaagaaaaaaagcaatttggaactcttcaaagaagaattaaagcaaattcaagaggaacgtgatgagagacataaaacaaaaggcagattaagtcgatttgaacctcctcagtcagattctgatggtcagcgtcgttctatggacgcgccttcaagaagaaatagatcatctggtgttcttgatgattacgcacctggctcacatgatgtaggagatccaagcactactaatttataccttggaaacattaatccacagatgaatgaagaaatgctgtgccaagaatttggaagatttggaccgttagccagtgtgaaaatcatgtggcctagaactgatgaagaaagagccagagagagaaattgcggctttgtggcctttatgaatagaagagatgctgaaagagctttaaaaaatttgaatggaaaaatgattatgtcttttgaaatgaagttaggttggggtaaagctgtacctattcctccacatccaatatacattccgccttctatgatggaacatacgcttcccccacctccatccggactgccttttaatgcgcagcctagagagcggttaaaaaaccctaatgctcctatgttaccgccacctaaaaacaaagaggattttgagaaggaatttgctcgccctgatacatcgaatgatagagtttgttgtacgtgaagggccaatgtttgaagctatgattatgaacagagaaatcaacaatcctatgttcaggttcttatttgaaaaccagacaccagcccatgtttactataggtggaagctttattctattctgcagggagattctccaactaaatggcggacggaagattttcgtatgttcaaaaatggatctttttggaggccaccaccattaaatccgtacttgcatggaatgtcagaagagcaagaaacagaagcttttgtagaggaacctagtaaaaagggagcacttaaggaagaacagagggataaattggaagaaatcttgcggggattaactccaaggaaaaatgatattggagatgcaatggttttctgtcttaataatgctgaagctgctgaagaaatagtggattgcattactgagtcgttgtccatcttaaagacaccccttcctaaaaagattgccagattatatttggtttctgatgttttgtacaactcttcagccaaagttgctaatgcttcatattatagaaaattttttgaaacaaagttatgtcagatattttcagacctcaatgccacctatcgtacaattcaaggccatttacaatctgaaaactttaagcaacgggtaatgacttgcttcagagcatgggaagattgggcaatttatccagaaccatttttgatcaaactacaaaatattttcttaggacttgtaaatattattgaagaaaaggaaacagaggatgttccagatgaccttgatggtgcccccatcgaggaagagcttgatggtgcacctctggaagatgtagatggaattcctattgatgctactcccatcgatgatcttgatggagtccctataaaaagtcttgatgatgatcttgatggagtgcctttggatgcaactgaagactcaaaaaagaatgagcctatatttaaagttgccccatcaaaatgggaagctgtggatgaatctgaattggaagcacaggctgttacaacttctaaatgggaattatttgaccagcatgaagaatcagaagaagaagaaaatcaaaatcaagaagaagaaagtgaagatgaagaagatactcaaagttccaaatctgaagaacatcatttgtactctaatccaatcaaagaagaaatgactgagtctaagttctctaagtactctgaaatgagtgaggaaaaacgagccaaacttcgtgaaattgagctcaaagttatgaagtttcaggatgaattggaatctgggaaaagacctaaaaaaccaggccagagttttcaggagcaagtagaacactacagagataaacttcttcaacgagagaaagagaaagagttagaaagagaacgagaaagagacaagaaagataaagaaaaattggaatctcgctccaaagacaagaaggaaaaagatgagtgtactccgacaaggaaggaaaggaagaggcgacacagtacatcccccagcccatctcgcagtagcagtggtagacgagtgaaatccccatcaccaaaatcggagcgatcagagcgttcagaaagatctcataaagagagctcacggtccaggtcatctcacaaagattctcctagagatgttagcaaaaaagccaaaagatcaccatctggttcaaggacacctaaaaggtctaggcgatcacggtctagatctcctaaaaaatcaggaaagaagtccagatcccagtccagatctccacacaggtctcataaaaagtcaaagaaaaacaaacactgacgtaaatttttaagatgctgtcacttattggaaatgcgatttgttttgtgcctgaacggtctgttttttaaaaaaacaaaaaatcaaatgaaagagcattcctggggttttttgtttgtttgtgtatgcatgtgtaaactcatgagcaactgcatctgtagatctgtcattgttttatattgtgtaaattactttcattgtggctatttctcaagatgaaatttttattgttctaatggatttcatcagaaatgtgtataatggatctgctgacagtagtagtattttgttttaggatgttgtgacttagcaaaaataatacagatgtcttccccccttttgtagctttgacaatttgaattagatttcaaataaaatctgaacagaaaactataatgttgtttttttgccccaccggtgatattaagtcccttaaagtcctactgagtttcacactactgttgtgcttcttatacctgatgcactttataagccccagtgttcaagtagcttaagttttatatttactaagatgactatccaaattaagggacctgagactcctatttggtggtttgctaaccatttgcttttgataagtttctcttgggtaatactaatacccagatatcaaagactaggtagatatggcatggcgttttgttagtggaatgcctggctaaaacatttttttcacagaagcaatatgatttccatacatccaacccatgttctgagcaactacttacttttagggggaaattaaatatcttttcatttcctcttctattatgaaagaagtttatttgtaaaacaaattttctaacaaggtttggccatagaattctcttgtatgatcgttgaccttttataatcttctgtaggctatctttcaaacactggcatcagaatattttttataagtttgtgtttaaacagcttagttggtccccccccactcccaagagacttgggtttagttatagctttaagtaaaatttaaaaataaaatgtttttcaggaaacttcgtatctaatggtttgtaaattcaaggtgcaaaaagttgatttaaaccatttgcagagttgaactctattatgaaaataaatttgctacggtatgaggaagaaataaaacttgtgtaatgttggtcataatactgctataaatataataaagggttatgtagaattgaactgacactattatttgtgaatcttgatttcagttttttatgtaggcacttcatacactggtttgatgggttttttttttcctccctaaaagagaaagtagaaaactattctaacaatggattattttgatttagcttgctttttaaaaaaatcttttcaacttgttttacttaatcttgcctagtcacaaaataagatgtgcacccatggtttggagagttcctatattagctgagcagtgagatacactatttccaaacggtgcacacctacagtagctttggaaatgagccaatcactgttttacttaatggttcttatcagcatgcaaatattgcttgaaagttatttccttattcactgttttgttagtccattttgttaggaaacattaattcctaaaaatttgttcagaataattaaaagtgaacatttggtgctgatactcaaaaacctacaaatgtagccatttaaaaagtaacatgtttttctcccctgctcattgcctgggagaatggaattttatataactacctttctttgcaaaaataacggtcgtgtcgagttggtggtgattttggcattccatcttgcactggtttctagtataggcttagaaataattggtcaggtaataatctttccagtcaagttgcaagggatgcttatttctcttcaaaaaaagacatcctgcgggattgagtagaaaattttaggtcagttttgggtgcttatttgtaatatttttcctactacattggagtttagcagttctttttttctggatccagatacaagtgtcatggtttatcttacagtgggtgaaactgactttcttttggttgggtgggtgaggatttcttaggcctgatagaatatatattctgtgaagtttgttaatgtacatattagattgtattggatttttttttcttgaattgcaaatggtattattagataggttatttccagttttacttcatgacaaattacctagagtaaacctacttaatactcccatggattctatgaaagtttaatgggatcagaaattggtgacttataagggggaagatattctaccatatttttataatagcttattattcatgtttcttgtctgaaggacactcaagttacagagcaaaatttctataggttgactagaatgttcataagcatggtcttccagttgcaggaaagatcatgttctatctgtggacacttactgtcctctaccacagctacgtgccagagttgttttccacagttcttataaagggcatgacttaggctctttaccctccaacttaatgtttatacacagggattgtttactaggttaatgacatttaactcccctctcttctgtaggtgagagaaaataagtaagtcttgatctgtttcttaccaaagagagacagacctatgatggaaaatgatcacgtctctgaattttttctttaacgttatagttccttattacagatagtaagcatatgggaatttctgagctataacatgttgagaagttagaaattaaaactaacacaacaaaaggcgctgaatcaaaagatctttgcttttatttggctcagaatgtttttggcttttctgctaaagatggcagaaattactctacacagacctgatttttctttattgcagaccattcttgtgggcttaccctgagacttttatcccaattagtgaatcttggagggaatacttgcttatttatgacttaggtatttccccccaaactttaatattcttgagcacttgaaaatacttttgagaaattttaactgtgattaaatttaggtttattagaaatattctgtacacatttgcctccatggtggcgtaagttctgaaaaattatatgaccgtgacaatagtttatcatcatcattattgttattcaaaataagggtaaataaatctctgtattgccaaagtgacttaaactgttctgatgaccacacagtgtgatttctttagcagagaaagttggttttaaaaataaatagtaccacttttctaagactgtacagtttacaaataaggtttttttctttgttgttttcctcttctattaagttttagtgaaaagcctaattacagaaaattgtgcagatactagtgaagatactagtataagtttaaaggaacacgtgactgtaaaatctcacatttacaaagtgcttgatctcttcatatttcacacgcatgttttagaatagattttagggagtgtttaattcattatccttttgacttaaaatttttgttaccaacttcctaggacttagataatatataaataagtacaaatcccaggggaagtgttgtgatgctagactaaaaggtgggaatgtgctgctgttccgtgagccttgttccattgttgaaaatttgatgcctcagtgtttattcagtaccacctcatggagcttcaatgtaaatggattatatgtataattggtaatttgtatagttttgtagattgtagattaaatgcactcatcatgtcacatgtaattgtgcttggagtatttgtgttttattcttttacttcaacgggttcttgtctgttacatctctggtgatttgaaatatcaggaaagacagtttgtcagaaatgagaataatatagttgaaatcagttgggctaaaatattctacagcaagacaatttcttttgggtgaactgattctataatttacttacttttaatgtaaggattagatttattgttgagctgctttccagatcagactgtcactttatagtttttctacataaagattatatagttgcaaacaaaggttgtgaaatttcccttttgttgtttttgacttttaattaataaaagtacattgttttcatagcaaacttagactgtccatgtaattttctccatattgtttttccgatgcaagcccagttaataattagttttttagcagctttctctcaagtgaaataagtgatgtgacatgtttatcagttatggctaaaatgttacactttacatgtttaaactataatcatatgttttcatgctagatggt

SEQ ID NO: 2552 - DNA, 7297 bp, Homo sapiens
ggttggcgttgggataagagggcgcctctggcgggcttcactgagatccgctctttcggtgctcgactcgcccgtgctgctgccgccgccgaaggaggggcaaagctcaagatggcggacaaaacgccaggcggatctcagaaggccagttcaaagacgagatcatcagatgttcattcatctggatcttcagatgcacatatggatgcatctggaccctcagatagtgatatgccaagtcggacacgacctaagagcccaagaaaacataattataggaatgaaagtgcccgtgaaagcctttgtgattctcctcatcagaatctctcaagacctcttctggaaaacaaacttaaagcattcagtattggaaaaatgagtacagctaagcgaactttaagtaaaaaggaacaggaagaattaaagaaaaaggaggatgaaaaggcagctgctgagatttatgaggagtttcttgctgcttttgaaggaagtgatggtaataaagtgaaaacatttgtgcgagggggtgttgttaatgcagctaaagaagaacatgaaacagatgaaaaaagaggtaaaatctataagccatcttcaagatttgcagatcaaaaaaatcctccaaatcagtcttccaatgaaagaccaccatctcttcttgtgatagaaaccaaaaaacctccacttaaaaaaggagagaaagaaaagaaaaaaagcaatttggaactcttcaaagaagaattaaagcaaattcaagaggaacgtgatgagagacataaaacaaaaggcagattaagtcgatttgaacctcctcagtcagattctgatggtcagcgtcgttctatggacgcgccttcaagaagaaatagatcatctggtgttcttgatgattacgcacctggctcacatgatgtaggagatccaagcactactaatttataccttggaaacattaatccacagatgaatgaagaaatgctgtgccaagaatttggaagatttggaccgttagccagtgtgaaaatcatgtggcctagaactgatgaagaaagagccagagagagaaattgcggctttgtggcctttatgaatagaagagatgctgaaagagctttaaaaaatttgaatggaaaaatgattatgtcttttgaaatgaagttaggttggggtaaagctgtacctattcctccacatccaatatacattccgccttctatgatggaacatacgcttcccccacctccatccggactgccttttaatgcgcagcctagagagcggttaaaaaaccctaatgctcctatgttaccgccacctaaaaacaaagaggattttgagaagactctgtcgcaagccatagtcaaagtggttatcccaacagaaaggaatttgctcgccctgatacatcgaatgatagagtttgttgtacgtgaagggccaatgtttgaagctatgattatgaacagagaaatcaacaatcctatgttcaggttcttatttgaaaaccagacaccagcccatgtttactataggtggaagctttattctattctgcagggagattctccaactaaatggcggacggaagattttcgtatgttcaaaaatggatctttttggaggccaccaccattaaatccgtacttgcatggaatgtcagaagagcaagaaacagaagcttttgtagaggaacctagtaaaaagggagcacttaaggaagaacagagggataaattggaagaaatcttgcggggattaactccaaggaaaaatgatattggagatgcaatggttttctgtcttaataatgctgaagctgctgaagaaatagtggattgcattactgagtcgttgtccatcttaaagacaccccttcctaaaaagattgccagattatatttggtttctgatgttttgtacaactcttcagccaaagttgctaatgcttcatattatagaaaattttttgaaacaaagttatgtcagatattttcagacctcaatgccacctatcgtacaattcaaggccatttacaatctgaaaactttaagcaacgggtaatgacttgcttcagagcatgggaagattgggcaatttatccagaaccatttttgatcaaactacaaaatattttcttaggacttgtaaatattattgaagaaaaggaaacagaggatgttccagatgaccttgatggtgcccccatcgaggaagagcttgatggtgcacctctggaagatgtagatggaattcctattgatgctactcccatcgatgatcttgatggagtccctataaaaagtcttgatgatgatcttgatggagtgcctttggatgcaactgaagactcaaaaaagaatgagcctatatttaaagttgccccatcaaaatgggaagctgtggatgaatctgaattggaagcacaggctgttacaacttctaaatgggaattatttgaccagcatgaagaatcagaagaagaagaaaatcaaaatcaagaagaagaaagtgaagatgaagaagatactcaaagttccaaatctgaagaacatcatttgtactctaatccaatcaaagaagaaatgactgagtctaagttctctaagtactctgaaatgagtgaggaaaaacgagccaaacttcgtgaaattgagctcaaagttatgaagtttcaggatgaattggaatctgggaaaagacctaaaaaaccaggccagagttttcaggagcaagtagaacactacagagataaacttcttcaacgagagaaagagaaagagttagaaagagaacgagaaagagacaagaaagataaagaaaaattggaatctcgctccaaagacaagaaggaaaaagatgagtgtactccgacaaggaaggaaaggaagaggcgacacagtacatcccccagcccatctcgcagtagcagtggtagacgagtgaaatccccatcaccaaaatcggagcgatcagagcgttcagaaagatctcataaagagagctcacggtccaggtcatctcacaaagattctcctagagatgttagcaaaaaagccaaaagatcaccatctggttcaaggacacctaaaaggtctaggcgatcacggtctagatctcctaaaaaatcaggaaagaagtccagatcccagtccagatctccacacaggtctcataaaaagtcaaagaaaaacaaacactgacgtaaatttttaagatgctgtcacttattggaaatgcgatttgttttgtgcctgaacggtctgttttttaaaaaaacaaaaaatcaaatgaaagagcattcctggggttttttgtttgtttgtgtatgcatgtgtaaactcatgagcaactgcatctgtagatctgtcattgttttatattgtgtaaattactttcattgtggctatttctcaagatgaaatttttattgttctaatggatttcatcagaaatgtgtataatggatctgctgacagtagtagtattttgttttaggatgttgtgacttagcaaaaataatacagatgtcttccccccttttgtagctttgacaatttgaattagatttcaaataaaatctgaacagaaaactataatgttgtttttttgccccaccggtgatattaagtcccttaaagtcctactgagtttcacactactgttgtgcttcttatacctgatgcactttataagccccagtgttcaagtagcttaagttttatatttactaagatgactatccaaattaagggacctgagactcctatttggtggtttgctaaccatttgcttttgataagtttctcttgggtaatactaatacccagatatcaaagactaggtagatatggcatggcgttttgttagtggaatgcctggctaaaacatttttttcacagaagcaatatgatttccatacatccaacccatgttctgagcaactacttacttttagggggaaattaaatatcttttcatttcctcttctattatgaaagaagtttatttgtaaaacaaattttctaacaaggtttggccatagaattctcttgtatgatcgttgaccttttataatcttctgtaggctatctttcaaacactggcatcagaatattttttataagtttgtgtttaaacagcttagttggtccccccccactcccaagagacttgggtttagttatagctttaagtaaaatttaaaaataaaatgtttttcaggaaacttcgtatctaatggtttgtaaattcaaggtgcaaaaagttgatttaaaccatttgcagagttgaactctattatgaaaataaatttgctacggtatgaggaagaaataaaacttgtgtaatgttggtcataatactgctataaatataataaagggttatgtagaattgaactgacactattatttgtgaatcttgatttcagttttttatgtaggcacttcatacactggtttgatgggttttttttttcctccctaaaagagaaagtagaaaactattctaacaatggattattttgatttagcttgctttttaaaaaaatcttttcaacttgttttacttaatcttgcctagtcacaaaataagatgtgcacccatggtttggagagttcctatattagctgagcagtgagatacactatttccaaacggtgcacacctacagtagctttggaaatgagccaatcactgttttacttaatggttcttatcagcatgcaaatattgcttgaaagttatttccttattcactgttttgttagtccattttgttaggaaacattaattcctaaaaatttgttcagaataattaaaagtgaacatttggtgctgatactcaaaaacctacaaatgtagccatttaaaaagtaacatgtttttctcccctgctcattgcctgggagaatggaattttatataactacctttctttgcaaaaataacggtcgtgtcgagttggtggtgattttggcattccatcttgcactggtttctagtataggcttagaaataattggtcaggtaataatctttccagtcaagttgcaagggatgcttatttctcttcaaaaaaagacatcctgcgggattgagtagaaaattttaggtcagttttgggtgcttatttgtaatatttttcctactacattggagtttagcagttctttttttctggatccagatacaagtgtcatggtttatcttacagtgggtgaaactgactttcttttggttgggtgggtgaggatttcttaggcctgatagaatatatattctgtgaagtttgttaatgtacatattagattgtattggatttttttttcttgaattgcaaatggtattattagataggttatttccagttttacttcatgacaaattacctagagtaaacctacttaatactcccatggattctatgaaagtttaatgggatcagaaattggtgacttataagggggaagatattctaccatatttttataatagcttattattcatgtttcttgtctgaaggacactcaagttacagagcaaaatttctataggttgactagaatgttcataagcatggtcttccagttgcaggaaagatcatgttctatctgtggacacttactgtcctctaccacagctacgtgccagagttgttttccacagttcttataaagggcatgacttaggctctttaccctccaacttaatgtttatacacagggattgtttactaggttaatgacatttaactcccctctcttctgtaggtgagagaaaataagtaagtcttgatctgtttcttaccaaagagagacagacctatgatggaaaatgatcacgtctctgaattttttctttaacgttatagttccttattacagatagtaagcatatgggaatttctgagctataacatgttgagaagttagaaattaaaactaacacaacaaaaggcgctgaatcaaaagatctttgcttttatttggctcagaatgtttttggcttttctgctaaagatggcagaaattactctacacagacctgatttttctttattgcagaccattcttgtgggcttaccctgagacttttatcccaattagtgaatcttggagggaatacttgcttatttatgacttaggtatttccccccaaactttaatattcttgagcacttgaaaatacttttgagaaattttaactgtgattaaatttaggtttattagaaatattctgtacacatttgcctccatggtggcgtaagttctgaaaaattatatgaccgtgacaatagtttatcatcatcattattgttattcaaaataagggtaaataaatctctgtattgccaaagtgacttaaactgttctgatgaccacacagtgtgatttctttagcagagaaagttggttttaaaaataaatagtaccacttttctaagactgtacagtttacaaataaggtttttttctttgttgttttcctcttctattaagttttagtgaaaagcctaattacagaaaattgtgcagatactagtgaagatactagtataagtttaaaggaacacgtgactgtaaaatctcacatttacaaagtgcttgatctcttcatatttcacacgcatgttttagaatagattttagggagtgtttaattcattatccttttgacttaaaatttttgttaccaacttcctaggacttagataatatataaataagtacaaatcccaggggaagtgttgtgatgctagactaaaaggtgggaatgtgctgctgttccgtgagccttgttccattgttgaaaatttgatgcctcagtgtttattcagtaccacctcatggagcttcaatgtaaatggattatatgtataattggtaatttgtatagttttgtagattgtagattaaatgcactcatcatgtcacatgtaattgtgcttggagtatttgtgttttattcttttacttcaacgggttcttgtctgttacatctctggtgatttgaaatatcaggaaagacagtttgtcagaaatgagaataatatagttgaaatcagttgggctaaaatattctacagcaagacaatttcttttgggtgaactgattctataatttacttacttttaatgtaaggattagatttattgttgagctgctttccagatcagactgtcactttatagtttttctacataaagattatatagttgcaaacaaaggttgtgaaatttcccttttgttgtttttgacttttaattaataaaagtacattgttttcatagcaaa

SEQ ID NO: 2553 - DNA, 3491 bp, Homo sapiens
agctcaagatggcggacaaaacgccaggcggatctcagaaggccagttcaaagacgagatcatcagatgttcattcatctggatcttcagatgcacatatggatgcatctggaccctcagatagtgatatgccaagtcggacacgacctaagagcccaagaaaacataattataggaatgaaagtgcccgtgaaagcctttgtgattctcctcatcagaatctctcaagacctcttctggaaaacaaacttaaagcattcagtattggaaaaatgagtacagctaagcgaactttaagtaaaaaggaacaggaagaattaaagaaaaaggaggatgaaaaggcagctgctgagatttatgaggagtttcttgctgcttttgaaggaagtgatggtaataaagtgaaaacatttgtgcgagggggtgttgttaatgcagctaaagaagaacatgaaacagatgaaaaaagaggtaaaatctataagccatcttcaagatttgcagatcaaaaaaatcctccaaatcagtcttccaatgaaagaccaccatctcttcttgtgatagaaaccaaaaaacctccacttaaaaaaggagagaaagaaaagaaaaaaagcaatttggaactcttcaaagaagaattaaagcaaattcaagaggaacgtgatgagagacataaaacaaaaggcagattaagtcgatttgaacctcctcagtcagattctgatggtcagcgtcgttctatggacgcgccttcaagaagaaatagatcatctgttcttgatgattacgcacctggctcacatgatgtaggagatccaagcactactaatttataccttggaaacattaatccacagatgaatgaagaaatgctgtgccaagaatttggaagatttggaccgttagccagtgtgaaaatcatgtggcctagaactgatgaagaaagagccagagagagaaattgcggctttgtggcctttatgaatagaagagatgctgaaagagctttaaaaaatttgaatggaaaaatgattatgtcttttgaaatgaagttaggttggggtaaagctgtacctattcctccacatccaatatacattccgccttctatgatggaacatacgcttcccccacctccatccggactgccttttaatgcgcagcctagagagcggttaaaaaaccctaatgctcctatgttaccgccacctaaaaacaaagaggattttgagaagactctgtcgcaagccatagtcaaagtggttatcccaacagaaaggaatttgctcgccctgatacatcgaatgatagagtttgttgtacgtgaagggccaatgtttgaagctatgattatgaacagagaaatcaacaatcctatgttcaggttcttatttgaaaaccagacaccagcccatgtttactataggtggaagctttattctattctgcaggcaaattctccaactaaatggcggacggaagattttcgtatgttcaaaaatggatctttttggaggccaccaccattaaatccgtacttgcatggaatgtcagaagagcaagaaacagaagcttttgtagaggaacctagtaaaaagggagcacttaaggaagaacagagggataaattggaagaaatcttgcggggattaactccaaggaaaaatgatattggagatgcaatggttttctgtcttaataatgctgaagctgctgaagaaatagtggattgcattactgagtcgttgtccatcttaaagacaccccttcctaaaaagattgccagattatatttggtttctgatgttttgtacaactcttcagccaaagttgctaatgcttcatattatagaaaattttttgaaacaaagttatgtcagatattttcagacctcaatgccacctatcgtacaattcaaggccatttacaatctgaaaactttaagcaacgggtaatgacttgcttcagagcatgggaagattgggcaatttatccagaaccatttttgatcaaactacaaaatattttcttaggacttgtaaatattattgaagaaaaggaaacagaggatgttccagatgaccttgatggtgcccccatcgaggaagagcttgatggtgcacctctggaagatgtagatggaattcctattgatgctactcccatcgatgatcttgatggagtccctataaaaagtcttgatgatgatcttgatggagtgcctttggatgcaactgaagactcaaaaaagaatgagcctatatttaaagttgccccatcaaaatgggaagctgtggatgaatctgaattggaagcacaggctgttacaacttctaaatgggaattatttgaccagcatgaagaatcagaagaagaagaaaatcaaaatcaagaagaagaaagtgaagatgaagaagatactcaaagttccaaatctgaagaacatcatttgtactctaatccaatcaaagaagaaatgactgagtctaagttctctaagtactctgaaatgagtgaggaaaaacgagccaaacttcgtgaaattgagctcaaagttatgaagtttcaggatgaattggaatctgggaaaagacctaaaaaaccaggccagagttttcaggagcaagtagaacactacagagataaacttcttcaacgagagaaagagaaagagttagaaagagaacgagaaagagacaagaaagataaagaaaaattggaatctcgctccaaagacaagaaggaaaaagatgagtgtactccgacaaggaaggaaaggaagaggcgacacagtacatcccccagcccatctcgcagtagcagtggtagacgagtgaaatccccatcaccaaaatcggagcgatcagagcgttcagaaagatctcataaagagagctcacggtccaggtcatctcacaaagattctcctagagatgttagcaaaaaagccaaaagatcaccatctggttcaaggacacctaaaaggtctaggcgatcacggtctagatctcctaaaaaatcaggaaagaagtccagatcccagtccagatctccacacaggtctcataaaaagtcaaagaaaaacaaacactgacgtaaatttttaagatgctgtcacttattggaaatgcgatttgttttgtgcctgaacggtctgttttttaaaaaaacaaaaaatcaaatgaaagagcattcctggggttttttgtttgtttgtgtatgcatgtgtaaactcatgagcaactgcatctgtagatctgtcattgttttatattgtgtaaattactttcattgtggctatttctcaagatgaaatttttattgttctaatggatttcatcagaaatgtgtataatggatctgctgacagtagtagtattttgttttaggatgttgtgacttagcaaaaataatacagatgtcttccccccttttgtagctttgacaatttgaattagatttcaaataaaatctgaacagaaaactataa

SEQ ID NO: 2554 - DNA, 588 bp, Homo sapiens
tattcagccttgcaggcgcctctggcgggcttcactgagatccgctctttcggtgctcgactcgcccgtgctgctgccgccgccgaaggaggggcaaagctcaagatggcggacaaaacgccaggcggatctcagaaggccagttcaaagacgagatcatcagatgttcattcatctggatcttcagatgcacatatggatgcatctggaccctcagatagtgatatgccaagtcggacacgacctaagagcccaagaaaacataattataggaatgaaagtgcccgtgaaagcctttgtgattctcctcatcagaatctctcaagacctcttctggaaaacaaacttaaagcattcagtattggaaaaatgagtacagctaagcgaactttaagtaaaaaggaacaggaagaattaaagaaaaaggaggatgaaaaggcagctgctgagatttatgaggagtttcttgctgcttttgaaggaagtgatggtaataaagtgaaaacatttgtgcgagggggtgttgttaatgcagctaaagaagaacatgaaacagatgaaaaaagaggtaaaatctataagccatct

SEQ ID NO: 2555 - DNA, 3427 bp, Homo sapiens
aatcttatatcacgtgacaggggcggcgcggcccggggtgtcagtgtggaggagactgagtattctaccttgtaaatactgttatttgtatatactgtaaatgatgacatcggtgggcactaaccgagcccggggaaactgggaacaacctcaaaaccaaaaccagacacagcacaagcagcggccacaggccactgcagaacaaattagacttgcacagatgatttcggaccataatgatgctgactttgaggagaaggtgaaacaattgattgatattacaggcaagaaccaggatgaatgtgtgattgctttgcatgactgcaatggagatgtcaacagagctatcaatgttcttctggaaggaaacccagacacgcattcctgggagatggtcgggaagaagaagggagtctcaggccagaaggatggtggccagacggaatccaatgaggaaggcaaagaaaatcgagaccgggacagagactatagtcggcgacgtggtgggccaccaagacgggggagaggtgccagccgtggacgagagtgtatgcatggggctttatcaaaaccagctgtggttcgaggtcaggaaaatggattggatggcaccaagagtggagggccttctggaagaggaacagaaagaggcagaaggggccgtggccgaggcagaggtggctctggtaggcgaggaggaaggttttctgctcaaggaatgggaacctttaacccagctgattatgcagagccagccaatactgatgataactatggcaatagcagcggcaatacgtggaacaacactggccactttgaaccagatgatgggacgagtgcatggaggactgcaacagaggagtgggggactgaagattggaatgaagatctttctgagaccaagatcttcactgcctctaatgtgtcttcagtgcctctgcctgcggagaatgtgacaatcactgctggtcagagaattgaccttgctgttctgctggggaagacaccatctacaatggagaatgattcatctaatctggatccgtctcaggctccttctctggcccagcctctggtgttcagtaattcgaagcagactgccatatcacagcctgcttcagggaacacattttctcatcacagtatggtgagcatgttagggaaaggatttggtgatgtcggtgaagctaaaggcggcagtactacaggctcccagttcttggagcaattcaagactgcccaagccctggctcagttggcagctcagcattctcagtctggaagcaccaccacctcctcttgggacatgggctcgacgacacaatccccatcactggtgcagtatgatttgaagaacccaagtgattcagcagtgcacagcccctttacaaagcgccaggcttttaccccatcttcaaccatgatggaggtgttccttcaggagaagtcacctgcagtggctacctccacagctgcacctccacctccgtcttctcctctgccaagcaaatccacatcggctccacagatgtcgcctggatcttcagacaaccagtcctctagccctcagccggctcagcagaaactgaaacagcagaagaaaaaagcctccttgacttctaagattcctgctctggctgtggagatgcctggctcagcagatatctcagggctaaacctgcagtttggggcattgcagtttgggtcagagcctgtcctttctgattatgagtccacccccaccacgagcgcctcttcaagccaggctccaagtagcctgtataccagcacggccagtgaatcatcctctacaatttcatctaaccagagtcaggagtctggttatcagagcggcccaattcagtcgacaacctatacctcccaaaataatgctcagggccctctttatgaacagagatccacacagactcggcggtaccccagctccatctcttcatcaccccaaaaggacctgactcaggcaaagaatggcttcagttctgtgcaggccacgcagttacagaccacacaatctgttgaaggtgctacaggctctgcagtgaaatctgattcaccttccacttctagcatcccccctctcaatgaaacggtatctgcagcttccttactgacgacaaccaatcagcattcatcctccttgggtggcttgagccacagtgaggagattccaaatactaccaccacacaacacagcagcacgttatctacgcagcagaataccctttcatcatcaacatcttctgggcgcacttcgacatccactcttttgcacacaagtgtggagagtgaggcgaatctccattcttcctccagcactttttccaccacatccagcacagtctctgcacctcccccagtggtcagtgtctcctccagtctcaatagtggcagtagcctgggcctcagcctaggcagcaactccactgtcacagcctcgactcgaagctcagttgctacgacttcaggaaaagctcctcccaacctccctcctggggtcccgccgttgttgcctaatccgtatattatggctccagggctgttacatgcctacccgccacaagtatatggttatgatgacttgcagatgcttcagacaagatttccattggattactacagcatcccatttcccacacccactactccgctgactgggagggatggtagcctggccagcaacccttattctggtgacctcacaaagttcggccgtggggatgcctcctccccagccccggccacaaccttggcccaaccccaacagaaccagacgcagactcaccataccacgcagcagacattcctgaacccggcgctgcctcctggctacagttacaccagcctgccatactatacaggggtcccgggcctccccagcaccttccagtatgggcctgctgtgttccctgtggctcctacctcttccaagcagcatggtgtgaatgtcagtgtgaatgcatcggccacccctttccaacagccgagtggatatgggtctcatggatacaacactggtgtttcagtcacctccagtaacacgggcgtgccagatatctcgggttctgtgtactccaaaacccagtcctttgagaaacaaggttttcattccggtactcctgctgcttccttcaacttgccttcagccctaggaagtgggggccccatcaatccggccacagctgctgcctacccacctgccccctttatgcacattctgaccccccatcagcagccgcattctcagatccttcaccatcacctgcagcaggatggccaggacatcctcaatttcgtcgatgaccagcttggtgaataagtattactgtaccaactgggcctcctctagcaggcccctgaaggcagtggaataaaatgaaatcttcgccctttaagaactcctgacctt

SEQ ID NO: 2556 - DNA, 3411 bp, Homo sapiens
cccgactaagtgacttaaactcccacctactcctggaataaggagtcaaagcccggataggcgcagtattctaccttgtaaatactgttatttgtatatactgtaaatgatgacatcggtgggcactaaccgagcccggggaaactgggaacaacctcaaaaccaaaaccagacacagcacaagcagcggccacaggccactgcagaacaaattagacttgcacagatgatttcggaccataatgatgctgactttgaggagaaggtgaaacaattgattgatattacaggcaagaaccaggatgaatgtgtgattgctttgcatgactgcaatggagatgtcaacagagctatcaatgttcttctggaaggaaacccagacacgcattcctgggagatggtcgggaagaagaagggagtctcaggccagaaggatggtggccagacggaatccaatgaggaaggcaaagaaaatcgagaccgggacagagactatagtcggcgacgtggtgggccaccaagacgggggagaggtgccagccgtggacgagagtttcgaggtcaggaaaatggattggatggcaccaagagtggagggccttctggaagaggaacagaaagaggcagaaggggccgtggccgaggcagaggtggctctggtaggcgaggaggaaggttttctgctcaaggaatgggaacctttaacccagctgattatgcagagccagccaatactgatgataactatggcaatagcagcggcaatacgtggaacaacactggccactttgaaccagatgatgggacgagtgcatggaggactgcaacagaggagtgggggactgaagattggaatgaagatctttctgagaccaagatcttcactgcctctaatgtgtcttcagtgcctctgcctgcggagaatgtgacaatcactgctggtcagagaattgaccttgctgttctgctggggaagacaccatctacaatggagaatgattcatctaatctggatccgtctcaggctccttctctggcccagcctctggtgttcagtaattcgaagcagactgccatatcacagcctgcttcagggaacacattttctcatcacagtatggtgagcatgttagggaaaggatttggtgatgtcggtgaagctaaaggcggcagtactacaggctcccagttcttggagcaattcaagactgcccaagccctggctcagttggcagctcagcattctcagtctggaagcaccaccacctcctcttgggacatgggctcgacgacacaatccccatcactggtgcagtatgatttgaagaacccaagtgattcagcagtgcacagcccctttacaaagcgccaggcttttaccccatcttcaaccatgatggaggtgttccttcaggagaagtcacctgcagtggctacctccacagctgcacctccacctccgtcttctcctctgccaagcaaatccacatcggctccacagatgtcgcctggatcttcagacaaccagtcctctagccctcagccggctcagcagaaactgaaacagcagaagaaaaaagcctccttgacttctaagattcctgctctggctgtggagatgcctggctcagcagatatctcagggctaaacctgcagtttggggcattgcagtttgggtcagagcctgtcctttctgattatgagtccacccccaccacgagcgcctcttcaagccaggctccaagtagcctgtataccagcacggccagtgaatcatcctctacaatttcatctaaccagagtcaggagtctggttatcagagcggcccaattcagtcgacaacctatacctcccaaaataatgctcagggccctctttatgaacagagatccacacagactcggcggtaccccagctccatctcttcatcaccccaaaaggacctgactcaggcaaagaatggcttcagttctgtgcaggccacgcagttacagaccacacaatctgttgaaggtgctacaggctctgcagtgaaatctgattcaccttccacttctagcatcccccctctcaatgaaacggtatctgcagcttccttactgacgacaaccaatcagcattcatcctccttgggtggcttgagccacagtgaggagattccaaatactaccaccacacaacacagcagcacgttatctacgcagcagaataccctttcatcatcaacatcttctgggcgcacttcgacatccactcttttgcacacaagtgtggagagtgaggcgaatctccattcttcctccagcactttttccaccacatccagcacagtctctgcacctcccccagtggtcagtgtctcctccagtctcaatagtggcagtagcctgggcctcagcctaggcagcaactccactgtcacagcctcgactcgaagctcagttgctacgacttcaggaaaagctcctcccaacctccctcctggggtcccgccgttgttgcctaatccgtatattatggctccagggctgttacatgcctacccgccacaagtatatggttatgatgacttgcagatgcttcagacaagatttccattggattactacagcatcccatttcccacacccactactccgctgactgggagggatggtagcctggccagcaacccttattctggtgacctcacaaagttcggccgtggggatgcctcctccccagccccggccacaaccttggcccaaccccaacagaaccagacgcagactcaccataccacgcagcagacattcctgaacccggcgctgcctcctggctacagttacaccagcctgccatactatacaggggtcccgggcctccccagcaccttccagtatgggcctgctgtgttccctgtggctcctacctcttccaagcagcatggtgtgaatgtcagtgtgaatgcatcggccacccctttccaacagccgagtggatatgggtctcatggatacaacactggaagaaaatatccacccccttacaagcatttctggacggctgagagctaatttggcccaaggctgggggctgtgttttgtgtgtgtgtataaatttgcactgaagtcttgtttcagaaaccagaccactgaggagagcctgctgagctgaggccatggcctgcgtggcttggggaaatgagttggtggataccttctgggcttttgaacttgcccctcccccatttccctctcccccatgtgtctgaccctgtcttacccatttcaagttcaagcggtgcagcaccttcgaagcatcaatgcacacacctgctgttgcttttgatttctggaaggcatgtagtttcaacttgtaacaaaaatatttgtagtcttcaataaactgtggtatttctttagctaac

SEQ ID NO: 2557 - DNA, 3864 bp, Homo sapiens
agtattctaccttgtaaatactgttatttgtatatactgtaaatgatgacatcggtgggcactaaccgagcccggggaaactgggaacaacctcaaaaccaaaaccagacacagcacaagcagcggccacaggccactgcagaacaaattagacttgcacagatgatttcggaccataatgatgctgactttgaggagaaggtgaaacaattgattgatattacaggcaagaaccaggatgaatgtgtgattgctttgcatgactgcaatggagatgtcaacagagctatcaatgttcttctggaaggaaacccagacacgcattcctgggagatggtcgggaagaagaagggagtctcaggccagaaggatggtggccagacggaatccaatgaggaaggcaaagaaaatcgagaccgggacagagactatagtcggcgacgtggtgggccaccaagacgggggagaggtgccagccgtggacgagagtttcgaggtcaggaaaatggattggatggcaccaagagtggagggccttctggaagaggaacagaaagaggcagaaggggccgtggccgaggcagaggtggctctggtaggcgaggaggaaggttttctgctcaaggaatgggaacctttaacccagctgattatgcagagccagccaatactgatgataactatggcaatagcagcggcaatacgtggaacaacactggccactttgaaccagatgatgggacgagtgcatggaggactgcaacagaggagtgggggactgaagattggaatgaagatctttctgagaccaagatcttcactgcctctaatgtgtcttcagtgcctctgcctgcggagaatgtgacaatcactgctggtcagagaattgaccttgctgttctgctggggaagacaccatctacaatggagaatgattcatctaatctggatccgtctcaggctccttctctggcccagcctctggtgttcagtaattcgaagcagactgccatatcacagcctgcttcagggaacacattttctcatcacagtatggtgagcatgttagggaaaggatttggtgatgtcggtgaagctaaaggcggcagtactacaggctcccagttcttggagcaattcaagactgcccaagccctggctcagttggcagctcagcattctcagtctggaagcaccaccacctcctcttgggacatgggctcgacgacacaatccccatcactggtgcagtatgatttgaagaacccaagtgattcagcagtgcacagcccctttacaaagcgccaggcttttaccccatcttcaaccatgatggaggtgttccttcaggagaagtcacctgcagtggctacctccacagctgcacctccacctccgtcttctcctctgccaagcaaatccacatcggctccacagatgtcgcctggatcttcagacaaccagtcctctagccctcagccggctcagcagaaactgaaacagcagaagaaaaaagcctccttgacttctaagattcctgctctggctgtggagatgcctggctcagcagatatctcagggctaaacctgcagtttggggcattgcagtttgggtcagagcctgtcctttctgattatgagtccacccccaccacgagcgcctcttcaagccaggctccaagtagcctgtataccagcacggccagtgaatcatcctctacaatttcatctaaccagagtcaggagtctggttatcagagcggcccaattcagtcgacaacctatacctcccaaaataatgctcagggccctctttatgaacagagatccacacagactcggcggtaccccagctccatctcttcatcaccccaaaaggacctgactcaggcaaagaatggcttcagttctgtgcaggccacgcagttacagaccacacaatctgttgaaggtgctacaggctctgcagtgaaatctgattcaccttccacttctagcatcccccctctcaatgaaacggtatctgcagcttccttactgacgacaaccaatcagcattcatcctccttgggtggcttgagccacagtgaggagattccaaatactaccaccacacaacacagcagcacgttatctacgcagcagaataccctttcatcatcaacatcttctgggcgcacttcgacatccactcttttgcacacaagtgtggagagtgaggcgaatctccattcttcctccagcactttttccaccacatccagcacagtctctgcacctcccccagtggtcagtgtctcctccagtctcaatagtggcagtagcctgggcctcagcctaggcagcaactccactgtcacagcctcgactcgaagctcagttgctacgacttcaggaaaagctcctcccaacctccctcctggggtcccgccgttgttgcctaatccgtatattatggctccagggctgttacatgcctacccgccacaagtatatggttatgatgacttgcagatgcttcagacaagatttccattggattactacagcatcccatttcccacacccactactccgctgactgggagggatggtagcctggccagcaacccttattctggtgacctcacaaagttcggccgtggggatgcctcctccccagccccggccacaaccttggcccaaccccaacagaaccagacgcagactcaccataccacgcagcagacattcctgaacccggcgctgcctcctggctacagttacaccagcctgccatactatacaggggtcccgggcctccccagcaccttccagtatgggcctgctgtgttccctgtggctcctacctcttccaagcagcatggtgtgaatgtcagtgtgaatgcatcggccacccctttccaacagccgagtggatatgggtctcatggatacaacactggtgtttcagtcacctccagtaacacgggcgtgccagatatctcgggttctgtgtactccaaaacccagcagtcctttgagaaacaaggttttcattccggtactcctgctgcttccttcaacttgccttcagccctaggaagtgggggccccatcaatccggccacagctgctgcctacccacctgccccctttatgcacattctgaccccccatcagcagccgcattctcagatccttcaccatcacctgcagcaggatggccagacgggcagcgggcaacgtagccagaccagctccatcccgcagaagccccagaccaacaagtctgcctacaacagctacagctggggggccaactgaggccctgaccctcttctcccggtcccatcttctgagagggcttctcagcctggaaactatggaaacagcatcaaagagaaaggaatgtggggggtttccgctgccccccacccccagcggcccaccccatgcctcagcttcatgtctgtcccattcctataccatccccaccctgttgtatgtattataggatttgtattttctccttttttttcccccttccattccttctcccctcttgcattcaagattatgaaactttgctatgggccctgcacttcctttgcttcctcctgttcaccctggtggtgtacggatgaggcggggaggtgggacccccaaacatatatcagcccaacagccctaagtctccttctttattattaggaaaacaacaacaacaacaaacaaaaaaatggcgtcatgaatatgaacagcattgtcagatgaattagttgaagtggttttttttttgttttttttttttttttgtactgtgtcctcaaatttaatggattaatgtgtcttgtatatataaaaagaaaacctctaccttca

SEQ ID NO: 2558 - DNA, 1120 bp, Homo sapiens
cccggggtgtcagtgtggaggagactgagtattctaccttgtaaatactgttatttgtatatactgtaaatgatgacatcggtgggcactaaccgagcccggggaaactgggaacaacctcaaaaccaaaaccagacacagcacaagcagcggccacaggccactgcagaacaaattagacttgcacagatgatttcggaccataatgatgctgactttgaggagaaggtgaaacaattgattgatattacaggcaagaaccaggatgaatgtgtgattgctttgcatgactgcaatggagatgtcaacagagctatcaatgttcttctggaaggaaacccagacacgcattcctgggagatggtcgggaagaagaagggagtctcaggccagaaggatggtggccagacggaatccaatgaggaaggcaaagaaaatcgagaccgggacagagactatagtcggcgacgtggtgggccaccaagacgggggagaggtgccagccgtggacgagagtgtatgcatggggctttatcaaaaccagctgtggttcgaggtcaggaaaatggattggatggcaccaagagtggagggccttctggaagaggaacagaaagaggcagaaggggccgtggccgaggcagaggtggctctggtaggcgaggaggaaggttttctgctcaaggaatgggaacctttaacccagctgattatgcagagccagccaatactgatgataactatggcaatagcagcggcaatacgtggaacaacactggccactttgaaccagatgatgggacgagtgcatggaggactgcaacagaggagtgggggactgaagattggaatgaagatctttctgagaccaagatcttcactgcctctaatgtgtcttcagtgcctctgcctgcggagaatgtgacaatcactgctggtcagagaattgaccttgctgttctgctggggaagacaccatctacaatggagaatgattcatctaatctggatccgtctcaggctccttctctggcccagcctctggtgttcagtaattcgaagcagactgccatatcacagcctgcttcagggaacacattttctcatcacagtatggtga

SEQ ID NO: 2559 - DNA, 980 bp, Homo sapiens
gcggcccggggtgtcagtgtggaggagactgaggtaaagttgggagcgcagcggcgttggcggcggcggcggcggcagcggcagcgcggcggggccggtattctaccttgtaaatactgttatttgtatatactgtaaatgatgacatcggtgggcactaaccgagcccggggaaactgggaacaacctcaaaaccaaaaccagacacagcacaagcagcggccacaggccactgcagaacaaattagacttgcacagatgatttcggaccataatgatgctgactttgaggagaaggtgaaacaattgattgatattacaggcaagaaccaggatgaatgtgtgattgctttgcatgactgcaatggagatgtcaacagagctatcaatgttcttctggaaggaaacccagacacgcattcctgggagatggtcgggaagaagaagggagtctcaggccagaaggatggtggccagacggaatccaatgaggaaggcaaagaaaatcgagaccgggacagagactatagtcggcgacgtggtgggccaccaagacgggggagaggtgccagccgtggacgagagtttcgaggtcaggaaaatggattggatggcaccaagagtggagggccttctggaagaggaacagaaagaggcagaaggggccgtggccgaggcagaggtggctctggtaggcgaggaggaaggttttctgctcaaggaatgggaacctttaacccagctgattatgcagagccagccaatactgatgataactatggcaatagcagcggcaatacgtggaacaacactggccactttgaaccagatgatgggacgagtgcatggaggactgcaacagaggagtgggggactgaagattggaatgaagatctttctgagaccaagatcttcactgcctctaatgtgtcttcagtgcctctgcctgcggagaatgtgacaatcactgctggtcagag

SEQ ID NO: 2560 - DNA, 1419 bp, Homo sapiens
tgtggagagtgaggcgaatctccattcttcctccagcactttttccaccacatccagcacagtctctgcacctcccccagtggtcagtgtctcctccagtctcaatagtggcagtagcctgggcctcagcctaggcagcaactccactgtcacagcctcgactcgaagctcagttgctacgacttcaggaaaagctcctcccaacctccctcctggggtcccgccgttgttgcctaatccgtatattatggctccagggctgttacatgcctacccgccacaagtatatggttatgatgacttgcagatgcttcagacaagatttccattggattactacagcatcccatttcccacacccactactccgctgactgggagggatggtagcctggccagcaacccttattctggtgacctcacaaagttcggccgtggggatgcctcctccccagccccggccacaaccttggcccaaccccaacagaaccagacgcagactcaccataccacgcagcagacattcctgaacccggcgctgcctcctggctacagttacaccagcctgccatactatacaggggtcccgggcctccccagcaccttccagtatgggcctgctgtgttccctgtggctcctacctcttccaagcagcatggtgtgaatgtcagtgtgaatgcatcggccacccctttccaacagccgagtggatatgggtctcatggatacaacactggtgtttcagtcacctccagtaacacgggcgtgccagatatctcgggttctgtgtactccaaaacccagcagtcctttgagaaacaaggttttcattccggtactcctgctgcttccttcaacttgccttcagccctaggaagtgggggccccatcaatccggccacagctgctgcctacccacctgccccctttatgcacattctgaccccccatcagcagccgcattctcagatccttcaccatcacctgcagcaggatggccagctaccatatttgcagatgattctctgttgccagcgccagcaggaggagcagacgggcagcgggcaacgtagccagaccagctccatcccgcagaagccccagaccaacaagtctgcctacaacagctacagctggggggccaactgaggccctgaccctcttctcccggtcccatcttctgagagggcttctcagcctggaaactatggaaacagcatcaaagagaaaggaatgtggggggtttccgctgccccccacccccagcggcccaccccatgcctcagcttcatgtctgtcccattcctataccatccccaccctgttgtatgtattataggatttgtattttctccttttttttcccccttccattccttctcccctcttgcattcaagattatgaaactttgctatgg

SEQ ID NO: 2561 - DNA, 3988 bp, Homo sapiens
aagtgggcgggggaaggcgcgagagcgagcgcgagagggaaaaggagggagggggtggggaagagggaatcttatatcacgtgacaggggcggcgcggcccggggtgtcagtgtggaggagactgagtattctaccttgtaaatactgttatttgtatatactgtaaatgatgacatcggtgggcactaaccgagcccggggaaactgggaacaacctcaaaaccaaaaccagacacagcacaagcagcggccacaggccactgcagaacaaattagacttgcacagatgatttcggaccataatgatgctgactttgaggagaaggtgaaacaattgattgatattacaggcaagaaccaggatgaatgtgtgattgctttgcatgactgcaatggagatgtcaacagagctatcaatgttcttctggaaggaaacccagacacgcattcctgggagatggtcgggaagaagaagggagtctcaggccagaaggatggtggccagacggaatccaatgaggaaggcaaagaaaatcgagaccgggacagagactatagtcggcgacgtggtgggccaccaagacgggggagaggtgccagccgtggacgagagtttcgaggtcaggaaaatggattggatggcaccaagagtggagggccttctggaagaggaacagaaagaggcagaaggggccgtggccgaggcagaggtggctctggtaggcgaggaggaaggttttctgctcaaggaatgggaacctttaacccagctgattatgcagagccagccaatactgatgataactatggcaatagcagcggcaatacgtggaacaacactggccactttgaaccagatgatgggacgagtgcatggaggactgcaacagaggagtgggggactgaagattggaatgaagatctttctgagaccaagatcttcactgcctctaatgtgtcttcagtgcctctgcctgcggagaatgtgacaatcactgctggtcagagaattgaccttgctgttctgctggggaagacaccatctacaatggagaatgattcatctaatctggatccgtctcaggctccttctctggcccagcctctggtgttcagtaattcgaagcagactgccatatcacagcctgcttcagggaacacattttctcatcacagtatggtgagcatgttagggaaaggatttggtgatgtcggtgaagctaaaggcggcagtactacaggctcccagttcttggagcaattcaagactgcccaagccctggctcagttggcagctcagcattctcagtctggaagcaccaccacctcctcttgggacatgggctcgacgacacaatccccatcactggtgcagtatgatttgaagaacccaagtgattcagcagtgcacagcccctttacaaagcgccaggcttttaccccatcttcaaccatgatggaggtgttccttcaggagaagtcacctgcagtggctacctccacagctgcacctccacctccgtcttctcctctgccaagcaaatccacatcggctccacagatgtcgcctggatcttcagacaaccagtcctctagccctcagccggctcagcagaaactgaaacagcagaagaaaaaagcctccttgacttctaagattcctgctctggctgtggagatgcctggctcagcagatatctcagggctaaacctgcagtttggggcattgcagtttgggtcagagcctgtcctttctgattatgagtccacccccaccacgagcgcctcttcaagccaggctccaagtagcctgtataccagcacggccagtgaatcatcctctacaatttcatctaaccagagtcaggagtctggttatcagagcggcccaattcagtcgacaacctatacctcccaaaataatgctcagggccctctttatgaacagagatccacacagactcggcggtaccccagctccatctcttcatcaccccaaaaggacctgactcaggcaaagaatggcttcagttctgtgcaggccacgcagttacagaccacacaatctgttgaaggtgctacaggctctgcagtgaaatctgattcaccttccacttctagcatcccccctctcaatgaaacggtatctgcagcttccttactgacgacaaccaatcagcattcatcctccttgggtggcttgagccacagtgaggagattccaaatactaccaccacacaacacagcagcacgttatctacgcagcagaataccctttcatcatcaacatcttctgggcgcacttcgacatccactcttttgcacacaagtgtggagagtgaggcgaatctccattcttcctccagcactttttccaccacatccagcacagtctctgcacctcccccagtggtcagtgtctcctccagtctcaatagtggcagtagcctgggcctcagcctaggcagcaactccactgtcacagcctcgactcgaagctcagttgctacgacttcaggaaaagctcctcccaacctccctcctggggtcccgccgttgttgcctaatccgtatattatggctccagggctgttacatgcctacccgccacaagtatatggttatgatgacttgcagatgcttcagacaagatttccattggattactacagcatcccatttcccacacccactactccgctgactgggagggatggtagcctggccagcaacccttattctggtgacctcacaaagttcggccgtggggatgcctcctccccagccccggccacaaccttggcccaaccccaacagaaccagacgcagactcaccataccacgcagcagacattcctgaacccggcgctgcctcctggctacagttacaccagcctgccatactatacaggggtcccgggcctccccagcaccttccagtatgggcctgctgtgttccctgtggctcctacctcttccaagcagcatggtgtgaatgtcagtgtgaatgcatcggccacccctttccaacagccgagtggatatgggtctcatggatacaacactggtgtttcagtcacctccagtaacacgggcgtgccagatatctcgggttctgtgtactccaaaacccagcagtcctttgagaaacaaggttttcattccggtactcctgctgcttccttcaacttgccttcagccctaggaagtgggggccccatcaatccggccacagctgctgcctacccacctgccccctttatgcacattctgaccccccatcagcagccgcattctcagatccttcaccatcacctgcagcaggatggccagacgggcagcgggcaacgtagccagaccagctccatcccgcagaagccccagaccaacaagtctgcctacaacagctacagctggggggccaactgaggccctgaccctcttctcccggtcccatcttctgagagggcttctcagcctggaaactatggaaacagcatcaaagagaaaggaatgtggggggtttccgctgccccccacccccagcggcccaccccatgcctcagcttcatgtctgtcccattcctataccatccccaccctgttgtatgtattataggatttgtattttctccttttttttcccccttccattccttctcccctcttgcattcaagattatgaaactttgctatgggccctgcacttcctttgcttcctcctgttcaccctggtggtgtacggatgaggcggggaggtgggacccccaaacatatatcagcccaacagccctaagtctccttctttattattaggaaaacaacaacaacaacaaacaaaaaaatggcgtcatgaatatgaacagcattgtcagatgaattagttgaagtggttttttttttgttttttttttttttttgtactgtgtcctcaaatttaatggattaatgtgtcttgtatatataaaaagaaaacctctaccttc

SEQ ID NO: 2562 - DNA, 4039 bp, Homo sapiens
aagtgggcgggggaaggcgcgagagcgagcgcgagagggaaaaggagggagggggtggggaagagggaatcttatatcacgtgacaggggcggcgcggcccggggtgtcagtgtggaggagactgagtattctaccttgtaaatactgttatttgtatatactgtaaatgatgacatcggtgggcactaaccgagcccggggaaactgggaacaacctcaaaaccaaaaccagacacagcacaagcagcggccacaggccactgcagaacaaattagacttgcacagatgatttcggaccataatgatgctgactttgaggagaaggtgaaacaattgattgatattacaggcaagaaccaggatgaatgtgtgattgctttgcatgactgcaatggagatgtcaacagagctatcaatgttcttctggaaggaaacccagacacgcattcctgggagatggtcgggaagaagaagggagtctcaggccagaaggatggtggccagacggaatccaatgaggaaggcaaagaaaatcgagaccgggacagagactatagtcggcgacgtggtgggccaccaagacgggggagaggtgccagccgtggacgagagtttcgaggtcaggaaaatggattggatggcaccaagagtggagggccttctggaagaggaacagaaagaggcagaaggggccgtggccgaggcagaggtggctctggtaggcgaggaggaaggttttctgctcaaggaatgggaacctttaacccagctgattatgcagagccagccaatactgatgataactatggcaatagcagcggcaatacgtggaacaacactggccactttgaaccagatgatgggacgagtgcatggaggactgcaacagaggagtgggggactgaagattggaatgaagatctttctgagaccaagatcttcactgcctctaatgtgtcttcagtgcctctgcctgcggagaatgtgacaatcactgctggtcagagaattgaccttgctgttctgctggggaagacaccatctacaatggagaatgattcatctaatctggatccgtctcaggctccttctctggcccagcctctggtgttcagtaattcgaagcagactgccatatcacagcctgcttcagggaacacattttctcatcacagtatggtgagcatgttagggaaaggatttggtgatgtcggtgaagctaaaggcggcagtactacaggctcccagttcttggagcaattcaagactgcccaagccctggctcagttggcagctcagcattctcagtctggaagcaccaccacctcctcttgggacatgggctcgacgacacaatccccatcactggtgcagtatgatttgaagaacccaagtgattcagcagtgcacagcccctttacaaagcgccaggcttttaccccatcttcaaccatgatggaggtgttccttcaggagaagtcacctgcagtggctacctccacagctgcacctccacctccgtcttctcctctgccaagcaaatccacatcggctccacagatgtcgcctggatcttcagacaaccagtcctctagccctcagccggctcagcagaaactgaaacagcagaagaaaaaagcctccttgacttctaagattcctgctctggctgtggagatgcctggctcagcagatatctcagggctaaacctgcagtttggggcattgcagtttgggtcagagcctgtcctttctgattatgagtccacccccaccacgagcgcctcttcaagccaggctccaagtagcctgtataccagcacggccagtgaatcatcctctacaatttcatctaaccagagtcaggagtctggttatcagagcggcccaattcagtcgacaacctatacctcccaaaataatgctcagggccctctttatgaacagagatccacacagactcggcggtaccccagctccatctcttcatcaccccaaaaggacctgactcaggcaaagaatggcttcagttctgtgcaggccacgcagttacagaccacacaatctgttgaaggtgctacaggctctgcagtgaaatctgattcaccttccacttctagcatcccccctctcaatgaaacggtatctgcagcttccttactgacgacaaccaatcagcattcatcctccttgggtggcttgagccacagtgaggagattccaaatactaccaccacacaacacagcagcacgttatctacgcagcagaataccctttcatcatcaacatcttctgggcgcacttcgacatccactcttttgcacacaagtgtggagagtgaggcgaatctccattcttcctccagcactttttccaccacatccagcacagtctctgcacctcccccagtggtcagtgtctcctccagtctcaatagtggcagtagcctgggcctcagcctaggcagcaactccactgtcacagcctcgactcgaagctcagttgctacgacttcaggaaaagctcctcccaacctccctcctggggtcccgccgttgttgcctaatccgtatattatggctccagggctgttacatgcctacccgccacaagtatatggttatgatgacttgcagatgcttcagacaagatttccattggattactacagcatcccatttcccacacccactactccgctgactgggagggatggtagcctggccagcaacccttattctggtgacctcacaaagttcggccgtggggatgcctcctccccagccccggccacaaccttggcccaaccccaacagaaccagacgcagactcaccataccacgcagcagacattcctgaacccggcgctgcctcctggctacagttacaccagcctgccatactatacaggggtcccgggcctccccagcaccttccagtatgggcctgctgtgttccctgtggctcctacctcttccaagcagcatggtgtgaatgtcagtgtgaatgcatcggccacccctttccaacagccgagtggatatgggtctcatggatacaacactggtgtttcagtcacctccagtaacacgggcgtgccagatatctcgggttctgtgtactccaaaacccagcagtcctttgagaaacaaggttttcattccggtactcctgctgcttccttcaacttgccttcagccctaggaagtgggggccccatcaatccggccacagctgctgcctacccacctgccccctttatgcacattctgaccccccatcagcagccgcattctcagatccttcaccatcacctgcagcaggatggccagctaccatatttgcagatgattctctgttgccagcgccagcaggaggagcagacgggcagcgggcaacgtagccagaccagctccatcccgcagaagccccagaccaacaagtctgcctacaacagctacagctggggggccaactgaggccctgaccctcttctcccggtcccatcttctgagagggcttctcagcctggaaactatggaaacagcatcaaagagaaaggaatgtggggggtttccgctgccccccacccccagcggcccaccccatgcctcagcttcatgtctgtcccattcctataccatccccaccctgttgtatgtattataggatttgtattttctccttttttttcccccttccattccttctcccctcttgcattcaagattatgaaactttgctatgggccctgcacttcctttgcttcctcctgttcaccctggtggtgtacggatgaggcggggaggtgggacccccaaacatatatcagcccaacagccctaagtctccttctttattattaggaaaacaacaacaacaacaaacaaaaaaatggcgtcatgaatatgaacagcattgtcagatgaattagttgaagtggttttttttttgttttttttttttttttgtactgtgtcctcaaatttaatggattaatgtgtcttgtatatataaaaagaaaacctctaccttc

SEQ ID NO: 2563 - DNA, 1789 bp, Homo sapiens
tcagcattcatcctccttgggtggcttgagccacagtgaggagattccaaatactaccaccacacaacacagcagcacgttatctacgcagcagaataccctttcatcatcaacatcttctgggcgcacttcgacatccactcttttgcacacaagtgtggagagtgaggcgaatctccattcttcctccagcactttttccaccacatccagcacagtctctgcacctcccccagtggtcagtgtctcctccagtctcaatagtggcagtagcctgggcctcagcctaggcagcaactccactgtcacagcctcgactcgaagctcagttgctacgacttcaggaaaagctcctcccaacctccctcctggggtcccgccgttgttgcctaatccgtatattatggctccagggctgttacatgcctacccgccacaagtatatggttatgatgacttgcagatgcttcagacaagatttccattggattactacagcatcccatttcccacacccactactccgctgactgggagggatggtagcctggccagcaacccttattctggtgacctcacaaagttcggccgtggggatgcctcctccccagccccggccacaaccttggcccaaccccaacagaaccagacgcagactcaccataccacgcagcagacattcctgaacccggcgctgcctcctggctacagttacaccagcctgccatactatacaggggtcccgggcctccccagcaccttccagtatgggcctgctgtgttccctgtggctcctacctcttccaagcagcatggtgtgaatgtcagtgtgaatgcatcggccacccctttccaacagccgagtggatatgggtctcatggatacaacactggtgtttcagtcacctccagtaacacgggcgtgccagatatctcgggttctgtgtactccaaaacccagcagtcctttgagaaacaaggttttcattccggtactcctgctgcttccttcaacttgccttcagccctaggaagtgggggccccatcaatccggccacagctgctgcctacccacctgccccctttatgcacattctgaccccccatcagcagccgcattctcagatccttcaccatcacctgcagcaggatggccaggacatcctcaatttcgtcgatgaccagcttggtgaataagtattactgtaccaactgggcctcctctagcaggcccctgaaggcagtggaataaaatgaaatcttcgccctttaagaactcctgaccttaatgtggtagtagtatcttgtccttgaggggatttccttcccctcacccctaagactttcacaacctggtgactggaaagaaccaccacaaatcttcatttcctccagaaactgctacatctacagccgatttcaggcagtaaagggagagggatagaggagattgggtggaaaatggagaggatcaagaaggagctgagaccatttcaaagaaaaaaaatgctttatagagttttaagtatgacttagatgggtccaggcaaataaactaaaaagaagtgaaggcaacatgtatcgtctggcagaactaaatcttggagtggggtgagggatgaaagactacatattgggtacagtgtacactgctcgggtgatgggtgcgctaaagtcgcagaaatcactaaagaactcatccatgtaaccaaacaccacctgtaccccaaaaacgaaataaaaaaacaaaaccttggggcccattccccctaggaatggactactgta

SEQ ID NO: 2564 - DNA, 911 bp, Homo sapiens
gagactgaggtaaagttgggagcgcagcggcgttggcggcggcggcggcggcagcggcagcgcggcggggccggtattctaccttgtaaatactgttatttgtatatactgtaaatgatgacatcggtgggcactaaccgagcccggggaaactgggaacaacctcaaaaccaaaaccagacacagcacaagcagcggccacaggccactgcagaacaaattagacttgcacagatgatttcggaccataatgatgctgactttgaggagaaggtgaaacaattgattgatattacaggcaagaaccaggatgaatgtgtgattgctttgcatgactgcaatggagatgtcaacagagctatcaatgttcttctggaaggaaacccagacacgcattcctgggagatggtcgggaagaagaagggagtctcaggccagaaggatggtggccagacggaatccaatgaggaaggcaaagaaaatcgagaccgggacagagactatagtcggcgacgtggtgggccaccaagacgggggagagttcgaggtcaggaaaatggattggatggcaccaagagtggagggccttctggaagaggaacagaaagaggcagaaggggccgtggccgaggcagaggtggctctggtaggcgaggaggaaggttttctgctcaaggaatgggaacctttaacccagctgattatgcagagccagccaatactgatgataactatggcaatagcagcggcaatacgtggaacaacactggccactttgaaccagatgatgggacgagtgcatggaggactgcaacagaggagtgggggactgaagattggaatgaagatctttctgagaccaagatcttcactgcctctaatgtgtcttcagtgcctctgcctgcggagaa

SEQ ID NO: 2565 - DNA, 678 bp, Homo sapiens
gggaaaaggagggagggggtggggaagagggaatcttatatcacgtgacaggggcggcgcggcccggggtgtcagtgtggaggagactgagtattctaccttgtaaatactgttatttgtatatactgtaaatgatgacatcggtgggcactaaccgagcccggggaaactgggaacaacctcaaaaccaaaaccagacacagcacaagcagcggccacaggccactgcagaacaaattagacttgcacagatgatttcggaccataatgatgctgactttgaggagaaggtgaaacaattgattgatattacaggcaagaaccaggatgaatgtgtgattgctttgcatgactgcaatggagatgtcaacagagctatcaatgttcttctggaaggaaacccagacacgcattcctgggagatggtcgggaagaagaagggagtctcaggccagaaggatggtggccagacggaatccaatgaggaaggcaaagaaaatcgagaccgggacagagactatagtcggcgacgtggtgggccaccaagacgggggagaggtgccagccgtggacgagagtttcgaggtcaggaaaatggattggatggcaccaagagtggagggccttctggaagaggaacagaaagaggcagaaggggccgtggccgaggcagaggtg

SEQ ID NO: 2566 - DNA, 812 bp, Homo sapiens
atgcggctagagcctgagaggggagagcgagaaagagcgcgagcgagcgaggcctgggccttgcctgagtattctaccttgtaaatactgttatttgtatatactgtaaatgatgacatcggtgggcactaaccgagcccggggaaactgggaacaacctcaaaaccaaaaccagacacagcacaagcagcggccacaggccactgcagaacaaattagacttgcacagatgatttcggaccataatgatgctgactttgaggagaaggtgaaacaattgattgatattacaggcaagaaccaggatgaatgtgtgattgctttgcatgactgcaatggagatgtcaacagagctatcaatgttcttctggaaggaaacccagacacgcattcctgggagatggtcgggaagaagaagggagtctcaggccagaaggatggtggccagacggaatccaatgaggaaggcaaagaaaatcgagaccgggacagagactatagtcggcgacgtggtgggccaccaagacgggggagaggtgccagccgtggacgagagtttcgaggtcaggaaaatggattggatggcaccaagagtggagggccttctggaagaggaacagaaagaggcagaaggggccgtggccgaggcagaggtggctctggtaggcgaggaggaaggttttctgctcaaggaatgggaacctttaacccagctgattatgcagagccagccaatactgatgataactatggcaatagcagcggcaatacgtggaacaacactggccactttgaaccagatgatgggacga

SEQ ID NO: 2567 - DNA, 4035 bp, Homo sapiens
aagtgggcgggggaaggcgcgagagcgagcgcgagagggaaaaggagggagggggtggggaagagggaatcttatatcacgtgacaggggcggcgcggcccggggtgtcagtgtggaggagactgagtattctaccttgtaaatactgttatttgtatatactgtaaatgatgacatcggtgggcactaaccgagcccggggaaactgggaacaacctcaaaaccaaaaccagacacagcacaagcagcggccacaggccactgcagaacaaattagacttgcacagatgatttcggaccataatgatgctgactttgaggagaaggtgaaacaattgattgatattacaggcaagaaccaggatgaatgtgtgattgctttgcatgactgcaatggagatgtcaacagagctatcaatgttcttctggaaggaaacccagacacgcattcctgggagatggtcgggaagaagaagggagtctcaggccagaaggatggtggccagacggaatccaatgaggaaggcaaagaaaatcgagaccgggacagagactatagtcggcgacgtggtgggccaccaagacgggggagaggtgccagccgtggacgagagtttcgaggtcaggaaaatggattggatggcaccaagagtggagggccttctggaagaggaacagaaagaggcagaaggggccgtggccgaggcagaggtggctctggtaggcgaggaggaaggttttctgctcaaggaatgggaacctttaacccagctgattatgcagagccagccaatactgatgataactatggcaatagcagcggcaatacgtggaacaacactggccactttgaaccagatgatgggacgagtgcatggaggactgcaacagaggagtgggggactgaagattggaatgaagatctttctgagaccaagatcttcactgcctctaatgtgtcttcagtgcctctgcctgcggagaatgtgacaatcactgctggtcagagaattgaccttgctgttctgctggggaagacaccatctacaatggagaatgattcatctaatctggatccgtctcaggctccttctctggcccagcctctggtgttcagtaattcgaagcagactgccatatcacagcctgcttcagggaacacattttctcatcacagtatggtgagcatgttagggaaaggatttggtgatgtcggtgaagctaaaggcggcagtactacaggctcccagttcttggagcaattcaagactgcccaagccctggctcagttggcagctcagcattctcagtctggaagcaccaccacctcctcttgggacatgggctcgacgacacaatccccatcactggtgcagtatgatttgaagaacccaagtgattcagcagtgcacagcccctttacaaagcgccaggcttttaccccatcttcaaccatgatggaggtgttccttcaggagaagtcacctgcagtggctacctccacagctgcacctccacctccgtcttctcctctgccaagcaaatccacatcggctccacagatgtcgcctggatcttcagacaaccagtcctctagccctcagccggctcagcagaaactgaaacagcagaagaaaaaagcctccttgacttctaagattcctgctctggctgtggagatgcctggctcagcagatatctcagggctaaacctgcagtttggggcattgcagtttgggtcagagcctgtcctttctgattatgagtccacccccaccacgagcgcctcttcaagccaggctccaagtagcctgtataccagcacggccagtgaatcatcctctacaatttcatctaaccagagtcaggagtctggttatcagagcggcccaattcagtcgacaacctatacctcccaaaataatgctcagggccctctttatgaacagagatccacacagactcggcggtaccccagctccatctcttcatcaccccaaaaggacctgactcaggcaaagaatggcttcagttctgtgcaggccacgcagttacagaccacacaatctgttgaaggtgctacaggctctgcagtgaaatctgattcaccttccacttctagcatcccccctctcaatgaaacggtatctgcagcttccttactgacgacaaccaatcagcattcatcctccttgggtggcttgagccacagtgaggagattccaaatactaccaccacacaacacagcagcacgttatctacgcagcagaataccctttcatcatcaacatcttctgggcgcacttcgacatccactcttttgcacacaagtgtggagagtgaggcgaatctccattcttcctccagcactttttccaccacatccagcacagtctctgcacctcccccagtggtcagtgtctcctccagtctcaatagtggcagtagcctgggcctcagcctaggcagcaactccactgtcacagcctcgactcgaagctcagttgctacgacttcaggaaaagctcctcccaacctccctcctggggtcccgccgttgttgcctaatccgtatattatggctccagggctgttacatgcctacccgccacaagtatatggttatgatgacttgcagatgcttcagacaagatttccattggattactacagcatcccatttcccacacccactactccgctgactgggagggatggtagcctggccagcaacccttattctggtgacctcacaaagttcggccgtggggatgcctcctccccagccccggccacaaccttggcccaaccccaacagaaccagacgcagactcaccataccacgcagcagacattcctgaacccggcgctgcctcctggctacagttacaccagcctgccatactatacaggggtcccgggcctccccagcaccttccagtatgggcctgctgtgttccctgtggctcctacctcttccaagcagcatggtgtgaatgtcagtgtgaatgcatcggccacccctttccaacagccgagtggatatgggtctcatggatacaacactggtgtttcagtcacctccagtaacacgggcgtgccagatatctcgggttctgtgtactccaaaacccagcagtcctttgagaaacaaggttttcattccggtactcctgctgcttccttcaacttgccttcagccctaggaagtgggggccccatcaatccggccacagctgctgcctacccacctgccccctttatgcacattctgaccccccatcagcagccgcattctcagatccttcaccatcacctgcagcaggatggccagctaccatatttgcagatgattctctgttgccagcgccagcaggaggagcagacgggcagcgggcaacgtagccagaccagctccatcccgcagaagccccagaccaacaagtctgcctacaacagctacagctggccaactgaggccctgaccctcttctcccggtcccatcttctgagagggcttctcagcctggaaactatggaaacagcatcaaagagaaaggaatgtggggggtttccgctgccccccacccccagcggcccaccccatgcctcagcttcatgtctgtcccattcctataccatccccaccctgttgtatgtattataggatttgtattttctccttttttttcccccttccattccttctcccctcttgcattcaagattatgaaactttgctatgggccctgcacttcctttgcttcctcctgttcaccctggtggtgtacggatgaggcggggaggtgggacccccaaacatatatcagcccaacagccctaagtctccttctttattattaggaaaacaacaacaacaacaaacaaaaaaatggcgtcatgaatatgaacagcattgtcagatgaattagttgaagtggttttttttttgttttttttttttttttgtactgtgtcctcaaatttaatggattaatgtgtcttgtatatataaaaagaaaacctctaccttc

SEQ ID NO: 2568 - DNA, 1593 bp, Homo sapiens
atggaggacgactcactctacttgagaggtgagtggcagttcaaccacttttcaaaactcacatcttctcggcccgatgcagcttttgctgaaatccagcggacttctctccctgagaagtcaccactctcatgtgagacccgtgtcgacctctgtgatgatttggctcctgtggcaagacagcttgctcccagggagaagcttcctctgagtagcaggagacctgctgcggtgggggctgggctccagaatatgggaaatacctgctacgtgaacgcttccttgcagtgcctgacatacacaccgccccttgccaactacatgctgtcccgggagcactctcaaacgtgtcatcgtcacaagggctgcatgctctgtactatgcaagctcacatcacacgggccctccacaatcctggccacgtcatccagccctcacaggcattggctgctggcttccatagaggcaagcaggaagatgcccatgaatttctcatgttcactgtggatgccatgaaaaaggcatgccttcccgggcacaagcaggtagatcatcactctaaggacaccaccctcatccaccaaatatttggaggctactggagatctcaaatcaagtgtctccactgccacggcatttcagacacttttgacccttacctggacatcgccctggatatccaggcagctcagagtgtccagcaagctttggaacagttggtgaagcccgaagaactcaatggagagaatgcctatcattgtggtgtttgtctccagagggcgccggcctccaagacgttaactttacacacctctgccaaggtcctcatccttgtattgaagagattctccgatgtcacaggcaacaagattgccaagaatgtgcaatatcctgagtgccttgacatgcagccatacatgtctcagccgaacacaggacctctcgtctatgtcctctatgctgtgctggtccacgctgggtggagttgtcacaacggacattacttctcttatgtcaaagctcaagaaggccagtggtataaaatggatgatgccgaggtcaccgcctctagcatcacttctgtcctgagtcaacaggcctacgtcctcttttacatccagaagagtgaatgggaaagacacagtgagagtgtgtcaagaggcagggaaccaagagcccttggcgcagaagacaccgacaggcgagcaacgcaaggagagctcaagagagaccacccctgcctccaggcccccgagttggacgagcacttggtggaaagagccactcaggaaagcaccttagaccactggaaattccttcaagagcaaaacaaaacgaagcctgagttcaacgtcagaaaagtcgaaggtaccctgcctcccgacgtacttgtgattcatcaatcaaaatacaagtgtgggatgaagaaccatcatcctgaacagcaaagctccctgctaaacctctcttcgtcgaccccgacacatcaggagtccatgaacactggcacactcgcttccctgcgagggagggccaggagatccaaagggaagaacaaacacagcaagagggctctgcttgtgtgccagtga

SEQ ID NO: 2569 - DNA, 1593 bp, Homo sapiens; identical to SEQ ID NO: 2568

SEQ ID NO: 2570 - DNA, 1593 bp, Homo sapiens; identical to SEQ ID NO: 2568

SEQ ID NO: 2571 - DNA, 1593 bp, Homo sapiens; identical to SEQ ID NO: 2568

SEQ ID NO: 2572 - DNA, 1593 bp, Homo sapiens; identical to SEQ ID NO: 2568

SEQ ID NO: 2573 - DNA, 1593 bp, Homo sapiens; identical to SEQ ID NO: 2568

SEQ ID NO: 2574 - DNA, 1593 bp, Homo sapiens; identical to SEQ ID NO: 2568

SEQ ID NO: 2575 - DNA, 9418 bp, Homo sapiens
tggcggcggcagcttctcgctagtgacgcgcggtgcgggctcatctccttcccctccttcctcacctcccctagtccggaccccgtccgccgccgggaccagaccgtccccgtagcccgcagccagcagccgcccctctcctcccccggccgcccctctcccaacgcccgtctgccgctggccggcggcgcgcccctggtcccggccgcctgcctcgcactccgcgctgtcgccgggggagcgggtggcgtgtggattcgccctcctgcccgcccctccgggccgcggacacacgcccggcagggaggcggcggcggcccctgcgtatttgcttccctccatttggggactgggaggcggcggcggctgtgggttttggggaggggtagagggctggggggcgggcgagagcgggagggggccgccctcgagtggaggacgagaaggaaagcaccatgacgtccatccatttcgtggttcacccgctgccgggcaccgaggaccagctcaatgacaggttacgagaagtttctgagaagctgaacaaatataatttaaacagccacccccctttgaatgtattggaacaggctactattaaacagtgtgtggtgggaccaaatcatgctgcctttcttcttgaggatggtagagtttgcaggattggtttttcagtacagccagacagattggaattgggtaaacctgataataatgatgggtcaaagttgaacagcaactcgggggcagggaggacgtcaaggcctggtaggacaagcgactctccatggtttctctcaggttctgagactctaggcaggctggcaggcaacaccttaggaagccgctggagttctggagtgggtggaagtggtggaggatcctctggtaggtcatcagctggagctcgagattcccgccggcagactcgagttattcggacaggacgggatcgagggtctgggcttttgggcagtcagccccagccagttattccagcatctgtcattccagaggagctgatttcacaggcccaagttgttttacaaggcaaatccagaagtgtcattattcgagaacttcagagaacaaatcttgatgtgaaccttgctgtaaataatttacttagccgggatgatgaagatggagatgatggggatgatacagccagcgaatcttatttgcctggagaggatcttatgtctctccttgatgccgacattcattctgcccacccaagtgtcattattgatgcagatgccatgttttctgaagacattagctattttggttacccttcttttcgtcgttcatcactttccaggctaggctcatctcgagttctccttcttcccttagagagagactctgagctgttgcgtgaacgtgaatccgttttacgtttacgtgaacgaaggtggcttgatggagcctcatttgataatgaaaggggttctaccagcaaggaaggagagccaaacttggataagaagaatacacctgttcaaagtccagtatctctaggagaagatttgcagtggtggcctgataaggatggaacaaaattcatctgtattggggctctgtattctgaacttctggctgtcagcagtaaaggagaactttatcagtggaaatggagtgaatctgagccttacagaaatgcccagaatccttcattacatcatccacgagcaacatttttggggttaaccaatgaaaagatagtcctcctgtctgcaaatagcataagagcaactgtagctacagaaaataacaaggttgctacatgggtggatgaaactttaagttctgtggcttctaaattagagcacactgctcagacttactctgaacttcaaggagagcggatagtttctttacattgctgtgccctttacacctgcgctcagctggaaaacagtttatattggtggggtgtagttccttttagtcaaaggaagaaaatgttagagaaagctagagcaaaaaataaaaagcctaaatccagtgctggtatttcttcaatgccgaacatcactgttggtacccaggtatgcttgagaaataatcctctttatcatgctggagcagttgcattttcaattagtgctgggattcctaaagttggtgtcttaatggagtcagtttggaatatgaatgacagctgtagatttcaacttagatctcctgaaagcttgaaaaacatggaaaaagctagcaaaactactgaagctaagcctgaaagtaagcaggagccagtgaaaacagaaatgggtcctccaccatctccagcatccacgtgtagtgatgcatcctcaattgccagcagtgcatcaatgccatacaaacgacgacggtcaacccctgcaccaaaagaagaggaaaaggtgaatgaagagcagtggtctcttcgggaagtggtttttgtggaagatgtcaagaatgttcctgttggcaaggtgctaaaagtagatggtgcctatgttgctgtaaaatttccaggaacctccagtaatactaactgtcagaacagctctggtccagatgctgacccttcttctctcctgcaggattgtaggttacttagaattgatgaattgcaggttgtcaaaactggtggaacaccgaaggttcccgactgtttccaaaggactcctaaaaagctttgtatacctgaaaaaacagaaatattagcagtgaatgtagattccaaaggtgttcatgctgttctgaagactggaaattgggtacgatactgtatctttgatcttgctacaggaaaagcagaacaggaaaataattttcctacaagcagcattgctttccttggtcagaatgagaggaatgtagccattttcactgctggacaggaatctcccattattcttcgagatggaaatggtaccatctacccaatggccaaagattgcatgggaggaataagggatcccgattggctggatcttccacctattagtagtcttggaatgggtgtgcattctttaataaatcttcctgccaattcaacaatcaaaaagaaagctgctgttatcatcatggctgtagagaaacaaaccttaatgcaacacattctgcgctgtgactatgaggcctgtcgacaatatctaatgaatcttgagcaagcggttgttttagagcagaatctacagatgctgcagacattcatcagccacagatgtgatggaaatcgaaatattttgcatgcttgtgtatcagtttgctttccaaccagcaataaagaaactaaagaagaagaggaagcggagcgttctgaaagaaatacatttgcagaaaggctttctgctgttgaggccattgcaaatgcaatatcagttgtttcaagtaatggcccaggtaatcgggctggatcatcaagtagccgaagtttgagattacgggaaatgatgagacgttcgttgagagcagctggtttgggtagacatgaagctggagcttcatccagtgaccaccaggatccagtttcaccccccatagctccccctagttgggttcctgaccctcctgcgatggatcctgatggtgacattgattttatcctggcccccgctgtgggatctcttaccacagcagcaaccggtactggtcaaggaccaagcacctccactattccaggtccttccacagagccatctgtagtagaatccaaggatcgaaaggcgaatgctcattttatattgaaattgttatgtgacagtgtggttctccagccctatctacgagaacttctttctgccaaggatgcaagagggatgaccccatttatgtcagctgtaagtggccgagcttatcctgctgcaattaccatcttagaaactgctcagaaaattgcaaaagctgaaatatcctcaagtgaaaaagaggaagatgtattcatgggaatggtttgcccatcaggtaccaaccctgatgactctcctttatatgttttatgttgtaatgacacttgcagttttacatggactggagcagagcacattaaccaggatatttttgagtgtcgaacttgtggcttgctggagtcactgtgttgttgtacggaatgtgcaagggtttgtcataaaggtcatgattgcaaactcaaacggacatcaccaacagcctactgtgattgttgggagaaatgtaaatgtaaaactcttattgctggacagaaatctgctcgtcttgatctactttatcgcctgctcactgctactaatctggttactctgccaaacagcaggggagagcacctcttactattcttagtacagacagtcgcaaggcagacggtggagcattgtcaatacaggccacctcgaatcagggaagatcgtaaccgaaaaacagccagtcctgaagattcagatatgccagatcatgatttagagcctccaagatttgcccagcttgcattggagcgtgttctacaggactggaatgccttgaaatctatgattatgtttgggtcgcaggagaataaagaccctcttagtgccagcagtagaataggccatcttttgccagaagagcaagtatacctcaatcagcaaagtggcacaattcggctggactgtttcactcattgccttatagttaagtgtacagcagatattttgcttttagatactctactaggtacactagtgaaagaactccaaaacaaatatacacctggacgtagagaagaagctattgctgtgacaatgaggtttctacgttcagtggcaagagtttttgttattctgagtgtggaaatggcttcatccaaaaagaaaaacaactttattccacagccaattggaaaatgcaagcgtgtattccaagcattgctaccttacgctgtggaagaattgtgcaacgtagcagagtcactgattgttcctgtcagaatggggattgctcgtccaactgcaccatttaccctggctagtactagcatagatgccatgcagggcagtgaagaattattttcagtggaaccactaccaccacgaccatcatctgatcagtctagcagctccagtcagtctcagtcatcctacatcatcaggaatccacagcagaggcgcatcagccagtcacagcccgttcggggcagagatgaagaacaggatgatattgtttcagcagatgtggaagaggttgaggtggtggagggtgtggctggagaagaggatcatcatgatgaacaggaagaacacggggaagaaaatgctgaggcagagggacaacatgatgagcatgatgaagacgggagtgatatggagctggacttgttagcagcagctgaaacagaaagtgatagtgaaagtaaccacagcaaccaagataatgctagtgggcgcagaagcgttgtcactgcagcaactgctggttcagaagcaggagcaagcagtgttcctgccttcttttctgaagatgattctcaatcgaatgactcaagtgattctgatagcagtagtagtcagagtgacgacatagaacaggagacctttatgcttgatgagccattagaaagaaccacaaatagctcccatgccaatggtgctgcccaagctccccgttcaatgcagtgggctgtccgcaacacccagcatcagcgagcagccagtacagccccttccagtacatctacaccagcagcaagttcagcgggtttgatttatattgatccttcaaacttacgccggagtggtaccatcagtacaagtgctgcagctgcagcagctgctttggaagctagcaacgccagcagttacctaacatctgcaagcagtttagccagggcttacagcattgtcattagacaaatctcggacttgatgggccttattcctaagtataatcacctagtatactctcagattccagcagctgtgaaattgacttaccaagatgcagtaaacttacagaactatgtagaagaaaagcttattcccacttggaactggatggtcagtattatggattctactgaagctcaattacgttatggttctgcattagcatctgctggtgatcctggacatccaaatcatcctcttcacgcttctcagaattcagcgagaagagagaggatgactgcgcgagaagaagctagcttacgaacacttgaaggcagacgacgtgccaccttgcttagcgcccgtcaaggaatgatgtctgcacgaggagacttcctaaattatgctctgtctctaatgcggtctcataatgatgagcattctgatgttcttccagttttggatgtttgctcattgaagcatgtggcatatgtttttcaagcacttatatactggattaaggcaatgaatcagcagacaacattggatacacctcaactagaacgcaaaaggacgcgagaactcttggaactgggtattgataatgaagattcagaacatgaaaatgatgatgacaccaatcaaagtgctactttgaatgataaggatgatgactctcttcctgcagaaactggccaaaaccatccatttttccgacgttcagactccatgacattccttgggtgtatacccccaaatccatttgaagtgcctctggctgaagccatccccttggctgatcagccacatctgttgcagccaaatgctagaaaggaggatctttttggccgtccaagtcagggtctttattcttcatctgccagtagtgggaaatgtttaatggaggttacagtggatagaaactgcctagaggttcttccaacaaaaatgtcttatgctgccaatctgaaaaatgtaatgaacatgcaaaaccggcaaaaaaaagaaggggaagaacagcccgtgctgccagaagaaactgagagttcaaaaccagggccatctgctcatgatcttgctgcacaattaaaaagtagcttactagcagaaataggacttactgaaagtgaagggccacctctcacatctttcaggccacagtgtagctttatgggaatggttatttcccatgatatgctgctaggacgttggcgcctttctttagaactgttcggcagggtattcatggaagatgttggagcagaacctggatcaatcctaactgaattgggtggttttgaggtaaaagaatcaaaattccgcagagaaatggaaaaactgagaaaccagcagtcaagagatttgtcactagaggttgatcgggatcgagatcttctcattcagcagactatgaggcagcttaacaatcactttggtcgaagatgtgctactacaccaatggctgtacacagagtaaaagtcacatttaaggatgagccaggagagggcagtggtgtagcacgaagtttttatacagccattgcacaagcatttttatcaaatgaaaaattgccaaatctagagtgtatccaaaatgccaacaaaggcacccacacaagtttaatgcagagattaaggaaccgaggagagagagaccgggaaagggagagagaaagggaaatgaggaggagtagtggtttgcgagcaggttctcggagggaccgggatagagactttagaagacagctttccatcgacactaggccctttagaccagcctctgaagggaatcctagcgatgatcctgagcctttgccagcacatcggcaggcacttggagagaggctttatcctcgtgtacaagcaatgcaaccagcatttgcaagtaaaatcactggcatgttgttggaattatccccagctcagctgcttctccttctagcaagtgaggattctctgagagcaagagtggatgaggccatggaactcattattgcacatggacgggaaaatggagctgatagtatcctggatcttggattagtagactcctcagaaaaggtacaggaaaaccgaaagcgccatggctctagtcgaagtgtagtagatatggatttagatgatacagatgatggtgatgacaatgcccctttgttttaccaacctgggaaaagaggattttatactccaaggcctggcaagaacacagaagcaaggttgaattgtttcagaaacattggcaggattcttggactatgtctgttacagaatgaactatgtcctatcacattgaatagacatgtaattaaagtattgcttggtagaaaagtcaattggcatgattttgctttttttgatcctgtaatgtatgagagtttgcggcaactaatcctcgcgtctcagagttcagatgctgatgctgttttctcagcaatggatttggcatttgcaattgacctgtgtaaagaagaaggtggaggacaggttgaactcattcctaatggtgtaaatataccagtcactccacagaatgtatatgagtatgtgcggaaatacgcagaacacagaatgttggtagttgcagaacagcccttacatgcaatgaggaaaggtctactagatgtgcttccaaaaaattcattagaagatttaacggcagaagattttaggcttttggtaaatggctgcggtgaagtcaatgtgcaaatgctgatcagttttacctctttcaatgatgaatcaggagaaaatgctgagaagcttctgcagttcaagcgttggttctggtcaatagtagagaagatgagcatgacagaacgacaagatcttgtttacttttggacatcaagcccatcactgccagccagtgaagaaggattccagcctatgccctcaatcacaataagaccaccagatgaccaacatcttcctactgcaaatacttgcatttctcgactttacgtcccactctattcctctaaacagattctcaaacagaaattgttactcgccattaagaccaagaattttggttttgtgtagagtataaaaagtgtgtattgctgtgtaatattactagcaaattttgtagatttttttccatttgtctataaaagtttatggaagttaatgctgtcatacccccctggtggtaccttaaagagataaaatgcagacattccttgctgagtttatagcttaaaggcctaaggagcactagcaacatttggctatattggtttgctagtcaccaacttctgggtctaaccccagccaaagatgacagcagaacaacataatttacactgtgatttatctttttgctgagggggaaaaaatgtaaatgttctgaaaattcactgctgcctttgtggaaactgtttcagcaaaggttcttgtatagagggaatagggaatttcaaaataaaaaattaagtatgttctgtgttttcattttaactttttttatggtgtttaatttgtggttggctgcaactgtgtatcatgtatatggaacttgtaaaaaagttctcgacattcagatcttaagagatgaaatcacttttacctataaaaaccacttttattgcggtttgactgcattgagc

SEQ ID NO: 2576 - DNA, 1931 bp, Homo sapiens
tttgtaatggataagcttctgagaactccaattactttgttgttttttaaactctcaaggaaaggctaaaactagattttcagattgtacatagaaaaattcaagctactttccaacattgaatttactactttttgacttcttgatgtgttttaataggttgatcgggatcgagatcttctcattcagcagactatgaggcagcttaacaatcactttggtcgaagatgtgctactacaccaatggctgtacacagagtaaaagtcacatttaaggatgagccaggagagggcagtggtgtagcacgaagtttttatacagccattgcacaagcatttttatcaaatgaaaaattgccaaatctagagtgtatccaaaatgccaacaaaggcacccacacaagtttaatgcagagattaaggaaccgaggagagagagaccgggaaagggagagagaaagggaaatgaggaggagtagtggtttgcgagcaggttctcggagggaccgggatagagactttagaagacagctttccatcgacactaggccctttagaccagcctctgaagggaatcctagcgatgatcctgagcctttgccagcacatcggcaggcacttggagagaggctttatcctcgtgtacaagcaatgcaaccagcatttgcaagtaaaatcactggcatgttgttggaattatccccagctcagctgcttctccttctagcaagtgaggattctctgagagcaagagtggatgaggccatggaactcattattgcacatggacgggaaaatggagctgatagtatcctggatcttggattagtagactcctcagaaaaggtacaggaaaaccgaaagcgccatggctctagtcgaagtgtagtagatatggatttagatgatacagatgatggtgatgacaatgcccctttgttttaccaacctgggaaaagaggattttatactccaaggcctggcaagaacacagaagcaaggttgaattgtttcagaaacattggcaggattcttggactatgtctgttacagaatgaactatgtcctatcacattgaatagacatgtaattaaagtattgcttggtagaaaagtcaattggcatgattttgctttttttgatcctgtaatgtatgagagtttgcggcaactaatcctcgcgtctcagagttcagatgctgatgctgttttctcagcaatggatttggcatttgcaattgacctgtgtaaagaagaaggtggaggacaggttgaactcattcctaatggtgtaaatataccagtcactccacagaatgtatatgagtatgtgcggaaatacgcagaacacagaatgttggtagttgcagaacagcccttacatgcaatgaggaaaggtctactagatgtgcttccaaaaaattcattagaagatttaacggcagaagattttaggcttttggtaaatggctgcggtgaagtcaatgtgcaaatgctgatcagttttacctctttcaatgatgaatcaggagaaaatgctgagaagcttctgcagttcaagcgttggttctggtcaatagtagagaagatgagcatgacagaacgacaagatcttgtttacttttggacatcaagcccatcactgccagccagtgaagaaggattccagcctatgccctcaatcacaataagaccaccagatgaccaacatcttcctactgcaaatacttgcatttctcgactttacgtcccactctattcctctaaacagattctcaaacagaaattgttactcgccattaagaccaagaattttggttttgtgtagagtataaaaagtgtgtattgctgtgtaatattactagcaaattttgtagatttttttccatttgtctataaaagtttatggaagttaatgctgtcatacccccc

SEQ ID NO: 2577 - DNA, 10297 bp, Homo sapiens
gagggggccttgccgcccgtttcccggagccccgcctctcgccgccgcgcccccgcccgccggtctcctccctcctcctcctcccgtttgcccctcccccgccgctccggagcggagcctgcgagacggagaaactggggcagaagtgaagatggcggcggcagcttctcgctagtgacgcgcggtgcgggctcatctccttcccctccttcctcacctcccctagtccggaccccgtccgccgccgggaccagaccgtccccgtagcccgcagccagcagccgcccctctcctcccccggccgcccctctcccaacgcccgtctgccgctggccggcggcgcgcccctggtcccggccgcctgcctcgcactccgcgctgtcgccgggggagcgggtggcgtgtggattcgccctcctgcccgcccctccgggccgcggacacacgcccggcagggaggcggcggcggcccctgcgtatttgcttccctccatttggggactgggaggcggcggcggctgtgggttttggggaggggtagagggctggggggcgggcgagagcgggagggggccgccctcgagtggaggacgagaaggaaagcaccatgacgtccatccatttcgtggttcacccgctgccgggcaccgaggaccagctcaatgacaggttacgagaagtttctgagaagctgaacaaatataatttaaacagccacccccctttgaatgtattggaacaggctactattaaacagtgtgtggtgggaccaaatcatgctgcctttcttcttgaggatggtagagtttgcaggattggtttttcagtacagccagacagattggaattgggtaaacctgataataatgatgggtcaaagttgaacagcaactcgggggcagggaggacgtcaaggcctggtaggacaagcgactctccatggtttctctcaggttctgagactctaggcaggctggcaggcaacaccttaggaagccgctggagttctggagtgggtggaagtggtggaggatcctctggtaggtcatcagctggagctcgagattcccgccggcagactcgagttattcggacaggacgggatcgagggtctgggcttttgggcagtcagccccagccagttattccagcatctgtcattccagaggagctgatttcacaggcccaagttgttttacaaggcaaatccagaagtgtcattattcgagaacttcagagaacaaatcttgatgtgaaccttgctgtaaataatttacttagccgggatgatgaagatggagatgatggggatgatacagccagcgaatcttatttgcctggagaggatcttatgtctctccttgatgccgacattcattctgcccacccaagtgtcattattgatgcagatgccatgttttctgaagacattagctattttggttacccttcttttcgtcgttcatcactttccaggctaggctcatctcgagttctccttcttcccttagagagagactctgagctgttgcgtgaacgtgaatccgttttacgtttacgtgaacgaaggtggcttgatggagcctcatttgataatgaaaggggttctaccagcaaggaaggagagccaaacttggataagaagaatacacctgttcaaagtccagtatctctaggagaagatttgcagtggtggcctgataaggatggaacaaaattcatctgtattggggctctgtattctgaacttctggctgtcagcagtaaaggagaactttatcagtggaaatggagtgaatctgagccttacagaaatgcccagaatccttcattacatcatccacgagcaacatttttggggttaaccaatgaaaagatagtcctcctgtctgcaaatagcataagagcaactgtagctacagaaaataacaaggttgctacatgggtggatgaaactttaagttctgtggcttctaaattagagcacactgctcagacttactctgaacttcaaggagagcggatagtttctttacattgctgtgccctttacacctgcgctcagctggaaaacagtttatattggtggggtgtagttccttttagtcaaaggaagaaaatgttagagaaagctagagcaaaaaataaaaagcctaaatccagtgctggtatttcttcaatgccgaacatcactgttggtacccaggtatgcttgagaaataatcctctttatcatgctggagcagttgcattttcaattagtgctgggattcctaaagttggtgtcttaatggagtcagtttggaatatgaatgacagctgtagatttcaacttagatctcctgaaagcttgaaaaacatggaaaaagctagcaaaactactgaagctaagcctgaaagtaagcaggagccagtgaaaacagaaatgggtcctccaccatctccagcatccacgtgtagtgatgcatcctcaattgccagcagtgcatcaatgccatacaaacgacgacggtcaacccctgcaccaaaagaagaggaaaaggtgaatgaagagcagtggtctcttcgggaagtggtttttgtggaagatgtcaagaatgttcctgttggcaaggtgctaaaagtagatggtgcctatgttgctgtaaaatttccaggaacctccagtaatactaactgtcagaacagctctggtccagatgctgacccttcttctctcctgcaggattgtaggttacttagaattgatgaattgcaggttgtcaaaactggtggaacaccgaaggttcccgactgtttccaaaggactcctaaaaagctttgtatacctgaaaaaacagaaatattagcagtgaatgtagattccaaaggtgttcatgctgttctgaagactggaaattgggtacgatactgtatctttgatcttgctacaggaaaagcagaacaggaaaataattttcctacaagcagcattgctttccttggtcagaatgagaggaatgtagccattttcactgctggacaggaatctcccattattcttcgagatggaaatggtaccatctacccaatggccaaagattgcatgggaggaataagggatcccgattggctggatcttccacctattagtagtcttggaatgggtgtgcattctttaataaatcttcctgccaattcaacaatcaaaaagaaagctgctgttatcatcatggctgtagagaaacaaaccttaatgcaacacattctgcgctgtgactatgaggcctgtcgacaatatctaatgaatcttgagcaagcggttgttttagagcagaatctacagatgctgcagacattcatcagccacagatgtgatggaaatcgaaatattttgcatgcttgtgtatcagtttgctttccaaccagcaataaagaaactaaagaagaagaggaagcggagcgttctgaaagaaatacatttgcagaaaggctttctgctgttgaggccattgcaaatgcaatatcagttgtttcaagtaatggcccaggtaatcgggctggatcatcaagtagccgaagtttgagattacgggaaatgatgagacgttcgttgagagcagctggtttgggtagacatgaagctggagcttcatccagtgaccaccaggatccagtttcaccccccatagctccccctagttgggttcctgaccctcctgcgatggatcctgatggtgacattgattttatcctggcccccgctgtgggatctcttaccacagcagcaaccggtactggtcaaggaccaagcacctccactattccaggtccttccacagagccatctgtagtagaatccaaggatcgaaaggcgaatgctcattttatattgaaattgttatgtgacagtgtggttctccagccctatctacgagaacttctttctgccaaggatgcaagagggatgaccccatttatgtcagctgtaagtggccgagcttatcctgctgcaattaccatcttagaaactgctcagaaaattgcaaaagctgaaatatcctcaagtgaaaaagaggaagatgtattcatgggaatggtttgcccatcaggtaccaaccctgatgactctcctttatatgttttatgttgtaatgacacttgcagttttacatggactggagcagagcacattaaccaggatatttttgagtgtcgaacttgtggcttgctggagtcactgtgttgttgtacggaatgtgcaagggtttgtcataaaggtcatgattgcaaactcaaacggacatcaccaacagcctactgtgattgttgggagaaatgtaaatgtaaaactcttattgctggacagaaatctgctcgtcttgatctactttatcgcctgctcactgctactaatctggttactctgccaaacagcaggggagagcacctcttactattcttagtacagacagtcgcaaggcagacggtggagcattgtcaatacaggccacctcgaatcagggaagatcgtaaccgaaaaacagccagtcctgaagattcagatatgccagatcatgatttagagcctccaagatttgcccagcttgcattggagcgtgttctacaggactggaatgccttgaaatctatgattatgtttgggtcgcaggagaataaagaccctcttagtgccagcagtagaataggccatcttttgccagaagagcaagtatacctcaatcagcaaagtggcacaattcggctggactgtttcactcattgccttatagttaagtgtacagcagatattttgcttttagatactctactaggtacactagtgaaagaactccaaaacaaatatacacctggacgtagagaagaagctattgctgtgacaatgaggtttctacgttcagtggcaagagtttttgttattctgagtgtggaaatggcttcatccaaaaagaaaaacaactttattccacagccaattggaaaatgcaagcgtgtattccaagcattgctaccttacgctgtggaagaattgtgcaacgtagcagagtcactgattgttcctgtcagaatggggattgctcgtccaactgcaccatttaccctggctagtactagcatagatgccatgcagggcagtgaagaattattttcagtggaaccactaccaccacgaccatcatctgatcagtctagcagctccagtcagtctcagtcatcctacatcatcaggaatccacagcagaggcgcatcagccagtcacagcccgttcggggcagagatgaagaacaggatgatattgtttcagcagatgtggaagaggttgaggtggtggagggtgtggctggagaagaggatcatcatgatgaacaggaagaacacggggaagaaaatgctgaggcagagggacaacatgatgagcatgatgaagacgggagtgatatggagctggacttgttagcagcagctgaaacagaaagtgatagtgaaagtaaccacagcaaccaagataatgctagtgggcgcagaagcgttgtcactgcagcaactgctggttcagaagcaggagcaagcagtgttcctgccttcttttctgaagatgattctcaatcgaatgactcaagtgattctgatagcagtagtagtcagagtgacgacatagaacaggagacctttatgcttgatgagccattagaaagaaccacaaatagctcccatgccaatggtgctgcccaagctccccgttcaatgcagtgggctgtccgcaacacccagcatcagcgagcagccagtacagccccttccagtacatctacaccagcagcaagttcagcgggtttgatttatattgatccttcaaacttacgccggagtggtaccatcagtacaagtgctgcagctgcagcagctgctttggaagctagcaacgccagcagttacctaacatctgcaagcagtttagccagggcttacagcattgtcattagacaaatctcggacttgatgggccttattcctaagtataatcacctagtatactctcagattccagcagctgtgaaattgacttaccaagatgcagtaaacttacagaactatgtagaagaaaagcttattcccacttggaactggatggtcagtattatggattctactgaagctcaattacgttatggttctgcattagcatctgctggtgatcctggacatccaaatcatcctcttcacgcttctcagaattcagcgagaagagagaggatgactgcgcgagaagaagctagcttacgaacacttgaaggcagacgacgtgccaccttgcttagcgcccgtcaaggaatgatgtctgcacgaggagacttcctaaattatgctctgtctctaatgcggtctcataatgatgagcattctgatgttcttccagttttggatgtttgctcattgaagcatgtggcatatgtttttcaagcacttatatactggattaaggcaatgaatcagcagacaacattggatacacctcaactagaacgcaaaaggacgcgagaactcttggaactgggtattgataatgaagattcagaacatgaaaatgatgatgacaccaatcaaagtgctactttgaatgataaggatgatgactctcttcctgcagaaactggccaaaaccatccatttttccgacgttcagactccatgacattccttgggtgtatacccccaaatccatttgaagtgcctctggctgaagccatccccttggctgatcagccacatctgttgcagccaaatgctagaaaggaggatctttttggccgtccaagtcagggtctttattcttcatctgccagtagtgggaaatgtttaatggaggttacagtggatagaaactgcctagaggttcttccaacaaaaatgtcttatgctgccaatctgaaaaatgtaatgaacatgcaaaaccggcaaaaaaaagaaggggaagaacagcccgtgctgccagaagaaactgagagttcaaaaccagggccatctgctcatgatcttgctgcacaattaaaaagtagcttactagcagaaataggacttactgaaagtgaagggccacctctcacatctttcaggccacagtgtagctttatgggaatggttatttcccatgatatgctgctaggacgttggcgcctttctttagaactgttcggcagggtattcatggaagatgttggagcagaacctggatcaatcctaactgaattgggtggttttgaggtaaaagaatcaaaattccgcagagaaatggaaaaactgagaaaccagcagtcaagagatttgtcactagaggttgatcgggatcgagatcttctcattcagcagactatgaggcagcttaacaatcactttggtcgaagatgtgctactacaccaatggctgtacacagagtaaaagtcacatttaaggatgagccaggagagggcagtggtgtagcacgaagtttttatacagccattgcacaagcatttttatcaaatgaaaaattgccaaatctagagtgtatccaaaatgccaacaaaggcacccacacaagtttaatgcagagattaaggaaccgaggagagagagaccgggaaagggagagagaaagggaaatgaggaggagtagtggtttgcgagcaggttctcggagggaccgggatagagactttagaagacagctttccatcgacactaggccctttagaccagcctctgaagggaatcctagcgatgatcctgagcctttgccagcacatcggcaggcacttggagagaggctttatcctcgtgtacaagcaatgcaaccagcatttgcaagtaaaatcactggcatgttgttggaattatccccagctcagctgcttctccttctagcaagtgaggattctctgagagcaagagtggatgaggccatggaactcattattgcacatggacgggaaaatggagctgatagtatcctggatcttggattagtagactcctcagaaaaggtacagcaggaaaaccgaaagcgccatggctctagtcgaagtgtagtagatatggatttagatgatacagatgatggtgatgacaatgcccctttgttttaccaacctgggaaaagaggattttatactccaaggcctggcaagaacacagaagcaaggttgaattgtttcagaaacattggcaggattcttggactatgtctgttacagaatgaactatgtcctatcacattgaatagacatgtaattaaagtattgcttggtagaaaagtcaattggcatgattttgctttttttgatcctgtaatgtatgagagtttgcggcaactaatcctcgcgtctcagagttcagatgctgatgctgttttctcagcaatggatttggcatttgcaattgacctgtgtaaagaagaaggtggaggacaggttgaactcattcctaatggtgtaaatataccagtcactccacagaatgtatatgagtatgtgcggaaatacgcagaacacagaatgttggtagttgcagaacagcccttacatgcaatgaggaaaggtctactagatgtgcttccaaaaaattcattagaagatttaacggcagaagattttaggcttttggtaaatggctgcggtgaagtcaatgtgcaaatgctgatcagttttacctctttcaatgatgaatcaggagaaaatgctgagaagcttctgcagttcaagcgttggttctggtcaatagtagagaagatgagcatgacagaacgacaagatcttgtttacttttggacatcaagcccatcactgccagccagtgaagaaggattccagcctatgccctcaatcacaataagaccaccagatgaccaacatcttcctactgcaaatacttgcatttctcgactttacgtcccactctattcctctaaacagattctcaaacagaaattgttactcgccattaagaccaagaattttggttttgtgtagagtataaaaagtgtgtattgctgtgtaatattactagcaaattttgtagatttttttccatttgtctataaaagtttatggaagttaatgctgtcatacccccctggtggtaccttaaagagataaaatgcagacattccttgctgagtttatagcttaaaggcctaaggagcactagcaacatttggctatattggtttgctagtcaccaacttctgggtctaaccccagccaaagatgacagcagaacaacataatttacactgtgatttatctttttgctgagggggaaaaaatgtaaatgttctgaaaattcactgctgcctttgtggaaactgtttcagcaaaggttcttgtatagagggaatagggaatttcaaaataaaaaattaagtatgttctgtgttttcattttaactttttttatggtgtttaatttgtggttggctgcaactgtgtatcatgtatatggaacttgtaaaaaagttctcgacattcagatcttaagagatgaaatcacttttacctataaaaaccacttttattgcggtttgactgcattgagctctaggatattaaatgatatcactaatattttgcatgtaatttgctcatttgagtgagggcactttttttgtacatatgatggggccaatgcacaatacttttatcacaatcaactttttctttgtatccctatttcaatgagcagtcagtctcaagaggttactgcacttcagttctaactagacatttgtactaaggtatttcagttatgtaaactcagcctgggcactttctgataactgtaaaatgttttataagatcatgattattgaagatacattttggaaaattttaaatgttcgtgagcagcttaactacttttgtatctagccttttttaagtatcttgttacatttacttttttaaataaagaaattacagaagaaatgtcaagtaatattgaagaaacaatagtttttatttatgtagttgtacatttttaaactaagggcaatacactgacatggttatgtgcataaaaattttgacttaaagaactggaagtttatatacacctggactataagaaacagaagaaaatcagtccacattttacagttagcagagaatcctaaatggcactggcctggccaccttttcattttacaaatgggggaagtgaagtgtgaccccttacttggcataggaagttaacttacacctaataactgacaggtttttgttttgatgacctattaattatgtagcctaggattaatatcc

SEQ ID NO: 2578 - DNA, 9008 bp, Homo sapiens
cccgtttgcccctcccccgccgctccggagcggagcctgcgagacggagaaactggggcagaagtgaagatggcggcggcagcttctcgctagtgacgcgcggtgcgggctcatctccttcccctccttcctcacctcccctagtccggaccccgtccgccgccgggaccagaccgtccccgtagcccgcagccagcagccgcccctctcctcccccggccgcccctctcccaacgcccgtctgccgctggccggcggcgcgcccctggtcccggccgcctgcctcgcactccgcgctgtcgccgggggagcgggtggcgtgtggattcgccctcctgcccgcccctccgggccgcggacacacgcccggcagggaggcggcggcggcccctgcgtatttgcttccctccatttggggactgggaggcggcggcggctgtgggttttggggaggggtagagggctggggggcgggcgagagcgggagggggccgccctcgagtggaggacgagaaggaaagcaccatgacgtccatccatttcgtggttcacccgctgccgggcaccgaggaccagctcaatgacaggttacgagaagtttctgagaagctgaacaaatataatttaaacagccacccccctttgaatgtattggaacaggctactattaaacagtgtgtggtgggaccaaatcatgctgcctttcttcttgaggatggtagagtttgcaggattggtttttcagtacagccagacagattggaattgggtaaacctgataataatgatgggtcaaagttgaacagcaactcgggggcagggaggacgtcaaggcctggtaggacaagcgactctccatggtttctctcaggttctgagactctaggcaggctggcaggcaacaccttaggaagccgctggagttctggagtgggtggaagtggtggaggatcctctggtaggtcatcagctggagctcgagattcccgccggcagactcgagttattcggacaggacgggatcgagggtctgggcttttgggcagtcagccccagccagttattccagcatctgtcattccagaggagctgatttcacaggcccaagttgttttacaaggcaaatccagaagtgtcattattcgagaacttcagagaacaaatcttgatgtgaaccttgctgtaaataatttacttagccgggatgatgaagatggagatgatggggatgatacagccagcgaatcttatttgcctggagaggatcttatgtctctccttgatgccgacattcattctgcccacccaagtgtcattattgatgcagatgccatgttttctgaagacattagctattttggttacccttcttttcgtcgttcatcactttccaggctaggctcatctcgagagagagactctgagctgttgcgtgaacgtgaatccgttttacgtttacgtgaacgaaggtggcttgatggagcctcatttgataatgaaaggggttctaccagcaaggaaggagagccaaacttggataagaagaatacacctgttcaaagtccagtatctctaggagaagatttgcagtggtggcctgataaggatggaacaaaattcatctgtattggggctctgtattctgaacttctggctgtcagcagtaaaggagaactttatcagtggaaatggagtgaatctgagccttacagaaatgcccagaatccttcattacatcatccacgagcaacatttttggggttaaccaatgaaaagatagtcctcctgtctgcaaatagcataagagcaactgtagctacagaaaataacaaggttgctacatgggtggatgaaactttaagttctgtggcttctaaattagagcacactgctcagacttactctgaacttcaaggagagcggatagtttctttacattgctgtgccctttacacctgcgctcagctggaaaacagtttatattggtggggtgtagttccttttagtcaaaggaagaaaatgttagagaaagctagagcaaaaaataaaaagcctaaatccagtgctggtatttcttcaatgccgaacatcactgttggtacccaggtatgcttgagaaataatcctctttatcatgctggagcagttgcattttcaattagtgctgggattcctaaagttggtgtcttaatggagtcagtttggaatatgaatgacagctgtagatttcaacttagatctcctgaaagcttgaaaaacatggaaaaagctagcaaaactactgaagctaagcctgaaagtaagcaggagccagtgaaaacagaaatgggtcctccaccatctccagcatccacgtgtagtgatgcatcctcaattgccagcagtgcatcaatgccatacaaacgacgacggtcaacccctgcaccaaaagaagaggaaaaggtgaatgaagagcagtggtctcttcgggaagtggtttttgtggaagatgtcaagaatgttcctgttggcaaggtgctaaaagtagatggtgcctatgttgctgtaaaatttccaggaacctccagtaatactaactgtcagaacagctctggtccagatgctgacccttcttctctcctgcaggattgtaggttacttagaattgatgaattgcaggttgtcaaaactggtggaacaccgaaggttcccgactgtttccaaaggactcctaaaaagctttgtatacctgaaaaaacagaaatattagcagtgaatgtagattccaaaggtgttcatgctgttctgaagactggaaattgggtacgatactgtatctttgatcttgctacaggaaaagcagaacaggaaaataattttcctacaagcagcattgctttccttggtcagaatgagaggaatgtagccattttcactgctggacaggaatctcccattattcttcgagatggaaatggtaccatctacccaatggccaaagattgcatgggaggaataagggatcccgattggctggatcttccacctattagtagtcttggaatgggtgtgcattctttaataaatcttcctgccaattcaacaatcaaaaagaaagctgctgttatcatcatggctgtagagaaacaaaccttaatgcaacacattctgcgctgtgactatgaggcctgtcgacaatatctaatgaatcttgagcaagcggttgttttagagcagaatctacagatgctgcagacattcatcagccacagatgtgatggaaatcgaaatattttgcatgcttgtgtatcagtttgctttccaaccagcaataaagaaactaaagaagaagaggaagcggagcgttctgaaagaaatacatttgcagaaaggctttctgctgttgaggccattgcaaatgcaatatcagttgtttcaagtaatggcccaggtaatcgggctggatcatcaagtagccgaagtttgagattacgggaaatgatgagacgttcgttgagagcagctggtttgggtagacatgaagctggagcttcatccagtgaccaccaggatccagtttcaccccccatagctccccctagttgggttcctgaccctcctgcgatggatcctgatggtgacattgattttatcctggcccccgctgtgggatctcttaccacagcagcaaccggtactggtcaaggaccaagcacctccactattccaggtccttccacagagccatctgtagtagaatccaaggatcgaaaggcgaatgctcattttatattgaaattgttatgtgacagtgtggttctccagccctatctacgagaacttctttctgccaaggatgcaagagggatgaccccatttatgtcagctgtaagtggccgagcttatcctgctgcaattaccatcttagaaactgctcagaaaattgcaaaagctgaaatatcctcaagtgaaaaagaggaagatgtattcatgggaatggtttgcccatcaggtaccaaccctgatgactctcctttatatgttttatgttgtaatgacacttgcagttttacatggactggagcagagcacattaaccaggatatttttgagtgtcgaacttgtggcttgctggagtcactgtgttgttgtacggaatgtgcaagggtttgtcataaaggtcatgattgcaaactcaaacggacatcaccaacagcctactgtgattgttgggagaaatgtaaatgtaaaactcttattgctggacagaaatctgctcgtcttgatctactttatcgcctgctcactgctactaatctggttactctgccaaacagcaggggagagcacctcttactattcttagtacagacagtcgcaaggcagacggtggagcattgtcaatacaggccacctcgaatcagggaagatcgtaaccgaaaaacagccagtcctgaagattcagatatgccagatcatgatttagagcctccaagatttgcccagcttgcattggagcgtgttctacaggactggaatgccttgaaatctatgattatgtttgggtcgcaggagaataaagaccctcttagtgccagcagtagaataggccatcttttgccagaagagcaagtatacctcaatcagcaaagtggcacaattcggctggactgtttcactcattgccttatagttaagtgtacagcagatattttgcttttagatactctactaggtacactagtgaaagaactccaaaacaaatatacacctggacgtagagaagaagctattgctgtgacaatgaggtttctacgttcagtggcaagagtttttgttattctgagtgtggaaatggcttcatccaaaaagaaaaacaactttattccacagccaattggaaaatgcaagcgtgtattccaagcattgctaccttacgctgtggaagaattgtgcaacgtagcagagtcactgattgttcctgtcagaatggggattgctcgtccaactgcaccatttaccctggctagtactagcatagatgccatgcagggcagtgaagaattattttcagtggaaccactaccaccacgaccatcatctgatcagtctagcagctccagtcagtctcagtcatcctacatcatcaggaatccacagcagaggcgcatcagccagtcacagcccgttcggggcagagatgaagaacaggatgatattgtttcagcagatgtggaagaggttgaggtggtggagggtgtggctggagaagaggatcatcatgatgaacaggaagaacacggggaagaaaatgctgaggcagagggacaacatgatgagcatgatgaagacgggagtgatatggagctggacttgttagcagcagctgaaacagaaagtgatagtgaaagtaaccacagcaaccaagataatgctagtgggcgcagaagcgttgtcactgcagcaactgctggttcagaagcaggagcaagcagtgttcctgccttcttttctgaagatgattctcaatcgaatgactcaagtgattctgatagcagtagtagtcagagtgacgacatagaacaggagacctttatgcttgatgagccattagaaagaaccacaaatagctcccatgccaatggtgctgcccaagctccccgttcaatgcagtgggctgtccgcaacacccagcatcagcgagcagccagtacagccccttccagtacatctacaccagcagcaagttcagcgggtttgatttatattgatccttcaaacttacgccggagtggtaccatcagtacaagtgctgcagctgcagcagctgctttggaagctagcaacgccagcagttacctaacatctgcaagcagtttagccagggcttacagcattgtcattagacaaatctcggacttgatgggccttattcctaagtataatcacctagtatactctcagattccagcagctgtgaaattgacttaccaagatgcagtaaacttacagaactatgtagaagaaaagcttattcccacttggaactggatggtcagtattatggattctactgaagctcaattacgttatggttctgcattagcatctgctggtgatcctggacatccaaatcatcctcttcacgcttctcagaattcagcgagaagagagaggatgactgcgcgagaagaagctagcttacgaacacttgaaggcagacgacgtgccaccttgcttagcgcccgtcaaggaatgatgtctgcacgaggagacttcctaaattatgctctgtctctaatgcggtctcataatgatgagcattctgatgttcttccagttttggatgtttgctcattgaagcatgtggcatatgtttttcaagcacttatatactggattaaggcaatgaatcagcagacaacattggatacacctcaactagaacgcaaaaggacgcgagaactcttggaactgggtattgataatgaagattcagaacatgaaaatgatgatgacaccaatcaaagtgctactttgaatgataaggatgatgactctcttcctgcagaaactggccaaaaccatccatttttccgacgttcagactccatgacattccttgggtgtatacccccaaatccatttgaagtgcctctggctgaagccatccccttggctgatcagccacatctgttgcagccaaatgctagaaaggaggatctttttggccgtccaagtcagggtctttattcttcatctgccagtagtgggaaatgtttaatggaggttacagtggatagaaactgcctagaggttcttccaacaaaaatgtcttatgctgccaatctgaaaaatgtaatgaacatgcaaaaccggcaaaaaaaagaaggggaagaacagcccgtgctgccagaagaaactgagagttcaaaaccagggccatctgctcatgatcttgctgcacaattaaaaagtagcttactagcagaaataggacttactgaaagtgaagggccacctctcacatctttcaggccacagtgtagctttatgggaatggttatttcccatgatatgctgctaggacgttggcgcctttctttagaactgttcggcagggtattcatggaagatgttggagcagaacctggatcaatcctaactgaattgggtggttttgaggtaaaagaatcaaaattccgcagagaaatggaaaaactgagaaaccagcagtcaagagatttgtcactagaggttgatcgggatcgagatcttctcattcagcagactatgaggcagcttaacaatcactttggtcgaagatgtgctactacaccaatggctgtacacagagtaaaagtcacatttaaggatgagccaggagagggcagtggtgtagcacgaagtttttatacagccattgcacaagcatttttatcaaatgaaaaattgccaaatctagagtgtatccaaaatgccaacaaaggcacccacacaagtttaatgcagagattaaggaaccgaggagagagagaccgggaaagggagagagaaagggaaatgaggaggagtagtggtttgcgagcaggttctcggagggaccgggatagagactttagaagacagctttccatcgacactaggccctttagaccagcctctgaagggaatcctagcgatgatcctgagcctttgccagcacatcggcaggcacttggagagaggctttatcctcgtgtacaagcaatgcaaccagcatttgcaagtaaaatcactggcatgttgttggaattatccccagctcagctgcttctccttctagcaagtgaggattctctgagagcaagagtggatgaggccatggaactcattattgcacatggacgggaaaatggagctgatagtatcctggatcttggattagtagactcctcagaaaaggtacaggaaaaccgaaagcgccatggctctagtcgaagtgtagtagatatggatttagatgatacagatgatggtgatgacaatgcccctttgttttaccaacctgggaaaagaggattttatactccaaggcctggcaagaacacagaagcaaggttgaattgtttcagaaacattggcaggattcttggactatgtctgttacagaatgaactatgtcctatcacattgaatagacatgtaattaaagtattgcttggtagaaaagtcaattggcatgattttgctttttttgatcctgtaatgtatgagagtttgcggcaactaatcctcgcgtctcagagttcagatgctgatgctgttttctcagcaatggatttggcatttgcaattgacctgtgtaaagaagaaggtggaggacaggttgaactcattcctaatggtgtaaatataccagtcactccacagaatgtatatgagtatgtgcggaaatacgcagaacacagaatgttggtagttgcagaacagcccttacatgcaatgaggaaaggtctactagatgtgcttccaaaaaattcattagaagatttaacggcagaagattttaggcttttggtaaatggctgcggtgaagtcaatgtgcaaatgctgatcagttttacctctttcaatgatgaatcaggagaaaatgctgagaagcttctgcagttcaagcgttggttctggtcaatagtagagaagatgagcatgacagaacgacaagatcttgtttacttttggacatcaagcccatcactgccagccagtgaagaaggattccagcctatgccctcaatcacaataagaccaccagatgaccaacatcttcctactgcaaatacttgcatttctcgactttacgtcccactctattcctctaaacagattctcaaacagaaattgttactcgccattaagaccaagaattttggttttgtgtagagtataaaaagtgtgtattgctgtgtaatattactagcaaattttgtagatttttttccatttgtctataaaagtttatggaagttaatgctgtcatacccccc

SEQ ID NO: 2579 - DNA, 1910 bp, Homo sapiens
tattatatgtgcctatcaccctgaggagtaatttgattcaggtgttctagaagtcatgatgtgggctgtgtctgttgaattcccagcgatgcaaggggacacaccctgtgactcattccttaattgagtgctgatatttgattggtttatcgcacacctgatgggtgggtggggtgttcgcggttggtgggggtgagttatataagggctgatgcggccagagagctcgtcatttgaagactctcttggaagagatagcgtcttgctgcaacctgcagtcccagcagaaaaaccttgtgatccttgttgcgggcgacatggaggacgactcactctacttgggaggtgagtggcagttcaaccacttttcaaaactcacatcttctcggccagatgcagcttttgctgaaatccagcggacttctctccctgagaagtcaccactctcatctgaggcccgtgtcgacctctgtgatgatttggctcctgtggcaagacagcttgctcccaggaagaagcttcctctgagtagcaggagacctgctgcggtgggggctgggctccagaatatgggaaatacctgctacgagaacgcttccctgcagtgcctgacatacacaccgccccttgccaactacatgctgtcccgggagcactctcaaacatgtcagcgtcccaagtgctgcatgctctgtactatgcaagctcacatcacatgggccctccacagtcctggtcatgtcatccagccctcacaggcattggctgctggcttccatagaggcaagcaggaagatgcccatgaatttctcatgttcactgtggatgccatgaaaaaggcatgccttcccggccacaagcaggtagatcatcactctaaggacaccaccctcatccaccaaatatttggaggctgctggagatctcaaatcaagtgtctccactgccacgggatttcagacacttttgacccttacctggacatcgccctggatatccaggcagctcagagtgtcaagcaagctttggaacagttggtgaagcccgaagaactcaatggagagaatgcctatcattgcggtctttgtctccagagggcgccggcctccaagacgttaactttacacacttctgccaaggtcctcatccttgtcttgaagagattctccgatgtcacaggcaacaaacttgccaagaatgtgcaatatcctgagtgccttgacatgcagccatacatgtctcagcagaacacaggacctcttgtctatgtcctctatgctgtgctggtccacgctgggtggagttgtcacgacggacattacttctcttatgtcaaagctcaagaaggccagtggtataaaatggatgatgccaaggtcactgcctgtagcatcacttctgtcctgagtcaacaggcctatgtcctcttttacatccagaagagtgaatgggaaagacacagtgagagtgtgtcaagaggcagggaaccaagagccctcggcgctgaagacacagacaggcgagcaacgcaaggagagctcaagagagaccacccctgcctccaggcacccgagttggacgagcgcttggtggaaagagccactcaggaaagcaccttagaccactggaaattcccccaagagcaaaacaaaacgaagcctgagttcaacgtcagaaaagtcgaaggtaccctgcctcccaacgtacttgtgattcatcaatcgaaatacaagtgtgggatgaaaaaccatcatcctgaacagcaaagctccctgctaaacctctcttcgacgacccggacagatcaggagtccgtgaacactggcaccctcgcttctctgcaagggaggaccaggagatccaaagggaagaacaaacacagcaagagggctctgcttgtgtgccagtga

SEQ ID NO: 2580 - DNA, 8032 bp, Homo sapiens
gtgcgtgcgtgtttgcgtgtggtcacagttcccgccatcagccgctctccctgactaggggtagctagcggcctccctcctttgggttcggtatccctacttccattaccctcggctcctcccactcctcgcgggctccgtgctttccgcgggtctgtccgggggctccggaccctcggcgcagctgagttgatggcttccggagaactggcatagctgcagaatatgagtagtgtcccaagaagagtgctttgcctttggcacaaggatcagaataaaggtgaattgctattacatagggtttttcggtaaaagtcactgaaaattatttgccatacagtaaccagagacctccaactaggggcccccaaactgtatcctgcctgtagccagaagcaatttttaaagaaaatatgtctcctctgaagatacatggtcctatcagaattcgaagtatgcagactgggattacaaagtggaaagaaggatcctttgaaattgtagaaaaagagaataaagtcagcctagtagttcactacaatactggaggaattccaaggatatttcagctaagtcataacattaaaaatgtggtgcttcgacccagtggagcgaaacaaagccgcctaatgttaactctgcaagataacagcttcttgtctattgacaaagtaccaagtaaggatgcagaggaaatgaggttgtttctagatgcagtccatcaaaacagacttcctgcagccatgaaaccgtctcaggggtctggtagttttggagccattctgggcagcaggacctcacagaaggaaaccagcaggcagctttcttactcagacaatcaggcttctgcaaaaagaggaagtttggaaactaaagatgatattccatttcgaaaagttcttggtaatccgggtagaggatcgattaagactgtagcaggaagtggaatagctcggacgattccttctttgacatctacttcaacacctcttagatcagggttgctagaaaatcgtactgaaaagaggaaaagaatgatatcaactggctcagaattgaatgaagattaccctaaggaaaatgattcatcatcgaacaacaaggccatgacagatccctccagaaagtatttaaccagcagtagagaaaagcagctgagtttgaaacagtcagaagagaataggacatcagggcttttacctttacagtcatcatccttttatggtagcagagctggatccaaggaacactcttctggtggcactaacttagacaggactaatgtttcaagccagactccctctgccaaaagaagtttgggatttcttcctcagccagttcctctttctgttaaaaaactgaggtgtaaccaggattacactggctggaataaaccaagagtgcccctttcctctcaccaacagcagcaactgcagggcttctccaatttgggaaatacctgctatatgaatgctattctacaatctctattttcactccagtcatttgcaaatgacttgcttaaacaaggtatcccatggaagaaaattccactcaatgcacttatcagacgctttgcacacttgcttgttaaaaaagatatctgtaattcagagaccaaaaaggatttactcaagaaggttaaaaatgccatttcagctacagcagagagattctctggttatatgcagaatgatgctcatgaatttttaagtcagtgtttggaccagctgaaagaagatatggaaaaattaaataaaacttggaagactgaacctgtttctggagaagaaaattcaccagatatttcagctaccagagcatacacttgccctgttattactaatttggagtttgaggttcagcactccatcatttgtaaagcatgtggagagattatccccaaaagagaacagtttaatgacctctctattgaccttcctcgtaggaaaaaaccactccctcctcgttcaattcaagattctcttgatcttttctttagggccgaagaactggagtattcttgtgagaagtgtggtgggaagtgtgctcttgtcaggcacaaatttaacaggcttcctagggtcctcattctccatttgaaacgatatagcttcaatgtggctctctcgcttaacaataagattgggcagcaagtcatcattccaagatacctgaccctgtcatctcattgcactgaaaatacaaaaccaccttttacccttggttggagtgcacatatggcaatttctagaccattgaaagcctctcaaatggtgaattcctgcatcaccagcccttctacaccttcaaagaaattcaccttcaaatccaagagctccttggctttatgccttgattcagacagtgaggatgagctaaaacgttctgtggccctcagccagagactttgtgaaatgttaggcaacgaacagcagcaggaagacctggaaaaagattcaaaattatgcccaatagagcctgacaagtctgaattggaaaactcaggatttgacagaatgagcgaagaagagcttctagcagctgtcttggagataagtaagagagatgcttcaccatctctgagtcatgaagatgatgataagccaactagcagcccagataccggatttgcagaagatgatattcaagaaatgccagaaaatccagacactatggaaactgagaagcccaaaacaatcacagagctggatcctgccagttttactgagataactaaagactgtgatgagaataaagaaaacaaaactccagaaggatctcagggagaagttgattggctccagcagtatgatatggagcgtgaaagggaagagcaagagcttcagcaggcactggctcagagccttcaagagcaagaggcttgggaacagaaagaagatgatgacctcaaaagagctaccgagttaagtcttcaagagtttaacaactcctttgtggatgcattgggttctgatgaggactctggaaatgaggatgtttttgatatggagtacacagaagctgaagctgaggaactgaaaagaaatgctgagacaggaaatctgcctcattcgtaccggctcatcagtgttgtcagtcacattggtagcacttcttcttcaggtcattacattagtgatgtatatgacattaagaagcaagcgtggtttacttacaatgacctggaggtatcaaaaatccaagaggctgccgtgcagagtgatcgagatcggagtggctacatcttcttttatatgcacaaggagatctttgatgagctgctggaaacagaaaagaactctcagtcacttagcacggaagtggggaagactacccgtcaggccttgtgaggaacaaactcctgggttggcagcatgcactgcatatttgttactgctgcccacctcacctttcctctgctgaaggagaatttggaattctacttgatgcgggagcaacaaacagctcagggccaaaccaaaagacaaaaattggagtaacgtagaatgctccatgctattttatggaaactttggtctcacatccgtagctgattatcctctttttctcctatgagtggcacttcttttgtcttaggaatacatgttgtaaatatatatctgtgtatgtgtgtatacacacacacagacacacacacacacacacgggatgaatggagccttaaagagttaggatgagccaccagaatatgcctgctcaaaattaatagcacagcagtttggagaagaaatgaaggtgtcaaagagtccattcacctgagaaatgtgtgaagacatacttatcagttggcttttagcttttatgttccttgagtagtttcactcaagtctgtaaccttttgtgtttccttattagtaaaattcactggaaagccagctcttcatgttacactaatgacagtttgttctctttgcaagagaggggcattactgtcacctgacttgaggagctgttttgttgttgttgttgtctgcaaatttcatgaatttgtgatgtctttgctgtttacatgcagtcccaagaaatggattgttggtgctttggaatatgttacagtcccacatttgatatttcttatatactttgttttctctaaggagatttcttcacacagtatgttcatcatatatcatcatcattattatggtggtaaagatagaatcttttttcttttttgtcattctgccatggagcagcattaccctaatggattgcaaccaaaactttaaacaagtagaaagataatatttctccaattgggactccccagcaggaatacttagggataaggaagaatgctagcatctctgtctctcaaacatagggaggataagaagagtgttcttctggtaaagctaaaattctggaccactgaagctaaaagccctattgcaagtatgaaattaagtacttgagctgtaggacaaaccttgggcatttaaccatttactgtctggctttgcccttaaaatagggttgcaattaaaatgtgattggcttaggtaatcccaaaaactaacaaataacaaaggtgcataatttatttatctactttttaggtgctctgagttgaggcaaagtagagcggcaacattaagtgctatgctagtcacttagctgacgtaaccagcttggttaagcagcttatgaaaccatataaagaattcttttgaggatggaattctgtccacaaaataattttgtgagcccagatatcattaggatcacacagagttaaatatagaaaaatgaaaccatcattatattctttcgtgttttttcttttattataaacaaggggattattctttagttctcagaggtagggacaaaaccacatcaggttttcagaaggaaaaaacatttaaaaacccaccatcacatgagagaatcacttgaacccaggaggcagaggttgcagtgagctgagatcgcatcattgcactgcagtctgagtgacagagtgagactccatctcattaaaaaaaacgaaaacaaaaacaaaaaaaacacaaaccatcatcacagaagatgcaacatcttttctgaaagattgccttaagagagctccagtcctactcttggaacttggatgtattctaatgtagtaaactattctaagttttcattctttgaattataaatggcctcagcagttttgctcaactactgataaatgctttgcctcctaccatctacctatataccttattgtaatgaatgttccaaaatggtagagtggtagaaaacgccagagtagtttagagcagaggaaaatatttgttttaaaactagctttaaagttttgtttcatttctaccaggagcctctttggtttggtttgattttgcttggaaataattggttttcttataaatgagtgaagcggtgataaaattctttggctagttattaattcttttacgtgtctttgcatttgagaggcactgttaaaaattattgggaaagatttaaagtgcaggctgcaattaaaacatggagaaaagtagaaataatgccataagtctagattgcctcatgaagcagcctcatttgaattgctttcatagctttcatgtgtgtatggtttagaagtacacttacctcagaaacctgatttgatcttcatgtcttgggcaggagttgttgaaaataggttattggaatatataagttatctcactgctcatgtacttgcatgtttgggactcaaattttacttgatgtctgtccattcttgtggccctatcagccttctccttcctttactcctttaatctacttctttgactaccagtggagatttcagctggactatgttgatggggtttgttgttgtttttgagctggctgtatatattttaaaattataaatagataatatattattttttgcacattgtgatcagtttgcccagaattggggatggggcagttagcatgttggggccaggaagggacaagttagataaggactgagtgcttccgttgcaggcagtttgcacaatacctaattaaccttcctattgaaaataccaaatgtgtggttacattactttaaatgacattgaattggaacttgatggcaattagttctagatacaaccttttgatctttgttggaattttaagggaaaaatgaactaaacttcatatttgttgattttaatcacctaatagtactgaaggttggaaagttgcatgtggctggatgctgttaatttctttaatagccatgactataatttaagcctatgagaagatagactgtttcgtagggatatattcacatgtgtgtgcacactcatgagttttgtctcagcaggatagaataagcaaatccatgaactggtcttctattaatactttgattctaaaaattatttgtttacttgctatggtctgttcattctgggcctaaccttaaaggctcaataacaaatacaacaaatgtaaatatgtttacattttaagacatatgcagtggttcttacagatcagttaattaactccagaaagcaaatgttagactacacatttatttttctccttgatcaagtataaaattctgaaacagaggctttaaaatttaaaacctcagcaaaataatccatgaatttactgattcttctgtatcgtgtgtagttaccattatgtaactatacacacatacagctacggatataatgaaaattatctgcaaacacctaaattaaagagaaaaaaaagtagtttgtaaactcatttgtgatctactgaaaagaggttatattaaagcaaattaaaatattttccttctctgtcctctgaaatgactgcagtagatactcttagttatcccatttagggtggttggagggcctttttaatttaattgaccccccgaggtggtcttttgttttaaacagggggcaacagctggatctccaagtacatatggattttgtatatataggagatttttagaaaaatcaacaacctaacaccagattcaagtcacataaaagtgttccaataaaatggatggatgtctttttcctccccattttgctttatactgagtaatgcactcttgcaagtgtatacaaaaactaaatagacttctgccctccaacatctttttattgcattacttcaaaatcctaattttgtctctactgatatgtcttattaacatctgaaaaaatatatattttttattggaaaattctaatttgttaggccttgaaagttttgtgacaattattttgctgtgtttaaccacaatcattcaccttatggcatgctttgattactagacttcaggcagtctcattcattgtatcatacttacacacaattagtaagttgtctccatgtgtgctatatgtctgaggtgtatggagtttttatttaaaaagtgtgccagtctgaatataagcatttgattttgtaacattggacttttcttaaaagtacagaggttcaaagtataggtatgtccattggcataagaatagagtgggtgagggtctggaccaggttccaggttggtccagtcagatgccagaacaaagaagaacagtcaactaaactggtctacttcaaaaatagtgggcctgtgtgaagagtgagaccacatgtgggtgtgcacacctcttgtccccaggtttccctccctttgagcttttctttccctccctaacttctctggcctattgtcattgttgtttctttaaacttaaggagagaaaaacaaaaatgagattcctacactttgcctaattgagccactaccaggttttctggcagctgtggccacattatttgtgagatgattttttttctttatgttcagagtgacttttgattctgattctttatgttttgtatggagcggcacttttatctgtgttttagcagaactgttcctctgtatcctttacggtttttctttgtttttgtttcctttttaaattatgcatagagtttttttgtgtgtatgaaattaaagcctttattaaccttc

SEQ ID NO: 2581 - DNA, 3353 bp, Homo sapiens
gcctccctcctttgggttcggtatccctacttccattaccctcggctcctcccactcctcgcgggctccgtgctttccgcgggtctgtccgggggctccggaccctcggcgcagctgagttgatggcttccggagaactggcatagctgcagaatatgagtagtgtcccaagaagagtgctttgcctttggcacaaggatcagaataaagttatttgccatacagtaaccagagacctccaactaggggcccccaaactgtatcctgcctgtagccagaagcaatttttaaagaaaatatgtctcctctgaagatacatggtcctatcagaattcgaagtatgcagactgggattacaaagtggaaagaaggatcctttgaaattgtagaaaaagagaataaagtcagcctagtagttcactacaatactggaggaattccaaggatatttcagctaagtcataacattaaaaatgtggtgcttcgacccagtggagcgaaacaaagccgcctaatgttaactctgcaagataacagcttcttgtctattgacaaagtaccaagtaaggatgcagaggaaatgaggttgtttctagatgcagtccatcaaaacagacttcctgcagccatgaaaccgtctcaggggtctggtagttttggagccattctgggcagcaggacctcacagaaggaaaccagcaggcagctttcttactcagacaatcaggcttctgcaaaaagaggaagtttggaaactaaagatgatattccatttcgaaaagttcttggtaatccgggtagaggatcgattaagactgtagcaggaagtggaatagctcggacgattccttctttgacatctacttcaacacctcttagatcagggttgctagaaaatcgtactgaaaagaggaaaagaatgatatcaactggctcagaattgaatgaagattaccctaaggaaaatgattcatcatcgaacaacaaggccatgacagatccctccagaaagtatttaaccagcagtagagaaaagcagctgagtttgaaacagtcagaagagaataggacatcagggcttttacctttacagtcatcatccttttatggtagcagagctggatccaaggaacactcttctggtggcactaacttagacaggactaatgtttcaagccagactccctctgccaaaagaagtttgggatttcttcctcagccagttcctctttctgttaaaaaactgaggtgtaaccaggattacactggctggaataaaccaagagtgcccctttcctctcaccaacagcagcaactgcagggcttctccaatttgggaaatacctgctatatgaatgctattctacaatctctattttcactccagtcatttgcaaatgacttgcttaaacaaggtatcccatggaagaaaattccactcaatgcacttatcagacgctttgcacacttgcttgttaaaaaagatatctgtaattcagagaccaaaaaggatttactcaagaaggttaaaaatgccatttcagctacagcagagagattctctggttatatgcagaatgatgctcatgaatttttaagtcagtgtttggaccagctgaaagaagatatggaaaaattaaataaaacttggaagactgaacctgtttctggagaagaaaattcaccagatatttcagctaccagagcatacacttgccctgttattactaatttggagtttgaggttcagcactccatcatttgtaaagcatgtggagagattatccccaaaagagaacagtttaatgacctctctattgaccttcctcgtaggaaaaaaccactccctcctcgttcaattcaagattctcttgatcttttctttagggccgaagaactggagtattcttgtgagaagtgtggtgggaagtgtgctcttgtcaggcacaaatttaacaggcttcctagggtcctcattctccatttgaaacgatatagcttcaatgtggctctctcgcttaacaataagattgggcagcaagtcatcattccaagatacctgaccctgtcatctcattgcactgaaaatacaaaaccaccttttacccttggttggagtgcacatatggcaatttctagaccattgaaagcctctcaaatggtgaattcctgcatcaccagcccttctacaccttcaaagaaattcaccttcaaatccaagagctccttggctttatgccttgattcagacagtgaggatgagctaaaacgttctgtggccctcagccagagactttgtgaaatgttaggcaacgaacagcagcaggaagacctggaaaaagattcaaaattatgcccaatagagcctgacaagtctgaattggaaaactcaggatttgacagaatgagcgaagaagagcttctagcagctgtcttggagataagtaagagagatgcttcaccatctctgagtcatgaagatgatgataagccaactagcagcccagataccggatttgcagaagatgatattcaagaaatgccagaaaatccagacactatggaaactgagaagcccaaaacaatcacagagctggatcctgccagttttactgagataactaaagactgtgatgagaataaagaaaacaaaactccagaaggatctcagggagaagttgattggctccagcagtatgatatggagcgtgaaagggaagagcaagagcttcagcaggcactggctcagagccttcaagagcaagaggcttgggaacagaaagaagatgatgacctcaaaagagctaccgagttaagtcttcaagagtttaacaactcctttgtggatgcattgggttctgatgaggactctggaaatgaggatgtttttgatatggagtacacagaagctgaagctgaggaactgaaaagaaatgctgagacaggaaatctgcctcattcgtaccggctcatcagtgttgtcagtcacattggtagcacttcttcttcaggtcattacattagtgatgtatatgacattaagaagcaagcgtggtttacttacaatgacctggaggtatcaaaaatccaagaggctgccgtgcagagtgatcgagatcggagtggctacatcttcttttatatgcacaaggagatctttgatgagctgctggaaacagaaaagaactctcagtcacttagcacggaagtggggaagactacccgtcaggccttgtgaggaacaaactcctgggttggcagcatgcactgcatatttgttactgctgcccacctcacctttcctctgctgaaggagaatttggaattctacttgatgcgggagcaacaaacag

SEQ ID NO: 2582 - DNA, 5019 bp, Homo sapiens
atcagccgctctccctgactaggggtagctagcggcctccctcctttgggttcggtatccctacttccattaccctcggctcctcccactcctcgcgggctccgtgctttccgcgggtctgtccgggggctccggaccctcggcgcagctgagttgatggcttccggagaactggcatagctgcagaatatgagtagtgtcccaagaagagtgctttgcctttggcacaaggatcagaataaaggtgaattgctattacatagggtttttcggtaaaagtcactgaaaattatttgccatacagtaaccagagacctccaactaggggcccccaaactgtatcctgcctgtagaacctgccaggtaaaggtatatttttgctttttaatttagccagaagcaatttttaaagaaaatatgtctcctctgaagatacatggtcctatcagaattcgaagtatgcagactgggattacaaagtggaaagaaggatcctttgaaattgtagaaaaagagaataaagtcagcctagtagttcactacaatactggaggaattccaaggatatttcagctaagtcataacattaaaaatgtggtgcttcgacccagtggagcgaaacaaagccgcctaatgttaactctgcaagataacagcttcttgtctattgacaaagtaccaagtaaggatgcagaggaaatgaggttgtttctagatgcagtccatcaaaacagacttcctgcagccatgaaaccgtctcaggggtctggtagttttggagccattctgggcagcaggacctcacagaaggaaaccagcaggcagctttcttactcagacaatcaggcttctgcaaaaagaggaagtttggaaactaaagatgatattccatttcgaaaagttcttggtaatccgggtagaggatcgattaagactgtagcaggaagtggaatagctcggacgattccttctttgacatctacttcaacacctcttagatcagggttgctagaaaatcgtactgaaaagaggaaaagaatgatatcaactggctcagaattgaatgaagattaccctaaggaaaatgattcatcatcgaacaacaaggccatgacagatccctccagaaagtatttaaccagcagtagagaaaagcagctgagtttgaaacagtcagaagagaataggacatcagggcttttacctttacagtcatcatccttttatggtagcagagctggatccaaggaacactcttctggtggcactaacttagacaggactaatgtttcaagccagactccctctgccaaaagaagtttgggatttcttcctcagccagttcctctttctgttaaaaaactgaggtgtaaccaggattacactggctggaataaaccaagagtgcccctttcctctcaccaacagcagcaactgcagggcttctccaatttgggaaatacctgctatatgaatgctattctacaatctctattttcactccagtcatttgcaaatgacttgcttaaacaaggtatcccatggaagaaaattccactcaatgcacttatcagacgctttgcacacttgcttgttaaaaaagatatctgtaattcagagaccaaaaaggatttactcaagaaggttaaaaatgccatttcagctacagcagagagattctctggttatatgcagaatgatgctcatgaatttttaagtcagtgtttggaccagctgaaagaagatatggaaaaattaaataaaacttggaagactgaacctgtttctggagaagaaaattcaccagatatttcagctaccagagcatacacttgccctgttattactaatttggagtttgaggttcagcactccatcatttgtaaagcatgtggagagattatccccaaaagagaacagtttaatgacctctctattgaccttcctcgtaggaaaaaaccactccctcctcgttcaattcaagattctcttgatcttttctttagggccgaagaactggagtattcttgtgagaagtgtggtgggaagtgtgctcttgtcaggcacaaatttaacaggcttcctagggtcctcattctccatttgaaacgatatagcttcaatgtggctctctcgcttaacaataagattgggcagcaagtcatcattccaagatacctgaccctgtcatctcattgcactgaaaatacaaaaccaccttttacccttggttggagtgcacatatggcaatttctagaccattgaaagcctctcaaatggtgaattcctgcatcaccagcccttctacaccttcaaagaaattcaccttcaaatccaagagctccttggctttatgccttgattcagacagtgaggatgagctaaaacgttctgtggccctcagccagagactttgtgaaatgttaggcaacgaacagcagcaggaagacctggaaaaagattcaaaattatgcccaatagagcctgacaagtctgaattggaaaactcaggatttgacagaatgagcgaagaagagcttctagcagctgtcttggagataagtaagagagatgcttcaccatctctgagtcatgaagatgatgataagccaactagcagcccagataccggatttgcagaagatgatattcaagaaatgccagaaaatccagacactatggaaactgagaagcccaaaacaatcacagagctggatcctgccagttttactgagataactaaagactgtgatgagaataaagaaaacaaaactccagaaggatctcagggagaagttgattggctccagcagtatgatatggagcgtgaaagggaagagcaagagcttcagcaggcactggctcagagccttcaagagcaagaggcttgggaacagaaagaagatgatgacctcaaaagagctaccgagttaagtcttcaagagtttaacaactcctttgtggatgcattgggttctgatgaggactctggaaatgaggatgtttttgatatggagtacacagaagctgaagctgaggaactgaaaagaaatgctgagacaggaaatctgcctcattcgtaccggctcatcagtgttgtcagtcacattggtagcacttcttcttcaggtcattacattagtgatgtatatgacattaagaagcaagcgtggtttacttacaatgacctggaggtatcaaaaatccaagaggctgccgtgcagagtgatcgagatcggagtggctacatcttcttttatatgcacaaggagatctttgatgagctgctggaaacagaaaagaactctcagtcacttagcacggaagtggggaagactacccgtcaggccttgtgaggaacaaactcctgggttggcagcatgcactgcatatttgttactgctgcccacctcacctttcctctgctgaaggagaatttggaattctacttgatgcgggagcaacaaacagctcagggccaaaccaaaagacaaaaattggagtaacgtagaatgctccatgctattttatggaaactttggtctcacatccgtagctgattatcctctttttctcctatgagtggcacttcttttgtcttaggaatacatgttgtaaatatatatctgtgtatgtgtgtatacacacacacagacacacacacacacacacgggatgaatggagccttaaagagttaggatgagccaccagaatatgcctgctcaaaattaatagcacagcagtttggagaagaaatgaaggtgtcaaagagtccattcacctgagaaatgtgtgaagacatacttatcagttggcttttagcttttatgttccttgagtagtttcactcaagtctgtaaccttttgtgtttccttattagtaaaattcactggaaagccagctcttcatgttacactaatgacagtttgttctctttgcaagagaggggcattactgtcacctgacttgaggagctgttttgttgttgttgttgtctgcaaatttcatgaatttgtgatgtctttgctgtttacatgcagtcccaagaaatggattgttggtgctttggaatatgttacagtcccacatttgatatttcttatatactttgttttctctaaggagatttcttcacacagtatgttcatcatatatcatcatcattattatggtggtaaagatagaatcttttttcttttttgtcattctgccatggagcagcattaccctaatggattgcaaccaaaactttaaacaagtagaaagataatatttctccaattgggactccccagcaggaatacttagggataaggaagaatgctagcatctctgtctctcaaacatagggaggataagaagagtgttcttctggtaaagctaaaattctggaccactgaagctaaaagccctattgcaagtatgaaattaagtacttgagctgtaggacaaaccttgggcatttaaccatttactgtctggctttgcccttaaaatagggttgcaattaaaatgtgattggcttaggtaatcccaaaaactaacaaataacaaaggtgcataatttatttatctactttttaggtgctctgagttgaggcaaagtagagcggcaacattaagtgctatgctagtcacttagctgacgtaaccagcttggttaagcagcttatgaaaccatataaagaattcttttgaggatggaattctgtccacaaaataattttgtgagcccagatatcattaggatcacacagagttaaatatagaaaaatgaaaccatcattatattctttcgtgttttttcttttattataaacaaggggattattctttagttctcagaggtagggacaaaaccacatcaggttttcagaaggaaaaaacatttaaaaacccaccatcacatgagagaatcacttgaacccaggaggcagaggttgcagtgagctgagatcgcatcattgcactgcagtctgagtgacagagtgagactccatctcattaaaaaaaacg

SEQ ID NO: 2583 - DNA, 1183 bp, Homo sapiens
gatgagaccagaggccgaactcaggttctgatggccgagctgccccacaggatcatcaaggaaacccagcgtttgctggcagagccagttcctggcatcaaagcagaaccagatgaaagcaacgcccgttattttcatgtggtcattgctggggaatcaaaggattccccctttgagggagggacttttaaacgtgaactattacttgcagaagaatacccaatggcagcccctaaagtacgtttcatgaccaaaatttatcatccaaatgtagacaagttggaaagaataagtttagatattttgaaagataagtggtccccagccctgcagatccgcacagttctgctatcgatccaggccttgttaaatgctcccaatccagatgatccattagcaaatgatgtagtggagcagtggaagaccaacgaagcccaagccattgaaacagctagagcatggactaggctatatgccatgaatagtatttaaattgatccaatcattaagtgtgcatcacttctcctgttctgccaagacttcttcctttttgcttgcatttaatggacatagtcttagaaacattacagaataaaaaaacccagacatcttcagttatttggtgattaaatgtacattagcaaatctatgtcttgtcctgattcactgtcataaagcatgagcagaggctagacgtatcatccggattgttgtgaaacgtttaaaagcagtggtccctccctgcttttattcatttcccccatcctggtttaagtataaagcactgtgaatgaaggtagttgtcaggttagctgcaagggtgtgggtgtttttctttattttatttttttgaggggggtaagtagttttattttaattttatgggctcctttccccgcctttttggtgatctaattggattggttaaaagcagctaaccagttctttagaaatatgctctctatccaagtctaactttatttagacactgtagatggacaagcttgattgtttgaaccaaaatgggaacatttaacaagcatcactgccctcactaataacattgtgactttgctgtcaagtgtagagtccccccttcaaaataagcttgtgaccattttgtatggcttgtctggaaacttctgtaaatcttatgttttactaaaatattttttgttattgt

SEQ ID NO: 2584 - DNA, 2112 bp, Homo sapiens
cccgctcctccccgccctgccgcgcgtgggcacctgggaagaggcggagaacaatatggcggatggcgaggagccaatggctgttgatggtgggtgtggggacactggagactgggaaggtcgctggaaccatgtaaagaagttcctcgagcgatctggacccttcacacaccctgatttcgaaccgagcactgaatctctccagttcttgttagatacatgtaaagttctagtcattggagctggcggcttaggatgtgagctcctgaaaaatctggccttgtctggttttagacagattcatgttatagatatggacactatagatgtttccaatctaaataggcagtttttatttaggcctaaagatattggaagacctaaggctgaagttgctgcagaatttctaaatgacagagttcctaattgcaatgtagttccacatttcaacaagattcaagattttaacgacactttctatcgacaatttcatattattgtatgtggactggactctatcatcgccagaagatggataaatggcatgctgatatctcttctaaattatgaagatggtgtcttagatccaagctccattgtccctttgatagatggggggacagaaggttttaaaggaaatgcccgggtgattctgcctggaatgactgcttgtatcgaatgcacgctggaactttatccaccacaggttaattttcccatgtgcaccattgcatctatgcccaggctaccagaacactgtattgagtatgtaaggatgttgcagtggcctaaggagcagccttttggagaaggggttccattagatggagatgatcctgaacatatacaatggattttccaaaaatccctagagagagcatcacaatataatattaggggtgttacgtataggctcactcaaggggtagtaaaaagaatcattcctgcagtagcttccacaaatgcagtcattgcagctgtgtgtgccactgaggtttttaaaatagccacaagtgcatacattcccttgaataattacttggtgtttaatgatgtagatgggctgtatacatacacatttgaagcagaaagaaaggaaaactgcccagcttgtagccagcttcctcaaaatattcagttttctccatcagctaaactacaggaggttttggattatctaaccaatagtgcttctctgcaaatgaaatctccagccatcacagccaccctagagggaaaaaatagaacactttacttacagtcggtaacctctattgaagaacgaacaaggccaaatctctccaaaacattgaaagaattggggcttgttgatggacaagaactggcggttgctgatgtcaccaccccacagactgtactattcaaacttcattttacttcttaaggaaaatctccacataatagaaaactcatggaaataatatactttgtggatgctaagaagttgaatcgatgtcatttttagcaatagtgttgccacgatttgtctttttttatataatgaaccactcttttttaactttgtaaccttcccttgaagacagaattttggtgttggtgcttgtaagcattttcattaataatatgagaaatgatacctggagagagagattatgagcaaatgtattgcttcttttagaggaggaagcatacaacctcttttgtgtgaattttgttattatggtcaaagaatgcattcctaagttttcatttgagtacccaaatacacaaaaggtgtccctttaaggaaaataaagaattaagttttaaataacattacattttacaatctgacatctggagtatattgaacataggctatttcttgatataacactcatttaattgtggccatccaaatgaatattattgcagaatttatcttgttcataatgatttgtaaatggtgttatagctgaatacctgtgcatgaaaatgggcaatattttcatctgtttacttgtagtgccatagaggccaatatgcacaatattaactaatgccaagacatggctgtttaaaaaatttaatgttcaaacagttatcactgatgcttttgcactatttattaataaaatcatatattgtgta

SEQ ID NO: 2585 - DNA, 2154 bp, Homo sapiens
cccgctcctccccgccctgccgcgcgtgggcacctgggaagaggcggagaacaatatggcggatggcgaggagccggagaagaaaagaaggagaatagaggagctgctggctgagaaaatggctgttgatggtgggtgtggggacactggagactgggaaggtcgctggaaccatgtaaagaagttcctcgagcgatctggacccttcacacaccctgatttcgaaccgagcactgaatctctccagttcttgttagatacatgtaaagttctagtcattggagctggcggcttaggatgtgagctcctgaaaaatctggccttgtctggttttagacagattcatgttatagatatggacactatagatgtttccaatctaaataggcagtttttatttaggcctaaagatattggaagacctaaggctgaagttgctgcagaatttctaaatgacagagttcctaattgcaatgtagttccacatttcaacaagattcaagattttaacgacactttctatcgacaatttcatattattgtatgtggactggactctatcatcgccagaagatggataaatggcatgctgatatctcttctaaattatgaagatggtgtcttagatccaagctccattgtccctttgatagatggggggacagaaggttttaaaggaaatgcccgggtgattctgcctggaatgactgcttgtatcgaatgcacgctggaactttatccaccacaggttaattttcccatgtgcaccattgcatctatgcccaggctaccagaacactgtattgagtatgtaaggatgttgcagtggcctaaggagcagccttttggagaaggggttccattagatggagatgatcctgaacatatacaatggattttccaaaaatccctagagagagcatcacaatataatattaggggtgttacgtataggctcactcaaggggtagtaaaaagaatcattcctgcagtagcttccacaaatgcagtcattgcagctgtgtgtgccactgaggtttttaaaatagccacaagtgcatacattcccttgaataattacttggtgtttaatgatgtagatgggctgtatacatacacatttgaagcagaaagaaaggaaaactgcccagcttgtagccagcttcctcaaaatattcagttttctccatcagctaaactacaggaggttttggattatctaaccaatagtgcttctctgcaaatgaaatctccagccatcacagccaccctagagggaaaaaatagaacactttacttacagtcggtaacctctattgaagaacgaacaaggccaaatctctccaaaacattgaaagaattggggcttgttgatggacaagaactggcggttgctgatgtcaccaccccacagactgtactattcaaacttcattttacttcttaaggaaaatctccacataatagaaaactcatggaaataatatactttgtggatgctaagaagttgaatcgatgtcatttttagcaatagtgttgccacgatttgtctttttttatataatgaaccactcttttttaactttgtaaccttcccttgaagacagaattttggtgttggtgcttgtaagcattttcattaataatatgagaaatgatacctggagagagagattatgagcaaatgtattgcttcttttagaggaggaagcatacaacctcttttgtgtgaattttgttattatggtcaaagaatgcattcctaagttttcatttgagtacccaaatacacaaaaggtgtccctttaaggaaaataaagaattaagttttaaataacattacattttacaatctgacatctggagtatattgaacataggctatttcttgatataacactcatttaattgtggccatccaaatgaatattattgcagaatttatcttgttcataatgatttgtaaatggtgttatagctgaatacctgtgcatgaaaatgggcaatattttcatctgtttacttgtagtgccatagaggccaatatgcacaatattaactaatgccaagacatggctgtttaaaaaatttaatgttcaaacagttatcactgatgcttttgcactatttattaataaaatcatatattgtgta

SEQ ID NO: 2586 - DNA, 1218 bp, Homo sapiens
acctgggaagaggcggagaacaatatggcggatggcgaggagccaatggctgttgatggtgggtgtggggacactggagactgggaaggtcgctggaaccatgtaaagaagttcctcgagcgatctggacccttcacacaccctgatttcgaaccgagcactgaaaatttcatattattgtatgtggactggactctatcatcgccagaagatggataaatggcatgctgatatctcttctaaattatgaagatggtgtcttagatccaagctccattgtccctttgatagatggggggacagaaggttttaaaggaaatgcccgggtgattctgcctggaatgactgcttgtatcgaatgcacgctggaactttatccaccacaggttaattttcccatgtgcaccattgcatctatgcccaggctaccagaacactgtattgagtatgtaaggatgttgcagtggcctaaggagcagccttttggagaaggggttccattagatggagatgatcctgaacatatacaatggattttccaaaaatccctagagagagcatcacaatataatattaggggtgttacgtataggctcactcaaggggtagtaaaaagaatcattcctgcagtagcttccacaaatgcagtcattgcagctgtgtgtgccactgaggtttttaaaatagccacaagtgcatacattcccttgaataattacttggtgtttaatgatgtagatgggctgtatacatacacatttgaagcagaaagaaaggaaaactgcccagcttgtagccagcttcctcaaaatattcagttttctccatcagctaaactacaggaggttttggattatctaaccaatagtgcttctctgcaaatgaaatctccagccatcacagccaccctagagggaaaaaatagaacactttacttacagtcggtaacctctattgaagaacgaacaaggccaaatctctccaaaacattgaaagaattggggcttgttgatggacaagaactggcggttgctgatgtcaccaccccacagactgtactattcaaacttcattttacttcttaaggaaaatctccacataatagaaaactcatggaaataatatactttgtggatgctaagaagttgaatcgatgtcatttttagcaatagtgttgccacgatttgtctttttttatataatgaaccactctttttt

SEQ ID NO: 2587 - DNA, 3452 bp, Homo sapiens
agagtcgtcgccgcctgtcgggcccggcgtccggtcggtccggtgggcgcgctcgcccgcctgccgctgagggcccgagccgcagggaaagcggcgcgggccgggcggggcgcggcgcccagagctcagggggagacaaaggggaccggttcctctctaggcgccaagatgtggatacaggttcgcaccattgatggctccaagacgtgcaccattgaggacgtgtctcgcaaagccacgattgaggagctgcgcgagcgggtgtgggcgctgttcgacgtgcggcccgaatgccagcgcctcttctaccggggcaagcagttggaaaatggatataccttatttgattatgatgttggactgaatgatataattcagctgctagttcgcccagaccctgatcatcttcctggcacatctacacagattgaggctaaaccctgttctaatagtccacctaaagtaaagaaagctccgagggtaggaccttccaatcagccatctacatcagctcgtgcccgtcttattgatcctggctttggaatatataaggtaaatgaattggtggatgccagagatgtcggccttggtgcttggtttgaagcacacatacatagtgttactagagcttctgatggacagtcacgtggcaaaactccactgaagaatggcagttcttgtaaaaggactaatggaaatataaagcataaatccaaagagaacacaaataaattggacagtgtaccctctacgtctaattcagactgtgttgctgctgatgaagacgttatttaccatatccagtatgatgaatacccagaaagcggtactctagaaatgaatgtcaaggatcttagaccacgagctagaaccattttgaaatggaatgaactaaatgttggtgatgtggtaatggttaattataatgtagaaagtcctggacaaagaggattctggtttgatgcagaaattaccacattgaagacaatctcaaggaccaaaaaagaacttcgtgtgaaaattttcctggggggttctgaaggaacattaaatgactgcaagataatatctgtagatgaaatcttcaagattgagagacctggagcccatcccctttcatttgcagatggaaagtttttaaggcgaaatgaccctgaatgtgacctgtgtggtggagacccagaaaagaaatgtcattcttgctcctgtcgtgtatgtggtgggaaacatgaacccaacatgcagcttctgtgtgatgaatgtaatgtggcttatcatatttactgtctgaatccacctttggataaagtcccagaagaggaatactggtattgtccttcttgtaaaactgattccagtgaagttgtaaaggctggtgaaagactcaagatgagtaaaaagaaagcaaagatgccgtcagctagtactgaaagccgaagagactggggcaggggaatggcttgtgttggtcgtacgagagaatgtactattgtcccttctaatcattatggacccattcctggtattcctgttggatcaacttggagatttagagttcaggtgagcgaagcaggtgttcacagaccccatgttggtggaattcatggtcgaagtaatgatggggcttattctcttgtactggctggtggatttgcggatgaagtcgaccgaggtgatgagttcacatacactggaagcggtggtaaaaatcttgctggtaacaaaagaattggtgcaccttcagctgatcaaacattaacaaacatgaacagggcattggccctaaactgtgatgctccattggatgataaaattggagcagagtctcggaattggagagctggtaagccagtcagagtgatacgcagttttaaagggaggaagatcagcaaatatgctcctgaagaaggcaacagatatgatggcatttataaggtggtgaaatactggccagagatttcatcaagccatggattcttggtttggcgctatcttttaagaagagatgatgttgaacctgctccttggacctctgaaggaatagaacggtcaaggagattatgtctacgtttacagtatccagcaggttacccttcagataaagaagggaagaagcctaaaggacagtcaaagaagcagcccagtggaaccacaaaaaggccaatttcagatgatgactgtccaagtgcctccaaagtgtacaaagcatcagattcagcagaagcaattgaggcttttcaactaactcctcaacagcaacatctcatcagagaagattgtcaaaaccagaagctgtgggatgaagtgctttcacatcttgtggaaggaccaaattttctgaaaaaattggaacaatcttttatgtgcgtttgctgtcaggagctagtttaccagcctgtgacaactgagtgcttccacaatgtctgtaaagattgcctacagcgctcctttaaggcacaggttttctcctgccctgcttgccggcatgatcttggccagaattacatcatgattcccaatgagattctgcagactctacttgaccttttcttccctggctacagcaaaggacgatgatctgcctgctttcactgtgttgttcatggtggctttttggacaataaagaatctaaaatgggtggggagggtggaagaaatggtggactgtatctctcacgttctgaagcagctaatcctctttcccacatagccatcatcttgtgtgtgtagtaagaggcccatttctcaactgtcttttaaatatctaaaggtagttcctgtaacaactagttttaatgagtaaaaagtcaaagcctcagctctagttgatatccaagttatgatttattttgcaactacctcaggacagaaaagatttatggggattttaaaaatcattgaataactagttaaatgaaattttagctacacactgcctcccaaatattagttgtgcctggttcttgtaatttgattttacagaaaaggaaatgacacttgagatccttggaatgaacacagcttctaaagtgtgcatatacttttttaacgtctcttcttccattacaatgtgtgttttgcaaggacaggttcattttttttagcccactttgtgaactccattgtgcttttttctggtgttttatgcaagttgactactaatgactaatgagaacaataatgaatgcattgttgctgcattagtgtaatgtggtgtggttttgcacttaaaagaggtattcatatgctctagttgtaaatgttcatgaaaatccacttctctactagtcgaactgcttttagtgtctcaccagtggttttacatctgcagagttttgagggctgtgctgacctttgagaggatttgaaattgcttcatattgtgatcctaaattttatattcactatattccctaaagtataccttaataaatattttatgatcagaaaaa

SEQ ID NO: 2588 - DNA, 802 bp, Homo sapiens
gcgggccgggcggggcgcggcgcccagagctcagggggagacaaaggggaccggttcctctctaggcgccaagatgtggatacaggttcgcaccattgatggctccaagacgtgcaccattgaggacgtgtctcgcaaagccacgattgaggagctgcgcgagcgggtgtgggcgctgttcgacgtgcggcccgaatgccagcgcctcttctaccggggcaagcagttggaaaatggatataccttatttgattatgatgttggactgaatgatataattcagctgctagttcgcccagaccctgatcatcttcctggcacatctacacagattgaggctaaaccctgttctaatagtccacctaaagtaaagaaagctccgagggtaggaccttccaatcagccatctacatcagctcgtgcccgtcttattgatcctggctttggaatatataagggtctggctctgtcacccaggctgtagtgcagtgacgtgaacacggctcgctgtagccttgacctgctggggtcaagtgatcttcctgctcggcctcccaaagtgctgggatacaggcgtgagccaccatgcccggctaacttagatctttgatatcttgattagttctttctttacatatttaatattttgctttatttctggtagctttgtttttgatgcaattattatatatggttatcttctaaaatagtaatctgtttgctgatatagagaaatgaaattgatttatttggcttttgtaaccagcaaccttttcaaatctaataaattgtgtagaaataa

SEQ ID NO: 2589 - DNA, 474 bp, Homo sapiens
ctgttctaatagtccacctaaagtaaagaaagctccgagggtaggaccttccaatcagccatctacatcagctcgtgcccgtcttattgatcctggctttggaatatataagatacccagaaagcggtactctagaaatgaatgtcaaggatcttagaccacgagctagaaccattttgaaatggaatgaactaaatgttggtgatgtggtaatggttaattataatgtagaaagtcctggacaaagaggattctggtttgatgcagaaattaccacattgaagacaatctcaaggaccaaaaaagaacttcgtgtgaaaattttcctggggggttctgaaggaacattaaatgactgcaagataatatctgtagatgaaatcttcaagattgagagacctggagcccatcccctttcatttgcagatggaaagtttttaaggcgaaatgaccctgaatgtgacctgtgtggtg

SEQ ID NO: 2590 - DNA, 4631 bp, Homo sapiens
ttttgtatttttagtagagacgggggtttcaccacgttagccaggctggtctcgaactcctgaactcaggtgatccgcccgccttggcctcccaaagtactgggattacaggcgtgagccaccgcgccgggactaagctgcttaatgacttccagagcgatccatccaggaaggtgttttccctctgcaggtcctagactccccctgcctcctcaacaacgtcctccagtggaaaatgtccttgggaaacgctgacagagtcttttgagcctcggccgcatccgtcactcgcgcagcaggcggaagtagcgggcagttggccggaagtggggctgtgaggctcggagtcgccggaggagccagtatctgtgtcgccgccgcccgcggcgtccccggtttggtgttgcggcgcccaccttcgggaggatcaggctgcttctgatgcttggaagatatcctctcagccacaaagatggtaataaatctttgcctcccacagttcagaccaagaattcactgcaacaagatatcagctgatggttacgaagtagaaaatctcatctctgaagatctcacaaagagaagtcatggtttcaggacagagtatttcattaagccaccagtctatgtgacagtttcatttccctttaatgtggaaatctgtaggatcaacatagacctcacagctgggggaggtcagaacgtcactggcctggaaatgtacacatctgcctcatctagcagagtgtcttggaatacgccccagtgccggaccctgggcccagctgagccatctgtcccagacaaggaggcgttcaccttggtaggcaaagtcttactgaaaaaccagagccaagtggtgtttagccacaggggcttcaaggccaggcccccttttggcgcgatggaagccacactcccctcccctgctgttgtggcccaggagctctggaataaaggggctctttcccttagccacgtggcccacttaaggatctgtatcacccatgtgacaggcggcggtatcccttgtatcaagcggttggaagtgtggggtcagccggccaagacctgctcccaggaagtgatagacagcatcctgctggtcacctcagagaacctgcctcaggatgtggctctgcaggctccagccttgcccatggaaagtgactgtgaccctggggaccagcctgagagccagcaggctccctccagcctgcagaagctggccgagatcattcaggatgtgcctgaggagttcctggatcccatcaccctggagatcatgccttgtcccatgctgctgccctcaggcaaggtcatcgaccagagcacactggagaagtgtaaccgcagtgaagccacatggggccgagtgcccagtgaccctttcacgggggtagcttttactccgcactctcagcccctgcctcacccctccctcaaggcccggattgaccatttcctgctccagcactccatccctggctgccacctgcttgggagagcacagacggcattggcagtgatcccttcttccattgttctgccctctcagaaaaggaagatagagcaggctgaacatgtcccagacagtaactttggtgtaaatgcttcctgtttttctgccacaagccctttggtcttacccactacctcagagcacactgctaagaaaatgaaagccaccaatgagcccagcctgacacatatggactgctcgacaggtccactgtcccacgagcagaagctgtcacaaagcttggaaattgccttggcatccacccttggctctatgccctccttcacggcacggctgaccaggggacagctccagcaccttggcacaagagggagcaacacttcctggaggcctggcaccggctcggagcagcctgggagcatcctgggccccgaatgtgcctcctgcaaaagagtattttctccctacttcaaaaaggagccggtgtaccagctgccctgcggccacctcctgtgccgaccctgcctgggtgagaagcaacgctccctgcccatgacgtgcacagcctgccagcggccggttgctagccaagacgtgctgcgggtccacttctgagtgactgacctccactggaggagacccattgctgggaggagctgagggggaacaggagcagggccacagcacccctgaggtctggccaggccccaggcacagagctgcctgctccctcccggggctcttcttcatcacctcacggtatagcacattgcttctgcgctggtggcaatagggcaacaaagccataggccagagggcggggggatgtccctgcctccctgccaccccccctgcctgagcccaggacccactggagccagccccaccctaggcaggaagacccctgctgagggcccccccgtgcagtccgcatacccccctgtccagcagggcactgtgggtggctcaccctagattgtggcccagatctcaggagtctctgccttcagggtcatccaaaagtggaccttgggagcagtgggggtgtctgtggagtgcatgactcagccccccgactcgcagccttaataaagcgatggttgacgtctgctgtgggtttcctcctggtggagtgcctgtctgtgtcacacactcctgtcgcccacctgcacccacacaagtggagctcacagggtagctgtgtgcagtcactgcagcttgccaggctgtcattcctgtcgatgacctgaaaggacacaaactggaattttcaggtctgtcccctgcatggggactcagaacccaggtttgcaggtgggcatacgtggtgggagggtggagggctccctctggccagtgccagctgtgctcagctggcttcagaaactgctccctgagggggagcgcagcgtttcctcatgcagttggtttcaggaaaaatacttgtttataggctgcatccttttttcagcccaacatttagctttatggagtgccaaagggaaaatatatccatatccctacaacttggtactctatcagattccagccactagaagaacctcagtgagaaaacacacccgcctttccctgttcccttctaagcacgtttgggaaggaacagcctaaagatgctttgtaaagctgtattttacccttgagcttagccgcgggtccctgtgaaccggcacattcctttcctttaggccgtccagagctctagtccacacccaatactttagagatctgggtttggggttagttgcttttttttttttttttttaattgagacagggttggtctctgttgcccaagcttgagggcagtggtgcaatcataactcattgcagcctcgaactcctgggcttaagggatccttctacctcagcctcccaggtagcaggaactataggcatgtgccaccatgcccagctaatttttttattttttgtagagacaaggtcttgctatgttgtccagactggtctcaaactcctgggctcaagcgatcctcccaaagtgcttggattgcaggcatgagccacttcgcctagccaagcctgcatttttttgagttcctacatcatttgtccacaaagatggcttcagagaggtggtcacatgctttgctctgcttcctcttggcactgaccttgatgcagccttcacatgagatttgagggtccgcatggatggcctgtgccgccctcgctggcgaggctcctgtgtgcccctggctttctgggtctgtgcctctccagaatcttgtcttaccctccggtgtgcttgtgttcttagaaaagccccagcatggccgggcatggtggctcatgcctattatcccagcactttgggaggccaaggtgggtggatcacttgaggtcaagagttcgagaccagcctggccaacatggcaaaaccccatctctactaaaaatacaaaaattagctgggcatggtggtgtgtgcctgtaatgccagctactcaggaggctgaggcatgagaatcgcttgaaccggggaggcagaggttgcagtgagccgagatctcaccactgtactccagcctgggcgacggagtgagactccctctcaaaaaaagaaaaaagccccagcatgtagcaaaagcatttcttggtgagtgtgggggctggtgattcccaccttcaccctgtcatggtctcagggaacagcctgcttcccaccagcagcttgacacccacagtgtgctctggctgctgggagcccatctctcggagaaaccctgtccacccaaccccgagagccctagcgtgcagtcagcgtcagcacggcgctcccagatgagggccggactgcctccccttaagcagctgtgttggaggtactgcccagaccgctgcaggtccctggggatctgcatttctaacaggctcctgcccccaagactgctctggtggaaaatccagcctgggagcccctggagtggcaggccctgtcctgggtacaggtggagccacccccaggagttgcgtgtgtttttcttaattgaaagacttcccccaaaaggaagtggtcttttcactacccttgccagaaacatgctaggcaccactgggctctgtttctgtcccctagaaaatgggaataaaatttcttttgctgtca

SEQ ID NO: 2591 - DNA, 4469 bp, Homo sapiens
ttttgtatttttagtagagacgggggtttcaccacgttagccaggctggtctcgaactcctgaactcaggtgatccgcccgccttggcctcccaaagtactgggattacaggcgtgagccaccgcgccgggactaagctgcttaatgacttccagagcgatccatccaggaaggtgttttccctctgcaggtcctagactccccctgcctcctcaacaacgtcctccagtggaaaatgtccttgggaaacgctgacagagtcttttgagcctcggccgcatccgtcactcgcgcagcaggcggaagtagcgggcagttggccggaagtggggctgtgaggctcggagtcgccggaggagccagtatctgtgtcgccgccgcccgcggcgtccccggtttggtgttgcggcgcccaccttcgggaggatcaggctgcttctgatgcttggaagatatcctctcagccacaaagatggtaataaatctttgcctcccacagttcagaccaagaattcactgcaacaagatatcagctgatggttacgaagtagaaaatctcatctctgaagatctcacaaagagaagtcatggtttcaggacagagtatttcattaagccaccagtctatgtgacagtttcatttccctttaatgtggaaatctgtaggatcaacatagacctcacagctgggggaggtcagaacgtcactggcctggaaatgtacacatctgcctcatctagcagagtgtcttggaatacgccccagtgccggaccctgggcccagctgagccatctgtcccagacaaggaggcgttcaccttggtaggcaaagtcttactgaaaaaccagagccaagtggtgtttagccacaggggcttcaaggccaggcccccttttggcgcgatggaagccacactcccctcccctgctgttgtggcccaggagctctggaataaaggggctctttcccttagccacgtggcccacttaaggatctgtatcacccatgtgacaggcggcggtatcccttgtatcaagcggttggaagtgtggggtcagccggccaagacctgctcccaggaagtgatagacagcatcctgctggtcacctcagagaacctgcctcaggatgtggctctgcaggctccagccttgcccatggaaagtgactgtgaccctggggaccagcctgagagccagcaggctccctccagcctgcagaagctggccgagatcattcaggatgtgcctgaggagttcctggatcccatcaccctggagatcatgccttgtcccatgctgctgccctcaggcaaggtcatcgaccagagcacactggagaagtgtaaccgcagtgaagccacatggggccgagtgcccagtgaccctttcacgggggtagcttttactccgcactctcagcccctgcctcacccctccctcaaggcccggattgaccatttcctgctccagcactccatccctggctgccacctgcttgggagagcacagacggcattggcagtgatcccttcttccattgttctgccctctcagaaaaggaagatagagcaggctgaacatgtcccagacagtaactttggtgtaaatgcttcctgtttttctgccacaagccctttggtcttacccactacctcagagcacactgctaagaaaatgaaagccaccaatgagcccagcctgacacatatggactgctcgacagagcagcctgggagcatcctgggccccgaatgtgcctcctgcaaaagagtattttctccctacttcaaaaaggagccggtgtaccagctgccctgcggccacctcctgtgccgaccctgcctgggtgagaagcaacgctccctgcccatgacgtgcacagcctgccagcggccggttgctagccaagacgtgctgcgggtccacttctgagtgactgacctccactggaggagacccattgctgggaggagctgagggggaacaggagcagggccacagcacccctgaggtctggccaggccccaggcacagagctgcctgctccctcccggggctcttcttcatcacctcacggtatagcacattgcttctgcgctggtggcaatagggcaacaaagccataggccagagggcggggggatgtccctgcctccctgccaccccccctgcctgagcccaggacccactggagccagccccaccctaggcaggaagacccctgctgagggcccccccgtgcagtccgcatacccccctgtccagcagggcactgtgggtggctcaccctagattgtggcccagatctcaggagtctctgccttcagggtcatccaaaagtggaccttgggagcagtgggggtgtctgtggagtgcatgactcagccccccgactcgcagccttaataaagcgatggttgacgtctgctgtgggtttcctcctggtggagtgcctgtctgtgtcacacactcctgtcgcccacctgcacccacacaagtggagctcacagggtagctgtgtgcagtcactgcagcttgccaggctgtcattcctgtcgatgacctgaaaggacacaaactggaattttcaggtctgtcccctgcatggggactcagaacccaggtttgcaggtgggcatacgtggtgggagggtggagggctccctctggccagtgccagctgtgctcagctggcttcagaaactgctccctgagggggagcgcagcgtttcctcatgcagttggtttcaggaaaaatacttgtttataggctgcatccttttttcagcccaacatttagctttatggagtgccaaagggaaaatatatccatatccctacaacttggtactctatcagattccagccactagaagaacctcagtgagaaaacacacccgcctttccctgttcccttctaagcacgtttgggaaggaacagcctaaagatgctttgtaaagctgtattttacccttgagcttagccgcgggtccctgtgaaccggcacattcctttcctttaggccgtccagagctctagtccacacccaatactttagagatctgggtttggggttagttgcttttttttttttttttttaattgagacagggttggtctctgttgcccaagcttgagggcagtggtgcaatcataactcattgcagcctcgaactcctgggcttaagggatccttctacctcagcctcccaggtagcaggaactataggcatgtgccaccatgcccagctaatttttttattttttgtagagacaaggtcttgctatgttgtccagactggtctcaaactcctgggctcaagcgatcctcccaaagtgcttggattgcaggcatgagccacttcgcctagccaagcctgcatttttttgagttcctacatcatttgtccacaaagatggcttcagagaggtggtcacatgctttgctctgcttcctcttggcactgaccttgatgcagccttcacatgagatttgagggtccgcatggatggcctgtgccgccctcgctggcgaggctcctgtgtgcccctggctttctgggtctgtgcctctccagaatcttgtcttaccctccggtgtgcttgtgttcttagaaaagccccagcatggccgggcatggtggctcatgcctattatcccagcactttgggaggccaaggtgggtggatcacttgaggtcaagagttcgagaccagcctggccaacatggcaaaaccccatctctactaaaaatacaaaaattagctgggcatggtggtgtgtgcctgtaatgccagctactcaggaggctgaggcatgagaatcgcttgaaccggggaggcagaggttgcagtgagccgagatctcaccactgtactccagcctgggcgacggagtgagactccctctcaaaaaaagaaaaaagccccagcatgtagcaaaagcatttcttggtgagtgtgggggctggtgattcccaccttcaccctgtcatggtctcagggaacagcctgcttcccaccagcagcttgacacccacagtgtgctctggctgctgggagcccatctctcggagaaaccctgtccacccaaccccgagagccctagcgtgcagtcagcgtcagcacggcgctcccagatgagggccggactgcctccccttaagcagctgtgttggaggtactgcccagaccgctgcaggtccctggggatctgcatttctaacaggctcctgcccccaagactgctctggtggaaaatccagcctgggagcccctggagtggcaggccctgtcctgggtacaggtggagccacccccaggagttgcgtgtgtttttcttaattgaaagacttcccccaaaaggaagtggtcttttcactacccttgccagaaacatgctaggcaccactgggctctgtttctgtcccctagaaaatgggaataaaatttcttttgctgtca

SEQ ID NO: 2592 - DNA, 524 bp, Homo sapiens
ccggaagtggggctgtgaggctcggagtcgccggaggagccagtatctgtgtcgccgccgcccgcggcgtccccggtttggtgttgcggcgcccaccttcgggaggatcagttagcatcgctccttcctctgcctggcccccctcctctaacttctagactctagtttaaaatgaagctattcggctctgctcagaccggtatgtggaagggagaaaggctgcttctgatgcttggaagatatcctctcagccacaaagatggtaataaatctttgcctcccacagttcagaccaagaattcactgcaacaagatatcagctgatggttacgaagtagaaaatctcatctctgaagatctcacaaagagaagtcatggtttcaggacagagtatttcattaagccaccagtctatgtgacagtttcatttccctttaatgtggaaatctgtaggatcaacatagacctcacagctgggggaggtcagaacgtcactggcctggaaatgtacacatctgcctcat

SEQ ID NO: 2593 - DNA, 2388 bp, Homo sapiens
acagcgtggggtggacagtcagctgtcggtggcttctgctgagatggccagaggactccaggttcccctgccgcggctggccacaggactgctgctcctcctcagtgtccagccctgggctgagagtggaaaggtgttggtggtgcccactgatggcagcccctggctcagcatgcgggaggccttgcgggagctccatgccagaggccaccaggcggtggtcctcaccccagaggtgaatatgcacatcaaagaagagaaatttttcaccctgacagcctatgctgttccatggacccagaaggaatttgatcgcgttacgctgggctacactcaagggttctttgaaacagaacatcttctgaagagatattctagaagtatggcaattatgaacaatgtatctttggcccttcataggtgttgtgtggagctactgcataatgaggccctgatcaggcacctgaatgctacttcctttgatgtggttttaacagaccccgttaacctctgtggggcggtgctggctaagtacctgtcgattcctgctgtgtttttttggaggtacattccatgtgacttagactttaagggcacacagtgtccaaatccttcctcctatattcctaagttactaacgaccaattcagaccacatgacattcctgcaaagggtcaagaacatgctctaccctctggccctgtcctacatttgccatactttttctgccccttatgcaagtcttgcctctgagctttttcagagagaggtgtcagtggtggatcttgtcagctatgcatccgtgtggctgttccgaggggactttgtgatggactaccccaggccgatcatgcccaacatggtcttcattgggggcatcaactgtgccaacgggaagccactatctcaggaatttgaagcctacattaatgcttctggagaacatggaattgtggttttctctttgggatcaatggtctcagaaattccagagaagaaagctatggcaattgctgatgctttgggcaaaatccctcagacagtcctgtggcggtacactggaacccgaccatcgaatcttgcgaacaacacgatacttgttaagtggctaccccaaaacgatctgcttggtcacccgatgacccgtgcctttatcacccatgctggttcccatggtgtttatgaaagcatatgcaatggcgttcccatggtgatgatgcccttgtttggtgatcagatggacaatgcaaagcgcatggagactaagggagctggagtgaccctgaatgttctggaaatgacttctgaagatttagaaaatgctctaaaagcagtcatcaatgacaaaagttacaaggagaacatcatgcgcctctccagccttcacaaggaccgcccggtggagccgctggacctggccgtgttctgggtggagtttgtgatgaggcacaagggcgcgccacacctgcgccccgcagcccacgacctcacctggtaccagtaccattccttggacgtgattggtttcctcttggccgtcgtgctgacagtggccttcatcacctttaaatgttgtgcttatggctaccggaaatgcttggggaaaaaagggcgagttaagaaagcccacaaatccaagacccattgagaagtgggtgggaaataaggtaaaattttgaaccattccctagtcatttccaaacttgaaaacagaatcagtgttaaattcattttattcttattaaggaaatactttgcataaattaatcagccccagagtgctttaaaaaattctcttaaataaaaataatagactcgctagtcagtaaagatatttgaatatgtatcgtgccccctctggtgtctttgatcaggatgacatgtgccatttttcagaggacgtgcagacaggctggcattctagattacttttcttactctgaaacatggcctgtttgggagtgcgggattcaaaggtggtcccacggctgcccctactgcaaatggcagttttaatcttatcttttggcttctgcagatggttgcaattgatccttaaccaataatggtcagtcctcatctctgtcgtgcttcataggtgccaccttgtgtgtttaaagaagggaagctttgtacctttagagtgtaggtgaaatgaatgaatggcttggagtgcactgagaacagcatatgatttcttgctttggggaaaaagaatgatgctatgaaattggtgggtggtgtatttgagaagataatcattgcttatgtcaaatggagctgaatttgataaaaacccaaaatacagctatgaagtgctgggcaagtttactttttttctgatgtttcctacaactaaaaataaattaataaatttatataaattct

SEQ ID NO: 2594 - DNA, 2048 bp, Homo sapiens
tccgggtccctgtctccgccgccgccgcccgcgcctcccgccgctggcccgccccggccccggcccgcgcccccgcgccccgccaccggccccgccggccccccgcgcgagatgatggacggccgcctcctggaacacccgcatgcccagttcgggggctcgctgggcggcgtggtgggcttcccctacccgctgggccaccaccacgtgtacgagctggccgggcaccagctgcagtcggccgccgccgccgcctcggtgcccttctccatcgacggcctgctcgggggctcgtgcgccgccgccgcctcggtggtcaaccccacgccgctgctgccagccgcctgcggggtcggcggggacggccagcccttcaagctgtcagactcgggggacccggacaaggagagcccgggctgcaagcggcggcgcacccgcaccaacttcaccggctggcagctggaggagctggagaaggcgttcaacgagagccactatcccgacgtgttcatgcgcgaggcgctggcgctgcgcctagacctggtcgagtcccgagttcaggtctggttccaaaaccgccgggccaagtggaggaagaaggagaacacgaaaaagggcccggggcggccggcgcacaactcgcacccgaccacgtgcagcggcgagcccatggacccggaggagatcgcgcgcaaggagctggagaagatggagaagaagaagcgcaagcacgagaagaagctgctgaagagccagggccgccacttgcactcgcccggcggcctgtccctgcacagcgcgcccagctccgacagcgacagcggcggcggcggcctgtctccggagccgcccgagccgccgccgcccgccgccaagggccccggagcgcacgcctcgggcgccgcggggaccgcgcccgcccctcccggcgagccgcctgcacccggcacctgcgaccccgccttctacccgagccaaagaagcggcgccggcccacagccgcgcccaggtcgccctgcggacaaggacgcggcctcgtgcgggccaggggccgctgtggcggcggtggagcgcggcgccgcggggctgcccaaggccagcccattcagcgtggagagcctcctgtccgactcgccgccgcgccggaaagccgcttccaacgccgccgccgccgccgccgcggggctggacttcgcgcccgggctgccgtgcgcgccgcggaccctgatcggcaagggccacttcctcctctaccccatcacgcagccgctcggcttcctggtgccgcaggccgcgctcaagggcggcgcgggcctggagccggcgcccaaggacgcgccgcccgcgcccgccgtgccgcccgcgccgcctgcccaggccagtttcggggccttctcggggcccggcggcgccccggactcggccttcgcgcgtcgcagccccgacgccgtcgcctccccgggggccccagccccggccccggcgcctttccgggacctcgcctcggcagcggctaccgagggcggcggcggggactgcgcggacgcggggaccgccggccccgcgcccccgccgcccgcgccgtcgcccaggcccggccctcggcctcccagccccgccgaggagccggccacctgcggggttcccgagcctggcgcggcggccggacccagcccgccggagggcgaggagctggacatggactgaggccgcggcggccgggagaggcgcgtagccggcccgcggccgctcgctcaggctccgactcacgcaacgaatcaggtgatcggctctagaaacactgctttcccttcttttcttttgttttctttcttttattattttttttaagagtaaacgaaagtgctgtatgaattcggacccaggcagcaaccacaggactgggggtgagaccctcctcctcccaagagagcaaaaaggacccatggcccccaaaaaaccccacaacgagaatcctcagccttgtaaaatgcaaaaatgtctaagaatatttatatatgtaccatttttgataaataaagctggtc

SEQ ID NO: 2595 - DNA, 1709 bp, Homo sapiens
gtgagcgccgggctcggggcccccccggccgcccgccccctcccctccctccctcccctcccctcccctcccccccgggccccgcgccccccccgcccccgccccccccatggacatgctggacccgggtctggatcccgctgcctcggccaccgctgctgccgccgccagccacgacaagggacccgaggcggaggagggcgtcgagctgcaggaaggcggggacggcccaggagcggaggagcagacagcggtggccatcaccagcgtccagcaggcggcgttcggcgaccacaacatccagtaccagttccgcacagagacaaatggaggacaggtgacataccgcgtagtccaggtgactgatggtcagctggacggccagggcgacacagctggcgccgtcagcgtcgtgtccaccgctgccttcgcgggggggcagcaggctgtgacccaggtgggtgtggacggggcagcccagcgcccgggccccgccgctgcctctgtgcccccaggtcctgcagcgcccttcccgctggctgtgatccaaaatcccttcagcaatggtggcagtccggcggccgaggctgtcagcggggaggcacgatttgcctatttcccagcgtccagtgtgggagatactacggctgtgtccgtacagaccacagaccagagcttgcaggctggaggccagttctacgtcatgatgacgccccaggatgtgcttcagacaggaacacagaggacgatcgccccccggacacacccttactctccaaaaattgatggaaccagaacaccccgagatgagaggagaagagcccagcacaacgaagtggagcggaggcggagggacaagatcaacaactggatcgtccagctttcgaaaatcattccagactgtaacgcagacaacagcaagacgggagcgagtaaaggagggatcctgtccaaggcctgcgattacatccgggagttgcgccagaccaaccagcgcatgcaggagaccttcaaagaggccgagcggctgcagatggacaacgagctcctgaggcagcagatcgaggagctgaagaatgagaacgccctgcttcgagcccagctgcagcagcacaacctggagatggtgggcgagggcacccggcagtgacgcccgccaccaccacgcagccgccgccgcccacgccggcctctgctgcccccttccccagcccttagcacagagagggacacatgcccctcccccagctgcgtttttttatagtagatttttaacaaaaaacggggagaaataatgcatttctgtggatacagtgcccaccgccctcctccacttggaaacggtatcctccctgcccatccgtctgtctgtcgcccttctcccggccctcactaagccccggcacttctagtggtctcacctggaggcaagagggaggggacagaggccctgccacgtcccgctgcctcctgctctctggaggtactgagacagggtgctgatgggaaggaggggagcctttggggggccacccggggcctggacctatgcagggaggccacgtcccaccccacctcttgtttctgggtccctgctcccctttgggggtgtgtgtgtgtgttttaattttctttatggaaaaattgacaaaaaaaaaatagagagagaggtatttaactgcaataaactggccccatgtggcccccgc

SEQ ID NO: 2596 - DNA, 1508 bp, Homo sapiens
gtgagcgccgggctcggggcccccccggccgcccgccccctcccctccctccctcccctcccctcccctcccccccgggccccgcgccccccccgcccccgccccccccatggacatgctggacccgggtctggatcccgctgcctcggccaccgctgctgccgccgccagccacgacaagggacccgaggcggaggagggcgtcgagctgcaggaaggcggggacggcccaggagcggaggagcagacagcggtggccatcaccagcgtccagcaggcggcgttcggcgaccacaacatccagtaccagttccgcacagagacaaatggaggacaggctgtgatccaaaatcccttcagcaatggtggcagtccggcggccgaggctgtcagcggggaggcacgatttgcctatttcccagcgtccagtgtgggagatactacggctgtgtccgtacagaccacagaccagagcttgcaggctggaggccagttctacgtcatgatgacgccccaggatgtgcttcagacaggaacacagaggacgatcgccccccggacacacccttactctccaaaaattgatggaaccagaacaccccgagatgagaggagaagagcccagcacaacgaagtggagcggaggcggagggacaagatcaacaactggatcgtccagctttcgaaaatcattccagactgtaacgcagacaacagcaagacgggagcgagtaaaggagggatcctgtccaaggcctgcgattacatccgggagttgcgccagaccaaccagcgcatgcaggagaccttcaaagaggccgagcggctgcagatggacaacgagctcctgaggcagcagatcgaggagctgaagaatgagaacgccctgcttcgagcccagctgcagcagcacaacctggagatggtgggcgagggcacccggcagtgacgcccgccaccaccacgcagccgccgccgcccacgccggcctctgctgcccccttccccagcccttagcacagagagggacacatgcccctcccccagctgcgtttttttatagtagatttttaacaaaaaacggggagaaataatgcatttctgtggatacagtgcccaccgccctcctccacttggaaacggtatcctccctgcccatccgtctgtctgtcgcccttctcccggccctcactaagccccggcacttctagtggtctcacctggaggcaagagggaggggacagaggccctgccacgtcccgctgcctcctgctctctggaggtactgagacagggtgctgatgggaaggaggggagcctttggggggccacccggggcctggacctatgcagggaggccacgtcccaccccacctcttgtttctgggtccctgctcccctttgggggtgtgtgtgtgtgttttaattttctttatggaaaaattgacaaaaaaaaaatagagagagaggtatttaactgcaataaactggccccatgtggcccccgc

SEQ ID NO: 2597 - DNA, 648 bp, Homo sapiens
atggacatgctggacccgggtctggatcccgctgcctcggccaccgctgctgccgccgccagccacgacaagggacccgaggcggaggagggcgtcgagctgcaggaaggcggggacggcccaggagcggaggagcagacagcggtggccatcaccagcgtccagcaggcggcgttcggcgaccacaacatccagtaccagttccgcacagagacaaatggaggacagacaggaacacagaggacgatcgccccccggacacacccttactctccaaaaattgatggaaccagaacaccccgagatgagaggagaagagcccagcacaacgaagtggagcggaggcggagggacaagatcaacaactggatcgtccagctttcgaaaatcattccagactgtaacgcagacaacagcaagacgggagcgagtaaaggagggatcctgtccaaggcctgcgattacatccgggagttgcgccagaccaaccagcgcatgcaggagaccttcaaagaggccgagcggctgcagatggacaacgagctcctgaggcagcagatcgaggagctgaagaatgagaacgccctgcttcgagcccagctgcagcagcacaacctggagatggtgggcgagggcacccggcagtga

SEQ ID NO: 2598 - DNA, 10832 bp, Homo sapiens
agccccgcctcttcctgcgccatgtgggcctgaagcgcgtgtctgctgtctgtgccagtgctcctgccgggtcccctcaggtgtgtcgtttccgtcgcgcttccgccctctcggccatgggggtccccaagaggaaggcctcgggcggccaggacggcgcggcttcctccgcgggtgcagccaagcgcgcccgcaaagaagagctcacgggcgtgcggttcaaggctcagctgaaggacccgcagggccccgggccaggcttggaagcgtttgtgtctgctgccaagaagctaccacgagaagatgtgtatgatgttgtggaagggtatataaagatttctgttgagtgtgtcgaaattttccagctcctaagtggagagaaacgacctgaaagtgaaacgatgttaatatttcaagttttcgaggccatattattgcggacagcaagtgatctttcacatttccatgttgtgggaaccaacattgtgaaaaagctgatgaacaaccacatgaagctcatctgtgagtccctgtatgcctcaggttacaggttggctcgcgcctgcctgagcctgatgaccgccatggtgacccagggtccggaagctgccagggacgtctgcagccattttgatttgaataaaaagaccctgtacaccctggtgaccaagagggattcaaagggagtgtacgacgttcggcaggcctacgttcagtttgctctctcctttttaattgcgggtgatgacagcactatagtgcaggtgttggaagtgaaagaatttattccttgcatttttagctcagggataaaggaagataggatctctaccatcaatattttattatccacactgaaaacaaaggtagttcacaataaaaatatcacaaaaacccagaaggtgcgtttctttacggggcagttattgaaccacatagcatcgctgtacaactggaatgggattaccgatgtgaacccagaaaatgtcaaggtttctgccgaagaagcagggaaaaccatggtgcgggagcttgttcataacttcctgatggatctttgctgttcactcaagcatggaattaatttttacgatgcatctttgggtacctttggcagaggcggaaacctgacactcttgcacttcttgctgggtttgaaaactgcagctgatgatgatctggtggctgaccttgtggtaaacatcctcaaagtgtgcccggacttactgaacaaatacttcaaggaagtaacgttttcctttatcccacgagcgaagtctacttggttaaataatatcaaactactaaacaagatctatgaggctcagccggagatttcccgggcatttcagaccagagagtttatacccttgcctcggctcctggcaatggtgatggtgaccaccgtgcccctggtgtgcaataagagcatgttcacccaagcattaaacttggacagcacctcagtgaggcacacagccttatcccttatttctgtcattttgaagagggcattaaaaactgttgaccactgcctgaataaagaggtgtggcaggaatcaggcgtgtacacagctgtgatgatggaagaattcgtgcagctcttcagagaagccctgagcaagattttgccagacctgaacactgtcgtgtgggtctggcagtcacttaaaaagcaagagaccaaacaggatgacaagaaagggcagaaaaggagcgatgggcccccggctgcctgcgatgctcaccagtgcgatgatgcagaaaccattcttttgaaagctgttttgctccaggtcatatgcctctaccagaaggtggtcccccacgtggtcatgcagtacaactttgacttcagcaagctcctgaaaggtgtcatctctgagcagggccttcgagaggaggtgcctcccattctgcagcaccacatgctgaaggtggccctggagctgccggccagcaagtttctgtggttaaaggcacaggaaggcccagatgcagaaattattggaggtgaacgatcagtattttacttactaatgaaaatgtttgtgaccagtagccatttacaactgaagtcattgaccaaacttctgatcatgaagattctgcgggacacgggggtgtttgagcacacctggaaggagctggagctctggctggagcatttagagaacaccatggaagaggacaaagagactgtgattcagtttctggaacgcattttattgacattggtggcgaatccctattcatacacagacaaagcatctgactttgtccaagaagcaagcatgctgcaggccactatgacgaagcaagaagccgatgacatgagcattcccatctcccacattgacgatgttctcgacatggtggatgtcctggtggagggcagtgaaggcttggatgaggaaatagggttcacgttgagtgaagacatgatcctgctcacgttcccattcagtgcggtagtccctgcggccctggaagccaggaataagttgctccttgggacaggcaatgaagcagcggaaaacgttgtgacatatctgacggcagtgctgactgacctcctccacacccagagggaccccctggctctgtgtctcctgctccaggcatatgataagcttgagcctccatgcctggtgccttgctgccagcagctctcacggtttaacagatactacagcctctggatcccggagcaagcccgagaggcctggctgctgcaggcacagggcagcccctcgccccctgcccttcccttggcctcgtccttcacagccctgctgcaggcagcctacgagagccaagcgcttcgggacgagcacatccaggtgcagctgcaggccaccatgccacacctgtccatgcagcaggtcctgctcgcggccaagcaggtgttgctctacctgcggagcactgtggagaacttcggccagctgggcagaagtgtgggcccgcccctcctgcagctcttcctggatctcctcaggcgcctggttgtccactgtgagcagctggatgcccagaaccagcagagatgcgaggccgcccgggccgaagccgacctcttcctggacatggagtccgtggcctcgctggagttggccaatgatcagacgctggaggaggtgcttgtggccatcctcaggcaccccaccctggagggctggttcctggccctggagcagcaggccctcccgccgcacacgctcagccctgtcctcgtgaagctcctggccacccactttagtgcaggggtccttcagctgctggcagcaagtgccccgatcctccagaacattgggcagctgggccttctggccaggtactcagaggccatcacccagagtgtgctgaaggaacttcagaacaggagggcgggcccggccacatcaccaccaaagaccccgccgcagctggaggccctgcaggagctgcatccatacatggagggtgcccagctccgtgaggtcaccctggccttgctgagcctgcctgagacacacctggtgacccagcaacccacgaaatcccccgggaaggaaagacacctgaatgctcttggaaagaccctggtgcagctgctgacctgcagcccccaggatcagctgcagagtggtgagctcctgtggtcctccgagtatgtgagaggcctgggggctctgctgcccacgctagcagtggacgagctggacacagtgctcctccacactctgcagagagaccctgtgctggcccccgcagtcggggctgatctgcttgactactgcctggcccggcgcacacaggcggccctcagcatcgctgccctgctcctccaggagagctgcacccacttgctgtggttcgagcagtggtgcctgcaggctggcccagggctcggcctccagggggacctggacgacttccttcccctcatccatgtgtacctccagtgcaggacacggagccacttcacacgcccagcaggagtgtcttccgctgtcattcctgtcttgaggaagaccctgtggaggcagctacagagcaggcttcttagcactgacagtcccccagcatctgggctgtaccaggagatcctggcacagctggtcccgtttgcacgagccaaggatctcagtgtactcatggaccgcctgcccagcttgcttcacaccccaagcagtcacaagaggtggatcgtggccgactccatttcagcagctctggaagggtcagcagaagagctgtgtgcctggagaaggacccttttggagtcctgtgtgaagtggctgatcgtgtctttcagtggtggacagcaagatgatgataatactcagaatcaggagaaggaaatgctgcttagattaaatgcgttgttgcatgcacttaatgaagttgatcctggtgactggcagaaattcgtgaagaagggactcaaatttcggtaccaggaccacacatttttaaagatgctcctcaccgccgtacagctcctgtacagcccagaaagctccgtgcgcacgaagctcatccagctcccggtggtctacgtgatgctcatgcagcactcgctgtttctgccgactctactgacgtctgacggagaggagagcccggacagccaagtaaaagaagcgctggtggacctgatgctgacggtggtggagatgtgcccctctgtctgtgagagcagccactttgcagtgcttctcggggcctatggcgccactctcagcgtcctagatcagaagattttacttctgcttcgagcgtatgagcagaacaagctcagcctcatcaacttcagggtgctgctgtggggcccagcggccgtggagcatcacaagacgtgccggagcctgggcaggtcactgtggcagcagccgagtgtcggggacatccttcgcctgctggaccgggaccggatgatgcagaccatcctgcacttcccccagaaccggaggctgctgccccccgaggacacacaggagctgatattcaaagacaaaagcagggtggatcttgatggcctctatgacccctgctttctccttcagctcttcagtgagctgaccaggccagagtttgtggtggattgtcgaaaatttttggattcaaatgctctgggcctaactgtcacagccctcagcagctatgacccccagatgcgagccatagcctaccatgtcctggcggcctactactcgcacttggagggcgcacggttccaagagcagtcccagctactttacctgttggatgtagtccggaatgggattcgaactcaggacatgagacttacttttaccttggctctcttcattgccaaagcagccctgcagattttgaaaccagaggagcacatgtacctgaaggtcagcaacttcctgctgtcgcatgagtacttgaacatggacaaagtgccaggcttctaccagttcttctacagctccgactttgagcaaaaaacagagcagaagtgggtgtttggcgttctgcggcaggggatccgtgacaagcagtgctacgaactgtgtgcccggcgtggcatcttccacatcatcctgtccttcttccacagcccgctgtgtgacgaggcagcacagaattggattctggaaattctacagaatgctgcccaggttgccagatctgcgtatgaaatcatacgagactatagccttttaacatggattttacacatccttgaaagcaagtttctggagactccgctgctgtctaatgtgatctccttgctacacacactgtgggtgaccaacctgggggacaaggcagtggagtgggagagccagcgcctttgccagcctagctcccaggagcctgccaagcggcttgccctgcacctggtcaatgagttcctttatgttctcatcgtgctcatgaagcacctgaggcccaccttggcccccgtccagctgaccaacttcttcgggacacttgactccgtgctgaggtaccgggccactgtcatacaggcctttagggacatgaacagattcaccgtaaatgagacagtgctttccaccaaggacgtccttgtcctcttgcacaagtggagcctcattgaaagagacctcaagctccaggaagacctgagagcagccattgagaaggcccaagcccgggagctcatgaaaatgctcaaggataagaacaagcctgtcatgccagcccgagccaaaggcccacggggccgaaagaggaggcctggggaggcagaggagatggctgaccctgagctgatggcatctaccttggagacatgcaagggcctcctgaggtccatcttgacttactggagaccagtgatccctggtcctgaccccactcaggagcctgtggactcagccagccccgagagcgatgcgccaggccccgtatatgctgccgcttccctggcagtcagttgggtgctgcggtcggtggccgagcacccgctcagcagggcagaggctgcaggactcattggctggcttaagagccatattttgccacaccctgtggtcgtggctgacctccttaaggacagtgccgtgaggagcagcatattcaggctgtatagccggctctgtggggctgaggggctggcagggcctgtgcaggaggtggcctgcctgttcaatacggtcatgctgcagctggtggctgcccagggccgggcagggagccccttccacccggccatggaagccctctccctgtcttctctgagtgagaaggatgaagccacacaagcctccgcagcattcctagtgtctctctacataaaggacatctggctgggggctcagcggccggacaccctcttaacccacgtccggatggtgtgtgaggccgcagatgatgccccgagcagtgaagaggaggccatcgtggtgctctgcaaggacgccgccagcgcagcctcagatgcttgactcctgccggccagcaccttgcaccctgatgaccagagcctcgagcacagcaccagcttctagaagtttggttgagtcaagggtttccagagaaggcatgggaaacaacaggttcagtacattggctcagttctttgacaagaaaagttgagaggactttattgaactgcccagtaaatgataaactcgggcctgtaggtgcccagcatcagagttgcaaggaatgtggggacttctaggccatgaggcccatccagtgcctcgtcaggccgccccttcctctctaggggcttggagctcatcacaggaaatagctcgagtttgaggcagcacttctgaatgcagaagagattcatctgtgttaaagctgaaatgtcaaaaggtatcagattttttttatgaaaacgaagagagatgtttaaagtttatttttcagcaggtgaggtggctcacgcctataatcccagcactttgggaggccaaggcgggtgaatcacctgaggtcaggagttcgaaaccagccttcccaacatggtgaaaccccatctctactaaaaatacaaaaattagccaggcatggtagcgcacacctgtaattccagctactcgggaggctaaggcaggggaatcgcttgaacctgggaggtggaggctacagtgagctgagatcgtgccattgcgctccagcctaggtgacagagcaagactccatctcaaaaaaataaaaaaataaagtttgtttttctataaaaagtcataacaaagtattagtatgactttttgaataagttaatttctgccagtgtttaattattttattaaagaaaaggatgttacactgaatccttaaagaataaaagtgatttgacctctgctttgagaagacagcctgtaatttttaaagctatacttcaaagaggggattttgaattttataaatgcttgttaatgtctatttttgtaaggtttttgtgttttcctttcattgttgtcaagaggctatttttgctccacataggcctgcatttattttaaaggtcagaattttactcttaatggtcatatattagttggggttgtagctgacaaaagtcatgaaatttcgtggttttcacagttaaaatttccgtctgttcctttaaaactctcctgcatgcctggggctcttgggatctgctctgtggcctaggatgtggctgttttatctgccgtataatgtacatcgtgctgacaatgccttggttttgtctgaaacatttacacttctattttccaccagtgttctttagaattgtttctgttttaggtgacttaaagttttaactaaagcatgagtaacgtttgttggcatacagtcccttcaccacaaataattgtcttgcactgtctacaaagcaaggatcagttacctcacttgtccccttccctacccaaataaaccttacaacgctattctttgagactatcctgaacttgaaatcccacgtttagatccaagctggactcaggcaagcgctgctccaacaaagcgttctcttcctggttccccttaatctttatccacctctccaaggcctatctttggggattcctttggttataggcacctctgcttgtttatgcagggggcattggccggaaggacattggtctggggaatatccctgaaccccatgcctctgggggcacagggaggggcagcgagcaggtggggtggatttccacggcttcatccctggctccaggcctaagctgcctcccaggttcttagggcccagcaagtcaatacatactacgtcaggtggcgacaaatgctccaaagccgagttccagctcagtcaagtgaggacacattttcagcacctcaccttcttttctgcatctctggagctcatcagtcttgcttttctttgttctcccttttaaatccactgccctgaccttgttcgtgtattttccagtcacttagtgtggaggaagggaatctcatcccatggagaatagatcgaacatggtcttcacctgacttaaaatataaaatgctaaattagaaatatcttaagtggggcggggggcacagttattttaaaaataaaacctatcaactccctccttgcctgaaagctgtaggggacatatgggtcttctgagatttgctgtgtgatgctgtctcctctccagggacaaggctgctgggcactagaggactagatctttcaagggtcccagatccactgtcacataaagtcacatccagaagacctttcctgccagcttccagggctctttgtgttctgtgacagcatttgggcatagatcctgcttacccggcctggctgctgacaggcgttggctgcctgccctccaggggagacactttcttgggctctgtctttgaaaggctgtggggaggttgaaggtgcaactcaggtccccagactgcagtgagctgacctggcagggcagatgccatcacatctgggggagccggcgggtgttagtggagcttggatgggaacttacccagcatcctaacaaaggtacagaaggaccaggtgaactcagggctgataacgcattacacagtaatggtaaagtggcatagtaaagattagtaagcaaacagcttttcctcttgatttgcatatattttattttcctactcttccctgagcaaatataagcagtaagcaagcaggctaggtgtgctcaataaactcagcaacacctgggatgacctctgcactcgaggggccactgcaatctttgtcaaaggcataggatgctcctgctctagttgcacttgacctaggtgccctttctgctacatgcaaatggcctctaagaagaacgaggaacgtatgtgtccaggttggcttgatttcaccagttcactcagctatggccacgatttactgacatcagctctgcaattgagaggtcctgtctccagggggaggctcgctgggcttgctcctgacgaggggacccccattgagggtcagttcccagaggagagtggggtgggtctggaaacccccgaggggcaaggtggaggagctctcctgtcgtagcggctggtcagggccagttctgctccctggctccactgagctcgcctgagcctgtgaggttgccaggggttccctgtggcacggcaggcacttctggatgcagaggtggaggttgaggccgtgactccaggggcatgtttggtggtgcttggggctgttcctgtgaacagagcagagtgggaggcaggcatcatagttgctgcagaacagtccatactgtggggctggggggtttcctgccacacctgccatctgcccggaccccatagggaaggccacacaggcaaattcctgagaagggtcagccagctcacaaaggtggccattctagagaaatctcagaggagaggaagtgctttgtcaggaactaggcctcaggtctttccctggaggccacttcttcctacattgatttaggatggggggggtggggggtggaggggagcaggttgacctcccatccagcgctgtatctgagtgtagttcattttatatccatagcccaagccaacttgtatcttggtgatatggtttggctgcgtcacgacacaaatctcaccttgaattgtaataatccccacgtgtcgtgggaaggacccagtgggaggtaattgaatcatgggggcgggtcttcccatgctgttctcgtgatagtaagtctcatgagatctgatggttttataaaggggagtttccctgcacatgcccttttgcctgtgtcatgtaagatgtggctttgctcttcctttgccttctgccatgactgtgaagcctcccccgccatgtgaaactgtgagtccattaaacctctttcctttataaatta

SEQ ID NO: 2599 - DNA, 5613 bp, Homo sapiens
ggacgcgggacccgtacagcggcctccgccgcaccgggacagcagccgccgccgctgccgccgtcctcccctgtctacccggagctgtctcgagctgagccccctaccgggccggatcccgagataaagcctagccatggctgctgtttattctggcatttcccttaagcttaaaagcaagacaacttcctgggaagataaactaaaactagctcactttgcttggatttctcaccagtgctttcttccaaataaagaacaagtgttacttgattgggcaagacaatcattggttgcattttataagaaaaagcttgaactgaaggaagatattgttgaaaggctttggatctatatagataacattttacatagcagaaaattgcagaatctcctcaagaatggaaagaccattaatcttcagatttccctagtcaagatcatcaatgagagagtagctgagttctctctttcgggatcccaaagaaacatctgtgctgtccttcgatgttgccagggcatcctgtcgacacctgccctggctgtcatctacacggccaaacaggagctgatggtggccttgctgagccagctttgctggtcggcctgcaggcagcccgaaggagctgtggtagcccagttgtttgaggtcattcacctggcccttggccattatctcttgatcctgcagcagcaggtcaacccaagacgtgcctttggggatgtgactgctcacctgctccagccgtgcctggtcctgaggcacttactctctgggggcacatggacgcaggctggccagggccagctgaggcaggtgctgagccgggacatcaggagtcagattgaggccatgttccgaggagggatttttcagcctgagctactgtcatcctacaaggaggggctcttggaccagcagcaaggggatgtgaagacgggagccatgaagaaccttctggctcccatggacaccgtgcttaacaggctggttgatgctggctactgtgcagcatcccttcatacctctgttgtggccaactcagtggccttgctgtataagctctttctagattcttactttaaggagggaaaccagcttctctgcttccaggttctccccaggttgtttggctgcttgaagatttcacacctgcaggaggagcagagcaaagccctgtccacatcagattggaccacagagcttttggttgtggaacagctactaaactcagtggccaacaacaatatctacaacatcgctgccgacagaattcggcacgaagaggctcagttccgcttttaccgccacgtggctgagctgctgataaaccatgcacaagcacccataccggcctggttccgctgtctgaagactttgatatctctgaatcatttgattttggagccagacctggatgacctgctggcttcagcgtggatcgatgccgaggtaacagagtttcgaaccaaaaaagcccaggaggcgcttattcgtactgtcttccagacttatgccaaactccgacaagtgccacggttgtttgaagaggttttgggggtgatctgtcgtccagctgctgaggcactgaggcagcctgtgctggcctcgggcccctccacggtactctctgcatgcctcctggagctgcctccaagtcagatcctggacacgtggtcccttgtgctggagaagttccagtctttagtcttgccctatttgcagagtgatgccgacatggccctgaaatcactgtcactgagcttgctgctgcactgcatcatgttcaacatgaggagcctggacagcagcacgcctctgcccattgtcagacggacacagtgcatgatggagaggatgatgagggagctcgtgcagcccctgctggcccttctcccggacaccccaggcccagagccagagctgtggctgcagaaggtcagtgactctgtgctcctgctctcttacacttgggcccaggtggacgctatgttcagtttgaactgtagccagtatcactctatgtctgggccccttataggtgttgctctggagatctcgaacctcccttcgttgctcccaggtgtaaaaacacagcattggaagaagatagagaagtttacagctcagttcagctctcttggtacatattgcttagaacagctgtacctgcagaaaatgaaaaggactttaatgcaaactagtttccggtctgaaggagccatccaaagtttgaggtgcgatgctgcctttattattggttccggcagaaaaagcttgaatcagagaacgacggcttcctgggatggccaagttgggatggtgagtggactcacataccctgtagcacactggcacttgattgtgtcaaatctcacaattttaatatcctatctgtgtccagatgatgtgggatacctggccagtgtcctgctgagaactttacccatgggcaaagcccaggaagtctcaatagatgaagaggcatacatcacactggaaaaaatatccaaagccttccttcatagccctctctttccagagatgcagtcccttcattctgctttcttaacgtgcgtaaccacaagttgctccagcattctgtgttctggtgcccagcgtgactcaggtcttgtcagtcagcagcttccctggctttttgaaaaggaccacatggttgtgggtcattgggaaaacagatttgcaaaagctggacccgaaggtatagaacctagaggagaaattgcccagaacttactgtccctggtcaagagtgacttccctatccagctggagggagagcagttggaaagcatcctggggcttttggaagtgatttctgccttacagctggacagcctcttgccaccctatcatgtgcattattttcttgtgttactgtccatggccgtcaccaaactaggatgctcttgctcctcctcactggctctcaagttcttgacgacttgctaccaacttcttggttacttgcaaaaggggaaaagtgctcgctctgtgttcaagatcatgtatggtagtgatatttttgaggttgtactgacctcattgttcagagctagtagtaggttccttattgagatggatgatcccgcttggctggaattcctccaagtgatagggacgttcttagaggagctaatgcagatgctcatccaaatgaagctgagcttggtgctcaattttagaaaaatcaccgcattcctctctagttccaaaccatacacggaggcagcttcaagcaaacaattagaaaatcagaacccccagggcaggcagctccttctggtgtctttaaccaggttgtgccatgtcctgggacctttcctcaaagagcagaagctgggccaagaggccccagcagcactgtctgagctgctgcagcaggttgtgctgcagacaggagctgtgctgcagctctgctcagtgccgggggcccggggctggcgccttccctcggtcctcatctcatccgtcagcacgctcttggaagccgacctgggtcagcactgcagggatggaggggccgacatttcccaaggaagcgacaggacgctgctctcccatgttgccctctaccagggtgtttactctcagatactgttggagttgccagctctcgcgggacatgatcagtcttttcaggcagccttgcagtttttgactctgttctttttggccccagaactgcatcccaaaaaggactccgtgtttacctccatgtttcattctgtgagaagagttcttgcagatcctgaaattcctgttcaggtcactcaggatattgagcctcatttgggagccttgttcacccaaatgttagaggttgggacgacagaggacttgaggctggtgatgcagtgtattctccagggactggatgtcagtaacatgtggaaagcagatgtgcaggctgttgtgtcagctgttacactgctgaggctgctactgaactgcccactcagtggagagaaagcaagtctgttgtggcgtgcgtgtccccagatagtcacagctttaacactcttaaaccgagaagcttctcaggagcagcctgtgtccctcacagtggtcgggcctgtcttagatgtcctggctgcactgctgcggcagggggaggaggccatcggcaacccccaccacgtcagcctggccttcagcatccttctcactgtccctttggaccatctgaagccgctggagtatggaagcgtcttcccgaggctgcacaacgtgctcttctcaatcctgcagtgtcaccctaaggtaatgctgaaagccatcccttctttcttgaactctttcaatagattggtgttttcagttatgcgggaagggcggcagaaggacaaaggaagcatagatgacctgcctacggtcctaaagtgtgcacgcctggttgaaagaatgtacagccacatcgccgcacgagctgaggagtttgctgtgttttccccatttatggtggcccagtacgtgttggaggtacagaaggtgaccttatatccagctgtgaaaagtctgctgcaggagggcatttacctcatcctggacctctgcatcgagcctgacgtccagttcctgcgggcctcgctgcagccgggaatgagagacatctttaaggagctctataatgactatctcaagtaccacaaggccaaacatgaaggagagaaaagatatacggcctaaggctatgggacagaagtgccgccagtgacactgtccagaggctttggctgcatggtctgaaagagctggagaatgaaagacttaagatgttctaattcgtagtattggtatacatagaaaatcctttggggtttatgtagtatattttgatgtattttacatcgtgtttttcttactattttttaatacatagttttatgcagtaagtattgcaatagaatcctgaaaattgaccctgggatgagattaattcaatagaaaaattgctgactcttgggacctttctgtgtttggttctcgtcttggctcagtggtttggtgttccctcgtctgcactggaaactacataaaacttggctttttactttgggtacatgggcgtataattcagccctgtttaaatatacttgcctttcaaattcttcaagtaacatgggaagtattcttgaaatgtcacattttctgccttccctctaagtatgctttctgaagaagtcagggaaagttagagtctgtggcctgaggtgtctgctctgggtggcgatagtgggcacctcaggcaggtcggtgacgtttagcacaggtgccagggctcctgcctgctcctcctgtgttagctctgtgaagttcatttaggaatttttttttcctatgcagtttaagaaataatcctaattgttttttcttattacctaagcaatatatttttattatagcaacctcagaaaagaaaaataaaaggataatttaaaaaactcattcatagtctcagttacccagataacctcggttgtcaccttggagtatcttgttgtagtccctttactatgtgtatgtatatagatgtgcatataaatatatatagtagctaaattggatcataaatgcatttttttaaagtt

SEQ ID NO: 2600 - DNA, 643 bp, Homo sapiens
ccaatgatacttgaatatattaattagtactgttcctattattgtttgtttctacccatttccagaatggattagcaccagcttagagtaaaaggtacagactcagcaaattccaaaccaggattgccccatagacctcctgaagttacgcagtgtgggttctctaccctagatagttaaaacaagggtcaaagagtctaatacaagatgggtgagcagtgacagcagcatgtccaggcgaaaggatgtggctatccctgggcacacacaactggtttgagtgtcccgatagactaggctaagaaagaaataagtatgagctcctttaaagtagaaaaacttaaataatcacgtatgtacttttacattctgttatctgtcattacaggtaatgctgaaagccatcccttctttcttgaactctttcaatagattggtgttttcagttatgcgggaagggcggcagaaggacaaaggaagcatagatgacctgcctacggtcctaaagtgtgcacgcctggttgaaagaatgtacagccacatcgccgcacgagctgaggagtttgctgtgttttccccatttatggtggcccagtacgtgttggaggtacagaaggtgaccttatatccagctgtgaaaagt

SEQ ID NO: 2601 - DNA, 1965 bp, Homo sapiens
atgaagggagactttagaaaaaaaaaatcagaggcaagaactcccctggagcaggaaattttcaacctcctccataagaacaagcagccagtgacagaccctttactgacccctgtggaaaaggcctctctccgagccatgagcctagaagaggcaaagatgcgacgagcagagcttcagagggctcgggctctgcagtcctactatgaggccaaggctcgaagagagaagaaaatcaaaagtaaaaagtatcacaaagtcgtgaagaaaggaaaggccaagaaagccctaaaagagtttgagcagctgcggaaggttaatccagctgcagcactagaagaactggaaaaaattgaaaaggccagaatgatggaaagaatgagccttaagcaccaaaacagtgggaaatgggccaagtcaaaggcaattatggccaaatatgacctggaggctcgccaagctatgcaggaacagttgtctaagaacaaagaactgacacagaaactccaggtagcctctgagagtgaggaagaggagggaggcacagaagatgtggaagaactccttgtccctgatgtagtgaatgaagtgcagatgaatgcagatgggccgaatccctggatgctcaggagctgcaccagtgacaccaaagaggctgcaacccaggaggaccctgagcaactgccagagcttgaggcccatggagtttctgaaagtgagggagaagaaagaccagtggcagaagaagaaattttgttgagagaatttgaggaaaggcgatcccttagaaaaagatctgagctcagccaagatgctgagccagcaggcagtcaagaaacaaaagattctggcagccaggaggtgctgtctgaattgagagtactatctcagaaattgaaggaaaaccatcagtccaggaagcaaaaagcaagttcagaggggactattccccaggtccagagagaggaacctgccccagaagaagaggagcccctgttgctacagagaccagagagagtacagacgctggaagagctagaagagctgggaaaagaagaatgttttcaaaataaggagcttcccagacctgtgttagaagggcagcagtcagagaggaccccaaataatcgccctgatgcccctaaggagaagaaaaagaaggagcaaatgatcgacctacagaacctcctaaccacacaatctccctccgtgaagtctttggcagttcccacaatagaggagctggaagatgaagaggagagaaaccataggcagatgataaaggaagcttttgctggggatgatgtcatcagagatttcttgaaagagaagagggaagctgtggaggcgagtaagccaaaggacgtggacctgacactacctggctggggcgagtggggtggtgtgggcctaaagcccagtgccaagaaaagacgccggtttctcattaaagcccctgagggtcctccaagaaaagataagaatttgccaaatgtgattatcaatgagaagcgcaacatccacgcagctgctcatcaggtacgagtgcttccatatccatttacccaccattggcaatttgaaaggaccatccagacccccataggatccacatggaacacccagagggctttccaaaagctgactactcccaaggtcgtcaccaagccaggccatatcattaaccccataaaagcagaagacgtgggctaccggtcttcctcaaggtcggacctgtctgtcatacagaggaatccaaaacgaatcaccacacgtcacaaaaaacagctgaagaaatgctctgtagattgagttgctggaggagtgacagccaggagccctgacttcacttcctttggtccagttttactctgatacagggtggattccaaaactggctcagtacattgcatgtagttaagccacattttaaaaataaaggcattttttaatctatttacctgg

SEQ ID NO: 2602 - DNA, 2376 bp, Homo sapiens
gagagaagctggctgctgaaatgactgcgaaccggcttgcagagagccttctggctttgagccaacaggaagaactagcggatttgccaaaagactacctcttgagtgagagtgaagatgagggggacaatgatggagagagaaagcatcaaaagcttctggaagcaatcagttcccttgatggaaagaataggatcaggagaaaagctggtccttgcagatctgcttgagcctgttaaaacttcatcttctttggccactgtgaaaaagcaactgagtagagtcaaatcaaagaagacagtggagttacctctgaacaaagaagagattgaacggatccacagagaagtagcattcaataaaaccgcacaagtcctctccaaatgggaccctgtcgtcctgaagaaccggcaggcagagcagctggtttttcccctggagaaagaggagccagccattgctcccattgaacatgtgctcagtggctggaaggcaagaactcccctggagcaggaaattttcaacctcctccataagaacaagcagccagtgacagaccctttactgacccctgtggaaaaggcctctctccgagccatgagcctagaagaggcaaagatgcgacgagcagagcttcagagggctcgggctctgcagtcctactatgaggccaaggctcgaagagagaagaaaatcaaaagtaaaaagtatcacaaagtcgtgaagaaaggaaaggccaagaaagccctaaaagagtttgagcagctgcggaaggttaatccagctgcagcactagaagaactggaaaaaattgaaaaggccagaatgatggaaagaatgagccttaagcaccaaaacagtgggaaatgggccaagtcaaaggcaattatggccaaatatgacctggaggctcgccaagctatgcaggaacagttgtctaagaacaaagaactgacacagaaactccaggtagcctctgagagtgaggaagaggagggaggcacagaagatgtggaagaactccttgtccctgatgtagtgaatgaagtgcagatgaatgcagatgggccgaatccctggatgctcaggagctgcaccagtgacaccaaagaggctgcaacccaggaggaccctgagcaactgccagagcttgaggcccatggagtttctgaaagtgagggagaagaaagaccagtggcagaagaagaaattttgttgagagaatttgaggaaaggcgatcccttagaaaaagatctgagctcagccaagatgctgagccagcaggcagtcaagaaacaaaagattctggcagccaggaggtgctgtctgaattgagagtactatctcagaaattgaaggaaaaccatcagtccaggaagcaaaaagcaagttcagaggggactattccccaggtccagagagaggaacctgccccagaagaagaggagcccctgttgctacagagaccagagagagtacagacgctggaagagctagaagagctgggaaaagaagaatgttttcaaaataaggagcttcccagacctgtgttagaagggcagcagtcagagaggaccccaaataatcgccctgatgcccctaaggagaagaaaaagaaggagcaaatgatcgacctacagaacctcctaaccacacaatctccctccgtgaagtctttggcagttcccacaatagaggagctggaagatgaagaggagagaaaccataggcagatgataaaggaagcttttgctggggatgatgtcatcagagatttcttgaaagagaagagggaagctgtggaggcgagtaagccaaaggacgtggacctgacactacctggctggggcgagtggggtggtgtgggcctaaagcccagtgccaagaaaagacgccggtttctcattaaagcccctgagggtcctccaagaaaagataagaatttgccaaatgtgattatcaatgagaagcgcaacatccacgcagctgctcatcaggtacgagtgcttccatatccatttacccaccattggcaatttgaaaggaccatccagacccccataggatccacatggaacacccagagggctttccaaaagctgactactcccaaggtcgtcaccaagccaggccatatcattaaccccataaaagcagaagacgtgggctaccggtcttcctcaaggtcggacctgtctgtcatacagaggaatccaaaacgaatcaccacacgtcacaaaaaacagctgaagaaatgctctgtagattgagttgctggaggagtgacagccaggagccctgacttcacttcctttggtccagttttactctgatacagggtggattccaaaactggctcagtacattgcatgtag

SEQ ID NO: 2603 - DNA, 2488 bp, Homo sapiens
gtccatgtgagagaagctggctgctgaaatgactgcgaaccggcttgcagagagccttctggctttgagccaacaggaagaactagcggatttgccaaaagactacctcttgagtgagagtgaagatgagggggacaatgatggagagagaaagcatcaaaagcttctggaagcaatcagttcccttgatggaaagaataggcggaaattggctgagaggtctgaggctagtctgaaggtgtcagagttcaatgtcagttctgaaggatcaggagaaaagctggtccttgcagatctgcttgagcctgttaaaacttcatcttctttggccactgtgaaaaagcaactgagtagagtcaaatcaaagaagacagtggagttacctctgaacaaagaagagattgaacggatccacagagaagtagcattcaataaaaccgcacaagtcctctccaaatgggaccctgtcgtcctgaagaaccggcaggcagagcagctggtttttcccctggagaaagaggagccagccattgctcccattgaacatgtgctcagtggctggaaggcaagaactcccctggagcaggaaattttcaacctcctccataagaacaagcagccagtgacagaccctttactgacccctgtggaaaaggcctctctccgagccatgagcctagaagaggcaaagatgcgacgagcagagcttcagagggctcgggctctgcagtcctactatgaggccaaggctcgaagagagaagaaaatcaaaagtaaaaagtatcacaaagtcgtgaagaaaggaaaggccaagaaagccctaaaagagtttgagcagctgcggaaggttaatccagctgcagcactagaagaactggaaaaaattgaaaaggccagaatgatggaaagaatgagccttaagcaccaaaacagtgggaaatgggccaagtcaaaggcaattatggccaaatatgacctggaggctcgccaagctatgcaggaacagttgtctaagaacaaagaactgacacagaaactccaggtagcctctgagagtgaggaagaggagggaggcacagaagatgtggaagaactccttgtccctgatgtagtgaatgaagtgcagatgaatgcagatgggccgaatccctggatgctcaggagctgcaccagtgacaccaaagaggctgcaacccaggaggaccctgagcaactgccagagcttgaggcccatggagtttctgaaagtgagggagaagaaagaccagtggcagaagaagaaattttgttgagagaatttgaggaaaggcgatcccttagaaaaagatctgagctcagccaagatgctgagccagcaggcagtcaagaaacaaaagattctggcagccaggaggtgctgtctgaattgagagtactatctcagaaattgaaggaaaaccatcagtccaggaagcaaaaagcaagttcagaggggactattccccaggtccagagagaggaacctgccccagaagaagaggagcccctgttgctacagagaccagagagagtacagacgctggaagagctagaagagctgggaaaagaagaatgttttcaaaataaggagcttcccagacctgtgttagaagggcagcagtcagagaggaccccaaataatcgccctgatgcccctaaggagaagaaaaagaaggagcaaatgatcgacctacagaacctcctaaccacacaatctccctccgtgaagtctttggcagttcccacaatagaggagctggaagatgaagaggagagaaaccataggcagatgataaaggaagcttttgctggggatgatgtcatcagagatttcttgaaagagaagagggaagctgtggaggcgagtaagccaaaggacgtggacctgacactacctggctggggcgagtggggtggtgtgggcctaaagcccagtgccaagaaaagacgccggtttctcattaaagcccctgagggtcctccaagaaaagataagaatttgccaaatgtgattatcaatgagaagcgcaacatccacgcagctgctcatcaggtacgagtgcttccatatccatttacccaccattggcaatttgaaaggaccatccagacccccataggatccacatggaacacccagagggctttccaaaagctgactactcccaaggtcgtcaccaagccaggccatatcattaaccccataaaagcagaagacgtgggctaccggtcttcctcaaggtcggacctgtctgtcatacagaggaatccaaaacgaatcaccacacgtcacaaaaaacagctgaagaaatgctctgtagattgagttgctggaggagtgacagccaggagccctgacttcacttcctttggtccagttttactctgatacagggtggattccaaaactggctcagtacattgcatgtagttaagccacattttaaaaataaaggcattttttaatcta

SEQ ID NO: 2604 - DNA, 2403 bp, Homo sapiens
acggaaacagaaattgctttgcggcccgcacggaaattgctttccttcggcttccgttcttggtccatgtgagagaagctggctgctgaaatgactgcgaaccggcttgcagagagccttctggctttgagccaacaggaagaactagcggatttgccaaaagactacctcttgagtgagagtgaagatgagggggacaatgatggagagagaaagcatcaaaagcttctggaagcaatcagttcccttgatggaaagaataggcggaaattggctgagaggtctgaggctagtctgaaggtgtcagagttcaatgtcagttctgaaggatcaggagaaaagctggtccttgcagatctgcttgagcctgttaaaacttcatcttctttggccactgtgaaaaagcaactgagtagagtcaaatcaaagaagacagtggagttacctctgaacaaagaagagattgaacgggcaagaactcccctggagcaggaaattttcaacctcctccataagaacaagcagccagtgacagaccctttactgacccctgtggaaaaggcctctctccgagccatgagcctagaagaggcaaagatgcgacgagcagagcttcagagggctcgggctctgcagtcctactatgaggccaaggctcgaagagagaagaaaatcaaaagtaaaaagtatcacaaagtcgtgaagaaaggaaaggccaagaaagccctaaaagagtttgagcagctgcggaaggttaatccagctgcagcactagaagaactggaaaaaattgaaaaggccagaatgatggaaagaatgagccttaagcaccaaaacagtgggaaatgggccaagtcaaaggcaattatggccaaatatgacctggaggctcgccaagctatgcaggaacagttgtctaagaacaaagaactgacacagaaactccaggtagcctctgagagtgaggaagaggagggaggcacagaagatgtggaagaactccttgtccctgatgtagtgaatgaagtgcagatgaatgcagatgggccgaatccctggatgctcaggagctgcaccagtgacaccaaagaggctgcaacccaggaggaccctgagcaactgccagagcttgaggcccatggagtttctgaaagtgagggagaagaaagaccagtggcagaagaagaaattttgttgagagaatttgaggaaaggcgatcccttagaaaaagatctgagctcagccaagatgctgagccagcaggcagtcaagaaacaaaagattctggcagccaggaggtgctgtctgaattgagagtactatctcagaaattgaaggaaaaccatcagtccaggaagcaaaaagcaagttcagaggggactattccccaggtccagagagaggaacctgccccagaagaagaggagcccctgttgctacagagaccagagagagtacagacgctggaagagctagaagagctgggaaaagaagaatgttttcaaaataaggagcttcccagacctgtgttagaagggcagcagtcagagaggaccccaaataatcgccctgatgcccctaaggagaagaaaaagaaggagcaaatgatcgacctacagaacctcctaaccacacaatctccctccgtgaagtctttggcagttcccacaatagaggagctggaagatgaagaggagagaaaccataggcagatgataaaggaagcttttgctggggatgatgtcatcagagatttcttgaaagagaagagggaagctgtggaggcgagtaagccaaaggacgtggacctgacactacctggctggggcgagtggggtggtgtgggcctaaagcccagtgccaagaaaagacgccggtttctcattaaagcccctgagggtcctccaagaaaagataagaatttgccaaatgtgattatcaatgagaagcgcaacatccacgcagctgctcatcaggtacgagtgcttccatatccatttacccaccattggcaatttgaaaggaccatccagacccccataggatccacatggaacacccagagggctttccaaaagctgactactcccaaggtcgtcaccaagccaggccatatcattaaccccataaaagcagaagacgtgggctaccggtcttcctcaaggtcggacctgtctgtcatacagaggaatccaaaacgaatcaccacacgtcacaaaaaacagctgaagaaatgctctgtagattgagttgctggaggagtgacagccaggagccctgacttcacttcctttggtccagttttactctgatacagggtggattccaaaactggctcagtacattgcatgtagttaagccacattttaaaaataaaggcattttttaatctatttacctgg

SEQ ID NO: 2605 - DNA, 979 bp, Homo sapiens
tttaaagtgtggctgcaggatgaagggagactttagaaaaaaaaaatcagaggcaagaactcccctggagcaggaaattttcaacctcctccataagaacaagcagccagtgacagaccctttactgacccctgtggaaaaggcctctctccgagccatgagcctagaagaggcaaagatgcgacgagcagagcttcagagggctcgggctctgcagtcctactatgaggccaaggctcgaagagagaagaaaatcaaaagtaaaaagtatcacaaagtcgtgaagaaaggaaaggccaagaaagccctaaaagagtttgagcagctgcggaaggttaatccagctgcagcactagaagaactggaaaaaattgaaaaggccagaatgatggaaagaatgagccttaagcaccaaaacagtgggaaatgggccaagtcaaaggcaattatggccaaatatgacctggaggctcgccaagctatgcaggaacagttgtctaagaacaaagaactgacacagaaactccaggtagcctctgagagtgaggaagaggagggaggcacagaagatgtggaagaactccttgtccctgatgtagtgaatgaagtgcagatgaatgcagatgggccgaatccctggatgctcaggagctgcaccagtgacaccaaagaggctgcaacccaggaggaccctgagcaactgccagagcttgaggcccatggagtttctgaaagtgagggagaagaaagaccagtggcagaagaagaaattttgttgagagaatttgaggaaaggcgatcccttagaaaaagatctgagctcagccaagatgctgagccagcaggcagtcaagaaacaaaagattctggcagccaggaggtgctgtctgaattgagagtactatctcagaaattgaaggaaaaccatcagtccaggaagcaaaaagcaagttcagaggggactattccccaggtccag

SEQ ID NO: 2606 - DNA, 5494 bp, Homo sapiens
gcctttgctaaattgctgaataagaagatggttgagtcacctccttcgcttaaacttgtcctcattggaggttgtcgtaacaaagatgatgaacttagggtaaaccaactgagaaggctgtctgaggatttaggagttcaagaatatgtggaatttaaaataaacattccatttgatgaattaaagaattatttgtctgaagcaacaattggtctgcataccatgtggaacgagcattttgggattggagttgtggagtgtatggcagctggcacaattatccttgcacacaattcggggggcccaaagcttgacattgtggttcctcacgaaggagatataactggctttctggctgagagtgaagaagactatgctgaaactatcgctcacattctttccatgtctgcagaaaagagactccaaatcagaaaaagtgctcgtgcatctgtaagcagattctctgatcaggaatttgaagtgacattcctatcatctgtggaaaagttatttaagtaatgccatatctgtaaaattaaagatattttatataaactggttaaacaccttcatatgtaaatatttttctaaattcaatctcatttgtcaaatcattttactttagaaaacagacaaaatttccttttagaataaaaggaagtgttgaaaagaaaatggatgactagccttcggcttccattcttggtatacatgagagaggctggctgctgagatgaatgtgaaccaggttgcagagaatctggctttgagccaccaggaagaactagtggatttgccaaaaaactaccccttgagtgaaaatgaagatgagggggacagtgatggagagagaaagcatcaaaagcttctggaagcaatcatttcccttgatggaaagaataggcggaaattggctgagaggtctgaggctagtctgaaagtgtcagagttcagtgtcagttctgaaggatcaggagaaaagctgggccttgcagatctgcttgagcccgttaaaacttcatcttctttggccactgtaaaaaagcaactgaatagagtcaaatcaaagaaggtggtggagttacctcttaacaaagaaaaaattgaacagatccacagagaagtagcattcagtaaaacctcacaggtcctctccaaatgggaccctatcatcctgaagaaccagcaggcagagcagctggtttttcccctggggaaggagcagccagccattgctcccattgaacatgcgctcagtggctggaaggcaagaactcccctggagcaggaaatttttaacctcctccataagaacaagcagccagtgacagatcctttactgactcccatggaaaaggcctctctccaagccatgagcctggaagaggcaaagatgcaccgagcagagcttcagagggctcgggctctgcagtcctactatgaggccaaggctcgaaaagagaagaaaatcaaaagtaaaaagtatcacaaagtcgtgaagaaaggaaaggccaagaaagccttaaaagagtttgagcagctacagaaggttaatccaactgtggcactggaagaaatggaaaaaattgaaaatgccagaatgatggaaagaatgagccttaagcaccaaaacagtgggaaatgggccaagtcaaaggcaattatggccaaatatgacctggaggctcgccaagctatgcaggaacagttggccaagaacaaagaactgacacagaaactccaggtagcctctgagagtgaggaagaggagggaggcacagaagtggaagaactccttgtccctcatgtagcgaatgaagtgcagatgaatgtggacggaccgaatccctggatgttcaggagctgcaccagtgacaccaaagaggctgcaacacaggaggaccctgagcaagtgccagagcttgcagctcatgaggtttctgcaagtgaggcagaagaaagaccagtggcagaggaagaaattttgttgagagaatttgaggaaaggcaatcccttagaaaaagatctgagctcaaccaggatgctgagccagcaagcagtcaagaaacaaaagattctagcagccaggaggtgctgtccgaattgagggcactatctcagaaattgaaggaaaaacatcagtccaggaagcaaaaagcaagttcagaggggactgttccccaggtccagagagaggaacctgccccagaagaagcggaacccctattgctacagaggtcagagagagtacaaactctggaagagctagaagagctgggaaaagaagattgttttcaaaataaggagcttcccagacctgtgttagaaggacagcagtcagagaggaccccaaataatcggcctgatgcccctaaggagaagaaagagaaggagcaactgatcaacctacagaacttcctgaccacacagtctccttccgtgaggtctttggcagttcccacaataatagaggagctggaagatgaagaggagagagaccaaaggcagatgataaaggaagcttttgctggggatgatgtcatcagagatttcttgaaagagaagagggaagctgtggaggcgagtaagccaaaggacgtggacctgacactacctggctggggcgagtggggtggtgtgggcctaaagcccagtgccaagaaaagacgccagtttctcattaaagcccctgagggtcctccaagaaaagataagaatttgccaaatgtgattatcagtgagaagcgcaacatccacgcagcagctcatcaggtacaagtgcttccatatccatttacccaccatcggcaatttgaaaggaccatccagacccctataggatccacatggaacacccagagggctttccaaaagctgactactcccaaggtcgtcaccaagccaggccatatcattaagcccataaaagcagaggatgtgggctaccagtcttcctcaaggtcagacctgcctgtcatacagaggaatccaaaacgaatcaccacacgtcacaataaagaagaaaaactgtaggttgtgtagctggagaagtgacagtcaggggccctgattccacttcctttggtccagttttactctgctacagggtggattccaaaactggctcagcacattgcatgtagttgagccacattttttaaaaaaagaaaatggatgaccattaattgactagcattttagaattgatcagacattagaacacagaaaaattctagtacatttaaattctaaacaatacagtggatgacccttttgaatatacctaatgatttccttaaaaaagaaattttaaacagacttgtttaatcgtgttctcaaagcatacagtcaagaggtgggactgactgatgctttataggtgtgtgtagggtggtagaggccaaggtgctgccagcaatcctttccatactaggtactggtgaaaattgtttttgtttatgctgtcagcacatttgtgtgggtctctcattgtcccttaacagtgccgcatctcagcctggaagtcagctttaagtcattcaagagaacctcaggctgtttttctgacagtgatgatatgatatacagatacatccacagggtatctattaccagcataatgcattgtaagatggcaaggtggcattttgaaagagcgctgggcaagcagttagcacatctgggcctaccttcagcttcttcatttacaaacttctgaccttttgacactaaagctgctcctttatctttctgagtctcagattcttcatctgtaatctggagttgttaattccagtccttactaccttttagagttggaatgagatggaaagtagatgaaactactttgaaaattacgacagttaagggctgggtgcggtgtctcacacctgtaatcccagcactttgggaggccgagatgggtggatcatgaggtcagcagttgagaccagcctgaacaacatggtgaaaccctgtctgtactaaaaatacaaaaaaattagctgggcctggtggcaggcacctgtaatcccagctacttgggagactgaggcaggagaattgcttgaaactggaaggcagaggttgcagtgagccaagattgtgccactgcactctagcctgggcaataagcaaaactccatctcaaaaaagaaaaaaaggaaaaagaaaattatgagagttacttaaaggtaacatcacatactaaatgtcttctataatcctatatttattaatgcattacaactctgtagattgttagttactaggccagtagctaggaattggtataaatttaatgcaccttctatcctgaataactagcatggaaaagtgaatatatgtgtgagcagatatggctataaagacctatagcttttgcactttatgcatatataatcaatcctttctagttcagtgaattgaccccatccacaggctgattcatctttgtgttaaggggcaaatgaaacggtatattatttctttgcagtctcctctcagtcattcatcaatgtggccagcttatctactcccaattatgttgttgatacatctccaagccatctgtcatcagatcaaaaagcagcaaacagagggtcagtcacaggatgttctgacacaccattgtaactttttgttagagatgatcccatttagaaaaagactggtagaaattggagtgaaaggaaccctacagattagcccagttctctcttattttcagctttacagacaagaacaatttaaatctaaagaatttagtagattccttcagtgtcacaaagctgtttcatgaaagaatcaagattataacctggatattctgactcctggcccagtgctttttcttactttgtagctacactttgaagtaagattcaaactgttatccactcaattgccttattcctgaggatgtagtgaaggaagaaaaagttttctggaattccgtaaattatattttaagcttatttcttcaaaattattttcatatatcacagatatatcattggaagatataatttgcatatatgttcattatcagtgttcctaatttggtattacatgtattctatttttttctgaatgatagcatgaaaagtgtcaaagtggtttgtccgctagcgtctgtctgcagaactttcaggatgactattaattcctctcagatgtcatttttgagtggtccaagcctgctgttttgaacccacagcagtggagatttgtattcttatttacagttgtgtactataaagtgtgtgttacataggttttgtgtaataattatttgtaaatattatttagatttgtatttagacatgatttatatctaatatagatacaaagtctgtgtctaaatattatttaaagaagtgatttttcattctcttggattctttccagtgtggtgccttttatatgcctcacatagtctccttgttctcctactaatattcccaagctccatatgccaattaaagaagaaac

SEQ ID NO: 2607 - DNA, 3687 bp, Homo sapiens
gtacgtcatcttcgcgcgacgttcggttcgctgtgtgtgtcgccggctccttgagggtccatgtgatttttacgccagtgctgctgaactgtgcagggtagggagctggcacagtccgattaattgtccttgggtcgaggtgtctcgtcggaccctttggggctcagtggagaattaaggcagagtcactgtaattatttctaataccaattccaaaatagtgactcttggacaatagtgcaattatatggaattatggctggttataagcctgtagctattcagacatatcctatacttggtgaaaaaatcacccaagatacactgtactggaacaactataagacccctgttcagattaaggaatttggtgcagtttcaaaagtagacttttctcctcagcctccatataattatgctgtcacagcttcctcaagaattcacatttatggccgatactcccaagaacctataaaaaccttttctcgatttaaagacacagcatactgtgctacttttcgacaagatggtagattgcttgtggctggcagtgaagatggtggagttcaactttttgatataagtgggagggctcccctcaggcagtttgaaggccatacaaaagcagttcatacagtagattttacagctgacaaatatcacgtggtctctggggctgatgattatacagttaaattatgggatattccaaactccaaagaaattttgacatttaaagaacactctgattatgtgaggtgtggatgtgctagcaaacttaatccggatctctttataacaggatcatatgatcatactgtgaagatgtttgatgcacgaacgagtgagagtgttctctccgttgagcatgggcagccagtggagagtgtcctacttttcccctctggaggtcttctggtgtcagcaggaggtcgttatgttaaagtctgggacatgttaaaaggaggacaattgctagtatctttgaaaaatcatcacaaaaccgtgacatgtttatgtctaagcagctctggacagaggttactctctggctcactggataggaaggtgaaagtatacagcacaacttcctacaaagtagtccacagttttgattatgcagcttcaattttgagtcttgcccttgcacatgaagatgagacaatagttgtaggaatgaccaatggaatactgagtgttaaacatcggaaatctgaagcaaagaaggaatcacttcccagaagaagaaggcctgcatatcgaacctttattaaaggaaaaaattacatgaagcaacgggatgacattttgattaacaggccagcaaagaagcacctagaattgtatgacagggatctgaaacattttcggatctctaaggcactcgatagagttcttgatcccacttgtacaataaagacacccgagattacggtgtccatcataaaggagttaaatcgaagaggagtccttgcaaatgcgcttgcaggtcgggatgagaaggaaatcagtcatgttcttaattttttgataaggaatctttctcagccaagatttgcccctgttttaatcaatgctgctgaaataattattgatatatatctgcctgtaattggtcagtcccctgtagttgataaaaagtttttactacttcaaggacttgtagaaaaagagattgattaccaaagagaattgttagaaaccttggggatgatggatatgctttttgccaccatgagaaggaaggaaggcacttctgtgttggaacacacatctgatggatttccagagaataagaagatagaatcatagtgtctgctaaataagacatataagaactctgaagttggaatagatttgactgtattaaatgttggcgagagactctctttgatacattaaaaaaactgtttgcagaagcagttctgtggaagagactggaataattatggccggaaaacaagtacccgttttaagtaagacatggttttccatgtaatattttgaattatagcatcttcacctagaagatctcaattgtcttagtcacagagtaggtttatctgggatggatattaattttaatacaggagtgttctgtatcaacatttgggttggtattcagatgggaattcaaatatgaatcctctctggagagggtccaactgggaatcctgctaaaggagcaaagccttgtattacctctggaagacaacaaaaacaattggcaacaacaaaaagcctctttcttgactttaatcagtgcctttgggatttctaggcccttgcttagcttgcttcctgtctccttgatatctacacttgtcttagatcacatgccctgcttcagctggtaatgggactgcatcggttccaagtgtggcaagtaagttttcggctctgaagaactgacactagctagatttgtattcagagtgtgagagcaagctctacagatagaccttattggactacttttttttttttcttcatgcagcctttctaccaagttttcaccttgtttcaggtcagaggaatgatagaatttgtcatttttcttacaacagcctttcagactattcttcatatgtttcaagctaatcttgtagctaagctacctaatcctctgaaaactgttttctctgatttgtatttagattcctccccccattattcacaatcatattgtatttcggaaccccaatgcagagcagtttgctttgaaaaatagttgtttttaaaagtttaatgtaaataattattttttagaagttttttttttttttttaaagacagggtctcgctttatcgcccaggctggagtacagtgatgcaatctcagtccactgcaacctctgccctcccgggtttaagcagttctcctgcctcagcctcctgagtagctgggattacaggtgtgccccaccacgcctggctaatttttgtagttttagtagagacggggtttcaccttaccgggctggtctaaaactcctgacctcaagtgatctacctgcctctgcctcccgaagtgcttggattacaggtgtgagccactgtgtccagcctgtaactattatttttttataaagagagattcttattttcttggctttttgatgtatctgttcctgatagataatcattggctagtaactcctagtacactggtttcacagttgctacctctcctgcttttctctaattattacgccaactcaagtagttaaaaatcagtaagaaaaatgtcttgagctagaagaacccatagaggaagattttgtaatgcgaatctcctctcataattttagttctgtaaattcagggtttttttttgtttttttgttttttttaagccgaaaaaatgcttaatatgttccagtaagggtattaagtaaaaattaaataaacgtattaagtttaacatattaaattaatttaacatttagactaacattaacatttaaattaatatgttaagtgaatatacttaatatattctagtacaggtatgcttggaaatagggcgtttccttttcatgaattgatttcgtacagcacagtggcttataaggaaccagcagtgtttttccctgagtaattatgaacttagtcaagatcagaagctgggttttggggttgagaagagttcatttatttaaataaagtttctatttaaaaaccttt

SEQ ID NO: 2608 - DNA, 1828 bp, Homo sapiens
gtgtgtgtcgccggctccttgagggtccatgtgatttttacgccagtgctgctgaactgtgcagggtagggagctggcacagtccgattaattgtccttgggtcgaggtgtctcgtcggaccctttggggctcagtggagaattaaggcagagtcactgtaattatttctaataccaattccaaaatagtgactcttggacaatagtgcaattatatggaattatggctggttataagcctgtagctattcagacatatcctatacttggtgaaaaaatcacccaagatacactgtactggaacaactataagcctccatataattatgctgtcacagcttcctcaagaattcacatttatggccgatactcccaagaacctataaaaaccttttctcgatttaaagacacagcatactgtgctacttttcgacaagatggtagattgcttgtggctggcagtgaagatggtggagttcaactttttgatataagtgggagggctcccctcaggcagtttgaaggccatacaaaagcagttcatacagtagattttacagctgacaaatatcacgtggtctctggggctgatgattatacagttaaattatgggatattccaaactccaaagaaattttgacatttaaagaacactctgattatgtgaggtgtggatgtgctagcaaacttaatccggatctctttataacaggatcatatgatcatactgtgaagatgtttgatgcacgaacgagtgagagtgttctctccgttgagcatgggcagccagtggagagtgtcctacttttcccctctggaggtcttctggtgtcagcaggaggtcgttatgttaaagtctgggacatgttaaaaggaggacaattgctagtatctttgaaaaatcatcacaaaaccgtgacatgtttatgtctaagcagctctggacagaggttactctctggctcactggataggaaggtgaaagtatacagcacaacttcctacaaagtagtccacagttttgattatgcagcttcaattttgagtcttgcccttgcacatgaagatgagacaatagttgtaggaatgaccaatggaatactgagtgttaaacatcggaaatctgaagcaaagaaggaatcacttcccagaagaagaaggcctgcatatcgaacctttattaaaggaaaaaattacatgaagcaacgggatgacattttgattaacaggccagcaaagaagcacctagaattgtatgacagggatctgaaacattttcggatctctaaggcactcgatagagttcttgatcccacttgtacaataaagacacccgagattacggtgtccatcataaaggagttaaatcgaagaggagtccttgcaaatgcgcttgcaggtcgggatgagaaggaaatcagtcatgttcttaattttttgataaggaatctttctcagccaagatttgcccctgttttaatcaatgctgctgaaataattattgatatatatctgcctgtaattggtcagtcccctgtagttgataaaaagtttttactacttcaaggacttgtagaaaaagagattgattaccaaagagaattgttagaaaccttggggatgatggatatgctttttgccaccatgagaaggaaggaaggcacttctgtgttggaacacacatctgatggatttccagagaataagaagatagaatcatagtgtctgctaaataagacatataagaactctgaagttggaatagatttgactgtattaaatgttggcgagagactctctttgatacattaaaaaaactgtttgcag

SEQ ID NO: 2609 - DNA, 538 bp, Homo sapiens
gcgcgacgttcggttcgctgtgtgtgtcgccggctccttgagggtccatgtgatttttacgccagtgctgctgaactgtgcagggtagggagctggcacagtccgattaattgtccttgggtcgaggtgtctcgtcggaccctttggggctcagtggaggtaggtgaaggcggctcccattgagggaagcccacactcacacccggccttcctgtgttaatctggcatgctcttctggggcttcccaggctatataggagagtggccaaattctttaaccggctcaagttcccctcaattaagcttcgacctaggttcttctctgcgattacaccctttcctgtccaccgttgttagttcccggagtaatcagcaactctccaaggcaatggacacatttccatctttgcctttgcttacgaggctccctcagaattaaggcagagtcactgtaattatttctaataccaattccaaaatagtgactcttggacaatagtgcaattatatggaattatggctggttataagcctgtag

SEQ ID NO: 2610 - DNA, 2057 bp, Homo sapiens
acgtcatcttcgcgcgacgttcggttcgctgtgtgtgtcgccggctccttgagggtccatgtgatttttacgccagtgctgctgaactgtgcagggtagggagctggcacagtccgattaattgtccttgggtcgaggtgtctcgtcggaccctttggggctcagtggagacccctgttcagattaaggaatttggtgcagtttcaaaagtagacttttctcctcagcctccatataattatgctgtcacagcttcctcaagaattcacatttatggccgatactcccaagaacctataaaaaccttttctcgatttaaagacacagcatactgtgctacttttcgacaagatggtagattgcttgtggctggcagtgaagatggtggagttcaactttttgatataagtgggagggctcccctcaggcagtttgaaggccatacaaaagcagttcatacagtagattttacagctgacaaatatcacgtggtctctggggctgatgattatacagttaaattatgggatattccaaactccaaagaaattttgacatttaaagaacactctgattatgtgaggtgtggatgtgctagcaaacttaatccggatctctttataacaggatcatatgatcatactgtgaagatgtttgatgcacgaacgagtgagagtgttctctccgttgagcatgggcagccagtggagagtgtcctacttttcccctctggaggtcttctggtgtcagcaggaggtcgttatgttaaagtctgggacatgttaaaaggaggacaattgctagtatctttgaaaaatcatcacaaaaccgtgacatgtttatgtctaagcagctctggacagaggttactctctggctcactggataggaaggtgaaagtatacagcacaacttcctacaaagtagtccacagttttgattatgcagcttcaattttgagtcttgcccttgcacatgaagatgagacaatagttgtaggaatgaccaatggaatactgagtgttaaacatcggaaatctgaagcaaagaaggaatcacttcccagaagaagaaggcctgcatatcgaacctttattaaaggaaaaaattacatgaagcaacgggatgacattttgattaacaggccagcaaagaagcacctagaattgtatgacagggatctgaaacattttcggatctctaaggcactcgatagagttcttgatcccacttgtacaataaagacacccgagattacggtgtccatcataaaggagttaaatcgaagaggagtccttgcaaatgcgcttgcaggtcgggatgagaaggaaatcagtcatgttcttaattttttgataaggaatctttctcagccaagatttgcccctgttttaatcaatgctgctgaaataattattgatatatatctgcctgtaattggtcagtcccctgtagttgataaaaagtttttactacttcaaggacttgtagaaaaagagattgattaccaaagagaattgttagaaaccttggggatgatggatatgctttttgccaccatgagaaggaaggaaggcacttctgtgttggaacacacatctgatggatttccagagaataagaagatagaatcatagtgtctgctaaataagacatataagaactctgaagttggaatagatttgactgtattaaatgttggcgagagactctctttgatacattaaaaaaactgtttgcagaagcagttctgtggaagagactggaataattatggccggaaaacaagtacccgttttaagtaagacatggttttccatgtaatattttgaattatagcatcttcacctagaagatctcaattgtcttagtcacagagtaggtttatctgggatggatattaattttaatacaggagtgttctgtatcaacatttgggttggtattcagatgggaattcaaatatgaatcctctctggagagggtccaactgggaatcctgctaaaggagcaaagccttgtattacctctggaagacaacaaaaacaattggcaac

SEQ ID NO: 2611 - DNA, 577 bp, Homo sapiens
ttctttcgccttctggctaaaaaacgttccgcagcaatgcagctgaaactttcgggttttcttttttttgtccctctctccttttttttaatatttttgtttttgccgcctttacgctccgaggcccatcctgccggagtactacacagacagggtcatttcagttgacggttctgggtcaccagagcagaggaagccccaatttcgccctccggtcacacctcctactccagatcgccccgcccacctgacccgcctctgcgccgccgggctgcgtgagtctcatgagcgtgctctgaattaaggcagagtcactgtaattatttctaataccaattccaaaatagtgactcttggacaatagtgcaattatatggaattatggctggttataagcctgtagctattcagacatatcctatacttggtgaaaaaatcacccaagatacactgtactggaacaactataagacccctgttcagattaaggaatttggtgcagtttcaaaagtagacttttctcctcagcctccatataattatgctgtcacagcttcctcaagaattcacatttatg

SEQ ID NO: 2612 - DNA, 2057 bp, Homo sapiens; identical to SEQ ID NO: 2610

SEQ ID NO: 2613 - DNA, 3693 bp, Homo sapiens
gcttcatttccgggtgaaactggcattgagggtactggggcgtgcgtgaggcgtttactgatgcttcctggtccggtggcctcggtcccggtaagccaggcatgaagatcacaaggcagaaacatgccaagaagcatcttggcttcttccgcaacaacttcggagtccgcgagccgtaccagatcctgctggacggcaccttctgtcaggcggcgctgcggggccgcatccagctgcgggagcagctgccccgctacctcatgggggagacgcagctgtgcaccacaagatgtgtgttaaaagagctagaaacattgggaaaggacttatatggggcaaaactgattgcacaaaaatgccaagttcgaaattgtcctcatttcaagaatgcagtgagtggatcagaatgtctgctttccatggttgaagagggaaatcctcatcattattttgtggcaacacaggatcagaatttgtctgtgaaagtaaaaaagaagcctggagttcctctcatgtttattattcagaacactatggttttggacaaaccttctcccaaaacaattgcctttgtaaaagcagtggagtcaggtcagcttgtctcagtgcatgagaaagaaagtatcaaacatctcaaagaggaacagggtttagtgaaaaacactgaacagagtagaagaaaaaagcgcaagaaaataagtggtcccaatcctcttagttgtttgaagaaaaagaaaaaggcaccggacacacaatcatctgcttctgaaaagaaaagaaaaagaaaaagaattcggaacagatctaacccaaaagtactttctgagaagcagaatgcagaaggagaatgaatcctttggatactttcaaggacattcaaatgtgaaaatgaattttttacaactagaagtatttataataaaagaccaaacttatttttgtaaatgaacccatatgctttagctaaaattaattataaaataaaaacagtgaccagtctagccagcatggcaaaaccccatctctactaaaatacaaaaattagctgggcatgatggtgcacagttgtaattccagctactcaggaggctgaggcatgagaatcgcttgaacctgggaggcagagattgcagtgagcccagttcgtgtcacttcactccagcctgggcaacagagtgagaacatgtctcaaaaaaaaaataaaaacagtgaatgggtgtaggtgtgatggaattcactttacttactaaatggtttcgggaggttgtttctccaggtaaaattgtcgcctctctggtcccattcccaccttcaaacattatatgcaaacagttttaaaaaatcttacagttctaaaaggcttgtgacaaaaaaagaggcagtccctctttcacattgacagaagaaacttcctctttcaattctagtagttgaagaatttatatttccaaattgtatgattataccgctactttttgatacatcaattatttattgacttcctactagaaagagtgaaattttgcccatttatactgcaccatttttccagtatatgaatattttactctttgtacatcagaaactcagtattttcattattatgactagagtttttttgtttgtttgtttgagttctacttgtccaataaggatgatgattttcttttagatgtaaatgttaacttcaatagcaagaattcaaaaataatattctctttgagattgactgtgaatgttattgaaaagtgtctaaattagtctgaggatcaatgagggtcaattcagttaggaattgaataatgaaacgtgtctctctgaattcccccggcaattgttttagtcatttatcaggccaaaattaaaatgtttttgtactacaagatggaagtataaaattattggacaagtgaaatcgtatcagtagttcctgactgacagcttctggagccacactagagcagtgattctcagtctaacattaggttatcatgatgacgtatgagtaaattcttaatggttaaatgtgagacagttcacatttattcccatagaaatgtcattctcatttgaattcagagatacttctttgctggaagttggaattatagctttacaccaaggagtgacacgtagactaatctggcaagccaaggtagtgtttggattgcaatgtcatgattctattttaaattcttgatggtagaaacatttttaataaggaaggtaaaaatactggaaaaaagtgaatagtgtaggttttgtgaggaaagttaacatttgtcaatgacaagcattaaggccacctaataaagtgtagacaaagtgataaatgaaatatacactgatgatactcatttcaatatgctaaaatacattaaatttaggtattactcttaatctatttctacttagtcagtgctatctgattacctgttaatagcatctgaactggagagctggaaaaatccacttttttatgaagcagtaattatagaagtactaaaaattacaatgtattagtaagtttaatattttgacagggcatggtggctcacacctgtaatcccagcactttgggaggccgaggctggcagatcacaaaattaagagatcaagaccatcctggccaacatggtgaaaccctgtctgtactaaaaatacaaaaattagctgggtgtggtggtgtgcgcctgtagtcccagctactcgggaggctgaggcaggagaatcgcttgaacccaggaggcggaggttgcagtgagccaagatcatgccactgcactccagcctggtgagagagtgaaaccccgtctcaaaaataaataaataaataagtttactattttaaaactggttaatcatttatgtattttgccagtaaaattactttaaaagatattttaacaaaagtctcatatccttgtacttcagtttttttgtgtgtgaatactatccctataccactacccctaaaacctcagaattatttgctttattttttcatacaacttggggaagggaaccatgggagtatgcacatgggatcataatccattctgtggtttggaaaaagaaaatgttaacctctgctttagagggtagctactagctttgttggggataaaagtgtaatacatgcacttttgaactctgaaagtttgccaatctgaaaaggggtgtttctgaagaccactatcttttacgaacacttaaaaataagtgtttgcagttgtgtatgggcacgatactgtattctttacatttttatggccctacagctacttcttatccctgcaagtatataaattaaaaccaagtcactttagaacagctttgaaactagagtttcaaaggtaaaaggatctcatgtttctgaatctgcgtaaagcaagatggctgtgatttgacaggtttaattgctagttttttataggtggatagaaatgaatagtttggagtctttaaaatgttttaaaaaatgtttgcttactatctatatatatgacattattcccaattagttttatatctccaagatatatatatgtatataggtatatacacatatgtatatatacatagtctatatattctatataagaatatattccaataagaatatattccatacgggaatatattagtcattgatgtattttgccggtaaaattaaaagatattttaacaaaa

SEQ ID NO: 2614 - DNA, 539 bp, Homo sapiens
gcttcatttccgggtgaaactggcattgagggtactggggcgtgcgtgaggcgtttactgatgcttcctggtccggtggcctcggtcccggtaagccaggcatgaagatcacaaggcagaaacatgccaagaagcatcttggcttcttccgcaacaacttcggagtccgcgagccgtaccagatcctgctggacggcaccttctgtcaggcggcgctgcggggccgcatccagctgcgggagcagctgccccgctacctcatgggggagacgcagctgtgcaccacaagatgtgtgttaaaagagctagaaacattgggaaaggacttatatggggcaaaactgattgcacaaaaatgccaagttcgaaattgtcctcatttcaagaatgcagtgagtggatcagaatgtctgctttccatggttgaagagggaaatcctcatcattattttgtggcaacacagtatatcccaagaatgtacacattctgcaccaattatggaggacaacagtatgtgattgatgctctgattggctag

SEQ ID NO: 2615 - DNA, 4334 bp, Homo sapiens
ctgggtctccgaacctgaaaccgggagcttcctgctcgtgttcgctgttgagaagctacccgcggggttgtagacctcggacctcatggcagagataattcaggaacgcatagaagatcggctcccggaattggaacagctggagcgcattggactgttcagtcatgcggagattaaggctatcattaagaaggcttccgatctagagtacaaaatccagagaagaacccttttcaaggaagactttatcaattatgttcaatatgaaattaatcttttggagctgatccagagaagaagaacacgcattggatattcatttaagaaggatgagattgagaattctattgtacaccgggtacaaggtgttttccagcgtgcctcagcaaaatggaaagacgatgttcaactttggctctcctatgtggctttttgtaagaagtgggctactaaaactcgacttagcaaggtattctctgccatgttggcgattcattccaacaaaccagctttgtggattatggcagccaaatgggaaatggaagatcgattgtcttcagaaagcgcaaggcaactatttcttcgcgcactgcgctttcatccagagtgcccaaaactttataaagaatactttaggatggagctgatgcatgctgaaaaactgaggaaggagaaggaagaatttgaaaaagccagtatggatgtggagaatcctgattattctgaagaaatccttaagggcgagttggcatggatcatctacaaaaattctgtaagcataattaaaggtgcagaatttcacgtgtcactgctttcgattgcacagctatttgactttgccaaagatctacaaaaagagatttatgatgaccttcaggctctacacacagatgatcctctcacttgggattatgtggcaaggcgagaattagagattgagtcacagacagaagagcagcctacaacgaaacaagccaaagcagtggaggtcggccggaaggaggagaggtgctgtgctgtgtatgaagaggcagtgaagactctgccaacagaggccatgtggaagtgttacatcaccttttgcttggaaagatttactaagaagtcaaatagtgggttccttagagggaagaggttggaaagaaccatgactgtattcaggaaggcacatgaactgaagcttctgtcagaatgccaatacaagcagttgagtgtttcgttgctgtgttataacttcctgagggaagctctggaagtggcagtagctggaactgaattgtttagagactctgggacaatgtggcagctgaagctgcaggtgctgatcgagtcaaagagccctgacatagccatgctttttgaagaagcctttgtgcacctgaaaccccaggtttgtctgccattgtggatttcctgggcagagtggagtgaaggtgccaaaagccaagaagacactgaggcagtctttaagaaagctctcttagctgtcataggtgccgactcagtaaccctgaagaataagtacctggattgggcttatcgaagtggtggctacaaaaaggccagagctgtgtttaaaagtttacaggagagccgaccattttcagttgactttttcaggaaaatgattcagtttgaaaaggagcaagaatcctgcaatatggcgaacataagagaatattatgagagagctttgagagagtttggatccgcagattctgatctttggatggattatatgaaagaagaattgaaccacccccttggtagacctgagaactgtggacagatctactggcgagcgatgaaaatgttgcagggagagtcagcagaggcatttgtagctaaacatgctatgcatcagactggccatttatgaagatgaagaatacagtcagctttgtgaaatagtattgcaagcaagccccgtgggcaaatttgtattgagtccatctgtaatttgctcagtgatggcagacaagatggctgtctggttttgagacacactttaattttatgttaacttgttaaatctttttaaaaattaaaaaatttttatgattgagactgggtcttgctctgttgccctggctggtcttgaactcctggactcaagtgaccttctcacctcagactcctgagtagctgggattataggtgcatgacactgctcagtttgatgtgctaatctgattccagtaaagagaattgctgatttaatgttgaggcccgatcttccacaggtcctaaatgtttcccaaaatacatggatagcatacgactgggtttttttaaaattatcccaggtcaagcatgagtatctctaatctcgacctaagagccagttaaaatgaaggagaaagtggccaggcatggtgactcaacgcctgtaatcccagcactttgggaaggctgaggcaggcggatcacctgaggtcaggagtttgagactagcctggccaacatggtgaaaccccgtctctactaaaaatacaaaaattagccaggtgtggtggtgggtgcctgtaatcccagctgcttgggaggctgaggcaggagaattgcttgaacctgggagacggaggttgcagtgagccgagatcatgccattgctactccatcctgggtaagaagagcgaaactccttctcaaggaaaaaaaaaaaggagaaagtacagttttgttggtttattctcattataaaagatacgtggtatgcatttgttctggaaaatatggaggaaatagaatagtgtggtaaaaaaaagcatcctgtcactgggagaagctttcagtgtagcttattgttacgtttcacttagtattgtttttctgtgtcattaaatagccttaaaaacatttaatgaattcgtaacattacattgtaaaaatgagccataatatattttactaatcctctggttagactgtctttttttttttgagatggagccttgctctgtcatccaggctggagtgcagtggctccatctcggctcactgcaacctccacctcccgggttcaagtggttctggctcagcctcccgagcagctgggtgggattacaggcacccgccaccgcgcccagccaatttttgtatttttagtagtgcgggggtttcatcatattggccaggctggttgcgaactcctgacctcatgatccacccgccttggcctcccaaagtgttgggattacaggcgtgaaccactaagcctggcctggactgtcatttctaatttttttaaaaattagataaatgctgttgatgaagattcttgtcaatctttgttcacatccctggccatttccttaggagattgacatccgacagtggaattactggatcaaaggatactgcttttagagaatactgatatgtattgctggtttgctccttctttcaagcaatacatgaaagtgtcagtacccttacctgtactggtgtaattatatcttttatttttaccattttataggtgaaatgtgatatgtcattgttttaccatactttgatattagtgaagttagtgtattttatgtttctcatctttttacatccttagactatttaaaaattttttttcttactaatttatgagttaatttttttttttaaattggacaagttcttgctttgtcacctaggctagagtgcagtggtgtgatcatggctcactacagccttaacttctgggctcaagagatcctcccacctcagcctcttgagtagctgggactgcaggtgcacaccaccatgcctggttaatttaaatttttttttgtagagactggtcttgctatgttgccagggctggtctcttaaacagttgggctcaaacaatcctcctacctcaacctcccaaagtgctggtattataggcatgagccattgtgcctggccagagtttttaaaaacatattcagaatattaatatcttgtttctcatttgttgcaaataattttacccccagccttgtttgtggtgattttttttttttgagacagagtcttgctctgtggtccaggctggagtgcagtggtgtggtcttactgcaacctctgcctcctaggttcaaacagttctccctgccaaagcctcccaagtagctgggattataggcaccttttgtggcgatttttgatgcccagaggtattttgtgtgtgtatgtgtgatgtctgtttttaaaatgctttggaagctcttcctggtgctgagaacaactctttttccccaagcagttaattttgccaacactatttgggcagttatgtttctctctgctgatttgtgatgttacctttattatatattaaatttctatgagta

SEQ ID NO: 2616 - DNA, 2098 bp, Homo sapiens
gatgagcaatgagggaataatccccattccgtctggaatcagagggcgggcctgccgcggaggcatctgggaaacggagttcccaggcaggcgaagcccaggggccgtcaggaagtcagcggcgcctgcgcgggcgcctcagattcaggatgcgcgcgcagcgctctccgcccagcggaagttttcgctgggcaactgagaaggtgagtccgggtaactgcggaggatccgagggtcaggctgcagaagcccagaatcccaccccagtccccaagtacagaggtcgctgtcaagatggagtttccaacccagtaaatccaagggccagaccgtgacctcataaagcatgatctccttctgtccagactgtggcaaaagtatccaagcggcattcaaattctgcccctactgtggaaattctttgcctgtagaggagcatgtagggtcccagacctttgtcaatccacatgtgtcatccttccaaggctcaaagagagggctgaactccagttttgaaacctctcctaagaaagtgaaatggtccagcaccgtcacctctccccgattatccctcttctcagatggtgacagttctgagtctgaagatactctgagttcctctgagagatccaaaggctccgggagcagacccccaacccccaaaagcagccctcagaagaccaggaagagccctcaggtgaccaggggtagccctcagaagaccagctgtagccctcagaagaccaggcagagccctcagacgctgaagcggagccgagtgaccacctcacttgaagctttgcccacagggacagtgctgacagacaagagtgggcgacagtggaagctgaagtccttccagaccagggacaaccagggcattctctatgaagctgcacccacctccaccctcacctgtgactcaggaccacagaagcaaaagttctcactcaaactggatgccaaggatgggcgcttgttcaatgagcagaacttcttccagcgggccgccaagcctctgcaagtcaacaagtggaagaagctgtactcgaccccactgctggccatccctacctgcatgggtttcggtgttcaccaggacaaatacaggttcttggtgttacccagcctggggaggagccttcagtcggccctggatgtcagcccaaagcatgtgctgtcagagaggtctgtgctgcaggtggcctgccggctgctggatgccctggagttcctccatgagaatgagtatgttcatggaaatgtgacagctgaaaatatctttgtggatccagaggaccagagtcaggtgactttggcaggctatggcttcgccttccgctattgcccaagtggcaaacacgtggcctacgtggaaggcagcaggagccctcacgagggggaccttgagttcattagcatggacctgcacaagggatgcgggccctcccgccgcagcgacctccagagcctgggctactgcatgctgaagtggctctacgggtttctgccatggacaaattgccttcccaacactgaggacatcatgaagcaaaaacagaagtttgttgataagccggggcccttcgtgggaccctgcggtcactggatcaggccctcagagaccctgcagaagtacctgaaggtggtgatggccctcacgtatgaggagaagccgccctacgccatgctgaggaacaacctagaagctttgctgcaggatctgcgtgtgtctccatatgaccccattggcctcccgatggtgccctaggtggaatccagaactttccatttgcagtgtgcaacagaaaaaaaaaaatgaagtaatgtgactcaaggcctgctgtttaatcacagataagcttctagaacaagccctggaatgtgcattcctgccactggtttcaggatactcatcagtcctgattagcctcccggagggccccagtttccctcccgtgaatgtgaagttccccatcttggtggcctgcccttcagccagtgtcctagcaaagctggatggggttgggccggcccacaggggggacccctcctacccttgacacctctgtgctttggtaataaattgttttaccag

SEQ ID NO: 2617 - DNA, 1948 bp, Homo sapiens
gatgagcaatgagggaataatccccattccgtctggaatcagagggcgggcctgccgcggaggcatctgggaaacggagttcccaggcaggcgaagcccaggggccgtcaggaagtcagcggcgcctgcgcgggcgcctcagattcaggatgcgcgcgcagcgctctccgcccagcggaagttttcgctgggcaactgagaaggtgagtccgggtaactgcggaggatccgagggtcaggctgcagaagcccagaatcccaccccagtccccaagtacagaggtcgctgtcaagatggagtttccaacccagtaaatccaagggccagaccgtgacctcataaagcatgatctccttctgtccagactgtggcaaaagtatccaagcggcattcaaattctgcccctactgtggaaattctttgcctgtagaggagcatgtagggtcccagacctttgtcaatccacatgtgtcatccttccaaggctccgggagcagacccccaacccccaaaagcagccctcagaagaccaggaagagccctcaggtgaccaggggtagccctcagaagaccagctgtagccctcagaagaccaggcagagccctcagacgctgaagcggagccgagtgaccacctcacttgaagctttgcccacagggacagtgctgacagacaagagtgggcgacagtggaagctgaagtccttccagaccagggacaaccagggcattctctatgaagctgcacccacctccaccctcacctgtgactcaggaccacagaagcaaaagttctcactcaaactggatgccaaggatgggcgcttgttcaatgagcagaacttcttccagcgggccgccaagcctctgcaagtcaacaagtggaagaagctgtactcgaccccactgctggccatccctacctgcatgggtttcggtgttcaccaggacaaatacaggttcttggtgttacccagcctggggaggagccttcagtcggccctggatgtcagcccaaagcatgtgctgtcagagaggtctgtgctgcaggtggcctgccggctgctggatgccctggagttcctccatgagaatgagtatgttcatggaaatgtgacagctgaaaatatctttgtggatccagaggaccagagtcaggtgactttggcaggctatggcttcgccttccgctattgcccaagtggcaaacacgtggcctacgtggaaggcagcaggagccctcacgagggggaccttgagttcattagcatggacctgcacaagggatgcgggccctcccgccgcagcgacctccagagcctgggctactgcatgctgaagtggctctacgggtttctgccatggacaaattgccttcccaacactgaggacatcatgaagcaaaaacagaagtttgttgataagccggggcccttcgtgggaccctgcggtcactggatcaggccctcagagaccctgcagaagtacctgaaggtggtgatggccctcacgtatgaggagaagccgccctacgccatgctgaggaacaacctagaagctttgctgcaggatctgcgtgtgtctccatatgaccccattggcctcccgatggtgccctaggtggaatccagaactttccatttgcagtgtgcaacagaaaaaaaaaaatgaagtaatgtgactcaaggcctgctgtttaatcacagataagcttctagaacaagccctggaatgtgcattcctgccactggtttcaggatactcatcagtcctgattagcctcccggagggccccagtttccctcccgtgaatgtgaagttccccatcttggtggcctgcccttcagccagtgtcctagcaaagctggatggggttgggccggcccacaggggggacccctcctacccttgacacctctgtgctttggtaataaattgttttaccag

SEQ ID NO: 2618 - DNA, 1061 bp, Homo sapiens
aagttttcgctgggcaactgagaaggtcgctgtcaagatggagtttccaacccagtaaatccaagggccagaccgtgacctcataaagcatgatctccttctgtccagactgtggcaaaagtatccaagcggcattcaaattctgcccctactgtggaaattctttgcctgtagaggagcatgtagggtcccagacctttgtcaatccacatgtgtcatccttccaaggctcaaagagagggctgaactccagttttgaaacctctcctaagaaagtgaaatggtccagcaccgtcacctctccccgattatccctcttctcagatggtgacagttctgagtctgaagatactctgagttcctctgagagatccaaaggctccgggagcagacccccaacccccaaaagcagccctcagaagaccaggaagagccctcaggtgaccaggggtagccctcagaagaccagctgtagccctcagaagaccaggcagagccctcagacgctgaagcggagccgagtgaccacctcacttgaagctttgcccacagggacagtgctgacagacaagagtgggcgacagtggaagctgaagtccttccagaccagggacaaccagggcattctctatgaagctgcacccacctccaccctcacctgtgactcaggaccacagaagcaaaagttctcactcaaactgtcaacaagtggaagaagctgtactcgaccccactgctggccatccctacctgcatgggtttcggtgttcaccaggacaaatacaggttcttggtgttacccagcctggggaggagccttcagtcggccctggatgtcagcccaaagcatgtgctgtcagagaggtctgtgctgcaggtggcctgccggctgctggatgccctggagttcctccatgagaatgagtatgttcatggaaatgtgacagctgaaaatatctttgtggatccagaggaccagagtcaggtgactttggcaggctatggcttcgccttccgctattgcccaagtggcaaacacgtggcctacgtggaaggcagca

SEQ ID NO: 2619 - DNA, 1736 bp, Homo sapiens
agttttcgctgggcaactgagaaggtcgctgtcaagatggagtttccaacccagtaaatccaagggccagaccgtgacctcataaagcatgatctccttctgtccagactgtggcaaaagtatccaagcggcattcaaattctgcccctactgtggaaattctttgcctgtagaggagcatgtagggtcccagacctttgtcaatccacatgtgtcatccttccaaggctccgggagcagacccccaacccccaaaagcagccctcagaagaccaggaagagccctcaggtgaccaggggtagccctcagaagaccagctgtagccctcagaagaccaggcagagccctcagacgctgaagcggagccgagtgaccacctcacttgaagctttgcccacagggacagtgctgacagacaagagtgggcgacagtggaagctgaagtccttccagaccagggacaaccagggcattctctatgaagctgcacccacctccaccctcacctgtgactcaggaccacagaagcaaaagttctcactcaaactggttcttggtgttacccagcctggggaggagccttcagtcggccctggatgtcagcccaaagcatgtgctgtcagagaggtctgtgctgcaggtggcctgccggctgctggatgccctggagttcctccatgagaatgagtatgttcatggaaatgtgacagctgaaaatatctttgtggatccagaggaccagagtcaggtgactttggcaggctatggcttcgccttccgctattgcccaagtggcaaacacgtggcctacgtggaaggcagcaggagccctcacgagggggaccttgagttcattagcatggacctgcacaagggatgcgggccctcccgccgcagcgacctccagagcctgggctactgcatgctgaagtggctctacgggtttctgccatggacaaattgccttcccaacactgaggacatcatgaagcaaaaacagaagtttgttgataagccggggcccttcgtgggaccctgcggtcactggatcaggccctcagagaccctgcagaagtacctgaaggtggtgatggccctcacgtatgaggagaagccgccctacgccatgctgaggaacaacctagaagctttgctgcaggatctgcgtgtgtctccatatgaccccattggcctcccgatggtgccctaggtggaatccaggtgggaagagcttgtgaggcttaagcctctcaccccttgccctcacccgagccctgccccaggctccaggagacacttcccagaggctgttccacgttcataccagggcccagcttcccagggagacactgggtttttccgcacggtccttgaacttcccagcctcaaggaatggcaagtagcagaaacccggctcaacttggctttaagaaaagtggggattgattggctgttgtagctagaaaattacaagggggagcttcaggcacaacgggattcagggcctcaaaaatagcatcaagacgttgtttgtctctcgccatcttctgtcccttcttgcatccatgcctccctctgtccttccacccggccacctgtagtctctactttcctttggcctggcccccttggcgcccccatacacaaaaggtagctgctccatgccttcgggtctcgttcatagtgcgcactaccccttcctgtggatgacggacactcctcacagccagcagct

SEQ ID NO: 2620 - DNA, 756 bp, Homo sapiens
gttgcgagacgttgagctgcggaagatgagtccaaagccgagagcctcgggacctccggccaaggccaaggaggcaggaaagaggaagtcctcctctcagccgagccccagtgacccgaagaagaagactaccaaggtggccaagaagggaaaagcagttcgtagagggagacgcgggaagaaaggggctgcgacaaagatggcggccgtgacggcacctgaggcggagagcgggccagcggcacccggccccagcgaccagcccagccaggagctccctcagcacgagctgccgccggaggagccagtgagcgaggtggaagaaccactgagtcaggagagccaggtggaggaaccactgagtcaggagagcgaggtggaagaaccactgagtcaggagagccaggtggaggaaccactgagtcaggagagcgaggtggaagaaccactgagtcaggagagccaggtggaggaaccactgagtcaggagagcgaggtggaagaaccactgagtcaggagagccaggtggaggaaccactgagtcaggagagcgagatggaagaaccactgagtcaggagagccaggtggaggaaccactgagtcaggagagcgagatggaagaaccactgagtcaggagagcgagatggaagaactaccgagtgtgtagacggccaagtactcccctatctccgagagcagcgactaagttcaggcccagccgccagacctcagagatctcaccagcggggtgct

SEQ ID NO: 2621 - DNA, 775 bp, Homo sapiens
accaatcacagctcaggggcgtgattgtctcgtcctgggatcgcgagaggtgtatatacagggaggccaggcagcctggagttagtcgaccgttgcgagacgttgagctgcggaagatgagtccaaagccgagagcctcgggacctccggccaaggccaaggaggcaggaaagaggaagtcctcctctcagccgagccccagtgacccgaagaagaagactaccaaggtggccaagaagggaaaagcagttcgtagagggagacgcgggaagaaaggggctgcgacaaagatggcggccgtgacggcacctgaggcggagagcgggccagcggcacccggccccagcgaccagcccagccaggagctccctcagcacgagctgccgccggaggagccagtgagcgaggggacccagcacgaccccctgagtcaggagagcgagctggaggaaccactgagtcaggagagcgaggtggaagaaccactgagtcaggagagccaggtggaggaaccactgagtcaggagagcgaggtggaagaaccactgagtcaggagagccaggtggaggaaccactgagtcaggagagcgagatggaagaaccactgagtcaggagagccaggtggaggaaccactgagtcaggagagcgagatggaagaactaccgagtgtgtagacggccaagtactcccctatctccgagagcagcgactaagttcaggcccagccgccagacctcagagatctcaccagcggggtgcttgccattctgat

SEQ ID NO: 2622 - DNA, 958 bp, Homo sapiens
atgtggatgctgggagaagtatgtgagatggaaaagttgtttcatggcatccaagaagtgaatgatcctcaaggtgtagcagaggaatttgtaggagagagggatgattgacatcttcgtgtagccctccatccatcccagttagcatggagggattttagggctaccattggctgggtagtggagtgttgaccaatcacagctcaggggcgtgattgtctcgtcctgggatcgcgagaggtgtatatacagggaggccaggcagcctggagttagtcgaccgttgcgagacgttgagctgcggaagatgagtccaaagccgagagcctcgggacctccggccaaggccaaggaggcaggaaagaggaagtcctcctctcagccgagccccagtgacccgaagaagaagactaccaaggtggccaagaagggaaaagcagttcgtagagggagacgcgggaagaaaggggctgcgacaaagatggcggccgtgacggcacctgaggcggagagcgggccagcggcacccggccccagcgaccagcccagccaggagctccctcagcacgagctgccgccggaggagccagtgagcgaggggacccagcacgaccccctgagtcaggagagcgagctggaggaaccactgagtcaggagagcgaggtggaagaaccactgagtcaggagagccaggtggaggaaccactgagtcaggagagcgaggtggaagaaccactgagtcaggagagccaggtggaggaaccactgagtcaggagagcgaggtggaagaaccactgagtcaggagagccaggtggaggaaccactgagtcaggagagcgagatggaagaaccactgagtcaggagagccaggtggaggaaccactgagtcaggagagcgagatggaagaaccactgagtcaggagagcgagatggaagaactaccgagtgtgtag

SEQ ID NO: 2623 - DNA, 994 bp, Homo sapiens
atgtggatgctgggagaagtatgtgagatggaaaagttgtttcatggcatccaagaagtgaatgatcctcaaggtgtagcagaggaatttgtaggagagagggatgattgacatcttcgtgtagccctccatccatcccagttagcatggagggattttagggctaccattggctgggtagtggagtgttgaccaatcacagctcaggggcgtgattgtctcgtcctgggatcgcgagaggtgtatatacagggaggccaggcagcctggagttagtcgaccgttgcgagacgttgagctgcggaagatgagtccaaagccgagagcctcgggacctccggccaaggccaaggaggcaggaaagaggaagtcctcctctcagccgagccccagtgacccgaagaagaagactaccaaggtggccaagaagggaaaagcagttcgtagagggagacgcgggaagaaaggggctgcgacaaagatggcggccgtgacggcacctgaggcggagagcgggccagcggcacccggccccagcgaccagcccagccaggagctccctcagcacgagctgccgccggaggagccagtgagcgaggggacccagcacgaccccctgagtcaggagagcgagctggaggaaccactgagtcaggagagcgaggtggaagaaccactgagtcaggagagccaggtggaggaaccactgagtcaggagagcgaggtggaagaaccactgagtcaggagagccaggtggaggaaccactgagtcaggagagcgaggtggaggaaccactgagtcaggagagcgaggtggaagaaccactgagtcaggagagcgagatggaagaactaccgagtgtgtagacggccaagtactcccctatctccgagagcagcgactaagttcaggcccagccgccagacctcagagatctcaccagcggggtgcttgccattctgatgataataaaatgaatgtgttgcaaattg

SEQ ID NO: 2624 - DNA, 2644 bp, Homo sapiens
aaccagggcccgcagccccgcccctcccccagacatcgaggagccggggaggtgtgaacggcctcctttgtgcctctgaatcgaaggcaattaggcgctgcttatctgggcattagccgtgtatgcaaaccgggctcccgccccctcctcctgggcttataaacgccgccgcctggcgaggcccgaggtggatcctgcgcctggccagccccgcctggccttccctccggcccacctggccgccatgcgcctctcctcctccccacctcgtggcccgcagcagctctccagctttggctccgtggactggctctcccagagcagctgctcagggccgacccacacccccaggcctgccgacttctccctggggagcctccctggcccaggccagacatccggcgcccgggagccccctcaggccgtcagcatcaaggaggccgccgggtcctcaaatctgcctgcgccggagaggaccatggccgggttgagtaaggagccaaataccttgcgggccccccgtgtccgcacagccttcaccatggagcaggtccgcaccttggagggcgtcttccagcaccaccagtacctgagccctctggagcggaagaggctggccagggagatgcagctctcagaggtccagataaaaacctggtttcagaatcgccgcatgaaacacaaacggcaaatgcaggacccccagctgcacagccccttctcggggtctctccatgcgcccccagctttctactcaacgtcttctggccttgccaatggcctgcagctgctgtgcccttgggcacccctgtccgggccccaggctctgatgctgccccctggctccttctggggtctctgccaagtggcacaagaggccctggcatctgcgggagcttcctgctgcgggcagcctctggcgtcccacccccctaccccaggccggccttcgctgggaccagccctgtccacggggccccggggcctgtgtgctatgccacagacgggggatgcattttgaggaggcacctctgactcccacactcgcggtcttgctgatcgcacctggctcctacctggaggactcagttgttctgtttacatcctggtggcacctctcaccctgacccacacaaaggttctggagattactggagaatatatataaatatatatatgtacgtatatatgtaaatacacatatacgtatatataaatatatatatacatatgtgtgtgtatatatatatatatttttttttttttttttttttttgagacggagtgttgctctgtcacccaggctggagtgcaatgacgcaatctcggctcactgcaacctccgcctcctgggttcaagcgattctccagcctcagcctcccgagtagctgggattacagacacccgccaccacgcccggctaattttttctatttttagtagaaatggggtttcaccatgttagccaggctggtctcaaactcctgaccctgtgatccgcccgcctcggcctcccaaagtgctgggattacaggcatgagccactgcacccggccctgagaatatatttattaaagccacctcttcactgaaagttaccgaaagagtcggtttaggaaggaaacgaagggtcagtgaacagagtcaaatgcagaagtgggcttgtcatgggtagggctttcggcgtacgataaaaggatcatttgttttttaaaaggggttggaaaaactggttttccagttggaaacagtaaaggttgtaagctttgtgtgtacaaaagaaaacagggaatgcaggtgtgtttatagcgttgtggttcaagtccctcttaacaagaactccaaagctggaaagcaggagggaacaaaggtgaacatgaaggcgaggatgctggggccctgcagtgcgctctaggctgtgcgtgagccgggactgtacccacagcttgctgagggctgctcttcttgggccagggaaagcagggcagccgggacctgcggctgtgcctggactgaagctgtcccgcaggtccccaccctccaacacgtgctcacctgtccccctgctcgcagcagcctcgggacaaaacaatgactcaaggacagcacttcttgcagaaggtctggaagtgcccagaatgggaggcacggaagcccctcccggggaggactcccgcgttgatggaccgttcttggtgcagactcctgactgcgtgcatgaaacctgagacaagtgcaattccttccatgtcgccccagagtgcccaggaggcaggcagtgcggggtgcccaggcagacgggttcagcctgcagaactggaggcgacctgtgaaacccacccgggcaccccaacaggaacagaagcgtggtcctgcggctgcgtccccagcgagtttcactttccccttgctcgtttctcccttgttgtaagtgtttacaactggcatgtgcttttaaacgtcaggtaagaggggaacagctgctgtacatcgtcctggcgagtgacaatgtgacagaagcctgggcgaggccctcggagggcagcagctggacagggactactgggtttggcctggacagcactgatttgtggatgtggatgggggcacgttgtccgtgataaaagtacaagtgcccctcac

SEQ ID NO: 2625 - DNA, 4494 bp, Homo sapiens
accagactggccgcctctcggcgagcgcgccactctcccgtcgccgctgacccgcgcgcggccgccgaagcctccccgcggggacattcattcttgccccttgcctgtcgccgggccgggcgtacgggccgcgttgtcgggggttttgtcccctttttcctcttttttttttccttctccgccccccccccttttttttttttttgctttttttttcctttctgtttttgttgttgttcttgcctatgttcgggaaaccagacaaaatggacgttcgatgccactcggacgccgaggctgcccgggtctcgaagaacgcgcacaaggagagtcgggagagcaagggcgcggaggggaacctcccagccgccttcctcaaggagccgcagggcgccttctcagcgtcgggcgctgctgaggattgtaacaaaagtaaatccaattccgcagcggacccggattactgccgccggatcctggtccgagatgccaaggggtccatccgagagatcatcctgcccaagggcctggacttggaccggcctaagaggacgcgcacgtccttcaccgcggagcagctctatcggctggagatggagttccagcgctgccagtacgtggtgggccgcgagaggaccgagctcgcccggcagcttaacctctccgagacccaggcaaatagtgaagaaaataatgaacgattcaaacgcgggataaaaaaacaaaagaagaaaaggaagaaagagccagcaaatgatgagtctcggcgtggggactccgggggcagagggtggcagcccctatagtgcggggccctgcgactggtaccgtgagcgcctgggatgaggtttgggcggatttcgggtttccggagaggcagagacgcctggctacgacgatttgttccacttccttgagtgtttcgctctcgatttctctatctgtccctctgaggtcggcccctcagaccctcctccttaatttcccactgcgtaattcttagtttatttaggaactcatctctgggcactataaagtctctgcctcctaatgctaggtttctagagtcttccagctgcatcttcatgccggcagcattttggattttgtgcaatcatgggcccagaataggcaaggttttattttcttctgacttagaatataagtctcgccatcgtcaaagagaaactttgaaggagcaggagactgaaatcgatattaattcctgcaaagagacctcctcaccctggtgcttatgcggtggtgacgggtgtagacgttgcaaacaaatcttgggaagcgaggagggccggggaggacacttccggacacgctcttctaaagcgtgtgcagcacggggcgaagtccgcgctgcgggggcagcggccccggctccttcttgtagcgcctgcacacctgggtgttgcagggacccgcagctcccgtgcggcaccggccctagccaggccttactgcccctactcgtgtactgtgcctgaagctgaagttggaggcatccaaaataaggcggggcacagtgtgggcggcggagtccctgagccttgagctccgctttttgctgagatcacagcagccgcccacagacagttcacttttatttctcaaagttgctgcagatccctcagcttggcttctcttggctcttcccctccctgtccgcctctccttactttctcttgcttgaaactgcttttccttttctactcttttcttccgcgctcctgtcccgtaaacgcctgcgcttcctttaaggagttctctctctgtggtgtgggctcccctctcgttccccctgtctccctcctccattacttcttccttccaggtctctctctctcttttggttttctggtttttttctcctgctcaaggggtcccaaaggccaaggcagtgggtggctctcgctgcagcttcaaggctggtggctgggaccctccaggggtgagaaggaagggagaaggtggcataactttttggaacaaaagaaaacacaaaatcctagcttgggattcccaacaaattcagcctcctctcccaggggcctcagcctgggaagtcaccaagcagatccctccttccagcttcctgctctttctcctttttgctttcttacccctgaaagagggaaggacaagtcacctcataacttctgctctcacctcccttccctccctggctttgggaagagctgctgagctctttgcctgccactcagggagtgcaattgttcttaaagagcctcttctgcatagaaaaagaattgcaattttaatttaaaaacatttatagaaaattcatttaattttagtgactatcttcttttccctccttccccaagggcctccagtaagctgccttggtccctggaggcttctggcttccaactggagactcacaggccttggaggaggaggcaggtaccctctatgccaatagctgggcctgcctggggaaaggtggaaggagaaacagctgcaggaggggggagctgaaaggaatctgatgctcaggcctgcacaaagcaaccgccaaattgtttcagagcagaaaagaaaaagggagaaaacctcttagcaaagccctgtgagtttgggggtcaggttcaagaaagatgtgggaagtcacttggagagctaaacgggacacatgctcctatccacacttgcagttggtctaaccttcagccagaatgtattcataagtagcatttggcaaccctttatagtttacaaatagcattttacatacaccattctactattcctcatggtggctttgggaggtccagctccgttttaaagactcacacaggactgaagcaaataacttgctcaaagccacatagctgctcagaacccaagattgtaagctccccctagggccagaggcctctttctttcagtttttttctttcgtccccctttgacccctctttccttcttccctttctcccctccttcctcctttccttctttttgtgcccacagtgtctggatcatggtacctgaattctttagcctatttgcacccacatctgctaatgtccatatctagccatctattacaccagctgctgaggatttacttggtgccctcatcaagaagtttgaatttctccctccttcctttttttttcctgccactgtcccaactctttccctctacgtctctctagaatgacatctttaaaccccttacactctttggtcttacacatccttaaaaatgattatttataaattgaattataatatccatgaggtaaacactcatagggtaaagtacacaaagcttaactatacaagttgatgatttacacacacacacacacacacacacacacaccccttcttgaatggctccaaggatacccttttaacttcttcccttcagccacataagccatatgatgacacacagtgtctttctcctgtttgaaaagaaattgtgtcatattggtgtgctgttcttgcatagaaagccttttttaagaagtctttttaagatttcttgaaggattttagaaatcatatatctcttctaaccccctgaaatcctgagtttaagtggcttgattaaatggctgatcaaaacttaaaaacacactaggtcaatgtttttcaagatacaactgaggaccagctgcttcagaatcatctggggactggctaaaattccaggttcctaagccctagtcccatctgatgaatcagaaactaggttggggcttaggaacgtgcattttaaacacttttccaaagtgattcttatccagactaatatttgagaagtactgtattaaatggcaaactcccaaaacactgcagcctcctgcatctggcccagggcctggcatttggtaggaatacaatgaatgtttgttaaacaaattaatccacagtttctgacacagtttagaatttcttggaccacattatgctattgtaatttaacaccatttctacgtcgggaaatctttacatttcagtctttttcattttcatggaggtttcattttaatggagcaggagagaaaagagagatctactttggtggtttctcaggtctcagggaaggtcttttataaactcaatggggaccaccttcctggagaggctgctcccttacagacctggtagtttggggaaaggaggaggagagcccttcaggtttgctgaaaagcattcagatgcacacccttcttggttggaactgaaagcttctgtttgaagagacatgagttctggaaggagcaaggccaccaggtccagagaacctggcatgcaatggacatggaagctgaaaattacttgggtattctctgatttctagctaatatgaaaataattttctttctagaaacacatttgcctatcttcttaccctgaaacagaaaataaatattgtgctttatgtggtagtgttgtacccattcttaaaaataaatcacatcatatatatgtgtaaaatat

SEQ ID NO: 2626 - DNA, 1250 bp, Homo sapiens
accagactggccgcctctcggcgagcgcgccactctcccgtcgccgctgacccgcgcgcggccgccgaagcctccccgcggggacattcattcttgccccttgcctgtcgccgggccgggcgtacgggccgcgttgtcgggggttttgtcccctttttcctcttttttttttccttctccgccccccccccttttttttttttttgctttttttttcctttctgtttttgttgttgttcttgcctatgttcgggaaaccagacaaaatggacgttcgatgccactcggacgccgaggctgcccgggtctcgaagaacgcgcacaaggagagtcgggagagcaagggcgcggaggggaacctcccagccgccttcctcaaggagccgcagggcgccttctcagcgtcgggcgctgctgaggattgtaacaaaagtaaatccaattccgcagcggacccggattactgccgccggatcctggtccgagatgccaaggggtccatccgagagatcatcctgcccaagggcctggacttggaccggcctaagaggacgcgcacgtccttcaccgcggagcagctctatcggctggagatggagttccagcgctgccagtacgtggtgggccgcgagaggaccgagctcgcccggcagcttaacctctccgagacccaggtgaaggtctggttccagaaccggcgcaccaagcagaagaaggaccagggcaaggactcggagctacgctcggtggtgtcggagaccgcggccacgtgcagcgtgctacggctgctggagcagggccgcctgttgtcgccgcccggcctgcctgcgctgctgccgccttgcgccacgggcgctctcggctcagcgctgcgcgggcccagcttgccggccctgggcgcgggcgccgctgcaggctcggccgccgcagccgccgccgccgccccgggcccagcgggcgctgcatccccgcacccgccggctgtgggcggtgctccaggtcccgggcccgccgggccggggggattgcacgcaggcgccccggccgcgggccacagcctcttcagcctgccggtgccctcgctgctcggctccgtcgccagccgcctgtcctccgccccgttaacaatggctggttcgctagctgggaatttgcaagaactctccgcccgatatctgagctcctcggccttcgagccttactcccggaccaacaataaagaaggggccgagaaaaaagcgctggactga

SEQ ID NO: 2627 - DNA, 1023 bp, Homo sapiens
gtgagaaggaaactgcaagagtggggcagagaaccagagtgtcagagcaaaacctcctctatctgcacatcctggggacgaaccgggcagccggagagctgcggccggcccagtcccgctccgcctttgaagggtaaaacccaaggcggggccttggttctggcagaagggacgctatgaccgcagaattcctctccctgctttgcctcgggctgtgtctgggctacgaagatgagaaaaagaatgagaaaccgcccaagccctccctccacgcctggcccagctcggtggttgaagccgagagcaatgtgaccctgaagtgtcaggctcattcccagaatgtgacatttgtgctgcgcaaggtgaacgactctgggtacaagcaggaacagagctcggcagaaaacgaagctgaattccccttcacggacctgaagcctaaggatgctgggaggtacttttgtgcctacaagacaacagcctcccatgagtggtcagaaagcagtgaacacttgcagctggtggtcacagataaacacgatgaacttgaagctccctcaatgaaaacagacaccagaaccatctttgtcgccatcttcagctgcatctccatccttctcctcttcctctcagtcttcatcatctacagatgcagccagcacagttcatcatctgaggaatccaccaagagaaccagccattccaaacttccggagcaggaggctgccgaggcagatttatccaatatggaaagggtatctctctcgacggcagacccccaaggagtgacctatgctgagctaagcaccagcgccctgtctgaggcagcttcagacaccacccaggagcccccaggatctcatgaatatgcggcactgaaagtgtagcaagaagacagccctggccactaaaggaggggggatcgtgctggccaaggttatcggaaatctggagatgcagatactgtgtttccttgctcttcgtccatatcaataaaattaagtttctcgtcttaaaaagaaa

SEQ ID NO: 2628 - DNA, 524 bp, Homo sapiens
gaagggacgctatgaccgcagaattcctctccctgctttgcctcgggctgtgtctgggctacgaagatgagaaaaagaatgggtcccactcggttgcccaggctggagtgcagtggtgcaatcacagctcactgcagccttgacctcccaggcccagataaacacgatgaacttgaagctccctcaatgaaaacagacaccagaaccatctttgtcgccatcttcagctgcatctccatccttctcctcttcctctcagtcttcatcatctacagatgcagccagcacagttcatcatctgaggaatccaccaagagaaccagccattccaaacttccggagcaggaggctgccgaggcagatttatccaatatggaaagggtatctctctcgacggcagacccccaaggagtgacctatgctgagctaagcaccagcgccctgtctgaggcagcttcagacaccacccaggagcccccaggatctcatgaatatgcggcactgaaagtgtagcaagaagacag

SEQ ID NO: 2629 - DNA, 922 bp, Homo sapiens
gtgagaaggaaactgcaagagtggggcagagaaccagagtgtcagagcaaaacctcctctatctgcacatcctggggacgaaccgggcagccggagagctgcggccggcccagtcccgctccgcctttgaagggtaaaacccaaggcggggccttggttctggcagaagggacgctatgaccgcagaattcctctccctgctttgcctcgggctgtgtctgggctacgaagatgagaaaaagaatgagaaaccgcccaagccctccctccacgcctggcccagctcggtggttgaagccgagagcaatgtgaccctgaagtgtcaggctcattcccagaatgtgacatttgtgctgcgcaaggtgaacgactctgggtacaagcaggaacagagctcggcagaaaacgaagctgaattccccttcacggacctgaagcctaaggatgctgggaggtacttttgtgcctacaagacaacagcctcccatgagtggtcagaaagcagtgaacacttgcagctggtggtcacagataaacacgatgaacttgaagctccctcaatgaaaacaggttcatcatctgaggaatccaccaagagaaccagccattccaaacttccggagcaggaggctgccgaggcagatttatccaatatggaaagggtatctctctcgacggcagacccccaaggagtgacctatgctgagctaagcaccagcgccctgtctgaggcagcttcagacaccacccaggagcccccaggatctcatgaatatgcggcactgaaagtgtagcaagaagacagccctggccactaaaggaggggggatcgtgctggccaaggttatcggaaatctggagatgcagatactgtgtttccttgctcttcgtccatatcaataaaattaagtttctcgtctta

SEQ ID NO: 2630 - DNA, 822 bp, Homo sapiens
gaagggacgctatgaccgcagaattcctctccctgctttgcctcgggctgtgtctgggctacgaagatgagaaaaagaatgagaaaccgcccaagccctccctccacgcctggcccagctcggtggttgaagccgagagcaatgtgaccctgaagtgtcaggctcattcccagaatgtgacatttgtgctgcgcaaggtgaacgactctgggtacaagcaggaacagagctcggcagaaaacgaagctgaattccccttcacggacctgaagcctaaggatgctgggaggtacttttgtgcctacaagacaacagcctcccatgagtggtcagaaagcagtgaacacttgcagctggtggtcacagataaacacgatgaacttgaagctccctcaatgaaaacagtggctcacgtctgtaataccaggactttgggaagatgaggcaggaggatcacttgagcccaggggttcaagaccagcctggacaacttgacaccagaaccatctttgtcgccatcttcagctgcatctccatccttctcctcttcctctcagtcttcatcatctacagatgcagccagcacagttcatcatctgaggaatccaccaagagaaccagccattccaaacttccggagcaggaggctgccgaggcagatttatccaatatggaaagggtatctctctcgacggcagacccccaaggagtgacctatgctgagctaagcaccagcgccctgtctgaggcagcttcagacaccacccaggagcccccaggatctcatgaatatgcggcactgaaagtgtagcaagaagacag

SEQ ID NO: 2631 - DNA, 2282 bp, Homo sapiens
atcggccaccgtcgaccgtttcctctctcatccgttcttttctttgtatttccgcctctcgcctctctctaaaagccgcagttagaggcgagatttaggaaaaacctctgccgagtgagcctctggttgggaatatgtatgagaaaaaaaaactggcaaggcgttagtcaagcaaagctgaaggcagaggaaatttgatatctggctggagtctagaggatttaatgcaaataagatactctgagggcagcgtggcaaaaaaagactacaattcccggtggtcacagcgtttgagaagcgatgctttctgagacttgtagtaactaggagctgtgtttgaactatccaggctcaggacagcctcttgaaaaaaaattttttattaataaagcggatttgagtgggatctttttcctaatcgattacgggcccacacgtatgggaagaattctaacaatgattaaagggacatgctacctttacgactatccttttctaatcgatgactcctaaatctaggagtaggtagtcgatgtttgtggtctgggcgtctgtagaagggcaacctcgtgctttctgcagaggagaccggagggcagaaggcagagtccaggcttagactgcagttcctcgcttacctgtgcagtctaattttgagctgcctctttgtagtcttaaaaggcaggagcttcgtgttgtgggtctgctaacccgtacgtttccgtgggcaagtcgtgtgtactcctcgccatggctcagctccaaacacgcttctacactgataacaagaaatatgccgtagatgatgttcccttctcaatccctgctgcctctgaaattgccgaccttagtaacatcatcaataaactactaaaggacaaaaatgagttccacaaacatgtggagtttgatttccttattaagggccagtttctgcgaatgcccttggacaaacacatggaaatggagaacatctcatcagaagaagttgtggaaatagaatacgtggagaagtatactgcaccccagccagagcaatgcatgttccatgatgactggatcagttcaattaaaggggcagaggaatggatcttgactggttcttatgataagacttctcggatctggtccttggaaggaaagtcaataatgacaattgtgggacatacggatgttgtaaaagatgtggcctgggtgaaaaaagatagtttgtcctgcttattattgagtgcttctatggatcagactattctcttatgggagtggaatgtagagagaaacaaagtgaaagccctacactgctgtagaggtcatgctggaagtgtagattctatagctgttgatggctcaggaactaaattttgcagtggctcctgggataagatgctaaagatctggtctacagtccctacagatgaagaagatgaaatggaggagtccacaaatcgaccaagaaagaaacagaagacagaacagttgggactaacaaggactcccatagtgaccctctctggccacatggaggcagtttcctcagttctgtggtcagatgctgaagaaatctgcagtgcatcttgggaccatacaattagagtgtgggatgttgagtctggcagtcttaagtcaactttgacaggaaataaagtgtttaattgtatttcctattctccactttgtaaacgtttagcatctggaagcacagataggcatatcagactgtgggatccccgaactaaagatggttctttggtgtcgctgtccctaacgtcacatactggttgggtgacatcagtaaaatggtctcctacccatgaacagcagctgatttcaggatctttagataacattgttaagctgtgggatacaagaagttgtaaggctcctctctatgatctggctgctcatgaagacaaagttctgagtgtagactggacagacacagggctacttctgagtggaggagcagacaataaattgtattcctacagatattcacctaccacttcccatgttggggcatgaaagtgaacaataatttgactatagagattatttctgtaaatgaaattggtagagaaccatgaaattacatagatgcagatgcagaaagcagccttttgaagtttatataatgttttcacccttcataacagctaacgtatcactttttcttattttgtatttataataagataggttgtgtttataaaatacaaactgtggcatacattctctatacaaacttgaaattaaactgagttttacatttctctttaaaggta

SEQ ID NO: 2632 - DNA, 3533 bp, Homo sapiens
gcgccggtgcgcctgcgcacggacgaacacgtggctgcagcggggccagagcagcaatggcggcgggcggcggcggtagctgcgaccccctggcccctgctggggtcccttgcgccttctccccgcacagccaggcctacttcgctttggcctctaccgacggtcacttacgagtatgggagacggccaacaaccggctgcaccaggagtacgtgccttccgcgcacctcagtggtacctgcacctgtctggcctgggcgccagcgcggctgcaggccaaggaaagtccccagaggaaaaaaaggaaatcagaagctgtaggaatgagtaaccagactgacttattggctcttggcacagcagttggtagcattttattatacagcacagtaaaaggagagttacacagtaaattaataagtggtggacatgacaacagagtcaactgcatacagtggcatcaagacagtggctgtttatatagttgttcagatgataaacatattgtggaatggaacgtacagacatgcaaagtaaagtgcaaatggaaaggcgacaatagcagtgtcagttccctatgtatcagcccagatggaaagatgttgctttcagctggtcgaacaatcaaactatgggttttggagaccaaagaagtctacaggcatttcacaggacatgcaacgccagtttcgtcactgatgttcactaccatcagacctcctaatgagagccagccctttgatggaattacaggtctttatttcttatctggagcagtacatgaccggttacttaatgtctggcaggtccgatcagaaaacaaagaaaagagtgcagtgatgtcatttacagttaccgatgaacctgtctatattgacttaactttgtcagaaaacaaagaagagcctgtcaagttggctgttgtttgcagagatggtcaagtccatctttttgaacacatattaaatgggtactgcaaaaagcctttgacttcaaactgcacaattcagatagcaacacctgggaaaggcaagaagtcaacaccaaaacccatccctattctagctgctggtttttgctcagacaaaatgtcattgttgcttgtatatggcagttggtttcagcctactattgagcgagtggctttaaactccagagaacctcatatgtgtttagtaagagatatttcaaactgctgggcccccaaagtagaaacagctataacaaaggtgaggacaccagtgatgaattctgaagcaaaagttctggtgcctgggattcctggtcatcatgcagctatcaagcccgctcctccacaaaccgagcaagtagagagcaagaggaagtcagggggaaatgaggttagcattgaagaacgtctgggagcaatggatatagacacacacaaaaaaggaaaggaagacctccagacgaatagctttccagttcttcttacccagggcttagaaagtaacgattttgaaatgctaaataaagtacttcaaactaggaatgtaaaccttataaagaagactgtattaaggatgcccctgcatactattattccgttgttacaagagcttacaaagaggttacaaggacatcctaatagtgctgtgctaatggttcagtggctaaaatgtgtgttaacagttcatgcatcatacctgtccacgttgcctgacctggtaccccagctggggacactctaccagttaatggaaagcagagtcaaaacttttcagaaactttcacaccttcatggaaagcttattcttctaattacacaagtaacagcatcagagaagacaaagggagcaacttcccctggacagaaggcaaagttggtgtatgaagaagagtcttctgaagaggagtctgatgatgaaatagcagataaggattctgaagataattgggatgaagatgaggaggagagtgaaagtgaaaaagatgaggacgttgaagaggaagatgaggatgccgaaggaaaagatgaagaaaatggcgaggacagagatacagcaagtgaaaaagaattaaatggagattctgatttagatcctgaaaatgaaagtgaagaagaatgaagacagcaaagcaagccggtcaaactatataaactctggctcaccttgcccagtggtgagggctgcctctgtgccaggatgccaaggaccgctgcacatttccaaattcacagcagtggatcccatgccactttgctgtcctgagcaccccagacttgactgtgtaaataagagtgtttcattcaaatgttaataaactttacacagtatatagacacattttctgcaatgtactgacatcagtgtccaatatatggtatatttttataatataatatcctagtatgattggttatatcaagaattgacaagtgcagataaagacctttcccataggagttcaagaactggactgttgtgaagaagtcagctcttatctcaggttggtatctttcatcaaatccagatgcaaagcagcactagtgaaaatttttttaatttagtacatttaatttggtacattttcataaaatatgaagggataactacaaactggagtaaaaatgatggtaattaaaaaaaatcctcagtatccctagcttgtctattaactgtgataatctgacttgagtcagattgaatatttggagtgcttccccagaataaccacttatttttgaagctatcatgtgaagtatttttttaaaacaaaacaaaaattatggtcattaaaaaactagagaattagccatattaaggatttttcttgactgcaaattacttctaaagaatcatcagtgtatagattagaagtgctcattacctgcaacttttaaaaaaaattcagttatagctgcttttgaagaggtttccatttttatttaaattactaatggatcaaagaacaattgtttattttttctctttggttttagatattaatgataaccttgttggaattttttttccaaagaaaatatttttataattaaataatttaatgtttttcttccttttcattacctactcttggcagtgttagggtatctgtttacctttaaaatgataagtctcactcaagattttttatgtatgtataaatattttggtgtgctacaaaagcctttgcaaattatcagtagtagtttttttttttttttttttttttttaaagaatgagccgatattggcttagtgctcactaggggacatgcacatggaagctcacctctaagaaagggctgggcagatggatttattttttcccacctgtgaatatgtaaaacaaaaccattatctttgagggagtttttaataccaatgacagaacagagatttgtgtgctcatcttaagagccagagccatataagcatcttgggaaagcaagtttgaaccagctgctggtgtaatgtacagttatatttgtctataaatggagctgtttatggcaatttaataccattctctttgtaaagtgaataaatattcatctttacccagtg

SEQ ID NO: 2633 - DNA, 3151 bp, Homo sapiens
gccgcctggcgcccgcccgagctgccgccttgtcgagctgagtccgcgctcccgcccaggcggcggccgacgcgacgccccgagcgcccggccccgccgccgcggcccggcagactgcctctgtcaccgggtccctccacccttgtctcctgtgcggccagcgtcagagccatggcgacggaggagaagaagcccgagaccgaggccgccagagcacagccaaccccttcgtcatccgccactcagagcaagcctacacctgtgaagccaaactatgctctaaagttcacccttgctggccacaccaaagcagtgtcctccgtgaaattcagcccgaatggagagtggctggcaagttcatctgctgataaacttattaaaatttggggcgcgtatgatgggaaatttgagaaaaccatatctggtcacaagctgggaatatccgatgtagcctggtcgtcagattctaaccttcttgtttctgcctcagatgacaaaaccttgaagatatgggacgtgagctcgggcaagtgtctgaaaaccctgaagggacacagtaattatgtcttttgctgcaacttcaatccccagtccaaccttattgtctcaggatcctttgacgaaagcgtgaggatatgggatgtgaaaacagggaagtgcctcaagactttgccagctcactcggatccagtctcggccgttcattttaatcgtgatggatccttgatagtttcaagtagctatgatggtctctgtcgcatctgggacaccgcctcaggccagtgcctgaagacgctcatcgatgacgacaacccccccgtgtcttttgtgaagttctccccgaacggcaaatacatcctggccgccacgctggacaacactctgaagctctgggactacagcaaggggaagtgcctgaagacgtacactggccacaagaatgagaaatactgcatatttgccaatttctctgttactggtgggaagtggattgtgtctggctcagaggataaccttgtttacatctggaaccttcagacgaaagagattgtacagaaactacaaggccacacagatgtcgtgatctcaacagcttgtcacccaacagaaaacatcatcgcctctgctgcgctagaaaatgacaaaacaattaaactgtggaagagtgactgctaagtccctttgctcctgcccgcgagagactgtcgggaagttgacccggattggcaagaaacagggtgtcttggaggtggtcccccagatctgcgcctgggggtcaggacagggcctgatttgagcctcctctctgaagatgatttggccgagcggaaggtgtggaccaccggaaagttcttaaaagttgctggtgacatttcttgccaattctaacactgtctagggaagagttcctagtctattgtgttcaaacagagtcaacaaaagtttttaattttttattacagaagggtgaagttcaatttaacatgcgttgtgttttttcagtaaacgttctgtatctttttgatattccatgacccagtgcacgctgtggcctgtcaccgccaccgtggccccgccagctggcctcccctttggcccacgccggccgcccccattctctgctgcgtagatgccctggcccagggccctgactcctccattcccgccagtagctgttcctagtgtattttcgtctttctggaaaacagcattgagtggttgttttctgtgtaaagagccgtttgtgtcttgggagtttgtggcccacatgccgatagcacggtcatcgcacatgactctcccgtttgtctcagtgtccctgcaacaagcagcaccgcagactgtaataaaaggtggggttttgtgaatggttgtggcaagtgcgtccttgtgaagctcgtctccatgtggctttcttggagaaaggctcccctggggcaagagggtggaaggtttctttggacaggaggtgctgaggctggctgcacctgctctctgaagacgccttcctctctaggttcattgttcagtgttgctgggggcggggaacgggggtggggaggttcttagttgcgaaggagccaagctcctgatggacttgcgttgggatgtgggggacacctgtggcatggtaaggctccctgagtcccttactccaggtcagatgccagtgggactcatgcgccctatgagggctgcagggccagtgctgcccctcggactcctcgaggggttgggtgctaagcgcgagcctcgccgtccctgctggagccctcgcctgcctgcccctctgcctgtgctcctggcagtgtggcttcccggtgctcacctgcacagcagttaacagcagaggccgagcgggagcctctggggagcgaggctgaaacctgaacctgcccatggagacagttgtggtgagggttgccacacacagtgagggcggagcagggtggctgagggcacaggtgcctgggtctgtcccacggggcagggctttggggctgtgatgctctgggaagccagcttgggtcctgggtctacagagggccctggccccggagcccagccagctctgcctctctcagggcctggagtcctgggggagctcagccagctctgcctttctcagggcctggagtcctggatgaatcctgcaggtttttggttgcaccggcccagggaggaagcggggggtttgtcaggtgggctctcctggaggtcctcgagtggcaggggtgaggaggggattatctgaggcatctggagatgtatatcctgtggtttcccctgcccctctgtttccgatgaggtgtacggatgagtgacctgcactaagaagtgagttgccacagtgaaaatgggttggtttttgtcttcgacgctcagggtctgggcgcctcgcatttgcagtctgttgtgacagacacggggagctccgcgtgccagcctgtggctgccctgctgtgggggtcctggggccggcgaggccccttcagtcttgttctggggggacggcccactccggggagggggtgtgctgtgctgagcgctgtatccctgaatatagtttattttttctacatttgaattctgttgtagatttatgtaaaaatacattctttttgaaaataaaaattttcatgtcttctaa

SEQ ID NO: 2634 - DNA, 3069 bp, Homo sapiens
gctccctgttctgcatctcgctcaacagactgcctctgtcaccgggtccctccacccttgtctcctgtgcggccagcgtcagagccatggcgacggaggagaagaagcccgagaccgaggccgccagagcacagccaaccccttcgtcatccgccactcagagcaagcctacacctgtgaagccaaactatgctctaaagttcacccttgctggccacaccaaagcagtgtcctccgtgaaattcagcccgaatggagagtggctggcaagttcatctgctgataaacttattaaaatttggggcgcgtatgatgggaaatttgagaaaaccatatctggtcacaagctgggaatatccgatgtagcctggtcgtcagattctaaccttcttgtttctgcctcagatgacaaaaccttgaagatatgggacgtgagctcgggcaagtgtctgaaaaccctgaagggacacagtaattatgtcttttgctgcaacttcaatccccagtccaaccttattgtctcaggatcctttgacgaaagcgtgaggatatgggatgtgaaaacagggaagtgcctcaagactttgccagctcactcggatccagtctcggccgttcattttaatcgtgatggatccttgatagtttcaagtagctatgatggtctctgtcgcatctgggacaccgcctcaggccagtgcctgaagacgctcatcgatgacgacaacccccccgtgtcttttgtgaagttctccccgaacggcaaatacatcctggccgccacgctggacaacactctgaagctctgggactacagcaaggggaagtgcctgaagacgtacactggccacaagaatgagaaatactgcatatttgccaatttctctgttactggtgggaagtggattgtgtctggctcagaggataaccttgtttacatctggaaccttcagacgaaagagattgtacagaaactacaaggccacacagatgtcgtgatctcaacagcttgtcacccaacagaaaacatcatcgcctctgctgcgctagaaaatgacaaaacaattaaactgtggaagagtgactgctaagtccctttgctcctgcccgcgagagactgtcgggaagttgacccggattggcaagaaacagggtgtcttggaggtggtcccccagatctgcgcctgggggtcaggacagggcctgatttgagcctcctctctgaagatgatttggccgagcggaaggtgtggaccaccggaaagttcttaaaagttgctggtgacatttcttgccaattctaacactgtctagggaagagttcctagtctattgtgttcaaacagagtcaacaaaagtttttaattttttattacagaagggtgaagttcaatttaacatgcgttgtgttttttcagtaaacgttctgtatctttttgatattccatgacccagtgcacgctgtggcctgtcaccgccaccgtggccccgccagctggcctcccctttggcccacgccggccgcccccattctctgctgcgtagatgccctggcccagggccctgactcctccattcccgccagtagctgttcctagtgtattttcgtctttctggaaaacagcattgagtggttgttttctgtgtaaagagccgtttgtgtcttgggagtttgtggcccacatgccgatagcacggtcatcgcacatgactctcccgtttgtctcagtgtccctgcaacaagcagcaccgcagactgtaataaaaggtggggttttgtgaatggttgtggcaagtgcgtccttgtgaagctcgtctccatgtggctttcttggagaaaggctcccctggggcaagagggtggaaggtttctttggacaggaggtgctgaggctggctgcacctgctctctgaagacgccttcctctctaggttcattgttcagtgttgctgggggcggggaacgggggtggggaggttcttagttgcgaaggagccaagctcctgatggacttgcgttgggatgtgggggacacctgtggcatggtaaggctccctgagtcccttactccaggtcagatgccagtgggactcatgcgccctatgagggctgcagggccagtgctgcccctcggactcctcgaggggttgggtgctaagcgcgagcctcgccgtccctgctggagccctcgcctgcctgcccctctgcctgtgctcctggcagtgtggcttcccggtgctcacctgcacagcagttaacagcagaggccgagcgggagcctctggggagcgaggctgaaacctgaacctgcccatggagacagttgtggtgagggttgccacacacagtgagggcggagcagggtggctgagggcacaggtgcctgggtctgtcccacggggcagggctttggggctgtgatgctctgggaagccagcttgggtcctgggtctacagagggccctggccccggagcccagccagctctgcctctctcagggcctggagtcctgggggagctcagccagctctgcctttctcagggcctggagtcctggatgaatcctgcaggtttttggttgcaccggcccagggaggaagcggggggtttgtcaggtgggctctcctggaggtcctcgagtggcaggggtgaggaggggattatctgaggcatctggagatgtatatcctgtggtttcccctgcccctctgtttccgatgaggtgtacggatgagtgacctgcactaagaagtgagttgccacagtgaaaatgggttggtttttgtcttcgacgctcagggtctgggcgcctcgcatttgcagtctgttgtgacagacacggggagctccgcgtgccagcctgtggctgccctgctgtgggggtcctggggccggcgaggccccttcagtcttgttctggggggacggcccactccggggagggggtgtgctgtgctgagcgctgtatccctgaatatagtttattttttctacatttgaattctgttgtagatttatgtaaaaatacattctttttgaaaataaaaattttcatgtcttctaattt

SEQ ID NO: 2635 - DNA, 1289 bp, Homo sapiens
agcaactacactgcgctgcatcggactcgacgcccgctggtgacgcacacgctgcgccggaagtgtgaactgtctgcctccaggctttgtcatggcggctgctgctgcacgctggaaccatgtgtgggtcggcaccgagactgggatcttgaaaggggtaaatcttcagcgaaaacaggcggcgaacttcacggccggaggacagccgcggcgcgaggaggcagtgagcgccctgtgttggggcaccggcggcgagacccagatgctggtgggctgcgcggacaggacggtgaagcacttcagcaccgaggatggcatattccagggtcagagacactgcccgggcggggagggcatgttccgtggcctcgcccaggccgacggcaccctcatcacatgtgtggattctgggattctcagagtctggcatgacaaggacaaggacacatcctctgacccactcctggaactgagagtgggccctggggtgtgtaggatgcgccaagacccagcacacccccatgtggttgccacaggtgggaaagagaatgctttgaagatatgggacctgcagggctctgaggaacctgtgttcagggccaagaacgtgcggaatgactggctggacttgcgggttcccatctgggaccaggacatacagtttctcccaggatcacagaagcttgtcacctgcacagggtaccaccaggtccgtgtttatgatccagcatccccccagcgccggccagtcctagagaccacctatggagagtacccactaacagccatgaccctcactccgggaggcaactcagtgattgtgggaaacactcatgggcagctggcagaaattgaccttcggcaagggcgtctactgggctgtctgaaggggctggcaggcagtgtgcgtgggttgcagtgccacccttcaaagcctctactagcctcctgtggcttggacagagtcttgaggatacacaggatccagaatccacggggtctggagcataaggtttatctcaagtctcaattgaactgcctcctcttgtcaggcagggacaactgggaggatgagccccaagagcctcaagaacccaacaaggtgcccctagaagacacagagacagatgaactttgggcatccttggaggcagctgccaagcggaagctctcgggtttggagcagccccaaggagctctccaaacgagacggagaaagaagaagcggcctgggtccaccagcccctgacgcccctgtgcccactttgtaaataaactgctgaacaccc

SEQ ID NO: 2636 - DNA, 1153 bp, Homo sapiens
caggctttgtcatggcggctgctgctgcacgctggaaccatgtgtgggtcggcaccgagactgggatcttgaaaggggtaaatcttcagcgaaaacaggcggcgaacttcacggccggaggacagccgcggcgcgaggaggcagtgagcgccctgtgttggggcaccggcggcgagacccagatgctggtgggctgcgcggacaggacggtgaagcacttcagcaccgaggatggcatattccagggtcagagacactgcccgggcggggagggcatgttccgtggcctcgcccaggccgacggcaccctcatcacatgtgtggattctgggattctcagagtctggcatgacaaggacaaggacacatcctctgacccactcctggaactgagagtgggccctggggtgtgtaggatgcgccaagacccagcacacccccatgtggttgccacaggtgggaaagagaatgctttgaagatatgggacctgcagggctctgaggaacctgtgttcagggccaagaacgtgcggaatgactggctggacttgcgggttcccatctgggaccaggacatacagtttctcccaggatcacagaagcttgtcacctgcacagggtaccaccaggtccgtgtttatgatccagcatccccccagcgccggccagtcctagagaccacctatggagagtacccactaacagccatgaccctcactccgggaggcaactcagtgattgtgggaaacactcatgggcagctggcagaaattgaccttcggcaagggcgtctactgggctgtctgaaggggctggcaggcagtgtgcgtgggttgcagtgccacccttcaaagcctctactagcctcctgtggcttggacagagtcttgaggatacacaggatccagaatccacggggtctggagcataaggatgagccccaagagcctcaagaacccaacaaggtgcccctagaagacacagagacagatgaactttgggcatccttggaggcagctgccaagcggaagctctcgggtttggagcagccccaaggagctctccaaacgagacggagaaagaagaagcggcctgggtccaccagcccctgacgcccctgtgcccactttgtaaataaactgctgaacaccca

SEQ ID NO: 2637 - DNA, 1736 bp, Homo sapiens
atcgcttctcggccttttggctaagatcaagtgtagtatctgttcttatcagtttaatatctgatacgtcctctatccgaggacaatatattaaatggatttttggaaataggagatggaataggagcttgctccgtccactccacgcatcgacctggtattgcagtacttccaggaacggtgcactctcccttcggggagagaacaaccgttgtttaatggaagatttcgatcagttaggtccagaacacatattacataatggagccgggagacagactagggctggcttgatccggccacgcagtccaggaaaggtgcttttcacccccaagtgcaaaatgatcaatgtattcttccgatctacataaacaagcacctcctggtttcattttcgtaaagcaaaacaagcatggaagctttactgtttcggctcttcaaacttccagcaactacactgcgctgcatcggactcgacgcccgctggtgacgcacacgctgcgccggaagtgtgaactgtctgcctccaggctttgtcatggcggctgctgctgcacgctggaaccatgtgtgggtcggcaccgagactgggatcttgaaaggggtaaatcttcagcgaaaacaggcggcgaacttcacggccggaggacagccgcggcgcgaggaggcagtgagcgccctgtgttggggcaccggcggcgagacccagatgctggtgggctgcgcggacaggacggtgaagcacttcagcaccgaggatggcatattccagggtcagagacactgcccgggcggggagggcatgttccgtggcctcgcccaggccgacggcaccctcatcacatgtgtggattctgggattctcagagtctggcatgacaaggacaaggacacatcctctgacccactcctggaactgagagtgggccctggggtgtgtaggatgcgccaagacccagcacacccccatgtggttgccacaggtgggaaagagaatgctttgaagatatgggacctgcagggctctgaggaacctgtgttcagggccaagaacgtgcggaatgactggctggacttgcgggttcccatctgggaccaggacatacagtttctcccaggatcacagaagcttgtcacctgcacagggtaccaccaggtccgtgtttatgatccagcatccccccagcgccggccagtcctagagaccacctatggagagtacccactaacagccatgaccctcactccgggaggcaactcagtgattgtgggaaacactcatgggcagctggcagaaattgaccttcggcaagggcgtctactgggctgtctgaaggggctggcaggcagtgtgcgtgggttgcagtgccacccttcaaagcctctactagcctcctgtggcttggacagagtcttgaggatacacaggatccagaatccacggggtctggagcataaggtttatctcaagtctcaattgaactgcctcctcttgtcaggcagggacaactgggaggatgagccccaagagcctcaagaacccaacaaggtgcccctagaagacacagagacagatgaactttgggcatccttggaggcagctgccaagcggaagctctcgggtttggagcagccccaaggagctctccaaacgagacggagaaagaagaagcggcctgggtccaccagcccctgacgcccctgtgcccactttgtaaataaactgctgaacaccc

SEQ ID NO: 2638 - DNA, 1366 bp, Homo sapiens
tagtaataccagctgtaatcccagctacttgggaggctgaggcagaagaatcgcttgaacccgggaggcggaggttgagcaactacactgcgctgcatcggactcgacgcccgctggtgacgcacacgctgcgccggaagtgtgaactgtctgcctccaggctttgtcatggcggctgctgctgcacgctggaaccatgtgtgggtcggcaccgagactgggatcttgaaaggggtaaatcttcagcgaaaacaggcggcgaacttcacggccggaggacagccgcggcgcgaggaggcagtgagcgccctgtgttggggcaccggcggcgagacccagatgctggtgggctgcgcggacaggacggtgaagcacttcagcaccgaggatggcatattccagggtcagagacactgcccgggcggggagggcatgttccgtggcctcgcccaggccgacggcaccctcatcacatgtgtggattctgggattctcagagtctggcatgacaaggacaaggacacatcctctgacccactcctggaactgagagtgggccctggggtgtgtaggatgcgccaagacccagcacacccccatgtggttgccacaggtgggaaagagaatgctttgaagatatgggacctgcagggctctgaggaacctgtgttcagggccaagaacgtgcggaatgactggctggacttgcgggttcccatctgggaccaggacatacagtttctcccaggatcacagaagcttgtcacctgcacagggtaccaccaggtccgtgtttatgatccagcatccccccagcgccggccagtcctagagaccacctatggagagtacccactaacagccatgaccctcactccgggaggcaactcagtgattgtgggaaacactcatgggcagctggcagaaattgaccttcggcaagggcgtctactgggctgtctgaaggggctggcaggcagtgtgcgtgggttgcagtgccacccttcaaagcctctactagcctcctgtggcttggacagagtcttgaggatacacaggatccagaatccacggggtctggagcataaggtttatctcaagtctcaattgaactgcctcctcttgtcaggcagggacaactgggaggatgagccccaagagcctcaagaacccaacaaggtgcccctagaagacacagagacagatgaactttgggcatccttggaggcagctgccaagcggaagctctcgggtttggagcagccccaaggagctctccaaacgagacggagaaagaagaagcggcctgggtccaccagcccctgacgcccctgtgcccactttgtaaataaactgctgaacaccc

SEQ ID NO: 2639 - DNA, 371 bp, Homo sapiens
tttgggcatccttggaggcagctgccaagcggaagctctcgggtttggagcagccccaaggagctctccaaacgagacggagaaagaagaagcggcctgggtccaccagcccctgacgcccctgtgcccactttgcgccgaagatatcgacttgaactccccggaccatccgaatcacaagtcgaacgaaagccttctgattaccgtgctgtggcggcgactatccacgttcggtcgtcggggctcctcgcggccaagcaagaggcaaccagaccagattcggaagcaggagagtccgatccgagaaggcaaccaggaggagccggagaagggatgaccccagacctgctctcagtccgccccaacctcca

SEQ ID NO: 2640 - DNA, 550 bp, Homo sapiens
atcgcttctcggccttttggctaagatcaagtgtagtatctgttcttatcagtttaatatctgatacgtcctctatccgaggacaatatattaaatggatttttggaaataggagatggaataggagcttgctccgtccactccacgcatcgacctggtattgcagtacttccaggaacggtgcactctcccttcggggagagaacaaccgttgtttaatggaagatttcgatcagttaggcaaaacaagcatggaagctttactgtttcggctcttcaaacttccagcaactacactgcgctgcatcggactcgacgcccgctggtgacgcacacgctgcgccggaagtgtgaactgtctgcctccaggctttgtcatggcggctgctgctgcacgctggaaccatgtgtgggtcggcaccgagactgggatcttgaaaggggtaaatcttcagcgaaaacaggcggcgaacttcacggccggaggacagccgcggcgcgaggaggcagtgagcgccctgtgttggggcaccggcggcgagacccagat

SEQ ID NO: 2641 - DNA, 2701 bp, Homo sapiens
ggctcaacgaaggaagttcagggcgggaccagagattggccattccgctactgcgcaaagatggtggaggaggagaacatccgcgtggttcgttgtggcggcagcgagttgaactttaggagagctgtgttctctgcagattctaagtatatcttctgtgtctctggagactttgttaaagtttacagcacagttacagaagagtgtgtacacatactgcatggacacagaaatctggtgactggaatccagcttaaccccaacaaccatctacagctgtattcttgttcccttgatggcacaattaaactgtgggactatatagatggcatcttaataaagactttcatagttggatgtaaacttcatgccctctttactcttgcccaagctgaggattctgtctttgttatagtgaataaagaaaaaccagatatatttcagctggtttcagtgaaactgccaaaatcctcaagccaggaagtagaagccaaggagctgtcctttgttttggattacataaaccagtcacccaagtgcattgcctttggaaacgagggagtatatgttgctgcagtacgggaattttacttgtctgtttattttttcaaaaagaaaacaacatcaaggtttactttatcatcatcaagaaataagaagcatgctaaaaacaattttacatgtgtagcatgtcacccaacggaagactgcatcgcatctggtcacatggatggcaaaattcgtctttggaggaatttttatgatgataagaaatatacgtacacatgtttacattggcaccatgatatggttatggatttggctttttcagtgacaggcaccagtctgctgagtggcggtcgtgaatctgtacttgtagagtggcgcgatgcaacagagaagaataaggagtttctcccgcgtttaggagctactattgaacatatctcagtctcgcctgcaggagatttattctgcacttctcactctgataataagataataattattcaccgaaaccttgaagcatccgcagtaattcaaggcctagtgaaagataggagtatcttcactggtttgatgattgatccaagaactaaagctttggttttgaatggaaaacctggccacctgcagttttattctctccagagtgataaacagttatacaatttagatattatacagcaagaatatattaatgattatggtctgatccaaattgaactaacaaaggctgcatttggctgctttggtaactggcttgcaacagtggaacagcggcaagaaaaggaaactgagcttgaattgcaaatgaaactgtggatgtataataagaaaacacaagggtttattcttaacactaaaattaacatgccacacgaagactgcattacagctctctgtttctgtaatgcagaaaaatctgaacagcccaccttggttacagctagcaaagatggttacttcaaagtatggatattaacagatgactctgacatatacaaaaaagctgttggctggacctgtgactttgttggtagttatcacaagtatcaagcaactaactgttgtttctccgaagatggttctttactagcagttagttttgaggaaatagtcacaatatgggattctgtaacatgggaacttaaatgtacattttgccaacgagctgggaaaataaggcacctttgctttgggagattgacgtgttcaaagtatctacttggtgctactgaaaatggcattctttgctgttggaatctgctgagctgtgcattggagtggaatgcaaaattaaatgttagagttatggaacccgatcctaattcagagaatattgctgcaatctctcagtcttcagtgggttcagacttgtttgtatttaaacctagtgagccaaggccattgtatattcaaaagggtatctccagagagaaagtccagtggggagtgtttgttccacgagatgtccctgaatccttcacctcagaagcttaccagtggctaaatagatcccagttttacttcctaacaaaatcacagagtttattgacattcagtacaaagtctccagaagaaaaactcacaccaacaagcaaacagctgctagcagaagaaagtcttcccacaaccccattttatttcatattgggaaaacacaggcaacagcaggatgaaaaactaaacgaaactttagagaatgagctggtacaactacccttaacagaaaacatacccgcaattagtgagcttcttcacactccagcccatgtcctgccatctgctgctttcctgtgctccatgtttgtaaattcattgctgctgtctaaagagactaagagtgctaaggaaattcctgaagatgtagatatggaagaagaaaaagaaagtgaagattcagatgaagaaaatgattttaccgaaaaagtccaggatacaagtaacacaggtttaggagaagacattatacatcagttgtcaaaatctgaagaaaaagaactgagaaaatttaggaaaatagactacagctggatagctgccctttaagccttggagatggggaggatccttggactttgtgtttttgattgtatgttgatattctaaaaacatctattttaatgttatttctgttctaaaaataagataataaatattaacaaactttgcttttttaaaaaactgataatatgaa

SEQ ID NO: 2642 - DNA, 1535 bp, Homo sapiens
ctgttccctctgctctgggtctccgccggcgcccgccccgccagcctcacctgcgcggcacgtgacccgcaccgcccgtgggcaccttgaaggcggatcccgcgcgcccccgctcctgcaggctgtttttcttcaaataaagaacatggtgaaactgattcacacattagctgatcatggtgacgatgtcaactgctgtgccttctccttttccctcttggctacttgctccttggacaaaacaattcgcctgtactcgttacgtgactttactgaactgccacattctccattgaagtttcatacctatgctgtccactgctgctgtttctccccttcaggacatattttggcatcgtgttcaacagatggtaccactgtcctatggaatactgaaaatggacagatgctggcagtgatggaacagcctagtggcagccctgtgagggtttgccagttttccccagactccacgtgtttggcatcaggggcagctgatggaactgtggttttgtggaatgcacagtcatacaaattatatagatgtggtagtgttaaagatggctccttggcggcatgtgcattttctcctaatggaagcttctttgtcactggctcctcatgtggtgatttaacagtgtgggatgataaaatgaggtgtccgcatagtgaaaaagcacatgatcttggaattacctgctgcgatttttcttcacagccagtttctgatggagaacaaggtcttcagttttttcgactggcatcatgtggtcaggattgccaagtcaaaatttggattgtttcttttacccatatcttagcaaggcgcacagaacatcagctgaagcaatttaccgaagattggtcagaggaggatgtctcaacatggctttgtgcacaagatttaaaagatcttgttggtattttcaagatgaataacattgatggaaaagaactgttgaatcttacaaaagaaagtctggctgatgatttgaaaattgaatctctaggactgcgtagtaaagtgctgaggaaaattgaagagctcaggaccaaggttaaatccctttcttcaggaattcctgatgaatttatatgtccaataactagagaacttatgaaagatccggtcatcgcatcagatggctattcatatgaaaaggaagcaatggaaaattggatcagcaaaaagaaacgtacaagtcccatgacaaatcttgttcttccttcagcggtacttacaccaaataggactctgaaaatggccatcaatagatggctggagacacaccaaaagtaaaattgttgatattgtattatttatattttcagtgatctcatttgaatgatttataggtaaatactaatcagacattattaaaagcaaaacaggaaaaaggtaaacttcttaaatttagttacctataaaaattgtcaattttcattctttaaaaaacacatggacttactataaaagcctttttgtactagtgaaaagaatcttcagctatatagaaataaagttatactttaaa

SEQ ID NO: 2643 - DNA, 1912 bp, Homo sapiens
ggggcctactccctccgctctgggtcacagcgggcgttcggggggcggggcctgttccctccgctctgggtccccgcgggcgttcgggggcggggcctgttccctctgctctgggtctccgccggcgcccgccccgccagcctcacctgcgcggcacgtgacccgcaccgcccgtgggcaccttgaaggcggatcccgcgcgcccccgctcctgcaggctgtttttcttcaaataaagaacatggtgaaactgattcacacattagctgatcatggtgacgatgtcaactgctgtgccttctccttttccctcttggctacttgctccttggacaaaacaattcgcctgtactcgttacgtgactttactgaactgccacattctccattgaagtttcatacctatgctgtccactgctgctgtttctccccttcaggacatattttggcatcgtgttcaacagatggtaccactgtcctatggaatactgaaaatggacagatgctggcagtgatggaacagcctagtggcagccctgtgagggtttgccagttttccccagactccacgtgtttggcatcaggggcagctgatggaactgtggttttgtggaatgcacagtcatacaaattatatagatgtggtagtgttaaagatggctccttggcggcatgtgcattttctcctaatggaagcttctttgtcactggctcctcatgtggtgatttaacagtgtgggatgataaaatgaggtgtccgcatagtgaaaaagcacatgatcttggaattacctgctgcgatttttcttcacagccagtttctgatggagaacaaggtcttcagttttttcgactggcatcatgtggtcaggattgccaagtcaaaatttggattgtttcttttacccatatcttaggttttgaattaaaatataaaagtacactgagtgggcactgtgctcctgttctggcttgtgctttttcccatgatgggcagatgctagtctcagggtcagtggataagtctgtcatagtatatgatactaatactgagaatatacttcacacattgactcagcacaccaggtatgtcacaacttgtgcttttgcacctaatacccttttacttgctactggttcaatggacaaaacagtgaacatctggcaatttgacctggaaacactttgccaagcaaggcgcacagaacatcagctgaagcaatttaccgaagattggtcagaggaggatgtctcaacatggctttgtgcacaagatttaaaagatcttgttggtattttcaagatgaataacattgatggaaaagaactgttgaatcttacaaaagaaagtctggctgatgatttgaaaattgaatctctaggactgcgtagtaaagtgctgaggaaaattgaagagctcaggaccaaggttaaatccctttcttcaggaattcctgatgaatttatatgtccaataactagagaacttatgaaagatccggtcatcgcatcagatggctattcatatgaaaaggaagcaatggaaaattggatcagcaaaaagaaacgtacaagtcccatgacaaatcttgttcttccttcagcggtacttacaccaaataggactctgaaaatggccatcaatagatggctggagacacaccaaaagtaaaattgttgatattgtattatttatattttcagtgatctcatttgaatgatttataggtaaatactaatcagacattattaaaagcaaaacaggaaaaaggtaaacttcttaaatttagttacctataaaaattgtcaattttcattctttaaaaaacacatggacttactataaaagcctttttgtactagtgaaaagaatcttcagctatatagaaataaagttatactttaaattgca

SEQ ID NO: 2644 - DNA, 1812 bp, Homo sapiens
agcggcggtggcggcaggtggggaagcgcggctgggcctgctcgcgcggggcgtctgagccctccatttcccggttctaaccgcgcagcagggcccaaccgggaccttgagtgcggcgaggcgtggctgtttttcttcaaataaagaacatggtgaaactgattcacacattagctgatcatggtgacgatgtcaactgctgtgccttctccttttccctcttggctacttgctccttggacaaaacaattcgcctgtactcgttacgtgactttactgaactgccacattctccattgaagtttcatacctatgctgtccactgctgctgtttctccccttcaggacatattttggcatcgtgttcaacagatggtaccactgtcctatggaatactgaaaatggacagatgctggcagtgatggaacagcctagtggcagccctgtgagggtttgccagttttccccagactccacgtgtttggcatcaggggcagctgatggaactgtggttttgtggaatgcacagtcatacaaattatatagatgtggtagtgttaaagatggctccttggcggcatgtgcattttctcctaatggaagcttctttgtcactggctcctcatgtggtgatttaacagtgtgggatgataaaatgaggtgtccgcatagtgaaaaagcacatgatcttggaattacctgctgcgatttttcttcacagccagtttctgatggagaacaaggtcttcagttttttcgactggcatcatgtggtcaggattgccaagtcaaaatttggattgtttcttttacccatatcttaggttttgaattaaaatataaaagtacactgagtgggcactgtgctcctgttctggcttgtgctttttcccatgatgggcagatgctagtctcagggtcagtggataagtctgtcatagtatatgatactaatactgagaatatacttcacacattgactcagcacaccaggtatgtcacaacttgtgcttttgcacctaatacccttttacttgctactggttcaatggacaaaacagtgaacatctggcaatttgacctggaaacactttgccaagcaaggcgcacagaacatcagctgaagcaatttaccgaagattggtcagaggaggatgtctcaacatggctttgtgcacaagatttaaaagatcttgttggtattttcaagatgaataacattgatggaaaagaactgttgaatcttacaaaagaaagtctggctgatgatttgaaaattgaatctctaggactgcgtagtaaagtgctgaggaaaattgaagagctcaggaccaaggttaaatccctttcttcaggaattcctgatgaatttatatgtccaataactagagaacttatgaaagatccggtcatcgcatcagatggctattcatatgaaaaggaagcaatggaaaattggatcagcaaaaagaaacgtacaagtcccatgacaaatcttgttcttccttcagcggtacttacaccaaataggactctgaaaatggccatcaatagatggctggagacacaccaaaagtaaaattgttgatattgtattatttatattttcagtgatctcatttgaatgatttataggtaaatactaatcagacattattaaaagcaaaacaggaaaaaggtaaacttcttaaatttagttacctataaaaattgtcaattttcattctttaaaaaacacatggacttactataaaagcctttttgtactagtgaaaagaatcttcagctatatagaaataaagttatacttt

SEQ ID NO: 2645 - DNA, 1920 bp, Homo sapiens
gctcctgcaggtgagagcggccgcgcccacgggccggctcagcggcggtggcggcaggtggggaagcgcggctgggcctgctcgcgcggggcgtctgagccctccatttcccggttctaaccgcgcagcagggcccaaccgggaccttgagtgcggcgaggcgtggttcgtgcacccttggcccggggctagggcgggcgtgtcggcgtcgggtggaaggaagccccttgcgggctgtttttcttcaaataaagaacatggtgaaactgattcacacattagctgatcatggtgacgatgtcaactgctgtgccttctccttttccctcttggctacttgctccttggacaaaacaattcgcctgtactcgttacgtgactttactgaactgccacattctccattgaagtttcatacctatgctgtccactgctgctgtttctccccttcaggacatattttggcatcgtgttcaacagatggtaccactgtcctatggaatactgaaaatggacagatgctggcagtgatggaacagcctagtggcagccctgtgagggtttgccagttttccccagactccacgtgtttggcatcaggggcagctgatggaactgtggttttgtggaatgcacagtcatacaaattatatagatgtggtagtgttaaagatggctccttggcggcatgtgcattttctcctaatggaagcttctttgtcactggctcctcatgtggtgatttaacagtgtgggatgataaaatgaggtgtccgcatagtgaaaaagcacatgatcttggaattacctgctgcgatttttcttcacagccagtttctgatggagaacaaggtcttcagttttttcgactggcatcatgtggtcaggattgccaagtcaaaatttggattgtttcttttacccatatcttaggttttgaattaaaatataaaagtacactgagtgggcactgtgctcctgttctggcttgtgctttttcccatgatgggcagatgctagtctcagggtcagtggataagtctgtcatagtatatgatactaatactgagaatatacttcacacattgactcagcacaccaggtatgtcacaacttgtgcttttgcacctaatacccttttacttgctactggttcaatggacaaaacagtgaacatctggcaatttgacctggaaacactttgccaagcaaggcgcacagaacatcagctgaagcaatttaccgaagattggtcagaggaggatgtctcaacatggctttgtgcacaagatttaaaagatcttgttggtattttcaagatgaataacattgatggaaaagaactgttgaatcttacaaaagaaagtctggctgatgatttgaaaattgaatctctaggactgcgtagtaaagtgctgaggaaaattgaagagctcaggaccaaggttaaatccctttcttcaggaattcctgatgaatttatatgtccaataactagagaacttatgaaagatccggtcatcgcatcagatggctattcatatgaaaaggaagcaatggaaaattggatcagcaaaaagaaacgtacaagtcccatgacaaatcttgttcttccttcagcggtacttacaccaaataggactctgaaaatggccatcaatagatggctggagacacaccaaaagtaaaattgttgatattgtattatttatattttcagtgatctcatttgaatgatttataggtaaatactaatcagacattattaaaagcaaaacaggaaaaaggtaaacttcttaaatttagttacctataaaaattgtcaattttcattctttaaaaaacacatggacttactataaaagcctttttgtactagtgaaaagaatcttcagctatatagaaataaagttatacttt

SEQ ID NO: 2646 - DNA, 4167 bp, Homo sapiens
aaagggacaatgtcccccgagcggtggaggcggcggcggctgcggaggccgcggcaccggcaccgggagcggcagcggcggtagcggcagcgacggccgcaccaaggaggggagctccgagccccggcacctggccggcggcgccgcctccccggcccacaatgccccgctgagccggtgcagcagctgagtggatccaagcagagaaaatccgatggaggggtctctggcaggcagcctggctgcaccagatcgtccccaaggcccagagagactgcctggcccggcgccaagggagaacatcgagggtggggccgaagctgctgagggggaaggtggcatcttccggtccacccgttacctgcctgtcaccaaggagggcccccgagacattctggatggcagaggtggcatctctgtggccaactttgacccaggcaccttcagcctgatgcgctgtgacttctgcggggctggcttcgacacacgggccggcctctccagccacgcccgggcccacctacgtgacttcggtatcaccaactgggagctcactgtctcacccatcaacatcctgcaggagctgctggccacctctgctgctgagcagccccccagccccctgggccgagagcctgggggtccgcctggcagcttcctgacctcccgtcggccccgcttacctctcacggtgccctttccacccacctgggctgaggaccctgggccagcctatggagatgcctcaggcccagagccagcacgagacatccgctgcgagttctgtggtgagttcttcgagaaccgcaagggcctctcgagccacgcgcgctcccatctgcggcaaatgggcgtgaccgagtggtacgtcaatggctcgcccatcgacacgctgcgggagatcctgaagagacggacccagtctcggcctggtggacctcccaacccaccagggccaagcccaaaagccctggccaagatgatgggcggcgcaggtcctggcagctcactggaagcccgcagcccctcggaccttcacatctcacccttggccaagaagttgccaccaccaccgggcagccccctgggccactcaccaactgcctctcctcctcctacggcccgaaagatgttcccaggcctggctgcaccctccttgcccaagaagctgaagcctgaacaaatacgggtggagatcaagcgggagatgctgccgggggcccttcatggggaactgcacccatctgagggtccctggggggcaccacgggaagacatgacacccctgaacctgtcgtcccgggcagagccggtgcgcgacatccgctgtgagttctgcggcgagttcttcgagaaccgcaagggcctgtcgagtcacgcgcgctcacacctgcggcagatgggtgtgaccgagtggtccgtcaatggttcgcccatcgacacactgcgagagatcctcaagaagaagtccaagccgtgcctcatcaagaaggagccaccggctggagacctggcccctgccctggctgaggacgggcctcccaccgtggcccctgggcccgtgcagtccccactgccgctgtcgcccctggctggccggccaggcaaaccaggtgcagggccggcccaggttcctcgtgagctcagcctgacgcccatcactggggccaagccctcagccactggctacctgggctcagtggcagccaagcggcccctgcaggaggaccgcctcctcccagcagaggtcaaggccaagacctacatccagactgaactgcccttcaaggcaaagacccttcatgagaagacctcccactcctccaccgaggcctgctgcgagctgtgtggcctttactttgaaaaccgcaaggccctggccagccacgcacgggcacacctgcggcagttcggcgtgaccgagtggtgcgtcaatggctcgcccatcgagacactgagcgagtggatcaaacaccggccccagaaggtgggcgcctaccgcagctacatccagggcggccgccccttcaccaagaagttccgcagtgccggccatggccgtgacagtgacaagcggccgtccctggggctggcacccgggggcctggccgtggtcggccgcagtgccggaggggagccagggcccgaggctggccgggcagccgacggtggtgagcggcctctggcagccagcccgccaggcaccgtgaaggctgaggagcaccagcggcagaacatcaacaaatttgaacgccgacaagcccgccctccagatgcctccgcagcccggggaggcgaggacaccaatgacctacagcagaagctggaggaggtgcggcaacccccaccccgagtccggccagtcccctccctggtgccccggcccccccagacatcacttgtcaagttcgtgggcaacatctacaccctcaaatgcaggttctgtgaggtggaattccagggccccctctccatccaggaagagtgggtgcggcacttacagcggcacatcctggagatgaacttctccaaagcggaccccccacctgaggagtcccaggccccgcaggcacagacagcggcggcagaggctccctaacacaaaagcattccagatcccctctcgtgccacctctgtctcctcttcttcctcctctgtgtccttgtccctcttcctctttctttccgtttccaaaggagcaagccaaaacctcaaaccggcgccccttgggggccgggcacactacagccagggcgccgggagccagctagctgcccttcccccagcccgaggactctggggccacagggtgtcttccttcagcccatgcccacctggtccagcaggggcagcagccaggtctctgatggcagccggtctggtcacaggggaggacagcactcccccgtctagcagccaggcagggcgatgtctgccatccgtggccatttgcaaagaccccaaagacccctgttctggttccctctctcccccatgaatatcctctcacacacatgtacatgcgaacacacacaacacgcacctcgtgagacccgggacctgccccggacccccagttcctgggttgaacgaccacatcatgccacggtgcttgctcaggggaagccacgctccctctgtggggcctgctggggcctgggagccccccactgagcccacaatgccacggaaatccttgttggctgcccccgagaggggccttcccagctgggaagagctcagagctgacagctgcctcctgccatgtcaaggccccccaaagagcctcaggggctctggggccctggagggtggggttggggggtgggactctcctcccccactcctgctccctctcccttttcactgttgctttctatgtatagctccctagacctttcacttttttaaaaacgcgttttgtgtagagaataaggaacgtggatctttttattttgcaatcctgggccagctagaagccaggagctgattgaccttttaacttttttcagtggccacattttggttatcgatgtacctagaagtatgtaaattagattaaatttctcttctggaaacaccctggggcaggcggccagcgtgtgtttttctgtcaagtggacaggctggcattggctggcagccggggctgggatcggggcctcctctgtccagagcgccatggaggccctgggttttccagttggccgccaagccgaccagacgcagctggggatgagcccaagttcccagctgttggctctttaggccatggctgggagggggtctctggctggctggcaaagcggctccagtgagcagatgaaccagggttctgggcagcctgtctgggaagggagccaggatcaagaagcagttgaggctagaggagcttatcaaaggcaggagctaccagcgagggtgtcagggacccgttgggagcatttgggtgggggccagtggggttgtagagagctggaactcacctgcttttaatacatgtgacttctagtgagacacatgcacccctgacccaaggaacatgcggggaaaagaggagccactggctcctttgcgatgttatttattttctcgctctgcaaatgtttattgaacatttctgagattttaagagattttgttggctgctccttcttgtttattgc

SEQ ID NO: 2647 - DNA, 6738 bp, Homo sapiens
aaagggacaatgtcccccgagcggtggaggcggcggcggctgcggaggccgcggcaccggcaccgggagcggcagcggcggtagcggcagcgacggccgcaccaaggaggggagctccgagccccggcacctggccggcggcgccgcctccccggcccacaatgccccgctgagccggtgcagcagctgagtggatccaagcagagaaaatccgatggaggggtctctggcaggcagcctggctgcaccagatcgtccccaaggcccagagagactgcctggcccggcgccaagggagaacatcgagggtggggccgaagctgctgagggggaaggtggcatcttccggtccacccgttacctgcctgtcaccaaggagggcccccgagacattctggatggcagaggtggcatctctggtacccctgatggccgggggccctgggagcacccccttgtccaggaggctggggagggcatcctatctgagcggagattcgaggactcagtcattgtgagaaccatgaaaccccacgctgagctagagggctctagaaggttcttacaccaccggggggaaccaaggcttttggagaaacatgcccagggccgccccaggttcgactggctccaagatgaggacgagcagggatccccccaggacgcagggctgcacttggacctgcctgcccagccgccacccctcgcccccttcaggagggtgtttgtgccagtggaagacaccccgaagacgctggacatggcggtggtgggtggcagagaagatctggaggacctggaggggctggcccagccgtccgagtggggcctacccacgtcagcctcggaggtagccacacagacctggacagtgaactcggaggcttctgtggagcggctgcagccgctactgcccccgatccggaccgggccctacctgtgtgagctgctggaggaggtggccgaaggggtggccagcccagatgaggacgaggacgaggagccggccgtgttcccatgcatcgagtgcagcatctacttcaagcagaaggagcacctcctggagcacatgagccagcaccgccgagccccgggccaggagccccctgcggacctggccccgctggcctgcggggagtgtggctgggcctttgctgaccccactgccctggagcagcaccggcagctgcatcaggcctcccgggagaagatcattgaggagatccaaaagctgaagcaagttccaggagacgagggccgggaggcacggctgcagtgccctaagtgtgtctttggcaccaattcatccagggcctatgtgcagcatgccaagctgcacatgcgtgagcccccaggccagaccaccaaagagccttttggaggcagcagcggggctggcagccccagccctgaggccagcgccctcctctatcagccctacggagctgccgttggcctcagcgcctgtgtcttctgtggtttccccgcgcccagcgagagcctgctcagggagcacgtgaggctggtgcatgcccatccccactgggaggaggatggcgaggcttatgaggaagaccctgccagccagccaggcactagccaggatgctcacgcctgcttccctgacactgctgtggactactttggcaaagctgagccgtccttggcccccatgtggcgggagaaccctgctggatacgaccccagcctggcctttggcccaggatgccagcagctgagcatcagagatttcccgctgtcaaagccactcctgcatggcacgggccagaggcctctcggaaggctggcctttccctccacactagcatccaccccctactccttacagctcgggagaaacaaaagcaccgtccacccacaagggctgggggaacggaggcgcccttggagcgaagaggaggaggaggaggaggaggaggaggatgtagtgctgacctccgagatggatttttcccctgaaaatggggtcttttcacccctagccacccccagcctcatcccgcaggcggccctggagctgaagcaggcattccgagaggccctgcaggcagtagaggccacccaggggcagcagcagcagctccgagggatggtacccattgtgctcgtggcgaagctggggccgcaggtcatggcggcagccagggtgcccccaaggttgcagcccgaggagctggggctggcaggcgcccaccccctggacttcctgctcctggacgcgccgctgggcggcccgctggggctggacacactcctggatggggatccggccatggcactgaagcacgaggagcggaaatgcccctactgccccgatcgcttccacaacggcatcggcttggccaaccacgtccggggccacctgaaccgcgtgggcgtcagctacaatgtgcgccatttcatctccgctgaggaggtgaaggccattgagcgcaggttctccttccagaagaagaagaaaaaagtggccaactttgacccaggcaccttcagcctgatgcgctgtgacttctgcggggctggcttcgacacacgggccggcctctccagccacgcccgggcccacctacgtgacttcggtatcaccaactgggagctcactgtctcacccatcaacatcctgcaggagctgctggccacctctgctgctgagcagccccccagccccctgggccgagagcctgggggtccgcctggcagcttcctgacctcccgtcggccccgcttacctctcacggtgccctttccacccacctgggctgaggaccctgggccagcctatggagatgcccagagcctgaccacctgcgaggtctgcggtgcctgctttgagacccgaaagggcctgtccagccacgcgcgctcccacctgcggcagctgggagtggcagagtcggaaagcagcggcgcacccatcgacctcctctacgagcttgtgaagcagaagggtctgcctgacgcccaccttgggctgcccccaggcctggctaagaagtccagctcactgaaggaggtggtcgccggggccccccggcccggcttgctcagcctggccaagcccttggatgcccctgctgtcaacaaagccatcaagtcgcctcccggcttctcggccaagggcctgggccacccgcccagctctccactcctcaaaaagacaccactggccctggcgggctcccctacccctaagaatcctgaggacaagagcccccagctgtccctgagcccccggccggcctccccaaaggcacagtggcctcagtctgaggatgaggggcccttgaacctcacctcaggcccagagccagcacgagacatccgctgcgagttctgtggtgagttcttcgagaaccgcaagggcctctcgagccacgcgcgctcccatctgcggcaaatgggcgtgaccgagtggtacgtcaatggctcgcccatcgacacgctgcgggagatcctgaagagacggacccagtctcggcctggtggacctcccaacccaccagggccaagcccaaaagccctggccaagatgatgggcggcgcaggtcctggcagctcactggaagcccgcagcccctcggaccttcacatctcacccttggccaagaagttgccaccaccaccgggcagccccctgggccactcaccaactgcctctcctcctcctacggcccgaaagatgttcccaggcctggctgcaccctccttgcccaagaagctgaagcctgaacaaatacgggtggagatcaagcgggagatgctgccgggggcccttcatggggaactgcacccatctgagggtccctggggggcaccacgggaagacatgacacccctgaacctgtcgtcccgggcagagccggtgcgcgacatccgctgtgagttctgcggcgagttcttcgagaaccgcaagggcctgtcgagtcacgcgcgctcacacctgcggcagatgggtgtgaccgagtggtccgtcaatggttcgcccatcgacacactgcgagagatcctcaagaagaagtccaagccgtgcctcatcaagaaggagccaccggctggagacctggcccctgccctggctgaggacgggcctcccaccgtggcccctgggcccgtgcagtccccactgccgctgtcgcccctggctggccggccaggcaaaccaggtgcagggccggcccaggttcctcgtgagctcagcctgacgcccatcactggggccaagccctcagccactggctacctgggctcagtggcagccaagcggcccctgcaggaggaccgcctcctcccagcagaggtcaaggccaagacctacatccagactgaactgcccttcaaggcaaagacccttcatgagaagacctcccactcctccaccgaggcctgctgcgagctgtgtggcctttactttgaaaaccgcaaggccctggccagccacgcacgggcacacctgcggcagttcggcgtgaccgagtggtgcgtcaatggctcgcccatcgagacactgagcgagtggatcaaacaccggccccagaaggtgggcgcctaccgcagctacatccagggcggccgccccttcaccaagaagttccgcagtgccggccatggccgtgacagtgacaagcggccgtccctggggctggcacccgggggcctggccgtggtcggccgcagtgccggaggggagccagggcccgaggctggccgggcagccgacggtggtgagcggcctctggcagccagcccgccaggcaccgtgaaggctgaggagcaccagcggcagaacatcaacaaatttgaacgccgacaagcccgccctccagatgcctccgcagcccggggaggcgaggacaccaatgacctacagcagaagctggaggaggtgcggcaacccccaccccgagtccggccagtcccctccctggtgccccggcccccccagacatcacttgtcaagttcgtgggcaacatctacaccctcaaatgcaggttctgtgaggtggaattccagggccccctctccatccaggaagagtgggtgcggcacttacagcggcacatcctggagatgaacttctccaaagcggaccccccacctgaggagtcccaggccccgcaggcacagacagcggcggcagaggctccctaacacaaaagcattccagatcccctctcgtgccacctctgtctcctcttcttcctcctctgtgtccttgtccctcttcctctttctttccgtttccaaaggagcaagccaaaacctcaaaccggcgccccttgggggccgggcacactacagccagggcgccgggagccagctagctgcccttcccccagcccgaggactctggggccacagggtgtcttccttcagcccatgcccacctggtccagcaggggcagcagccaggtctctgatggcagccggtctggtcacaggggaggacagcactcccccgtctagcagccaggcagggcgatgtctgccatccgtggccatttgcaaagaccccaaagacccctgttctggttccctctctcccccatgaatatcctctcacacacatgtacatgcgaacacacacaacacgcacctcgtgagacccgggacctgccccggacccccagttcctgggttgaacgaccacatcatgccacggtgcttgctcaggggaagccacgctccctctgtggggcctgctggggcctgggagccccccactgagcccacaatgccacggaaatccttgttggctgcccccgagaggggccttcccagctgggaagagctcagagctgacagctgcctcctgccatgtcaaggccccccaaagagcctcaggggctctggggccctggagggtggggttggggggtgggactctcctcccccactcctgctccctctcccttttcactgttgctttctatgtatagctccctagacctttcacttttttaaaaacgcgttttgtgtagagaataaggaacgtggatctttttattttgcaatcctgggccagctagaagccaggagctgattgaccttttaacttttttcagtggccacattttggttatcgatgtacctagaagtatgtaaattagattaaatttctcttctggaaacaccctggggcaggcggccagcgtgtgtttttctgtcaagtggacaggctggcattggctggcagccggggctgggatcggggcctcctctgtccagagcgccatggaggccctgggttttccagttggccgccaagccgaccagacgcagctggggatgagcccaagttcccagctgttggctctttaggccatggctgggagggggtctctggctggctggcaaagcggctccagtgagcagatgaaccagggttctgggcagcctgtctgggaagggagccaggatcaagaagcagttgaggctagaggagcttatcaaaggcaggagctaccagcgagggtgtcagggacccgttgggagcatttgggtgggggccagtggggttgtagagagctggaactcacctgcttttaatacatgtgacttctagtgagacacatgcacccctgacccaaggaacatgcggggaaaagaggagccactggctcctttgcgatgttatttattttctcgctctgcaaatgtttattgaacatttctgagattttaagagattttgttggctgctccttcttgtttattgc

SEQ ID NO: 2648 - DNA, 3632 bp, Homo sapiens
agtgccgagtgacaaaagcggagagcgccgccgccaccaccaccgccaccgccaccgccgccgcgggacgggcccaaggccgagccggagccggggcccgggcccgcgtccgctcccgcgcccggcctgggttctgaggaaaacgcaatggtggccatggacttgggctctccctcgctccctaagaagagcctgcctgtccctggggccctggagcaggtggccagtcggctgagcagcaaagtggctgcagaggttcctcatggcagcaaacaggagctgcaggacctcaaggcccagagcctgaccacctgcgaggtctgcggtgcctgctttgagacccgaaagggcctgtccagccacgcgcgctcccacctgcggcagctgggagtggcagagtcggaaagcagcggcgcacccatcgacctcctctacgagcttgtgaagcagaagggtctgcctgacgcccaccttgggctgcccccaggcctggctaagaagtccagctcactgaaggaggtggtcgccggggccccccggcccggcttgctcagcctggccaagcccttggatgcccctgctgtcaacaaagccatcaagtcgcctcccggcttctcggccaagggcctgggccacccgcccagctctccactcctcaaaaagacaccactggccctggcgggctcccctacccctaagaatcctgaggacaagagcccccagctgtccctgagcccccggccggcctccccaaaggcacagtggcctcagtctgaggatgaggggcccttgaacctcacctcaggcccagagccagcacgagacatccgctgcgagttctgtggtgagttcttcgagaaccgcaagggcctctcgagccacgcgcgctcccatctgcggcaaatgggcgtgaccgagtggtacgtcaatggctcgcccatcgacacgctgcgggagatcctgaagagacggacccagtctcggcctggtggacctcccaacccaccagggccaagcccaaaagccctggccaagatgatgggcggcgcaggtcctggcagctcactggaagcccgcagcccctcggaccttcacatctcacccttggccaagaagttgccaccaccaccgggcagccccctgggccactcaccaactgcctctcctcctcctacggcccgaaagatgttcccaggcctggctgcaccctccttgcccaagaagctgaagcctgaacaaatacgggtggagatcaagcgggagatgctgccgggggcccttcatggggaactgcacccatctgagggtccctggggggcaccacgggaagacatgacacccctgaacctgtcgtcccgggcagagccggtgcgcgacatccgctgtgagttctgcggcgagttcttcgagaaccgcaagggcctgtcgagtcacgcgcgctcacacctgcggcagatgggtgtgaccgagtggtccgtcaatggttcgcccatcgacacactgcgagagatcctcaagaagaagtccaagccgtgcctcatcaagaaggagccaccggctggagacctggcccctgccctggctgaggacgggcctcccaccgtggcccctgggcccgtgcagtccccactgccgctgtcgcccctggctggccggccaggcaaaccaggtgcagggccggcccaggttcctcgtgagctcagcctgacgcccatcactggggccaagccctcagccactggctacctgggctcagtggcagccaagcggcccctgcaggaggaccgcctcctcccagcagaggtcaaggccaagacctacatccagactgaactgcccttcaaggcaaagacccttcatgagaagacctcccactcctccaccgaggcctgctgcgagctgtgtggcctttactttgaaaaccgcaaggccctggccagccacgcacgggcacacctgcggcagttcggcgtgaccgagtggtgcgtcaatggctcgcccatcgagacactgagcgagtggatcaaacaccggccccagaaggtgggcgcctaccgcagctacatccagggcggccgccccttcaccaagaagttccgcagtgccggccatggccgtgacagtgacaagcggccgtccctggggctggcacccgggggcctggccgtggtcggccgcagtgccggaggggagccagggcccgaggctggccgggcagccgacggtggtgagcggcctctggcagccagcccgccaggcaccgtgaaggctgaggagcaccagcggcagaacatcaacaaatttgaacgccgacaagcccgccctccagatgcctccgcagcccggggaggcgaggacaccaatgacctacagcagaagctggaggaggtgcggcaacccccaccccgagtccggccagtcccctccctggtgccccggcccccccagacatcacttgtcaagttcgtgggcaacatctacaccctcaaatgcaggttctgtgaggtggaattccagggccccctctccatccaggaagagtgggtgcggcacttacagcggcacatcctggagatgaacttctccaaagcggaccccccacctgaggagtcccaggccccgcaggcacagacagcggcggcagaggctccctaacacaaaagcattccagatcccctctcgtgccacctctgtctcctcttcttcctcctctgtgtccttgtccctcttcctctttctttccgtttccaaaggagcaagccaaaacctcaaaccggcgccccttgggggccgggcacactacagccagggcgccgggagccagctagctgcccttcccccagcccgaggactctggggccacagggtgtcttccttcagcccatgcccacctggtccagcaggggcagcagccaggtctctgatggcagccggtctggtcacaggggaggacagcactcccccgtctagcagccaggcagggcgatgtctgccatccgtggccatttgcaaagaccccaaagacccctgttctggttccctctctcccccatgaatatcctctcacacacatgtacatgcgaacacacacaacacgcacctcgtgagacccgggacctgccccggacccccagttcctgggttgaacgaccacatcatgccacggtgcttgctcaggggaagccacgctccctctgtggggcctgctggggcctgggagccccccactgagcccacaatgccacggaaatccttgttggctgcccccgagaggggccttcccagctgggaagagctcagagctgacagctgcctcctgccatgtcaaggccccccaaagagcctcaggggctctggggccctggagggtggggttggggggtgggactctcctcccccactcctgctccctctcccttttcactgttgctttctatgtatagctccctagacctttcacttttttaaaaacgcgttttgtgtagagaataaggaacgtggatctttttattttgcaatcctgggccagctagaagccaggagctgattgaccttttaacttttttcagtggccacattttggttatcgatgtacctagaagtatgtaaattagattaaatttctcttctgg

SEQ ID NO: 2649 - DNA, 3311 bp, Homo sapiens
ggcctgggttctgaggaaaacgcaatggtggccatggacttgggctctccctcgctccctaagaagagcctgcctgtccctggggccctggagcaggtggccagtcggctgagcagcaaagtggctgcagaggttcctcatggcagcaaacaggagctgcaggacctcaaggcccagagcctgaccacctgcgaggtctgcggtgcctgctttgagacccgaaagggcctgtccagccacgcgcgctcccacctgcggcagctgggagtggcagagtcggaaagcagcggcgcacccatcgacctcctctacgagcttgtgaagcagaagggtctgcctgacgcccaccttgggctgcccccaggcctggctaagaagtccagctcactgaaggaggtggtcgccggggccccccggcccggcttgctcagcctggccaagcccttggatgcccctgctgtcaacaaagccatcaagtcgcctcccggcttctcggccaagggcctgggccacccgcccagctctccactcctcaaaaagacaccactggccctggcgggctcccctacccctaagaatcctgaggacaagagcccccagctgtccctgagcccccggccggcctccccaaaggcacagtggcctcagtctgaggatgaggggcccttgaacctcactttagatagtgacgggggcagagagctggactgccagctgtgcggtgcctggtttgagacccgcaagggcctgtctagccacgcccgtgcccacctgcgccacctgggcgtcagcgatccggacgccaagggatcccccatagacgtgctccacgggctcatcaggagggacggcgtccagatccgcctcccacccaggcgcggcgccctggcccacccggggcggccgcctcccacctccgcggccctctccttgcttccccccccaccgccggccaagaaggccaagctgaaggccgcgggtatggccagcccctgggggaagcaggacctctcggccgccgcagccgccggcattttctgggcctctgatgtggagccgtctcctctcaacctctcctcaggcccagagccagcacgagacatccgctgcgagttctgtggtgagttcttcgagaaccgcaagggcctctcgagccacgcgcgctcccatctgcggcaaatgggcgtgaccgagtggtacgtcaatggctcgcccatcgacacgctgcgggagatcctgaagagacggacccagtctcggcctggtggacctcccaacccaccagggccaagcccaaaagccctggccaagatgatgggcggcgcaggtcctggcagctcactggaagcccgcagcccctcggaccttcacatctcacccttggccaagaagttgccaccaccaccgggcagccccctgggccactcaccaactgcctctcctcctcctacggcccgaaagatgttcccaggcctggctgcaccctccttgcccaagaagctgaagcctgaacaaatacgggtggagatcaagcgggagatgctgccgggggcccttcatggggaactgcacccatctgagggtccctggggggcaccacgggaagacatgacacccctgaacctgtcgtcccgggcagagccggtgcgcgacatccgctgtgagttctgcggcgagttcttcgagaaccgcaagggcctgtcgagtcacgcgcgctcacacctgcggcagatgggtgtgaccgagtggtccgtcaatggttcgcccatcgacacactgcgagagatcctcaagaagaagtccaagccgtgcctcatcaagaaggagccaccggctggagacctggcccctgccctggctgaggacgggcctcccaccgtggcccctgggcccgtgcagtccccactgccgctgtcgcccctggctggccggccaggcaaaccaggtgcagggccggcccaggttcctcgtgagctcagcctgacgcccatcactggggccaagccctcagccactggctacctgggctcagtggcagccaagcggcccctgcaggaggaccgcctcctcccagcagaggtcaaggccaagacctacatccagactgaactgcccttcaaggcaaagacccttcatgagaagacctcccactcctccaccgaggcctgctgcgagctgtgtggcctttactttgaaaaccgcaaggccctggccagccacgcacgggcacacctgcggcagttcggcgtgaccgagtggtgcgtcaatggctcgcccatcgagacactgagcgagtggatcaaacaccggccccagaaggtgggcgcctaccgcagctacatccagggcggccgccccttcaccaagaagttccgcagtgccggccatggccgtgacagtgacaagcggccgtccctggggctggcacccgggggcctggccgtggtcggccgcagtgccggaggggagccagggcccgaggctggccgggcagccgacggtggtgagcggcctctggcagccagcccgccaggcaccgtgaaggctgaggagcaccagcggcagaacatcaacaaatttgaacgccgacaagcccgccctccagatgcctccgcagcccggggaggcgaggacaccaatgacctacagcagaagctggaggaggtgcggcaacccccaccccgagtccggccagtcccctccctggtgccccggcccccccagacatcacttgtcaagttcgtgggcaacatctacaccctcaaatgcaggttctgtgaggtggaattccagggccccctctccatccaggaagagtgggtgcggcacttacagcggcacatcctggagatgaacttctccaaagcggaccccccacctgaggagtcccaggccccgcaggcacagacagcggcggcagaggctccctaacacaaaagcattccagatcccctctcgtgccacctctgtctcctcttcttcctcctctgtgtccttgtccctcttcctctttctttccgtttccaaaggagcaagccaaaacctcaaaccggcgccccttgggggccgggcacactacagccagggcgccgggagccagctagctgcccttcccccagcccgaggactctggggccacagggtgtcttccttcagcccatgcccacctggtccagcaggggcagcagccaggtctctgatggcagccggtctggtcacaggggaggacagcactcccccgtctagcagccaggcagggcgatgtctgccatccgtggccatttgcaaagaccccaaagacccctgttctg

SEQ ID NO: 2650 - DNA, 1230 bp, Homo sapiens
gacataaaaaccgggtgccggcaggcgccagtcgcaggtgtgctgctgaggcgtgagaatggcgtcccgcggccggcgtccggagcatggcggacccccagagctgttttatgacgagacagaagcccggaaatacgttcgcaactcacggatgattgatatccagaccaggatggctgggcgagcattggagcttctttatctgccagagaataagccctgttacctgctggatattggctgtggcactgggctgagtggaagttatctgtcagatgaagggcactattgggtgggcctggatatcagccctgccatgctggatgaggctgtggaccgagagatagagggagacctgctgctgggggatatgggccagggcatcccattcaagccaggcacatttgatggttgcatcagcatttctgctgtgcagtggctctgtaatgctaacaagaagtctgaaaaccctgccaagcgcctgtactgcttttttgcttctcttttttctgttctcgtccggggatcccgagctgtcctgcagctgtaccctgagaactcagagcagttggagctgatcacaacccaggccacaaaggcaggcttctccggtggcatggtggtagactaccctaacagtgccaaagcaaagaaattctacctctgcttgttttctgggccttcgacctttataccagaggggctgagtgaaaatcaggatgaagttgaacccagggagtctgtgttcaccaatgagaggttcccattaaggatgtcgaggcggggaatggtgaggaagagtcgggcatgggtgctggagaagaaggagcggcacaggcgccagggcagggaagtcagacctgacacccagtacaccggccgcaagcgcaagccccgcttctaagtcaccacgcggttctggaaaggcacttgcctctgcacttttctatattgttcagctgacaaagtagtattttagaaaagttctaaagttataaaaatgttttctgcagtaaaaaaaaagttctctgggccgggcgtggtggctcacacctgtaatcccagcaccttgggaggctgaggtgggaggatcatttgaggccaggagtttgagacctgcctgggcaacataatgaaacttcctttccagggaggaaaaaaaaaaaaaaaaaaagctctgagagcatcttattttgtttaaaggcaagaaataaaatttccttttgtgga

SEQ ID NO: 2651 - DNA, 2496 bp, Homo sapiens
gtgctgctgaggcgtgagaatggcgtcccgcggccggcgtccggagcatggcggacccccagagctgttttatgacgagacagaagcccggaaatacgttcgcaagtgaggggagcctgaatactgcggggcgtccgggggtcgggaagcggcaagttgcccctgttgctggcgttgcccggaaaggccgtagaatttggggctcacggatgattgatatccagaccaggatggctgggcgagcattggagcttctttatctgccagagaataagccctgttacctgctggatattggctgtggcactgggctgagtggaagttatctgtcagatgaagggcactattgggtgggcctggatatcagccctgccatgctgggtccggggatcccgagctgtcctgcagctgtaccctgagaactcagagcagttggagctgatcacaacccaggccacaaaggcaggcttctccggtggcatggtggtagactaccctaacagtgccaaagcaaagaaattctacctctgcttgttttctgggccttcgacctttataccagaggggctgagtgaaaatcaggatgaagttgaacccagggagtctgtgttcaccaatgagaggttcccattaaggatgtcgaggcggggaatggtgaggaagagtcgggcatgggtgctggagaagaaggagcggcacaggcgccagggcagccccaagcctgcctcgaacacctgtgtgccacatccttcagggagcacccctgcccggcttcacgtgaacacagaaatggccaaatgtcctccaggagaggaaaagggcccacggataagaggaggagccgctggccgccggcgaaagtgagtccaactgggaggcatcaggagacaggggtcttgagtccacctttgccgctgacatttatgtgacctcagcctggtgttttcccctctctgggactcttccttccctaaaacctgccttacaaggggtctgtgtccaaatactgtccagacccagcactaggggtcatggacgtagggaacatggtgagggggtcatggcaggagggatggggcctacactcaccccagaggcaaagatggcggggttcccactctccagcatgtcctccagctcctcactggtcgtggtcctgccggctgcaagcgagtggggtcacactgagcccagccctcttcggggagttcagcagcagcattgggccccgccccctccgtcccaggcccgggctccccccagccccgagctcagcggcagcctcaggccccgcccccccggcccttaacacagcagccgcctcaggcccccgcccctccagccccaaactcagcagctgcctcgggccacccgcctcgggcccctaactaagcagcagccttgagccacgcactcagcagcagactcgggccccgcccctccaggctccaggccccgccccaggccccacccccagctcactgatctccagctgcctctggatgcggcctttgcagcgctcgcggtagtcggactgcgtggcgttgtactccgacatgacctccacaaactttctggacagcgtggagtgctgggggcccgagatggaggtgcaggggtcaggccctgcggggaccgacccagagactcaggtgcccgcccatcctagactccgtggccgcacctgtgtcttccggatcctcaggtcagcggaggagcggttcaggccttcctcttgctcgatggactgctcgatgcctgggggcacaggtggctgctaagtcataaccaggccccttcaaccccgtcccctacccgcacacccagcatctatccaccttcccacatcccctagggtatgtgtgtggcctgtggctggtgggatcagtgccaggcaccgatggaggaggggcctacagaagcccttccagctgtgacgctgtgtggtgtgtgcatgtgtgtaaatgcacacccactccaagctctgcgtgtgtgtgaggtctggtagctccggccaccctatgcctgggtaccactccttttctgctcagaaaggctgtgtacgagggaccatgcccacagcggggagagccaggtggcccctcctgcagggcatgtggccccgaggccttggcactcatggggtgcacgtgtctgttcacccagaataccgggcttctgcaagagaccaggaagtactggccacttcttcaaccctctttagcagaggtgaggggcagtgcccatccagagtggagccctccctcgccaaagccttaggtgggtgtgtccctgggcccagcccagagtctggcaccaacgggccttgccaagtagctgctgagtgaatgggcacatgacgccaccctcagaaaggaaagcaagatccggcgcaccccctcagggcgagcaaaaccccatgggctccgcagaggaagcaggcctagaatgccccccacccacccccagacaagcctgactcactctttaacttgg

SEQ ID NO: 2652 - DNA, 1219 bp, Homo sapiens
atggcgtcccgcggccggcgtccggagcatggcggacccccagagctgttttatgacgagacagaagcccggaaatacgttcgcaactcacggatgattgatatccagaccaggatggctgggcgagcattggagcttctttatctgccagagaataagccctgttacctgctggatattggctgtggcactgggctgagtggaagttatctgtcagatgaagggcactattgggtgggcctggatatcagccctgccatgctggatgaggctgtggaccgagagatagagggagacctgctgctgggggatatgggccagggcatcccattcaagccaggcacatttgatggttgcatcagcatttctgctgtgcagtggctctgtaatgctaacaagaagtctgaaaaccctgccaagcgcctgtactgcttttttgcttctcttttttctgttctcgtccggggatcccgagctgtcctgcagctgtaccctgagaactcagagcagttggagctgatcacaacccaggccacaaaggcaggcttctccggtggcatggtggtagactaccctaacagtgccaaagcaaagaaattctacctctgcttgttttctgggccttcgacctttataccagaggggctgagtgaaaatcaggatgaagttgaacccagggagtctgtgttcaccaatgagagggaaggtggagcatttgagagaaggggcatccgaggccaccagactcggaggttcccattaaggatgtcgaggcggggaatggtgaggaagagtcgggcatgggtgctggagaagaaggagcggcacaggcgccagggcagggaagtcagacctgacacccagtacaccggccgcaagcgcaagccccgcttctaagtcaccacgcggttctggaaaggcacttgcctctgcacttttctatattgttcagctgacaaagtagtattttagaaaagttctaaagttataaaaatgttttctgcagtaaaaaaaaagttctctgggccgggcgtggtggctcacacctgtaatcccagcaccttgggaggctgaggtgggaggatcatttgaggccaggagtttgagacctgcctgggcaacataatgaaacttcctttccagggaggaaaaaaaaaaaaaaaaaaagctctgagagcatcttattttgtttaaaggcaagaaataaaatttccttttg

SEQ ID NO: 2653 - DNA, 2618 bp, Homo sapiens
agaaggaggatggaggttttgggccccaggggaggacacagagacggcgggatggcgcagggacttgaggcttgagatcccgtccttcagctcaggtcccgtcgcgcttttaccccttcccggtgacctcaacccctttataccgaccccacctctttggagccgggagtaccgcccctgtagggggaggggagaggaggcgatttcgaacgcggattggatcgtctgggcacccgtagttgggaacagcggaacgctggtcccggggactgagtaaggtgtctggatcggagggaggttcgggtgggcatcgggcggctggaagagctcgactcgtcccgctgggaaagcgcgagtctgagtggaaccctggacgacttgcagagcggctggcgcagtcatggcggactactggaagtcacagccaaagaaattctgtgattactgcaagtgctggatagcagacaataggcctagtgttgaatttcatgaaagaggaaagaatcataaggaaaatgtggcaaaaaggatcagtgagattaaacagaaaagcctggataaggcaaaggaagaagaaaaggcatcaaaggagtttgctgcaatggaggcagctgccctgaaagcataccaagaggatttgaaaagacttggcttagagtcagaaattttggagccaagcataacaccagtaaccagcactatcccacctacctcgacatcaaatcaacagaaagaaaagaaagaaaagaagaaaagaaaaaaagatccttcaaagggcagatgggtagaaggcataacctctgagggttaccattactattatgatcttatctcaggagcatctcagtgggagaaacctgaaggatttcaaggagacttaaaaaagacagcagtgaagaccgtttgggtagaaggtttaagtgaagatggttttacctattactataatacagaaacaggagaatccagatgggagaaacctgatgatttcattccacacactagtgatctgccttctagtaaggtcaatgaaaattcacttggcaccctagatgaatccaaatcatcagattcgcatagtgattctgatggggaacaggaagcagaagaaggaggggtctctacagagacagaaaagccaaaaataaagtttaaggaaaaaaataaaaatagtgatggaggaagtgacccagaaacacagaaagaaaaaagtattcagaaacagaattcattaggttcaaatgaagaaaaatcgaaaactcttaagaaatcaaacccatatggagaatggcaagaaattaaacaagaggttgagtctcatgaggaggtagatttggaacttccaagcactgaaaatgagtatgtatcaacttcagaagctgatggtggcggagaacccaaagtggtatttaaagaaaaaacagtcacttctcttggagttatggcagatggagtggccccagtcttcaaaaagagaagaactgaaaatggaaaatctagaaatttaaggcaacgaggtgatgatcaatagttgcaggagagctttttgtacatgcttttaggacagaatggagacttatacacccaaagtttatctgtgtttgtttgtaagtattatgatgctaaaaatttagatttattctaaatgtatttgatgtgaattaaaataaatattttttcatgtgaaatttattttggttcctaaaatggaagcctaccacattgcattgtaatacagtgtattatgttcagtgtctaaaaactgctaattaagtcataatttaagatgctatgtatctgttatttaaaacatggagaaacagggcctttattccattcatattcataagagcatatttatcctgcattgaaaatgcattacttttgcacattgatattaactgttgtccaacaaataagtatcggagtacgtgagaatattcccagcccagtgatgatttggttctgaggctgatgtgagaaagctgatgtaaaaaatgtatgcatattggcttaccttactcaatttaaagtcaaaagccaacagccaggagcagctcaggtacttcagatgtgcttaatatggagtgaaaactggaccagaggtggaaagatgtatttgccccagttcacttcaaagcagcaaacgttgtttaagcattttagtttgaaccaggcattgtgttaggaatccagggataaagatgaatgaaatgtatttctgttcttcaggagttcacattctagcatatgccttttttcccccagtcatgcactctttttagcagtcttatatgtactagaaaagattttttaaagtttatttaaagctgtgtagatgaaggcttgatctaaaatagtataaggtctccagcttcagtaaaagtttttagtgtttacttaaattagtaatttctcactttctgtctggttaaaatgtcttaaaaagtagaattttcttctttaatccgtttagtagttacctcccttttacttttcaaattcacaaaattacatttctcataaattgtatagtatttaacttataatagttaatatttgtctttttaagatgactgtacatgtaagaaaaaagcttattaaaaacttgatcaaag

SEQ ID NO: 2654 - DNA, 1464 bp, Homo sapiens
atcggagggaggttcgggtgggcatcgggcggctggaagagctcgactcgtcccgctgggaaagcgcgagtctgagtggaaccctggacgacttgcagagcggctggcgcagtcatggcggactactggaagtcacagccaaagaaattctgtgattactgcaagtgctggatagcagacaataggcctattaaacagaaaagcctggataaggcaaaggaagaagaaaaggcatcaaaggagtttgctgcaatggaggcagctgccctgaaagcataccaagaggatttgaaaagacttggcttagagtcagaaattttggagccaagcataacaccagtaaccagcactatcccacctacctcgacatcaaatcaacagaaagaaaagaaagaaaagaagaaaagaaaaaaagatccttcaaagggcagatgggtagaaggcataacctctgagggttaccattactattatgatcttatctcaggagcatctcagtgggagaaacctgaaggatttcaaggagacttaaaaaagacagcagtgaagaccgtttgggtagaaggtttaagtgaagatggttttacctattactataatacagaaacaggagaatccagatgggagaaacctgatgatttcattccacacactagtgatctgccttctagtaaggtcaatgaaaattcacttggcaccctagatgaatccaaatcatcagattcgcatagtgattctgatggggaacaggaagcagaagaaggaggggtctctacagagacagaaaagccaaaaataaagtttaaggaaaaaaataaaaatagtgatggaggaagtgacccagaaacacagaaagaaaaaagtattcagaaacagaattcattaggttcaaatgaagaaaaatcgaaaactcttaagaaatcaaacccatatggagaatggcaagaaattaaacaagaggttgagtctcatgaggaggtagatttggaacttccaagcactgaaaatgagtatgtatcaacttcagaagctgatggtggcggagaacccaaagtggtatttaaagaaaaaacagtcacttctcttggagttatggcagatggagtggccccagtcttcaaaaagagaagaactgaaaatggaaaatctagaaatttaaggcaacgaggtgatgatcaatagttgcaggagagctttttgtacatgcttttaggacagaatggagacttatacacccaaagtttatctgtgtttgtttgtaagtattatgatgctaaaaatttagatttattctaaatgtatttgatgtgaattaaaataaatattttttcatgtgaaatttattttggttcctaaaatggaagcctaccacattgcattgtaatacagtgtattatgttcagtgtctaaaaactgctaattaagtcataatttaagatgctatgtatctgttatttaaaacat

SEQ ID NO: 2655 - DNA, 1883 bp, Homo sapiens
ctgaaccccacatctgcacctccaacatctgcttcagcggtccctgtttctcctgttccacagtcgccaatacctcccttacttcaggacccaaatcttcttagacaattgcttcctgctttgcaagccacgctgcagcttaataattctaatgtggacatatctaaaataaatgaagttcttacagcagctgtgacacaagcctcactgcagtctataattcataagtttcttactgctggaccatctgctttcaacataacgtctctgatttctcaagctgctcagctctctacacaagcccagccatctaatcagtctccgatgtctttaacatctgatgcgtcatccccaagatcatatgtttctccaagaataagcacacctcaaactaacacagtccctatcaaacctttgatcagtactcctcctgtttcatcacagccaaaggttagtactccagtagttaagcaaggaccagtgtcacagtcagccacacagcagcctgtaactgctgacaagagcaaggtcatgaacctgtctctcctcgaagtcttcagcgctcaagtagccagagaagtccatcacctggtcccaatcatacttctaatagtagtaatgcatcaaatgcaacagttgtaccacagaattcttctgcccgatccacgtgttcattaacgcctgcactagcagcacacttcagtgaaaatctcataaaacacgttcaaggatggcctgcagatcatgcagagaagcaggcatcaagattacgcgaagaagcgcataacatgggaactattcacatgtccgaaatttgtactgaattaaaaaatttaagatctttagtccgagtatgtgaaattcaagcaactttgcgagagcaaaggatactatttttgagacaacaaattaaggaacttgaaaagctaaaaaatcagaattccttcatggtgtgaagatgtgaataattgcacatggttttgagaacaggaactgtaaatctgttgcccaatcttaacatttttgagctgcatttaagtagactttggaccgttaagctgggcaaaggaaatgacaaggggacggggtctgtgagagtcaattcaggggaaagatacaagattgatttgtaaaacccttgaaatgtagatttcttgtagatgtatccttcacgttgtaaatatgttttgtagagtgaagccatgggaagccatgtgtaacagagcttagacatccaaaactaatcaatgctgaggtggctaaatacctagccttttacatgtaaacctgtctgcaaaattagcttttttaaaaaaaaaaaaaaaaaaattgggggggttaatttatcattcagaaatcttgcattttcaaaaattcagtgcaagcgccaggcgatttgtgtctaaggatacgattttgaaccatatgggcagtgtacaaaatatgaaacaactgtttccacacttgcacctgatcaagagcagtgcttctccatttgttttgcagagaaatgtttttcatttcccgtgtgtttccatttccttctgaaattctgattttatccatttttttaaggctcctctttatctcctttcttaaggcactgttgctatggcacttttctataaccttttcattcctgtgtacagtagcttaaaattgcagtgattgagcataacctacttgtttgtataaattattgaaatccatttgcaccctgttaagaatggacttaaaagtactgctggacaggcatgtgtgctcaaagtacattgattgctcaaatataaggaaatggcccaatgaacgtggttgtgggaggggaaagaggaaacagagctagtcagatgtgaattgtatctgttgtaataaacatgttaaaa

SEQ ID NO: 2656 - DNA, 2839 bp, Homo sapiens
cgtcgtcttgcccccctccccccggttcgcggtgccgccgtgtagttggcgccgctgccccggctgagagtgagcgtggtgtcgacggagggagatggcccgggagcgccggcgccagtaactgggagctgatgagagtcgccgagggcgcgccgggcccaggtgccggggctgcccgccgcccgccgccgccgccgcctgcgcgcccgcccgcctttcgcggccgctctcccccctccccgacacacactcacaggccgggcattgatggtaatgtatgcgaggaaacagcagagactcagtgatggctgtcacgaccggaggggggactcgcagccttaccaggcacttaagtattcatcgaagagtcaccccagtagcggtgatcacagacatgaaaagatgcgagacgccggagatccttcaccaccaaataaaatgttgcggagatctgatagtcctgaaaacaaatacagtgacagcacaggtcacagtaaggccaaaaatgtgcatactcacagagttagagagagggatggtgggaccagttactctccacaagaaaattcacacaaccacagtgctcttcatagttcaaattcacattcttctaatccaagcaataacccaagcaaaacttcagatgcaccttatgattctgcagatgactggtctgagcatattagctcttctgggaaaaagtactactacaattgtcgaacagaagtttcacaatgggaaaaaccaaaagagtggcttgaaagagaacagagacaaaaagaagcaaacaagatggcagtcaacagcttcccaaaagatagggattacagaagagaggtgatgcaagcaacagccactagtgggtttgccagtggaaaatctacatcaggagacaaacccgtatcacattcttgcacaactccttccacgtcttctgcctctggactgaaccccacatctgcacctccaacatctgcttcagcggtccctgtttctcctgttccacagtcgccaatacctcccttacttcaggacccaaatcttcttagacaattgcttcctgctttgcaagccacgctgcagcttaataattctaatgtggacatatctaaaataaatgaagttcttacagcagctgtgacacaagcctcactgcagtctataattcataagtttcttactgctggaccatctgctttcaacataacgtctctgatttctcaagctgctcagctctctacacaagcccagccatctaatcagtctccgatgtctttaacatctgatgcgtcatccccaagatcatatgtttctccaagaataagcacacctcaaactaacacagtccctatcaaacctttgatcagtactcctcctgtttcatcacagccaaaggttagtactccagtagttaagcaaggaccagtgtcacagtcagccacacagcagcctgtaactgctgacaagcagcaaggtcatgaacctgtctctcctcgaagtcttcagcgctcaagtagccagagaagtccatcacctggtcccaatcatacttctaatagtagtaatgcatcaaatgcaacagttgtaccacagaattcttctgcccgatccacgtgttcattaacgcctgcactagcagcacacttcagtgaaaatctcataaaacacgttcaaggatggcctgcagatcatgcagagaagcaggcatcaagattacgcgaagaagcgcataacatgggaactattcacatgtccgaaatttgtactgaattaaaaaatttaagatctttagtccgagtatgtgaaattcaagcaactttgcgagagcaaaggatactatttttgagacaacaaattaaggaacttgaaaagctaaaaaatcagaattccttcatggtgtgaagatgtgaataattgcacatggttttgagaacaggaactgtaaatctgttgcccaatcttaacatttttgagctgcatttaagtagactttggaccgttaagctgggcaaaggaaatgacaaggggacggggtctgtgagagtcaattcaggggaaagatacaagattgatttgtaaaacccttgaaatgtagatttcttgtagatgtatccttcacgttgtaaatatgttttgtagagtgaagccatgggaagccatgtgtaacagagcttagacatccaaaactaatcaatgctgaggtggctaaatacctagccttttacatgtaaacctgtctgcaaaattagcttttttaaaaaaaaaaaaaaaaaaattgggggggttaatttatcattcagaaatcttgcattttcaaaaattcagtgcaagcgccaggcgatttgtgtctaaggatacgattttgaaccatatgggcagtgtacaaaatatgaaacaactgtttccacacttgcacctgatcaagagcagtgcttctccatttgttttgcagagaaatgtttttcatttcccgtgtgtttccatttccttctgaaattctgattttatccatttttttaaggctcctctttatctcctttcttaaggcactgttgctatggcacttttctataaccttttcattcctgtgtacagtagcttaaaattgcagtgattgagcataacctacttgtttgtataaattattgaaatccatttgcaccctgttaagaatggacttaaaagtactgctggacaggcatgtgtgctcaaagtacattgattgctcaaatataaggaaatggcccaatgaacgtggttgtgggaggggaaagaggaaacagagctagtcagatgtgaattgtatctgttgtaataaacatgttaaaacaaacaaaaa

SEQ ID NO: 2657 - DNA, 3042 bp, Homo sapiens
cgccggcgccagtaactgggagctgatgagagtcgccgagggcgcgccgggcccaggtgccggggctgcccgccgcccgccgccgccgccgcctgcgcgcccgcccgcctttcgcggccgctctcccccctccccgacacacactcacaggccgggcattgatggtaatgtatgcgaggaaacagcagagactcagtgatggctgtcacgaccggaggggggactcgcagccttaccaggcacttaagtattcatcgaagagtcaccccagtagcggtgatcacagacatgaaaagatgcgagacgccggagatccttcaccaccaaataaaatgttgcggagatctgatagtcctgaaaacaaatacagtgacagcacaggtcacagtaaggccaaaaatgtgcatactcacagagttagagagagggatggtgggaccagttactctccacaagaaaattcacacaaccacagtgctcttcatagttcaaattcacattcttctaatccaagcaataacccaagcaaaacttcagatgcaccttatgattctgcagatgactggtctgagcatattagctcttctgggaaaaagtactactacaattgtcgaacagaagtttcacaatgggaaaaaccaaaagagtggcttgaaagagaacagagacaaaaagaagcaaacaagatggcagtcaacagcttcccaaaagatagggattacagaagagaggtgatgcaagcaacagccactagtgggtttgccagtggaatggaagacaagcattccagtgatgccagtagtttgctcccacagaatattttgtctcaaacaagcagacacaatgacagagactacagactgccaagagcagagactcacagtagttctacgccagtacagcaccccatcaaaccagtggttcatccaactgctaccccaagcactgttccttctagtccatttacgctacagtctgatcaccagccaaagaaatcatttgatgctaatggagcatctactttatcaaaactgcctacacccacatcttctgtccctgcacagaaaacagaaagaaaagaatctacatcaggagacaaacccgtatcacattcttgcacaactccttccacgtcttctgcctctggactgaaccccacatctgcacctccaacatctgcttcagcggtccctgtttctcctgttccacagtcgccaatacctcccttacttcaggacccaaatcttcttagacaattgcttcctgctttgcaagccacgctgcagcttaataattctaatgtggacatatctaaaataaatgaagttcttacagcagctgtgacacaagcctcactgcagtctataattcataagtttcttactgctggaccatctgctttcaacataacgtctctgatttctcaagctgctcagctctctacacaagcccagccatctaatcagtctccgatgtctttaacatctgatgcgtcatccccaagatcatatgtttctccaagaataagcacacctcaaactaacacagtccctatcaaacctttgatcagtactcctcctgtttcatcacagccaaaggttagtactccagtagttaagcaaggaccagtgtcacagtcagccacacagcagcctgtaactgctgacaagcagcaaggtcatgaacctgtctctcctcgaagtcttcagcgctcaagtagccagagaagtccatcacctggtcccaatcatacttctaatagtagtaatgcatcaaatgcaacagttgtaccacagaattcttctgcccgatccacgtgttcattaacgcctgcactagcagcacacttcagtgaaaatctcataaaacacgttcaaggatggcctgcagatcatgcagagaagcaggcatcaagattacgcgaagaagcgcataacatgggaactattcacatgtccgaaatttgtactgaattaaaaaatttaagatctttagtccgagtatgtgaaattcaagcaactttgcgagagcaaaggatactatttttgagacaacaaattaaggaacttgaaaagctaaaaaatcagaattccttcatggtgtgaagatgtgaataattgcacatggttttgagaacaggaactgtaaatctgttgcccaatcttaacatttttgagctgcatttaagtagactttggaccgttaagctgggcaaaggaaatgacaaggggacggggtctgtgagagtcaattcaggggaaagatacaagattgatttgtaaaacccttgaaatgtagatttcttgtagatgtatccttcacgttgtaaatatgttttgtagagtgaagccatgggaagccatgtgtaacagagcttagacatccaaaactaatcaatgctgaggtggctaaatacctagccttttacatgtaaacctgtctgcaaaattagcttttttaaaaaaaaaaaaaaaaaaattgggggggttaatttatcattcagaaatcttgcattttcaaaaattcagtgcaagcgccaggcgatttgtgtctaaggatacgattttgaaccatatgggcagtgtacaaaatatgaaacaactgtttccacacttgcacctgatcaagagcagtgcttctccatttgttttgcagagaaatgtttttcatttcccgtgtgtttccatttccttctgaaattctgattttatccatttttttaaggctcctctttatctcctttcttaaggcactgttgctatggcacttttctataaccttttcattcctgtgtacagtagcttaaaattgcagtgattgagcataacctacttgtttgtataaattattgaaatccatttgcaccctgttaagaatggacttaaaagtactgctggacaggcatgtgtgctcaaagtacattgattgctcaaatataaggaaatggcccaatgaacgtggttgtgggaggggaaagaggaaacagagctagtcagatgtgaattgtatctgttgtaataaacatgttaaaacaaacaaaaa

SEQ ID NO: 2658 - DNA, 3811 bp, Homo sapiens
ggtggcgcgcggcgtccggtgaggggcagcggcccgggctcggttccggcttccagcagcggcccgaaggcgccggagcacgctccccgctccccagaacgcagcttccgcggctgcagcccaggcagctcttcgggaagcgtccgcccgtggtctcgccagggggtttccgacctccccgcccgacagcgcaggggcgggggccgcggccggagagctcgcccgagagcaccccctcccgctgcgcctctgggcgcacgcgcagccgctgcagcctcccttatttagtccgcgatggcttccctcgcgccccaccgtcctcttccggaaggcggctccctccctgcgcagcccggagcccctgagatcagcctcgagcaggcgcccgagcgagactatccctaaacgggaacggcggtggccgactcgcgagtgaggaaaagaaggaaagggcagactggtcgcgaagagaagatccaggcctcagaggaggagaaaggccggagccagccgagctgtcacgaccggaggggggactcgcagccttaccaggcacttaagtattcatcgaagagtcaccccagtagcggtgatcacagacatgaaaagatgcgagacgccggagatccttcaccaccaaataaaatgttgcggagatctgatagtcctgaaaacaaatacagtgacagcacaggtcacagtaaggccaaaaatgtgcatactcacagagttagagagagggatggtgggaccagttactctccacaagaaaattcacacaaccacagtgctcttcatagttcaaattcacattcttctaatccaagcaataacccaagcaaaacttcagatgcaccttatgattctgcagatgactggtctgagcatattagctcttctgggaaaaagtactactacaattgtcgaacagaagtttcacaatgggaaaaaccaaaagagtggcttgaaagagaacagagacaaaaagaagcaaacaagatggcagtcaacagcttcccaaaagatagggattacagaagagaggtgatgcaagcaacagccactagtgggtttgccagtggaatggaagacaagcattccagtgatgccagtagtttgctcccacagaatattttgtctcaaacaagcagacacaatgacagagactacagactgccaagagcagagactcacagtagttctacgccagtacagcaccccatcaaaccagtggttcatccaactgctaccccaagcactgttccttctagtccatttacgctacagtctgatcaccagccaaagaaatcatttgatgctaatggagcatctactttatcaaaactgcctacacccacatcttctgtccctgcacagaaaacagaaagaaaagaatctacatcaggagacaaacccgtatcacattcttgcacaactccttccacgtcttctgcctctggactgaaccccacatctgcacctccaacatctgcttcagcggtccctgtttctcctgttccacagtcgccaatacctcccttacttcaggacccaaatcttcttagacaattgcttcctgctttgcaagccacgctgcagcttaataattctaatgtggacatatctaaaataaatgaagttcttacagcagctgtgacacaagcctcactgcagtctataattcataagtttcttactgctggaccatctgctttcaacataacgtctctgatttctcaagctgctcagctctctacacaagcccagccatctaatcagtctccgatgtctttaacatctgatgcgtcatccccaagatcatatgtttctccaagaataagcacacctcaaactaacacagtccctatcaaacctttgatcagtactcctcctgtttcatcacagccaaaggttagtactccagtagttaagcaaggaccagtgtcacagtcagccacacagcagcctgtaactgctgacaagcagcaaggtcatgaacctgtctctcctcgaagtcttcagcgctcaagtagccagagaagtccatcacctggtcccaatcatacttctaatagtagtaatgcatcaaatgcaacagttgtaccacagaattcttctgcccgatccacgtgttcattaacgcctgcactagcagcacacttcagtgaaaatctcataaaacacgttcaaggatggcctgcagatcatgcagagaagcaggcatcaagattacgcgaagaagcgcataacatgggaactattcacatgtccgaaatttgtactgaattaaaaaatttaagatctttagtccgagtatgtgaaattcaagcaactttgcgagagcaaaggatactatttttgagacaacaaattaaggaacttgaaaagctaaaaaatcagaattccttcatggtgtgaagatgtgaataattgcacatggttttgagaacaggaactgtaaatctgttgcccaatcttaacatttttgagctgcatttaagtagactttggaccgttaagctgggcaaaggaaatgacaaggggacggggtctgtgagagtcaattcaggggaaagatacaagattgatttgtaaaacccttgaaatgtagatttcttgtagatgtatccttcacgttgtaaatatgttttgtagagtgaagccatgggaagccatgtgtaacagagcttagacatccaaaactaatcaatgctgaggtggctaaatacctagccttttacatgtaaacctgtctgcaaaattagcttttttaaaaaaaaaaaaaaaaaaattgggggggttaatttatcattcagaaatcttgcattttcaaaaattcagtgcaagcgccaggcgatttgtgtctaaggatacgattttgaaccatatgggcagtgtacaaaatatgaaacaactgtttccacacttgcacctgatcaagagcagtgcttctccatttgttttgcagagaaatgtttttcatttcccgtgtgtttccatttccttctgaaattctgattttatccatttttttaaggctcctctttatctcctttcttaaggcactgttgctatggcacttttctataaccttttcattcctgtgtacagtagcttaaaattgcagtgattgagcataacctacttgtttgtataaattattgaaatccatttgcaccctgttaagaatggacttaaaagtactgctggacaggcatgtgtgctcaaagtacattgattgctcaaatataaggaaatggcccaatgaacgtggttgtgggaggggaaagaggaaacagagctagtcagatgtgaattgtatctgttgtaataaacatgttaaaacaaacaaaaattgttatttttcttttccttcggtcagtgcacattagcatttgaactacctggggattctttatcagaactgttcttgttgaatatttatacttaattgaaataattccttaagggaggttttgtttaaaacgtattaacaggaaattgtgtatgagatatttaatgaaataagaaattcaacaagaatgattaagtcacttcccaagtggttgtcatttgttaaaccctggtttacctgtcttgctattatgacatttcatttggaaggatgtttgtgttgtagctaactgttcaagtctggtgctgactgctgttcttagccatcacaaaacgctaaatttgtgtaattggagcttcctgctgttatctggaaatagcaggaaagcgcagctttgtatattgtttcctaaagtatattaaaataaaaaaagaaactattgctactataaaatta

SEQ ID NO: 2659 - DNA, 816 bp, Homo sapiens
tacaggcccttcggtgcaacacatctgaaactagcaccgcggatccccttaaaattccaggcacttaagtattcatcgaagagtcaccccagtagcggtgatcacagacatgaaaagatgcgagacgccggagatccttcaccaccaaataaaatgttgcggagatctgatagtcctgaaaacaaatacagtgacagcacaggtcacagtaaggccaaaaatgtgcatactcacagagttagagagagggatggtgggaccagttactctccacaagaaaattcacacaaccacagtgctcttcatagttcaaattcacattcttctaatccaagcaataacccaagcaaaacttcagatgcaccttatgattctgcagatgactggtctgagcatattagctcttctgggaaaaagtactactacaattgtcgaacagaagtttcacaatgggaaaaaccaaaagagtggcttgaaagagaacagagacaaaaagaagcaaacaagatggcagtcaacagcttcccaaaagatagggattacagaagagaggtgatgcaagcaacagccactagtgggtttgccagtggaatggaagacaagcattccagtgatgccagtagtttgctcccacagaatattttgtctcaaacaagcagacacaatgacagagactacagactgccaagagcagagactcacagtagttctacgccagtacagcaccccatcaaaccagtggttcatccaactgctaccccaagcactgttccttctagtccatttacgctacagtctgatcaccagccaaagaaa

SEQ ID NO: 2660 - DNA, 784 bp, Homo sapiens
gccgcctgcgcgcccgcccgcctttcgcggccgctctcccccctccccgacacacactcacaggccgggcattgatgctgtcacgaccggaggggggactcgcagccttaccaggcacttaagtattcatcgaagagtcaccccagtagcggtgatcacagacatgaaaagatgcgagacgccggagatccttcaccaccaaataaaatgttgcggagatctgatagtcctgaaaacaaatacagtgacagcacaggtcacagtaaggccaaaaatgtgcatactcacagagttagagagagggatggtgggaccagttactctccacaagaaaattcacacaaccacagtgctcttcatagttcaaattcacattcttctaatccaagcaataacccaagcaaaacttcagatgcaccttatgattctgcagatgactggtctgagcatattagctcttctgggaaaaagtactactacaattgtcgaacagaagtttcacaatgggaaaaaccaaaagagtggcttgaaagagaacagagacaaaaagaagcaaacaagatggcagtcaacagcttcccaaaagatagggattacagaagagaggtgatgcaagcaacagccactagtgggtttgccagtggaatggaagacaagcattccagtgatgccagtagtttgctcccacagaatattttgtctcaaacaagcagacacaatgacagagactacagactgccaagagcagagactcacagtagttctacgccagtacagcacccca

SEQ ID NO: 2661 - DNA, 1330 bp, Homo sapiens
tctcccccctccccgacacacactcacaggccgggcattgatggtaatgtatgcgaggaaacagcagagactcagtgatggctgtcacgaccggaggggggactcgcagccttaccaggtgactggagggagttcgctgatttaggaaaaaagaatcatttgcagccagaaagacctgactcgattatttgattatttgcgagtgaaggaatcgatgggatgagatgataggcacttaagtattcatcgaagagtcaccccagtagcggtgatcacagacatgaaaagatgcgagacgccggagatccttcaccaccaaataaaatgttgcggagatctgatagtcctgaaaacaaatacagtgacagcacaggtcacagtaaggccaaaaatgtgcatactcacagagttagagagagggatggtgggaccagttactctccacaagaaaattcacacaaccacagtgctcttcatagttcaaattcacattcttctaatccaagcaataacccaagcaaaacttcagatgcaccttatgattctgcagatgactggtctgagcatattagctcttctgggaaaaagtactactacaattgtcgaacagaagtttcacaatgggaaaaaccaaaagagtggcttgaaagagaacagagacaaaaagaagcaaacaagatggcagtcaacagcttcccaaaagatagggattacagaagagaggtgatgcaagcaacagccactagtgggtttgccagtggaatggaagacaagcattccagtgatgccagtagtttgctcccacagaatattttgtctcaaacaagcagacacaatgacagagactacagactgccaagagcagagactcacagtagttctacgccagtacagcaccccatcaaaccagtggttcatccaactgctaccccaagcactgttccttctagtccatttacgctacagtctgatcaccagccaaagaaatcatttgatgctaatggagcatctactttatcaaaactgcctacacccacatcttctgtccctgcacagaaaacagaaagaaaagaatctacatcaggagacaaacccgtatcacattcttgcacaactccttccacgtcttctgcctctggactgaaccccacatctgcacctccaacatctgcttcagcggtccctgtttctcctgttccacagtcgccaatacctcccttacttcaggacccaaatcttcttagacaattgcttcctgctttgcaagccacgctgcagcttaataattctaatgtggacatatctaaaataaatgaagttcttacagcag

SEQ ID NO: 2662 - DNA, 1531 bp, Homo sapiens
ccgccgccgccgccgcctgcgcgcccgcccgcctttcgcggccgctctcccccctccccgacacacactcacaggccgggcattgatggtaatgtatgcgaggaaacagcagagactcagtgatggctgtcacgaccggaggggggactcgcagccttaccaggcacttaagtattcatcgaagagtcaccccagtagcggtgatcacagacatgaaaagatgcgagacgccggagatccttcaccaccaaataaaatgttgcggagatctgatagtcctgaaaacaaatacagtgacagcacaggtcacagtaaggccaaaaatgtgcatactcacagagttagagagagggatggtgggaccagttactctccacaagaaaattcacacaaccacagtgctcttcatagttcaaattcacattcttctaatccaagcaataacccaagcaaaacttcagatgcaccttatgattctgcagatgactggtctgagcatattagctcttctgggaaaaagtactactacaattgtcgaacagaagtttcacaatgggaaaaaccaaaagagtggcttgaaagagaacagagacaaaaagaagcaaacaagatggcagtcaacagcttcccaaaagatagggattacagaagagaggtgatgcaagcaacagccactagtgggtttgccagtggaatggaagacaagcattccagtgatgccagtagtttgctcccacagaatattttgtctcaaacaagcagacacaatgacagagactacagactgccaagagcagagactcacagtagttctacgccagtacagcaccccatcaaaccagtggttcatccaactgctaccccaagcactgttccttctagtccatttacgctacagtctgatcaccagccaaagaaatcatttgatgctaatggagcatctactttatcaaaactgcctacacccacatcttctgtccctgcacagaaaacagaaagaaaagaatctacatcaggagacaaacccgtatcacattcttgcacaactccttccacgtcttctgcctctggactgaaccccacatctgcacctccaacatctgcttcagcggtccctgtttctcctgttccacagtcgccaatacctcccttacttcaggacccaaatcttcttagacaattgcttcctgctttgcaagccacgctgcagcttaataattctaatgtggacatatctaaaataaatgaagttcttacagcagctgtgacacaagcctcactgcagtctataattcataagtttcttactgctggaccatctgctttcaacataacgtctctgatttctcaagctgctcagctctctacacaagatatccctcttcatgaaggtatccaaatggagagagatacacataggagcaaatgggaagtgaaagggtcactttgtcagaaagctgataaacagcaggaatgccttgtctggaatggaagtataatggtgcaaagactcttgcaaccctctggctag

SEQ ID NO: 2663 - DNA, 759 bp, Homo sapiens
gaggagcggccgcgcgggcgggcgggcgggaacgcagtgtggcggggagcgggggcccggcttcgcggcatttcgccctctccggcccttccggaggctccgggtttgtgccgtgtgcgtgcggggctcggcgctggggcgctcgctgtcacgaccggaggggggactcgcagccttaccaggcacttaagtattcatcgaagagtcaccccagtagcggtgatcacagacatgaaaagatgcgagacgccggagatccttcaccaccaaataaaatgttgcggagatctgatagtcctgaaaacaaatacagtgacagcacaggtcacagtaaggccaaaaatgtgcatactcacagagttagagagagggatggtgggaccagttactctccacaagaaaattcacacaaccacagtgctcttcatagttcaaattcacattcttctaatccaagcaataacccaagcaaaacttcagatgcaccttatgattctgcagatgactggtctgagcatattagctcttctgggaaaaagtactactacaattgtcgaacagaagtttcacaatgggaaaaaccaaaagagtggcttgaaagagaacagagacaaaaagaagcaaacaagatggcagtcaacagcttcccaaaagatagggattacagaagagaggtgatgcaagcaacagccactagtgggtttgccagtggaatggaagacaagcattccagtgatgccagtagtttgctcccacaga

SEQ ID NO: 2664 - DNA, 506 bp, Homo sapiens
cgggcgggcgggcgggaacgcagtgtggcggggagcgggggcccggcttcgcggcatttcgccctctccggcccttccggaggctccgggtttgtgccgtgtgcgtgcggggctcggcgctggggcgctcggtaggtctcccgcggggaggggcggcgggggccccgttttcttcctccccggccccccacccgcgccgtgtcttatgtcgctgccttctcttcctgtttttcagctgtcacgaccggaggggggactcgcagccttaccaggcacttaagtattcatcgaagagtcaccccagtagcggtgatcacagacatgaaaagatgcgagacgccggagatccttcaccaccaaataaaatgttgcggagatctgatagtcctgaaaacaaatacagtgacagcacaggtcacagtaaggccaaaaatgtgcatactcacagagttagagagagggatggtgggaccagttactctccacaagaaaattcacacaaccac

SEQ ID NO: 2665 - DNA, 585 bp, Homo sapiens
ttatttagtccgcgatggcttccctcgcgccccaccgtcctcttccggaaggcggctccctccctgcgcagcccggagcccctgagatcagcctcgagcaggcgcccgagcgagactatccctaaacgggaacggcggtggccgactcgcgagtgaggaaaagaaggaaagggcagactggtcgcgaagagaagatccaggcctcagaggaggagaaaggccggagccagccgagctgtcacgaccggaggggggactcgcagccttaccaggtaccagccgaggccggggtggagggattggaaggggccggagggggaagggagggactgctactcgagcgcaggcctcagaagtcgatacaggcccttcggtgcaacacatctgaaactagcaccgcggatccccttaaaattccaggcacttaagtattcatcgaagagtcaccccagtagcggtgatcacagacatgaaaagatgcgagacgccggagatccttcaccaccaaataaaatgttgcggagatctgatagtcctgaaaacaaatacagtgacagcacaggtcacagtaaggccaaaaatgtg

SEQ ID NO: 2666 - DNA, 1520 bp, Homo sapiens
gaaacagcagagactcagtgatggctgtcacgaccggaggggggactcgcagccttaccaggggggtgatgttttacaggcacttaagtattcatcgaagagtcaccccagtagcggtgatcacagacatgaaaagatgcgagacgccggagatccttcaccaccaaataaaatgttgcggagatctgatagtcctgaaaacaaatacagtgacagcacaggtcacagtaaggccaaaaatgtgcatactcacagagttagagagagggatggtgggaccagttactctccacaagaaaattcacacaaccacagtgctcttcatagttcaaattcacattcttctaatccaagcaataacccaagcaaaacttcagatgcaccttatgattctgcagatgactggtctgagcatattagctcttctgggaaaaagtactactacaattgtcgaacagaagtttcacaatgggaaaaaccaaaagagtggcttgaaagagaacagagacaaaaagaagcaaacaagatggcagtcaacagcttcccaaaagatagggattacagaagagaggtgatgcaagcaacagccactagtgggtttgccagtggaatggaagacaagcattccagtgatgccagtagtttgctcccacagaatattttgtctcaaacaagcagacacaatgacagagactacagactgccaagagcagagactcacagtagttctacgccagtacagcaccccatcaaaccagtggttcatccaactgctaccccaagcactgttccttctagtccatttacgctacagtctgatcaccagccaaagaaatcatttgatgctaatggagcatctactttatcaaaactgcctacacccacatcttctgtccctgcacagaaaacagaaagaaaagaatctacatcaggagacaaacccgtatcacattcttgcacaactccttccacgtcttctgcctctggactgaaccccacatctgcacctccaacatctgcttcaggacccaaatcttcttagacaattgcttcctgctttgcaagccacgctgcagcttaataattctaatgtggacatatctaaaataaatgaagttcttacagcagctgtgacacaagcctcactgcagtctataattcataagtttcttactgctggaccatctgctttcaacataacgtctctgatttctcaagctgctcagctctctacacaagcccagccatctaatcagtctccgatgtctttaacatctgatgcgtcatccccaagatcatatgtttctccaagaataagcacacctcaaactaacacagtccctatcaaacctttgatcagtactcctcctgtttcatcacagccaaaggttagtactccagtagttaagcaaggaccagtgtcacagtcagccacacagcagcctgtaactgctgacaagcagcaaggtcatgaacctgtctctcctcgaagtcttcagcgctcaagtagccagagaagt

SEQ ID NO: 2667 - DNA, 5593 bp, Homo sapiens
gtttacacgctccggggcctgtaggcgccgcgagttccggctgtcgccgtcgccgccgcggctcctggaggtcggttgcgacgagtaacggcgccaggacgagccctgcgccttctttttcgatatgtacccgaattggggccggtatggcgggagcagccactatccgccgccaccggtcccaccgccgccgccagtggcgcttcctgaggcctcgccggggcccgggtactcgagctcgacgactcccgcggccccctcctcctcgggcttcatgagcttccgcgaacagcacttggcgcagctccagcagctgcagcagatgcaccagaagcaaatgcagtgcgtgcttcagccccaccaccttcctccgccccctctgccgcccccgccagtgatgccggggggcggctacggagactggcagccgccaccgccaccgatgcccccgccacccgggccggccctcagctatcagaagcagcagcagtacaaacaccagatgctccaccaccaacgagacgggcctcctggtttggttccaatggagctggaatccccccctgaatctccccctgtgccgcctgggtcctatatgcccccatctcagtcttacatgcccccacctcagccgccaccctcttactaccccccgacctcatctcagccctacctgcctcctgctcagccgtccccttcgcagtccccaccttcccaatcctacctggcgcccaccccttcttactcatcctcctcctcttcctcgcaatcctatttgagccattcccagtcctacttgccctcttctcaggcatctccttcccgcccctcccagggccattctaaatcccaactactagctccaccaccaccgtccgccccccctggaaataagacaactgtccagcaagagcctttggagagtggggccaaaaacaagagtactgaacagcagcaagccgcccctgagccagatccctctacgatgactccacaggaacagcagcagtattggtatcgacagcacttgcttagtttgcaacagaggacaaaagttcatttgccaggacacaaaaagggtcctgtggtagcaaaggatacaccagagccggtaaaagaagaagttacagtacctgccaccagtcaagttccagaatctccttcttctgaggagcccccattgccacctccaaatgaggaagtgccacctcctctcccacctgaggaaccccagtctgaggacccagaagaagatgccaggttaaagcagttgcaggctgcagcagcacactggcagcagcaccagcagcatcgagtcggtttccagtatcagggaataatgcagaagcacactcagttacagcagattctacaacagtatcagcagattatacagcccccaccacatatacaggcaactacacctcctccaggaatacctccccctggagttccacaagggatacctcctcagttaacagcagccccagttccaccagcctccagttcacagagctcgcaagttccagagaaacctagaccagcactgcttcctactcctgtgtcttttggttctgccccaccgacaacttaccatcctccgttgcaatcagctggtccatcagaacaagtgaattcaaaagctcctttgagcaagtctgctctgccatacagttcattctcatctgatcaaggacttggggagtcttcagctgctccatctcagccaatcactgcagtgaaggacatgccagtgagatcaggtggcctgcttccagatcctcctagaagtagttacttggaaagtccaagaggcccaagatttgatggtcctcgaagatttgaggatttagggtcaaggtgtgaaggaccgagacccaaagggcctcgttttgaaggaaatcgccccgatgggccaagacccagatatgaaggtcacccagcagagggcactaaaagcaagtggggaatgattccccgggggccagcatctcaattttatattacccccagtacatccctaagtcctcgacagagtggaccacagtggaaaggccccaaaccagcttttggacagcagcatcagcagcaacctaagtcacaagcagaacctctttcaggaaacaaagaaccattagcagacaccagtagtaaccagcagaagaattttaaaatgcaatcagctgcattttccattgctgcagatgtaaaggatgtcaaggcggctcagtcaaatgagaatctaagcgactctcaacaagagccacctaaaagtgaagtctcggaagggcccgtagagccctctaattgggaccagaatgttcaaagtatggagactcaaatcgacaaagcccaagctgttactcagcctgtaccccttgcgaataagcctgtacctgctcaatctacttttccttcaaaaacaggggggatggagggaggaacagcagtagcaacatcatcattaacagcagataatgattttaaacctgtgggtattggtctaccccattcagaaaacaaccaagataaaggcctgcctcggccagataatagagataatagattagaaggcaatagaggcaacagctcatcttacagaggtcctgggcaaagcagaatggaagacacacgggataaaggtctagtaaacagaggtcgcggccaggcaatcagtcgaggcccaggattggtcaagcaagaagactttcgggataagatgatgggtagaagagaagatagtcgagagaagatgaacagaggagaaggtagccgggacagagggttggtgaggcctggaagcagtcgggagaaagtgccaggtggtcttcaagggagccaggacaggggtgcagctggcagccgagaaaggggaccacctcggagggctggcagtcaggagaggggacctcttcgaagggctgggagtagagagagaataccaccccgaagagctgggagcagggagagaggaccacctcgagggcctggcagtcgagaaaggggactgggaagatcagattttggtcgtgatagaggtccattcagaccagaaccaggagatggtggggaaaaaatgtatccatatcaccgggatgagcctcctagggctccatggaaccatggagaagagcgagggcatgaagagtttccattagatggtagaaatgctccaatggaacgagaaagactcgatgactgggatagagagagatactggagagaatgtgaacgtgactatcaagatgatacactagagctctataacagagaggacaggttctcagcaccaccatctcggtctcatgatggagataggcgaggcccttggtgggatgattgggagagagaccaggatatggatgaggactacaatagggaaatggaaagggacatggacagggatgtggatcggatttcaagacctatggatatgtatgatagaagtttggataatgagtgggacagagattatgggagaccactggatgaacaagaatcacagtttcgtgaacgggatattccatctcttccacctttaccgcccctcccacctcttccacctttggatagatatcgggatgatagatggagagaagaaagaaatcgagagcatgggtatgatcgagatttccgtgataggggtgagttgaggattcgagagtatccagaaagaggagatacatggcgggaaaagcgagattatgttcctgacagaatggactgggaaagagaacggttgtcagacagatggtacccatctgatgtggatagacattcccccatggcggaacatatgccctcctcacatcattcctcagaaatgatggggtccgatgcaagcttagactctgaccaaggccttggaggggtaatggttctcagtcagaggcagcatgaaatcattttgaaagctgcacaagaactgaaaatgcttcgggaacagaaagaacagcttcaaaagatgaaagacttcgggtctgagccacagatggctgaccatctaccacctcaggaatcaagattgcagaatacatcttcaagacctggaatgtatccgcctccagggtcgtatagacctccccctcctatgggcaaaccaccaggttcaattgtaagaccctctgctccaccagcaagatcatctgttcctgtgaccaggccacctgtcccaataccaccacctccacctcctccacctctacctcctcctcctccagtgataaagccacaaacttcagctgtagaacaggaacgatgggatgaagattctttctatgggctctgggatacaaatgatgaacaaggactgaattcagaatttaagtcagaaactgcagcaattccatctgctccagtattaccacccccacctgttcactcttccattccccctcctggcccagtgcctatgggtatgccaccaatgtccaagccaccaccagtacaacagactgttgattatggccatggccgagatatatccactaataaagttgaacagataccttatggagaaagaataactctacgcccagatccactacctgaaagatcaacttttgagacagagcatgcaggccaacgtgatcgttatgatagagaaagagatcgtgagccttattttgatcgtcaaagtaatgtcatagcagatcatcgagattttaaaagggatcgtgagacacatagagatcgagaccgggatcgtggtgttattgactatgaccgggatcgatttgacagagaacgccgaccccgagatgatagagctcagtcatatcgagacaaaaaagaccattcctcatccagaagagggggttttgataggccatcctatgaccggaagtctgaccgaccagtctatgaaggaccatccatgtttggaggagaacgaaggacttatcctgaggagcgaatgcctctgccagctccttcactgagccaccagcctcctccagctccacgagtcgagaagaagcctgaatcaaagaatgtggacgatattttgaaaccaccgggccgggagagcagacctgagagaattgttgttataatgagaggattacctggcagtggaaagacacatgttgcaaaacttattcgagtaatggaatatgaatatgaagctgagatggaggagacttaccgcaccagcatgttcaaaactttcaaaaagactctggatgatggcttttttcccttcatcatcctggatgccatcaatgacagagttaggcattttgaccagttttggagtgcagcaaaaaccaagggatttgaggtatatttggctgaaatgagtgcagataaccagacttgtggcaagagaaatattcatggaagaaagcttaaagaaataaataagatggctgatcactgggaaactgcacctcgtcacatgatgcgtctagatattcgttctttgctgcaagatgctgctattgaagaggtagagatggaagattttgatgcaaatatcgaagaacagaaagaagaaaagaaagatgcagaggaagaggaaagcgaactggtaggagacagaccaaccactttgaacagtgtctctttattaaaattcttaaagaaggtttaa

SEQ ID NO: 2668 - DNA, 7017 bp, Homo sapiens
gtttacacgctccggggcctgtaggcgccgcgagttccggctgtcgccgtcgccgccgcggctcctggaggtcggttgcgacgagtaacggcgccaggacgagccctgcgccttctttttcgatatgtacccgaattggggccggtatggcgggagcagccactatccgccgccaccggtcccaccgccgccgccagtggcgcttcctgaggcctcgccggggcccgggtactcgagctcgacgactcccgcggccccctcctcctcgggcttcatgagcttccgcgaacagcacttggcgcagctccagcagctgcagcagatgcaccagaagcaaatgcagtgcgtgcttcagccccaccaccttcctccgccccctctgccgcccccgccagtgatgccggggggcggctacggagactggcagccgccaccgccaccgatgcccccgccacccgggccggccctcagctatcagaagcagcagcagtacaaacaccagatgctccaccaccaacgagacgggcctcctggtttggttccaatggagctggaatccccccctgaatctccccctgtgccgcctgggtcctatatgcccccatctcagtcttacatgcccccacctcagccgccaccctcttactaccccccgacctcatctcagccctacctgcctcctgctcagccgtccccttcgcagtccccaccttcccaatcctacctggcgcccaccccttcttactcatcctcctcctcttcctcgcaatcctatttgagccattcccagtcctacttgccctcttctcaggcatctccttcccgcccctcccagggccattctaaatcccaactactagctccaccaccaccgtccgccccccctggaaataagacaactgtccagcaagagcctttggagagtggggccaaaaacaagagtactgaacagcagcaagccgcccctgagccagatccctctacgatgactccacaggaacagcagcagtattggtatcgacagcacttgcttagtttgcaacagaggacaaaagttcatttgccaggacacaaaaagggtcctgtggtagcaaaggatacaccagagccggtaaaagaagaagttacagtacctgccaccagtcaagttccagaatctccttcttctgaggagcccccattgccacctccaaatgaggaagtgccacctcctctcccacctgaggaaccccagtctgaggacccagaagaagatgccaggttaaagcagttgcaggctgcagcagcacactggcagcagcaccagcagcatcgagtcggtttccagtatcagggaataatgcagaagcacactcagttacagcagattctacaacagtatcagcagattatacagcccccaccacatatacagaccatgtctgtagatatgcagctgcggcattatgagatgcagcagcaacagtttcaacatctttaccaagaatgggagcgagagtttcagctatgggaggaacaactccattcctatcctcataaagatcagcttcaggagtatgagaagcagtggaaaacatggcagggacatatgaaagccactcagagctatctccaggagaaagtcaattcatttcagaacatgaagaaccagtatatggggaacatgtcaatgccacctccttttgttccatattctcagatgcctccacctctacctacaatgccccctccagtgttgcctccttcattgccaccaccagtgatgccccctgccctccctgctacagtgccaccacctggcatgcccccacctgttatgccaccttctctaccaacctctgttcccccaccagggatgcctccttctctctcttctgcagggccaccaccagttctccccccaccttccctgtcttctgcagggccaccaccagttcttcccccaccatctctctcttcaacagcacctccacctgtcatgcccctcccaccattgtcttcagctacacctcctccaggaatacctccccctggagttccacaagggatacctcctcagttaacagcagccccagttccaccagcctccagttcacagagctcgcaagttccagagaaacctagaccagcactgcttcctactcctgtgtcttttggttctgccccaccgacaacttaccatcctccgttgcaatcagctggtccatcagaacaagtgaattcaaaagctcctttgagcaagtctgctctgccatacagttcattctcatctgatcaaggacttggggagtcttcagctgctccatctcagccaatcactgcagtgaaggacatgccagtgagatcaggtggcctgcttccagatcctcctagaagtagttacttggaaagtccaagaggcccaagatttgatggtcctcgaagatttgaggatttagggtcaaggtgtgaaggaccgagacccaaagggcctcgttttgaaggaaatcgccccgatgggccaagacccagatatgaaggtcacccagcagagggcactaaaagcaagtggggaatgattccccgggggccagcatctcaattttatattacccccagtacatccctaagtcctcgacagagtggaccacagtggaaaggccccaaaccagcttttggacagcagcatcagcagcaacctaagtcacaagcagaacctctttcaggaaacaaagaaccattagcagacaccagtagtaaccagcagaagaattttaaaatgcaatcagctgcattttccattgctgcagatgtaaaggatgtcaaggcggctcagtcaaatgagaatctaagcgactctcaacaagagccacctaaaagtgaagtctcggaagggcccgtagagccctctaattgggaccagaatgttcaaagtatggagactcaaatcgacaaagcccaagctgttactcagcctgtaccccttgcgaataagcctgtacctgctcaatctacttttccttcaaaaacaggggggatggagggaggaacagcagtagcaacatcatcattaacagcagataatgattttaaacctgtgggtattggtctaccccattcagaaaacaaccaagataaaggcctgcctcggccagataatagagataatagattagaaggcaatagaggcaacagctcatcttacagaggtcctgggcaaagcagaatggaagacacacgggataaaggtctagtaaacagaggtcgcggccaggcaatcagtcgaggcccaggattggtcaagcaagaagactttcgggataagatgatgggtagaagagaagatagtcgagagaagatgaacagaggagaaggtagccgggacagagggttggtgaggcctggaagcagtcgggagaaagtgccaggtggtcttcaagggagccaggacaggggtgcagctggcagccgagaaaggggaccacctcggagggctggcagtcaggagaggggacctcttcgaagggctgggagtagagagagaataccaccccgaagagctgggagcagggagagaggaccacctcgagggcctggcagtcgagaaaggggactgggaagatcagattttggtcgtgatagaggtccattcagaccagaaccaggagatggtggggaaaaaatgtatccatatcaccgggatgagcctcctagggctccatggaaccatggagaagagcgagggcatgaagagtttccattagatggtagaaatgctccaatggaacgagaaagactcgatgactgggatagagagagatactggagagaatgtgaacgtgactatcaagatgatacactagagctctataacagagaggacaggttctcagcaccaccatctcggtctcatgatggagataggcgaggcccttggtgggatgattgggagagagaccaggatatggatgaggactacaatagggaaatggaaagggacatggacagggatgtggatcggatttcaagacctatggatatgtatgatagaagtttggataatgagtgggacagagattatgggagaccactggatgaacaagaatcacagtttcgtgaacgggatattccatctcttccacctttaccgcccctcccacctcttccacctttggatagatatcgggatgatagatggagagaagaaagaaatcgagagcatgggtatgatcgagatttccgtgataggggtgagttgaggattcgagagtatccagaaagaggagatacatggcgggaaaagcgagattatgttcctgacagaatggactgggaaagagaacggttgtcagacagatggtacccatctgatgtggatagacattcccccatggcggaacatatgccctcctcacatcattcctcagaaatgatggggtccgatgcaagcttagactctgaccaaggccttggaggggtaatggttctcagtcagaggcagcatgaaatcattttgaaagctgcacaagaactgaaaatgcttcgggaacagaaagaacagcttcaaaagatgaaagacttcgggtctgagccacagatggctgaccatctaccacctcaggaatcaagattgcagaatacatcttcaagacctggaatgtatccgcctccagggtcgtatagacctccccctcctatgggcaaaccaccaggttcaattgtaagaccctctgctccaccagcaagatcatctgttcctgtgaccaggccacctgtcccaataccaccacctccacctcctccacctctacctcctcctcctccagtgataaagccacaaacttcagctgtagaacaggaacgatgggatgaagattctttctatgggctctgggatacaaatgatgaacaaggactgaattcagaatttaagtcagaaactgcagcaattccatctgctccagtattaccacccccacctgttcactcttccattccccctcctggcccagtgcctatgggtatgccaccaatgtccaagccaccaccagtacaacagactgttgattatggccatggccgagatatatccactaataaagttgaacagataccttatggagaaagaataactctacgcccagatccactacctgaaagatcaacttttgagacagagcatgcaggccaacgtgatcgttatgatagagaaagagatcgtgagccttattttgatcgtcaaagtaatgtcatagcagatcatcgagattttaaaagggatcgtgagacacatagagatcgagaccgggatcgtggtgttattgactatgaccgggatcgatttgacagagaacgccgaccccgagatgatagagctcagtcatatcgagacaaaaaagaccattcctcatccagaagagggggttttgataggccatcctatgaccggaagtctgaccgaccagtctatgaaggaccatccatgtttggaggagaacgaaggacttatcctgaggagcgaatgcctctgccagctccttcactgagccaccagcctcctccagctccacgagtcgagaagaagcctgaatcaaagaatgtggacgatattttgaaaccaccgggccgggagagcagacctgagagaattgttgttataatgagaggattacctggcagtggaaagacacatgttgcaaaacttattcgagataaggaggtagaatttggaggacctgcacccagagttctaagcctggatgattacttcatcactgaagtggaaaaagaagaaaaagatccagattctggaaagaaagtgaaaaagaaggtaatggaatatgaatatgaagctgagatggaggagacttaccgcaccagcatgttcaaaactttcaaaaagactctggatgatggcttttttcccttcatcatcctggatgccatcaatgacagagttaggcattttgaccagttttggagtgcagcaaaaaccaagggatttgaggtatatttggctgaaatgagtgcagataaccagacttgtggcaagagaaatattcatggaagaaagcttaaagaaataaataagatggctgatcactgggaaactgcacctcgtcacatgatgcgtctagatattcgttctttgctgcaagatgctgctattgaagaggtagagatggaagattttgatgcaaatatcgaagaacagaaagaagaaaagaaagatgcagaggaagaggaaagcgaactgggttacattccgaaaagcaaatgggagatggacacatctgaggcaaagctagacaagttggatggcttgaggactggtactaaaaggaaacgtgactgggaggccattgccagcagaatggaggattatcttcagctccccgatgattatgatactcgtgcttctgagcctgggaagaagagggtcagatgggcagacctggaagagaagaaggatgcagataggaaaagggccataggttttgtggtcggacagactgattgggagaagatcacagatgaaagtggtcacctggctgaaaaagccctcaatcgaaccaaatatatatgagacttagtttttgaacggagtcattattcctctaaggtggttcgctttgaggtggtctgaagccaaggcctcgcggagcttctttgtgtgtcaccttgcttccacgtttcagttcttgttttgtttctactgctttagttttttttaaagttctccagtgtccccaagaggtattagaatcttgctgtacccaagcaagacgttaatttttcttttaactgttttggggagggagggagtgatagcttaactgctgaagccaggcgggggtctgctggaggattccaacagagagtatttcctccactgtacaatgtcacagactatctctatcatcattgctttgtggctgtttctgttttttactgtatgtaactggtagctgattgtactaggattaaaaacaataaactttcatgataaagccgatgagattcatgggctatacagca

SEQ ID NO: 2669 - DNA, 6550 bp, Homo sapiens
gtttacacgctccggggcctgtaggcgccgcgagttccggctgtcgccgtcgccgccgcggctcctggaggtcggttgcgacgagtaacggcgccaggacgagccctgcgccttctttttcgatatgtacccgaattggggccggtatggcgggagcagccactatccgccgccaccggtcccaccgccgccgccagtggcgcttcctgaggcctcgccggggcccgggtactcgagctcgacgactcccgcggccccctcctcctcgggcttcatgagcttccgcgaacagcacttggcgcagctccagcagctgcagcagatgcaccagaagcaaatgcagtgcgtgcttcagccccaccaccttcctccgccccctctgccgcccccgccagtgatgccggggggcggctacggagactggcagccgccaccgccaccgatgcccccgccacccgggccggccctcagctatcagaagcagcagcagtacaaacaccagatgctccaccaccaacgagacgggcctcctggtttggttccaatggagctggaatccccccctgaatctccccctgtgccgcctgggtcctatatgcccccatctcagtcttacatgcccccacctcagccgccaccctcttactaccccccgacctcatctcagccctacctgcctcctgctcagccgtccccttcgcagtccccaccttcccaatcctacctggcgcccaccccttcttactcatcctcctcctcttcctcgcaatcctatttgagccattcccagtcctacttgccctcttctcaggcatctccttcccgcccctcccagggccattctaaatcccaactactagctccaccaccaccgtccgccccccctggaaataagacaactgtccagcaagagcctttggagagtggggccaaaaacaagagtactgaacagcagcaagccgcccctgagccagatccctctacgatgactccacaggaacagcagcagtattggtatcgacagcacttgcttagtttgcaacagaggacaaaagttcatttgccaggacacaaaaagggtcctgtggtagcaaaggatacaccagagccggtaaaagaagaagttacagtacctgccaccagtcaagttccagaatctccttcttctgaggagcccccattgccacctccaaatgaggaagtgccacctcctctcccacctgaggaaccccagtctgaggacccagaagaagatgccaggttaaagcagttgcaggctgcagcagcacactggcagcagcaccagcagcatcgagtcggtttccagtatcagggaataatgcagaagcacactcagttacagcagattctacaacagtatcagcagattatacagcccccaccacatatacagaccatgtctgtagatatgcagctgcggcattatgagatgcagcagcaacagtttcaacatctttaccaagaatgggagcgagagtttcagctatgggaggaacaactccattcctatcctcataaagatcagcttcaggagtatgagaagcagtggaaaacatggcagggacatatgaaagccactcagagctatctccaggagaaagtcaattcatttcagaacatgaagaaccagtatatggggaacatgtcaatgccacctccttttgttccatattctcagatgcctccacctctacctacaatgccccctccagtgttgcctccttcattgccaccaccagtgatgccccctgccctccctgctacagtgccaccacctggcatgcccccacctgttatgccaccttctctaccaacctctgttcccccaccagggatgcctccttctctctcttctgcagggccaccaccagttctccccccaccttccctgtcttctgcagggccaccaccagttcttcccccaccatctctctcttcaacagcacctccacctgtcatgcccctcccaccattgtcttcagctacacctcctccaggaatacctccccctggagttccacaagggatacctcctcagttaacagcagccccagttccaccagcctccagttcacagagctcgcaagttccagagaaacctagaccagcactgcttcctactcctgtgtcttttggttctgccccaccgacaacttaccatcctccgttgcaatcagctggtccatcagaacaagtgaattcaaaagctcctttgagcaagtctgctctgccatacagttcattctcatctgatcaaggacttggggagtcttcagctgctccatctcagccaatcactgcagtgaaggacatgccagtgagatcaggtggcctgcttccagatcctcctagaagtagttacttggaaagtccaagaggcccaagatttgatggtcctcgaagatttgaggatttagggtcaaggtgtgaaggaccgagacccaaagggcctcgttttgaaggaaatcgccccgatgggccaagacccagatatgaaggtcacccagcagagggcactaaaagcaagtggggaatgattccccgggggccagcatctcaattttatattacccccagtacatccctaagtcctcgacagagtggaccacagtggaaaggccccaaaccagcttttggacagcagcatcagcagcaacctaagtcacaagcagaacctctttcaggaaacaaagaaccattagcagacaccagtagtaaccagcagaagaattttaaaatgcaatcagctgcattttccattgctgcagatgtaaaggatgtcaaggcggctcagtcaaatgagaatctaagcgactctcaacaagagccacctaaaagtgaagtctcggaagggcccgtagagccctctaattgggaccagaatgttcaaagtatggagactcaaatcgacaaagcccaagctgttactcagcctgtaccccttgcgaataagcctgtacctgctcaatctacttttccttcaaaaacaggggggatggagggaggaacagcagtagcaacatcatcattaacagcagataatgattttaaacctgtgggtattggtctaccccattcagaaaacaaccaagataaaggcctgcctcggccagataatagagataatagattagaaggcaatagaggcaacagctcatcttacagaggtcctgggcaaagcagaatggaagacacacgggataaaggtctagtaaacagaggtcgcggccaggcaatcagtcgaggcccaggattggtcaagcaagaagactttcgggataagatgatgggtagaagagaagatagtcgagagaagatgaacagaggagaaggtagccgggacagagggttggtgaggcctggaagcagtcgggagaaagtgccaggtggtcttcaagggagccaggacaggggtgcagctggcagccgagaaaggggaccacctcggagggctggcagtcaggagaggggacctcttcgaagggctgggagtagagagagaataccaccccgaagagctgggagcagggagagaggaccacctcgagggcctggcagtcgagaaaggggactgggaagatcagattttggtcgtgatagaggtccattcagaccagaaccaggagatggtggggaaaaaatgtatccatatcaccgggatgagcctcctagggctccatggaaccatggagaagagcgagggcatgaagagtttccattagatggtagaaatgctccaatggaacgagaaagactcgatgactgggatagagagagatactggagagaatgtgaacgtgactatcaagatgatacactagagctctataacagagaggacaggttctcagcaccaccatctcggtctcatgatggagataggcgaggcccttggtgggatgattgggagagagaccaggatatggatgaggactacaatagggaaatggaaagggacatggacagggatgtggatcggatttcaagacctatggatatgtatgatagaagtttggataatgagtgggacagagattatgggagaccactggatgaacaagaatcacagtttcgtgaacgggatattccatctcttccacctttaccgcccctcccacctcttccacctttggatagatatcgggatgatagatggagagaagaaagaaatcgagagcatgggtatgatcgagatttccgtgataggggtgagttgaggattcgagagtatccagaaagaggagatacatggcgggaaaagcgagattatgttcctgacagaatggactgggaaagagaacggttgtcagacagatggtacccatctgatgtggatagacattcccccatggcggaacatatgccctcctcacatcattcctcagaaatgatggggtccgatgcaagcttagactctgaccaaggccttggaggggtaatggttctcagtcagaggcagcatgaaatcattttgaaagctgcacaagaactgaaaatgcttcgggaacagaaagaacagcttcaaaagatgaaagacttcgggtctgagccacagatggctgaccatctaccacctcaggaatcaagattgcagaatacatcttcaagacctggaatgtatccgcctccagggtcgtatagacctccccctcctatgggcaaaccaccaggttcaattgtaagaccctctgctccaccagcaagatcatctgttcctgtgaccaggccacctgtcccaataccaccacctccacctcctccacctctacctcctcctcctccagtgataaagccacaaacttcagctgtagaacaggaacgatgggatgaagattctttctatgggctctgggatacaaatgatgaacaaggactgaattcagaatttaagtcagaaactgcagcaattccatctgctccagtattaccacccccacctgttcactcttccattccccctcctggcccagtgcctatgggtatgccaccaatgtccaagccaccaccagtacaacagactgttgattatggccatggccgagatatatccactaataaagttgaacagataccttatggagaaagaataactctacgcccagatccactacctgaaagatcaacttttgagacagagcatgcaggccaacgtgatcgttatgatagagaaagagatcgtgagccttattttgatcgtcaaagtaatgtcatagcagatcatcgagattttaaaagggatcgtgagacacatagagatcgagaccgggatcgtggtgttattgactatgaccgggatcgatttgacagagaacgccgaccccgagatgatagagctcagtcatatcgagacaaaaaagaccattcctcatccagaagagggggttttgataggccatcctatgaccggaagtctgaccgaccagtctatgaaggaccatccatgtttggaggagaacgaaggacttatcctgaggagcgaatgcctctgccagctccttcactgagccaccagcctcctccagctccacgagtcgagaagaagcctgaatcaaagaatgtggacgatattttgaaaccaccgggccgggagagcagacctgagagaattgttgttataatgagaggattacctggcagtggaaagacacatgttgcaaaacttattcgagataaggaggtagaatttggaggacctgcacccagagttctaagcctggatgattacttcatcactgaagtggaaaaagaagaaaaagatccagattctggaaagaaagtgaaaaagaaggtaatggaatatgaatatgaagctgagatggaggagacttaccgcaccagcatgttcaaaactttcaaaaagactctggatgatggcttttttcccttcatcatcctggatgccatcaatgacagagttaggcattttgaccagttttggagtgcagcaaaaaccaagggatttgaggtatatttggctgaaatgagtgcagataaccagacttgtggcaagagaaatattcatggaagaaagcttaaagaaataaataagatggctgatcactgggaaactgcacctcgtcacatgatgcgtctagatattcgttctttgctgcaagatgctgctattgaagaggtagagatggaagattttgatgcaaatatcgaagaacagaaagaagaaaagaaagatgcagaggaagaggaaagcgaactgggttacattccgaaaagcaaatgggagatggacacatctgaggcaaagctagacaagttggatggcttgaggactggtactaaaaggaaacgtgactgggaggccattgccagcagaatggaggattatcttcagctccccgatgattatgatactcgtgcttctgagcctccaaggcctcgcggagcttctttgtgtgtcaccttgcttccacgtttcagttcttgttttgtttctactgctttagttttttttaaagttctccagtgtccccaagaggtattagaatcttgctgtacccaagcaagacgttaa

SEQ ID NO: 2670 - DNA, 6232 bp, Homo sapiens
tttcgggagcgggattgtttcgcgcaggaagcaggctccattttagcgccgcccgccgtcgccatctgtttcccttccctcccccatacctagcccgagtctgagccctaacgagaaggctgggcctaggccgctggatgctggagtgaaaggaagggagaaagggaaaaagcgggaagagtcgagaaggctgagtgttaagaggccaagtgcgacgcgcgtatccgggcagacggactgacggacgggcccgtgcttctgccgcggctgcggcgcccgcgcgagtcgcgtctaagcggcggcggcggtggcagcggcggaaaccgaaggggagccatggcggctgacagtcgggaggagaaagatggagaacttaatgttctggatgatattttaactgaagtaccagaacaagatgatgaactgtataatccagagagtgaacaagataaaaatgagaaaaagggatcaaaaagaaaaagtgatcgaatggaatctactgataccaaacgacaaaagccttctgtccattctagacaactggtttctaagccactgagctcatctgttagcaataacaaaagaatagttagtacaaaaggaaagtcagccacagagtataaaaatgaggaatatcaaagatctgaaagaaacaagcgtctagatgctgatcggaaaattcgtctatcaagtagtgcctccagagaaccttataagaatcaacctgaaaaaacctgtgtccggaaaagggatcctgaaaggagggccaaatctcctacgccagatggttctgagagaattgggcttgaagtggatagacgtgcaagcagatccagccagtcttctaaggaagaagtgaactctgaagaatatggctctgaccatgagactggcagcagtggttcttctgatgagcaagggaacaacactgagaatgaggaggaaggagtggaagaagatgtggaggaagatgaagaagtagaagaagatgcagaagaagatgaagaggtggatgaagatggagaggaggaggaggaagaggaggaggaggaagaggaggaggaggaggaggaagaagaagaatatgaacaggatgagagagaccagaaagaggagggaaatgattatgacactcgaagtgaggccagtgactctggttctgaatctgtttccttcacagatgggtctgtcagatctggttcaggcacagatggatcagatgagaaaaagaaggaaaggaagagagctagaggcatatctccaattgtttttgatagaagtggaagctctgcatcagagtcatatgcaggttcagaaaagaagcatgagaaattatcatcttccgttcgtgctgtccgaaaagatcaaaccagtaaactcaaatatgtgcttcaagatgcaagatttttcctcataaagagtaacaaccatgagaatgtgtctcttgccaaagcgaagggtgtatggtccacgctccctgtaaatgagaagaaattaaatcttgcatttagatctgcaaggagtgttatcttaatattttctgtcagagagagtggaaaatttcaagggtttgcaagactttcttcagaatcacatcacggaggatctcctatacactgggtgcttccagcaggaatgagtgctaaaatgctgggaggtgtctttaaaattgactggatttgcaggcgtgaattacccttcactaagtcggctcatctcaccaatccttggaatgaacataaaccagtaaagatcggacgtgatggacaggaaattgaacttgaatgtggaacccagctttgtcttctgtttccccccgatgaaagtattgacttgtatcaggtcattcataaaatgcgtcacaagagaagaatgcattctcagccccgatcacgaggacgtccatcccgtcgagaaccagtccgggatgtgggaaggcgtcgaccagaagattatgatattcataacagcagaaagaaaccaaggattgactatccccctgagtttcaccagagaccagggtatttaaaggatccacgataccaggaagtggacagacgattttcaggagttcgccgagatgtgtttttaaatgggtcctacaatgattatgtgagggaatttcataacatgggaccaccaccaccttggcaaggaatgcccccttacccaggaatggaacaacctccacaccatccttactatcagcaccatgctccacctcctcaagctcatcccccttactcaggacatcatccagtaccacatgaagcaagatacagagataaacgagtacatgattatgatatgagggtggatgatttccttcgtcgcacacaagctgttgtcagtggccggagaagtagaccccgtgaaagagaccgggaacgagagcgagaccgccctagagataacagacgagacagagagcgagatagaggacgtgatagagaaagagaaagagagcgattatgtgatcgagacagagaccgaggggagagaggtcgatatagaagataatgggcttttggaagcactgattgtttaaagatacaaaaaatcttgtattttttttttgtgtgtgtttacaagtagtaaatttattttcagctgtctgcctatgaagttcattgtgtagaaggatttattatgaccccctttgttccaagcatgcagtatcataagaactggaaaaactcaaatccgccaaaaatccacagctgacagttgaattgacacttttattggggcagaatggaacagtccaagaatgtagatactgattctttctccataaatgttcttatagtgtgttcatcctagagttatttttttgtttgtttttttcctttttggatcttgattgataactgccatgatattttgctttgatgtgtttctacatgtagttgcacacggttcagtaaaaataatgctgctatcgagtatgcaaatattgaagtatgatggtttgactgtatggcagtgttgtagcagcctcttgtttttttccccattgcctctttttttaaaaaacttataaagtcactttttatttttcctcagtcttcaatgacgagagcaatattaagaagacattgctatctaatttttaatctttttaaatgaaaaattcctatgttcagtagcgtggttgatgctattgtttagccttcccctccaaattgtatacattggcttggaatgttcacaacttgcgtgcgtggcagcggaagacgattcccatattctacattgctactgttttgtataaaataaattggtaaagattgacggttatcttttgtatctttttcttatccaattgcaggtttgttttattatgcaataatggacataaaagcatgctttttgttcaggaattttaggaaccccatttgctttttttgaggcacactttagcagaaatgattgacctaggcctgttgcattaaaagcttacttctatttctaacataagatacacagagttatgttaataatttggttaagtatttatacacctgataacattttgagtctactctgatcacagaatcgtttatttaggttttctatttgttgttttagtcttctgtaagtgaacgactttgtacatgctttctactttacttcataaatggacttttaaccctcttgtattagttctgtattttaagttaactgtccagttctcccagtggtaaccaactataacatagaaatagagccgctcaagaaaacagtttatgaaataatttttttgaattttttcttgagttacacctggagttttggcctttggaatttggcctttataaacattaggaatatttgaatgtttgatttttttatagtatcaacagttgtactgtgtaccagatcacatagtacagttttacatttaatctatattggcctgaaaagaacaacacaggcactttactcttaaaggatataataaactatagttatactgcattcatattcataccagcatgtagtatctttccctgcattcacagaagttttatttacaatgacaaaactaaagcctgaggatttgttttaaatctgcattgtggtagagaggaaaaagtacttttaaggaaacctgggttctagttttgtcattgtctttaattaaaccggttagtgatacatggtaagtcacttcattggcattttgtgtattcatcagtaagctagacaagatgatagctacagtttaagaatttctgtaaccattatacaaaactggtaggtaatattaaaggtattttcctgaaataataggaataaatactgagcactttgtatgcaatagagactttgtgcttttatatacagactcatttaaatgggctcagagaggctagtaaacttgcccaagattagaaaggtagtaattgatgggccaagattttacccatgtttttatttggtgtttctaaaccacctcatcacttttgaaaaaacagtatataaattaataaatgttttggagatggagtctgtcgcccaggtggagggcagtggcatgatcttggctcactgcaacctcctgcctcagcctcccgaatggctgggactacaggcacccaccaccacaccccgctaatttttgtaattttagtagagatggggttccaacatgttggccaggctggtctcaaactcgacctcaagtgacctcacctgcctcagcctcctaaagtgttgggattacaggcgtgagccactgcacctggcctgagatttttaaacattaacatttccttcaggcttaagcagaggatttttctaaagtgccatccaattagatgttaagttatgctttgtatgttgagcttagtattgagtcgatctattttaaaaagccaacattaagtttttaccaagtatctggcactattctaaacaattctgttggctcacataatcatcactgttttctcctttcctaatttttaaaataaacttaccggaacattgtataaaaaatgcaagatttttttctgtacagaagagtcagtatataaaaatcagtatgttttatttaatattcgtacacatgacagcttttgtcactgtgagaagacatggtttctttcgtgtactccactgtgctgtgattctaacaatctacattagtatgatgtgttcagatgaaaaacagaaaattcagtcattccgagtttagaaatccggtcagggattttattggctggagtaatagttcaaaggagtgaaaattcaagcatgtaatttttggatttgatttcctccataatgatttcctccataatggctttttttcaagcatggtctaatttttcagaaaatggccattatctccaagcttccattgtccatgtagtttcagtggcaggagagagactattttcctcccagtgtccatgtcagttccccaaaaggactgaatagccatgttggttttggagccagccgtaatccaatctgtatttccaaggaaatggggttctttgtctcccagcattgggaagcaagagaggcacatgttatggtcacctctgtgaggattacatcaggaaggacagtctccaaaagacatggacagaggaaatttagcagatgtccattaaatcaggatctcatacaagttataacacctgaatgtttgacttttcagagtattttgccatcacaggtgtggcatcttgcccttggatatatctacattctgctgtagaatgtcgtggtctttctgagggtcacatacatcctgtcttgtcataatgttaaccattaagagtcctcaggggcatggaattgaagaaggaactgttgccagcagttaactgaccaagctagagttccctgacccaacgtaagggtgactgtgacacacatggataattttagcttcatgtttaagattttgttatttgggtaggaaacattccaaatgcagtttgaaacacatattaaaattgaggcacacaggaaagaactggctcaagtttagtccccaagttccttatagtaggaataggaatccttagagtataagcaatccatgcatagtattctgttatctatcatgtagatcatttaatctctaattttttggggtggggattctcttgtttctaaatcttacactttcagtttcttctgtgtcttaaatatagattattgactattgtcttaaatactaataaatacattaaatgtatcttaaatacta

SEQ ID NO: 2671 - DNA, 3244 bp, Homo sapiens
tttcgggagcgggattgtttcgcgcaggaagcaggctccattttagcgccgcccgccgtcgccatctgtttcccttccctcccccatacctagcccgagtctgagccctaacgagaaggctgggcctaggccgctggatgctggagtgaaaggaagggagaaagggaaaaagcgggaagagtcgagaaggctgagtgttaagaggccaagtgcgacgcgcgtatccgggcagacggactgacggacgggcccgtgcttctgccgcggctgcggcgcccgcgcgagtcgcgtctaagcggcggcggcggtggcagcggcggaaaccgaaggggagccatggcggctgacagtcgggaggagaaagatggagaacttaatgttctggatgatattttaactgaagtaccagaacaagatgatgaactgtataatccagagagtgaacaagataaaaatgagaaaaagggatcaaaaagaaaaagtgatcgaatggaatctactgataccaaacgacaaaagccttctgtccattctagacaactggtttctaagccactgagctcatctgttagcaataacaaaagaatagttagtacaaaaggaaagtcagccacagagtataaaaatgaggaatatcaaagatctgaaagaaacaagcgtctagatgctgatcggaaaattcgtctatcaagtagtgcctccagagaaccttataagaatcaacctgaaaaaacctgtgtccggaaaagggatcctgaaaggagggccaaatctcctacgccagatggttctgagagaattgggcttgaagtggatagacgtgcaagcagatccagccagtcttctaaggaagaagtgaactctgaagaatatggctctgaccatgagactggcagcagtggttcttctgatgagcaagggaacaacactgagaatgaggaggaaggagtggaagaagatgtggaggaagatgaagaagtagaagaagatgcagaagaagatgaagaggtggatgaagatggagaggaggaggaggaagaggaggaggaggaagaggaggaggaggaggaggaagaagaagaatatgaacaggatgagagagaccagaaagaggagggaaatgattatgacactcgaagtgaggccagtgactctggttctgaatctgtttccttcacagatgggtctgtcagatctggttcaggcacagatggatcagatgagaaaaagaaggaaaggaagagagctagaggcatatctccaattgtttttgatagaagtggaagctctgcatcagagtcatatgcagatcaaaccagtaaactcaaatatgtgcttcaagatgcaagatttttcctcataaagagtaacaaccatgagaatgtgtctcttgccaaagcgaagggtgtatggtccacgctccctgtaaatgagaagaaattaaatcttgcatttagatctgcaaggagtgttatcttaatattttctgtcagagagagtggaaaatttcaagggtttgcaagactttcttcagaatcacatcacggaggatctcctatacactgggtgcttccagcaggaatgagtgctaaaatgctgggaggtgtctttaaaattgactggatttgcaggcgtgaattacccttcactaagtcggctcatctcaccaatccttggaatgaacataaaccagtaaagatcggacgtgatggacaggaaattgaacttgaatgtggaacccagctttgtcttctgtttccccccgatgaaagtattgacttgtatcaggtcattcataaaatgcgtcacaagagaagaatgcattctcagccccgatcacgaggacgtccatcccgtcgagaaccagtccgggatgtgggaaggcgtcgaccagaagattatgatattcataacagcagaaagaaaccaaggattgactatccccctgagtttcaccagagaccagggtatttaaaggatccacgataccaggaagtggacagacgattttcaggagttcgccgagatgtgtttttaaatgggtcctacaatgattatgtgagggaatttcataacatgggaccaccaccaccttggcaaggaatgcccccttacccaggaatggaacaacctccacaccatccttactatcagcaccatgctccacctcctcaagctcatcccccttactcaggacatcatccagtaccacatgaagcaagatacagagataaacgagtacatgattatgatatgagggtggatgatttccttcgtcgcacacaagctgttgtcagtggccggagaagtagaccccgtgaaagagaccgggaacgagagcgagaccgccctagagataacagacgagacagagagcgagatagaggacgtgatagagaaagagaaagagagcgattatgtgatcgagacagagaccgaggggagagaggtcgatatagaagataatgggcttttggaagcactgattgtttaaagatacaaaaaatcttgtattttttttttgtgtgtgtttacaagtagtaaatttattttcagctgtctgcctatgaagttcattgtgtagaaggatttattatgaccccctttgttccaagcatgcagtatcataagaactggaaaaactcaaatccgccaaaaatccacagctgacagttgaattgacacttttattggggcagaatggaacagtccaagaatgtagatactgattctttctccataaatgttcttatagtgtgttcatcctagagttatttttttgtttgtttttttcctttttggatcttgattgataactgccatgatattttgctttgatgtgtttctacatgtagttgcacacggttcagtaaaaataatgctgctatcgagtatgcaaatattgaagtatgatggtttgactgtatggcagtgttgtagcagcctcttgtttttttccccattgcctctttttttaaaaaacttataaagtcactttttatttttcctcagtcttcaatgacgagagcaatattaagaagacattgctatctaatttttaatctttttaaatgaaaaattcctatgttcagtagcgtggttgatgctattgtttagccttcccctccaaattgtatacattggcttggaatgttcacaacttgcgtgcgtggcagcggaagacgattcccatattctacattgctactgttttgtataaaataaattggtaaagattgacggt

SEQ ID NO: 2672 - DNA, 6195 bp, Homo sapiens
gtaaacagcgcagggcatttcgggagcgggattgtttcgcgcaggaagcaggctccattttagcgccgcccgccgtcgccatctgtttcccttccctcccccatacctagcccgagtctgagccctaacgagaaggctgggcctaggccgctggatgctggagtgaaaggaagggagaaagggaaaaagcgggaagagtcgagaaggctgagtgttaagaggccaagtgcgacgcgcgtatccgggcagacggactgacggacgggcccgtgcttctgccgcggctgcggcgcccgcgcgagtcgcgtctaagcggcggcggcggtggcagcggcggaaaccgaaggggagccatggcggctgacagtcgggaggagaaagatggagaacttaatgttctggatgatattttaactgaagtaccagaacaagatgatgaactgtataatccagagagtgaacaagataaaaatgagaaaaagggatcaaaaagaaaaagtgatcgaatggaatctactgataccaaacgacaaaagccttctgtccattctagacaactggtttctaagccactgagctcatctgttagcaataacaaaagaatagttagtacaaaaggaaagtcagccacagagtataaaaatgaggaatatcaaagatctgaaagaaacaagcgtctagatgctgatcggaaaattcgtctatcaagtagtgcctccagagaaccttataagaatcaacctgaaaaaacctgtgtccggaaaagggatcctgaaaggagggccaaatctcctacgccagatggttctgagagaattgggcttgaagtggatagacgtgcaagcagatccagccagtcttctaaggaagaagtgaactctgaagaatatggctctgaccatgagactggcagcagtggttcttctgatgagcaagggaacaacactgagaatgaggaggaaggagtggaagaagatgtggaggaagatgaagaagtagaagaagatgcagaagaagatgaagaggtggatgaagatggagaggaggaggaggaagaggaggaggaggaagaggaggaggaggaggaggaagaagaagaatatgaacaggatgagagagaccagaaagaggagggaaatgattatgacactcgaagtgaggccagtgactctggttctgaatctgtttccttcacagatgggtctgtcagatctggttcaggcacagatggatcagatgagaaaaagaaggaaaggaagagagctagaggcatatctccaattgtttttgatagaagtggaagctctgcatcagagtcatatgcagatcaaaccagtaaactcaaatatgtgcttcaagatgcaagatttttcctcataaagagtaacaaccatgagaatgtgtctcttgccaaagcgaagggtgtatggtccacgctccctgtaaatgagaagaaattaaatcttgcatttagatctgcaaggagtgttatcttaatattttctgtcagagagagtggaaaatttcaagggtttgcaagactttcttcagaatcacatcacggaggatctcctatacactgggtgcttccagcaggaatgagtgctaaaatgctgggaggtgtctttaaaattgactggatttgcaggcgtgaattacccttcactaagtcggctcatctcaccaatccttggaatgaacataaaccagtaaagatcggacgtgatggacaggaaattgaacttgaatgtggaacccagctttgtcttctgtttccccccgatgaaagtattgacttgtatcaggtcattcataaaatgcgtcacaagagaagaatgcattctcagccccgatcacgaggacgtccatcccgtcgagaaccagtccgggatgtgggaaggcgtcgaccagaagattatgatattcataacagcagaaagaaaccaaggattgactatccccctgagtttcaccagagaccagggtatttaaaggatccacgataccaggaagtggacagacgattttcaggagttcgccgagatgtgtttttaaatgggtcctacaatgattatgtgagggaatttcataacatgggaccaccaccaccttggcaaggaatgcccccttacccaggaatggaacaacctccacaccatccttactatcagcaccatgctccacctcctcaagctcatcccccttactcaggacatcatccagtaccacatgaagcaagatacagagataaacgagtacatgattatgatatgagggtggatgatttccttcgtcgcacacaagctgttgtcagtggccggagaagtagaccccgtgaaagagaccgggaacgagagcgagaccgccctagagataacagacgagacagagagcgagatagaggacgtgatagagaaagagaaagagagcgattatgtgatcgagacagagaccgaggggagagaggtcgatatagaagataatgggcttttggaagcactgattgtttaaagatacaaaaaatcttgtattttttttttgtgtgtgtttacaagtagtaaatttattttcagctgtctgcctatgaagttcattgtgtagaaggatttattatgaccccctttgttccaagcatgcagtatcataagaactggaaaaactcaaatccgccaaaaatccacagctgacagttgaattgacacttttattggggcagaatggaacagtccaagaatgtagatactgattctttctccataaatgttcttatagtgtgttcatcctagagttatttttttgtttgtttttttcctttttggatcttgattgataactgccatgatattttgctttgatgtgtttctacatgtagttgcacacggttcagtaaaaataatgctgctatcgagtatgcaaatattgaagtatgatggtttgactgtatggcagtgttgtagcagcctcttgtttttttccccattgcctctttttttaaaaaacttataaagtcactttttatttttcctcagtcttcaatgacgagagcaatattaagaagacattgctatctaatttttaatctttttaaatgaaaaattcctatgttcagtagcgtggttgatgctattgtttagccttcccctccaaattgtatacattggcttggaatgttcacaacttgcgtgcgtggcagcggaagacgattcccatattctacattgctactgttttgtataaaataaattggtaaagattgacggttatcttttgtatctttttcttatccaattgcaggtttgttttattatgcaataatggacataaaagcatgctttttgttcaggaattttaggaaccccatttgctttttttgaggcacactttagcagaaatgattgacctaggcctgttgcattaaaagcttacttctatttctaacataagatacacagagttatgttaataatttggttaagtatttatacacctgataacattttgagtctactctgatcacagaatcgtttatttaggttttctatttgttgttttagtcttctgtaagtgaacgactttgtacatgctttctactttacttcataaatggacttttaaccctcttgtattagttctgtattttaagttaactgtccagttctcccagtggtaaccaactataacatagaaatagagccgctcaagaaaacagtttatgaaataatttttttgaattttttcttgagttacacctggagttttggcctttggaatttggcctttataaacattaggaatatttgaatgtttgatttttttatagtatcaacagttgtactgtgtaccagatcacatagtacagttttacatttaatctatattggcctgaaaagaacaacacaggcactttactcttaaaggatataataaactatagttatactgcattcatattcataccagcatgtagtatctttccctgcattcacagaagttttatttacaatgacaaaactaaagcctgaggatttgttttaaatctgcattgtggtagagaggaaaaagtacttttaaggaaacctgggttctagttttgtcattgtctttaattaaaccggttagtgatacatggtaagtcacttcattggcattttgtgtattcatcagtaagctagacaagatgatagctacagtttaagaatttctgtaaccattatacaaaactggtaggtaatattaaaggtattttcctgaaataataggaataaatactgagcactttgtatgcaatagagactttgtgcttttatatacagactcatttaaatgggctcagagaggctagtaaacttgcccaagattagaaaggtagtaattgatgggccaagattttacccatgtttttatttggtgtttctaaaccacctcatcacttttgaaaaaacagtatataaattaataaatgttttggagatggagtctgtcgcccaggtggagggcagtggcatgatcttggctcactgcaacctcctgcctcagcctcccgaatggctgggactacaggcacccaccaccacaccccgctaatttttgtaattttagtagagatggggttccaacatgttggccaggctggtctcaaactcgacctcaagtgacctcacctgcctcagcctcctaaagtgttgggattacaggcgtgagccactgcacctggcctgagatttttaaacattaacatttccttcaggcttaagcagaggatttttctaaagtgccatccaattagatgttaagttatgctttgtatgttgagcttagtattgagtcgatctattttaaaaagccaacattaagtttttaccaagtatctggcactattctaaacaattctgttggctcacataatcatcactgttttctcctttcctaatttttaaaataaacttaccggaacattgtataaaaaatgcaagatttttttctgtacagaagagtcagtatataaaaatcagtatgttttatttaatattcgtacacatgacagcttttgtcactgtgagaagacatggtttctttcgtgtactccactgtgctgtgattctaacaatctacattagtatgatgtgttcagatgaaaaacagaaaattcagtcattccgagtttagaaatccggtcagggattttattggctggagtaatagttcaaaggagtgaaaattcaagcatgtaatttttggatttgatttcctccataatgatttcctccataatggctttttttcaagcatggtctaatttttcagaaaatggccattatctccaagcttccattgtccatgtagtttcagtggcaggagagagactattttcctcccagtgtccatgtcagttccccaaaaggactgaatagccatgttggttttggagccagccgtaatccaatctgtatttccaaggaaatggggttctttgtctcccagcattgggaagcaagagaggcacatgttatggtcacctctgtgaggattacatcaggaaggacagtctccaaaagacatggacagaggaaatttagcagatgtccattaaatcaggatctcatacaagttataacacctgaatgtttgacttttcagagtattttgccatcacaggtgtggcatcttgcccttggatatatctacattctgctgtagaatgtcgtggtctttctgagggtcacatacatcctgtcttgtcataatgttaaccattaagagtcctcaggggcatggaattgaagaaggaactgttgccagcagttaactgaccaagctagagttccctgacccaacgtaagggtgactgtgacacacatggataattttagcttcatgtttaagattttgttatttgggtaggaaacattccaaatgcagtttgaaacacatattaaaattgaggcacacaggaaagaactggctcaagtttagtccccaagttccttatagtaggaataggaatccttagagtataagcaatccatgcatagtattctgttatctatcatgtagatcatttaatctctaattttttggggtggggattctcttgtttctaaatcttacactttcagtttcttctgtgtcttaaatatagattattgactattgtcttaaatactaataaatacattaaatgtatcttaaatacta

SEQ ID NO: 2673 - DNA, 6249 bp, Homo sapiens
gtaaacagcgcagggcatttcgggagcgggattgtttcgcgcaggaagcaggctccattttagcgccgcccgccgtcgccatctgtttcccttccctcccccatacctagcccgagtctgagccctaacgagaaggctgggcctaggccgctggatgctggagtgaaaggaagggagaaagggaaaaagcgggaagagtcgagaaggctgagtgttaagaggccaagtgcgacgcgcgtatccgggcagacggactgacggacgggcccgtgcttctgccgcggctgcggcgcccgcgcgagtcgcgtctaagcggcggcggcggtggcagcggcggaaaccgaaggggagccatggcggctgacagtcgggaggagaaagatggagaacttaatgttctggatgatattttaactgaagtaccagaacaagatgatgaactgtataatccagagagtgaacaagataaaaatgagaaaaagggatcaaaaagaaaaagtgatcgaatggaatctactgataccaaacgacaaaagccttctgtccattctagacaactggtttctaagccactgagctcatctgttagcaataacaaaagaatagttagtacaaaaggaaagtcagccacagagtataaaaatgaggaatatcaaagatctgaaagaaacaagcgtctagatgctgatcggaaaattcgtctatcaagtagtgcctccagagaaccttataagaatcaacctgaaaaaacctgtgtccggaaaagggatcctgaaaggagggccaaatctcctacgccagatggttctgagagaattgggcttgaagtggatagacgtgcaagcagatccagccagtcttctaaggaagaagtgaactctgaagaatatggctctgaccatgagactggcagcagtggttcttctgatgagcaagggaacaacactgagaatgaggaggaaggagtggaagaagatgtggaggaagatgaagaagtagaagaagatgcagaagaagatgaagaggtggatgaagatggagaggaggaggaggaagaggaggaggaggaagaggaggaggaggaggaggaagaagaagaatatgaacaggatgagagagaccagaaagaggagggaaatgattatgacactcgaagtgaggccagtgactctggttctgaatctgtttccttcacagatgggtctgtcagatctggttcaggcacagatggatcagatgagaaaaagaaggaaaggaagagagctagaggcatatctccaattgtttttgatagaagtggaagctctgcatcagagtcatatgcaggttcagaaaagaagcatgagaaattatcatcttccgttcgtgctgtccgaaaagatcaaaccagtaaactcaaatatgtgcttcaagatgcaagatttttcctcataaagagtaacaaccatgagaatgtgtctcttgccaaagcgaagggtgtatggtccacgctccctgtaaatgagaagaaattaaatcttgcatttagatctgcaaggagtgttatcttaatattttctgtcagagagagtggaaaatttcaagggtttgcaagactttcttcagaatcacatcacggaggatctcctatacactgggtgcttccagcaggaatgagtgctaaaatgctgggaggtgtctttaaaattgactggatttgcaggcgtgaattacccttcactaagtcggctcatctcaccaatccttggaatgaacataaaccagtaaagatcggacgtgatggacaggaaattgaacttgaatgtggaacccagctttgtcttctgtttccccccgatgaaagtattgacttgtatcaggtcattcataaaatgcgtcacaagagaagaatgcattctcagccccgatcacgaggacgtccatcccgtcgagaaccagtccgggatgtgggaaggcgtcgaccagaagattatgatattcataacagcagaaagaaaccaaggattgactatccccctgagtttcaccagagaccagggtatttaaaggatccacgataccaggaagtggacagacgattttcaggagttcgccgagatgtgtttttaaatgggtcctacaatgattatgtgagggaatttcataacatgggaccaccaccaccttggcaaggaatgcccccttacccaggaatggaacaacctccacaccatccttactatcagcaccatgctccacctcctcaagctcatcccccttactcaggacatcatccagtaccacatgaagcaagatacagagataaacgagtacatgattatgatatgagggtggatgatttccttcgtcgcacacaagctgttgtcagtggccggagaagtagaccccgtgaaagagaccgggaacgagagcgagaccgccctagagataacagacgagacagagagcgagatagaggacgtgatagagaaagagaaagagagcgattatgtgatcgagacagagaccgaggggagagaggtcgatatagaagataatgggcttttggaagcactgattgtttaaagatacaaaaaatcttgtattttttttttgtgtgtgtttacaagtagtaaatttattttcagctgtctgcctatgaagttcattgtgtagaaggatttattatgaccccctttgttccaagcatgcagtatcataagaactggaaaaactcaaatccgccaaaaatccacagctgacagttgaattgacacttttattggggcagaatggaacagtccaagaatgtagatactgattctttctccataaatgttcttatagtgtgttcatcctagagttatttttttgtttgtttttttcctttttggatcttgattgataactgccatgatattttgctttgatgtgtttctacatgtagttgcacacggttcagtaaaaataatgctgctatcgagtatgcaaatattgaagtatgatggtttgactgtatggcagtgttgtagcagcctcttgtttttttccccattgcctctttttttaaaaaacttataaagtcactttttatttttcctcagtcttcaatgacgagagcaatattaagaagacattgctatctaatttttaatctttttaaatgaaaaattcctatgttcagtagcgtggttgatgctattgtttagccttcccctccaaattgtatacattggcttggaatgttcacaacttgcgtgcgtggcagcggaagacgattcccatattctacattgctactgttttgtataaaataaattggtaaagattgacggttatcttttgtatctttttcttatccaattgcaggtttgttttattatgcaataatggacataaaagcatgctttttgttcaggaattttaggaaccccatttgctttttttgaggcacactttagcagaaatgattgacctaggcctgttgcattaaaagcttacttctatttctaacataagatacacagagttatgttaataatttggttaagtatttatacacctgataacattttgagtctactctgatcacagaatcgtttatttaggttttctatttgttgttttagtcttctgtaagtgaacgactttgtacatgctttctactttacttcataaatggacttttaaccctcttgtattagttctgtattttaagttaactgtccagttctcccagtggtaaccaactataacatagaaatagagccgctcaagaaaacagtttatgaaataatttttttgaattttttcttgagttacacctggagttttggcctttggaatttggcctttataaacattaggaatatttgaatgtttgatttttttatagtatcaacagttgtactgtgtaccagatcacatagtacagttttacatttaatctatattggcctgaaaagaacaacacaggcactttactcttaaaggatataataaactatagttatactgcattcatattcataccagcatgtagtatctttccctgcattcacagaagttttatttacaatgacaaaactaaagcctgaggatttgttttaaatctgcattgtggtagagaggaaaaagtacttttaaggaaacctgggttctagttttgtcattgtctttaattaaaccggttagtgatacatggtaagtcacttcattggcattttgtgtattcatcagtaagctagacaagatgatagctacagtttaagaatttctgtaaccattatacaaaactggtaggtaatattaaaggtattttcctgaaataataggaataaatactgagcactttgtatgcaatagagactttgtgcttttatatacagactcatttaaatgggctcagagaggctagtaaacttgcccaagattagaaaggtagtaattgatgggccaagattttacccatgtttttatttggtgtttctaaaccacctcatcacttttgaaaaaacagtatataaattaataaatgttttggagatggagtctgtcgcccaggtggagggcagtggcatgatcttggctcactgcaacctcctgcctcagcctcccgaatggctgggactacaggcacccaccaccacaccccgctaatttttgtaattttagtagagatggggttccaacatgttggccaggctggtctcaaactcgacctcaagtgacctcacctgcctcagcctcctaaagtgttgggattacaggcgtgagccactgcacctggcctgagatttttaaacattaacatttccttcaggcttaagcagaggatttttctaaagtgccatccaattagatgttaagttatgctttgtatgttgagcttagtattgagtcgatctattttaaaaagccaacattaagtttttaccaagtatctggcactattctaaacaattctgttggctcacataatcatcactgttttctcctttcctaatttttaaaataaacttaccggaacattgtataaaaaatgcaagatttttttctgtacagaagagtcagtatataaaaatcagtatgttttatttaatattcgtacacatgacagcttttgtcactgtgagaagacatggtttctttcgtgtactccactgtgctgtgattctaacaatctacattagtatgatgtgttcagatgaaaaacagaaaattcagtcattccgagtttagaaatccggtcagggattttattggctggagtaatagttcaaaggagtgaaaattcaagcatgtaatttttggatttgatttcctccataatgatttcctccataatggctttttttcaagcatggtctaatttttcagaaaatggccattatctccaagcttccattgtccatgtagtttcagtggcaggagagagactattttcctcccagtgtccatgtcagttccccaaaaggactgaatagccatgttggttttggagccagccgtaatccaatctgtatttccaaggaaatggggttctttgtctcccagcattgggaagcaagagaggcacatgttatggtcacctctgtgaggattacatcaggaaggacagtctccaaaagacatggacagaggaaatttagcagatgtccattaaatcaggatctcatacaagttataacacctgaatgtttgacttttcagagtattttgccatcacaggtgtggcatcttgcccttggatatatctacattctgctgtagaatgtcgtggtctttctgagggtcacatacatcctgtcttgtcataatgttaaccattaagagtcctcaggggcatggaattgaagaaggaactgttgccagcagttaactgaccaagctagagttccctgacccaacgtaagggtgactgtgacacacatggataattttagcttcatgtttaagattttgttatttgggtaggaaacattccaaatgcagtttgaaacacatattaaaattgaggcacacaggaaagaactggctcaagtttagtccccaagttccttatagtaggaataggaatccttagagtataagcaatccatgcatagtattctgttatctatcatgtagatcatttaatctctaattttttggggtggggattctcttgtttctaaatcttacactttcagtttcttctgtgtcttaaatatagattattgactattgtcttaaatactaataaatacattaaatgtatcttaaatacta

SEQ ID NO: 2674 - DNA, 2406 bp, Homo sapiens
ggggcgaatccccgctgggtcgagggcctgaacgggagccaatcgagcagccgaggctactgccaatcacgcggctccctccaatcccacccgtgccatttccaaaatctcggtcccactgtgcagctcaaatgtggtgttcactctgccaatcgctggaggatagagtgggaacaggaataagcagagttaagaggccaggacaaaagaagttaaagagcgcccaatacatacatgtttttgaaggcgggcagagggaataaagtccccccagtgagggtctatgggcctgattgtgtagttctgatggagccccctttgagcaagaggaacccgccagcgctgagattagcggatttggcaacggctcaggtccagccgcttcagaatatgacaggcttcccggcgctggccggcccgcccgcccactcccaactccgggccgccgtcgcgcacctccgcctgcgggacctgggcgctgaccccggcgtggccaccactccgctcggacccgagcacatggcccaggcgagcacgctgggcctcagccctccctcccaggcgttcccggcacacccggaggctccggcagccgccgcccgtgctgcagccttggtcgcgcaccccggcgcgggcagctacccctgcggcgggggcagcagtggcgcgcagccctccgcgcccccgcccccagcccctcctcttcctcccaccccttcaccccctccccctcccccgcctcctcctcctcctgccctctcgggctacaccaccaccaacagtggcggcggcggcagcagcggcaaaggccacagcagggacttcgtcctccggagggacctttccgccacggcccccgcggcggccatgcacggggccccgctcggaggggagcagcggtccggcaccggctccccccagcacccggccccgcctccccactcggccggcatgttcatctccgccagcggcacctacgcgggcccggacggcagcggcggcccggcgctcttccccgcgctgcacgacacgccgggggccccaggcggccacccgcacccgctcaacggccagatgcgcctggggctggcggcggcagcggcagccgcggcggctgagctgtacggccgcgccgaaccgcccttcgcgccgcgctctggggacgcgcactacggggcggttgcggccgcagcggcggccgccctgcacggctacggagccgtgaacttaaacctgaacctggcggctgcggcggccgcagcagcggccgggcccgggccccacctgcagcaccacgcgccgcccccggcgccgccgccgccgccggcgcccgcgcagcacccgcaccagcaccacccccacctcccaggggcggctggggccttcctgcgctacatgcggcagccaatcaagcaggagctcatctgcaagtggatcgaccccgacgagctggccgggctgccgccgccgccgccgccgccgccgccgccgccgccaccgcccccggccggcggcgccaagccctgctccaaaactttcggcaccatgcacgagctggtgaatcacgtcacggtggagcacgtgggaggccccgagcagagcagccacgtctgcttctgggaggactgtccgcgcgagggcaagcccttcaaggccaaatacaagctcatcaaccacatccgcgtgcacaccggcgagaagccctttccctgccctttccccggctgcggcaaggtcttcgcgcgctccgagaacctcaagatccacaagcgtactcatacaggggaaaagcctttcaaatgtgaatttgatggctgtgacaggaagtttgccaatagcagtgatcggaagaaacattcccatgtccacaccagtgacaagccctactactgcaagattcgaggctgtgacaaatcctacactcacccaagctccctgaggaagcacatgaagattcactgcaagtccccgccaccttctccaggaccccttggttactcatcagtggggactccagtgggcgcccccttgtcccctgtgctggacccagccaggagtcactccagcactctgtcccctcaggtgaccaacctcaatgagtggtacgtttgccaggccagtggggcccccagccacctccacaccccttccagcaacggaaccacctctgagactgaagatgaggaaatttacgggaaccctgaagttgtgcggacgatacattagaatttattattaataataataagtgaaataataagtgggagtccttggaccacatcctaacctgagacaatgccgagcctgagacaaacccgtgactcagacttgccaccgggtctaattagccctatttattcagtatgaaaccctatggtgtttgtacatttaattaatttaattaag

SEQ ID NO: 2675 - DNA, 3262 bp, Homo sapiens
gcggcggccgccctgcacggctacggagccgtgaacttaaacctgaacctggcggctgcggcggccgcagcacacccgcaccagcaccacccccacctcccaggggcggctggggccttcctgcgctacatgcggcagccaatcaagcaggagctcatctgcaagtggatcgaccccgacgagctggccgggcgcgccaagccctgctccaaaactttcggcaccatgcacgagctggtgaatcacgtcacggtggagcacgtgggaggccccgagcagagcagccacgtctgcttctgggaggactgtccgcgcgagggcaagcccttcaaggccaaatacaagctcatcaaccacatccgcgtgcacaccggcgagaagccctttccctgccctttccccggctgcggcaaggtcttcgcgcgctccgagaacctcaagatccacaagcgtactcatacaggggaaaagcctttcaaatgtgaatttgatggctgtgacaggaagtttgccaatagcagtgatcggaagaaacattcccatgtccacaccagtgacaagccctactactgcaagattcgaggctgtgacaaatcctacactcacccaagctccctgaggaagcacatgaagattcactgcaagtccccgccaccttctccaggaccccttggttactcatcagtggggactccagtgggcgcccccttgtcccctgtgctggacccagccaggagtcactccagcactctgtcccctcaggtgaccaacctcaatgagtggtacgtttgccaggccagtggggcccccagccacctccacaccccttccagcaacggaaccacctctgagactgaagatgaggaaatttacgggaaccctgaagttgtgcggacgatacattagaatttattattaataataataagtgaaataataagtgggagtccttggaccacatcctaacctgagacaatgccgagcctgagacaaacccgtgactcagacttgccaccgggtctaattagccctatttattcagtatgaaaccctatggtgtttgtacatttaattaatttaattaagatatttgggcttttttttttttttttcttaaaaaacaaacaaaaaacaaccaagctggacttgtacattgcaggaggatggggctgggggcaaattgtaccaaggaaaatgaatggagagattagttaatggcgatacacactgccgatgcaatatatatatatatatatatatacatatatatatatattattttttttaaaagggggagaaaaagagcattaagtcagaacttaacacagcaccaaggccctctgcatttcccagagtgcctctcaaatgcctttgacaccataccatgggctgcttttgagcctccttgttggaccctaattctgccaaggcctcttgattgtaaaccacacacctgctgcattgccaacagatcctgttccgtacctgtgtccaaaaacatttgtaaaaaccctttgagtttaatatttgtaatttttaatttccactcttttattactgatcttagcttaatacaatatttttatacaggattatttcttcagtatcctactgtgtgattttaaaaaaagatgcagcaaccttaatatatctccatatcttgtgctactgtgattgttcaagcaaaagtggagagaagaaaagctgctgcaaaagacaactgtgaaactgtgatattttataaaatagaagaaattcaagtgctttctttttcctatatgtttttttttttttatctgaattctcagatactgcctcctaactgtgtccaaacttcttgtgtaataaagagattctgttttcgatcctaagttctttgggatgccaacattcacagtcaagtcttgaggaggtgtgatgatggcatcatgcctatttttttggaaagctgttgtttttaaaacaggccaacacctcttttatactgttgtatcagccttttaaaaagtctatttttcaatgcctgaaactgcattttaatgcattttcttccacctgagcactgagcacaccaaactggaatccatttgaaaatgacagtgtgtgaagtgtatgatttacattaaaagaggggagggagttgccatacatattaaaaatttttaaaaggtttatagttaccaccaaacactgatgaatgtgtgacctttgccagagctgtcaagctaggataaaaaaggtcaaggacctaggacaataactcttagtcgatttattttcggttggtacaacacatctcctgtgcaaaatgtagtccatcagaaacatcctacagatacactaaagagcactaatttatccttagagaccccgaagacaccccctccccagggtttgtagaaatttgttttgtgtgctgtgagtggttgatgtagtcttgtcattgttaataacttgtatgtgaacactattatttgtacagttgaattaatttattttcagacatcatcctttttttttttctttcctggaagagttcaaagcacaccaaagaattatattatacattttggtgaaagattgtcatttatgatccatggtttatttaaaaaaaaaaggaaagaaaatggaaaaatatatttttaagcttacttgaatgaacaacgtaatgtgaaaaccaagactcttcctgcatgtcttttttgcattgtgttgataagattatatatagtttatagatatattatattactagtacagtgcatggtgctgtcacttggaaagcctttcaatgttgtcttcagattgttgtgatgaatatgaaacatgcagaccctcctttataaagaaaaagaccttaaaacttgaatatgagataattttacattttaaaagtttatttgattttcatattattcactttcaaagccctttcaaatagaaaaggtatgaacttttggggggataatttatgtatcgtaaacttattagaacaaaatattcctgatgtataatgagttgttttatttatacaactttttcaatggtagtttgcactattctttattatgctacaggtttatttattatgaaacaaaggaatatgtattttatgtattttaccatgcataggttaactctttgccacagatttattggttcttgatacacctaaaataaaaaaaaatgtgtacctccaatagagagcaagcaagaatgattatgaagtaacaaatttaataaaggtattcttgttattatt

SEQ ID NO: 2676 - DNA, 4294 bp, Homo sapiens
gtgcaggagtctgagaagaaagggtgtagatggagaggcggtggcctcacctctgcatgctccgtgggaagcggcggaggcgcccagcatccctcctactctgcccttggtggaggtttacgagaaaacacggccatctttatgtgtaaatgttgtaacctcttctcaccaaatcagtcggaactcctctcccacgtttcagagaagcacatggaagaaggggttaatgttgatgagattattattccccttaggcctctgagtacacctgaaccccccaactcaagcaaaaccggagatgagtttttggtcatgaagaggaagagaggcaggcctaaggggtccacgaagaagtccagcacagaagaggagctggcagaaaacatcgtgagtccgactgaggacagcccgctggctccggaggaagggaacagcctgcctccaagcagcttggagtgtagcaagtgctgtcggaagttctccaacacgcgccagctgcggaagcacatctgcattatcgtgctgaatttgggtgaggaggaaggagaagcaggtaacgagtctgaccttgaactagaaaagaagtgtaaggaagatgatcgggaaaaagcctcgaaaagaccacggtcacagaaaacagagaaagtccagaagatctcaggaaaggaggccagacagctttctggggcgaagaaacccatcataagtgtggttttaactgcacacgaagcaattccaggtgctaccaagattgtgccagtggaggctgggccccctgaaacaggagctacaaattctgagaccacttcagcagacctggtgcctcggagaggctaccaggaatacgccattcagcagacaccttatgagcaaccaatgaagtcaagcaggctaggtcccactcagctcaaaatcttcacttgtgaatactgcaacaaggtcttcaagttcaagcactcgctgcaggcccacctgaggatccacaccaatgaaaagccatacaagtgcccccagtgcagctatgccagtgccatcaaggccaacctcaatgtgcacctgcgcaagcacactggagagaagttcgcctgcgactattgctcgttcacctgcctgagcaagggccacctcaaggtgcacatcgagcgagtgcacaagaagatcaagcagcactgccgcttctgcaagaagaagtactctgacgtcaagaacctcatcaagcacatccgagacgcgcatgacccacaggacaagaaggtcaaagaggccttggacgagctctgcctgatgacgagggagggcaagcggcagctgctctatgactgccacatctgtgagcgcaagttcaagaacgagctggaccgtgaccgccatatgctggtccacggagacaagtggccttttgcctgtgagctctgtggccatggggccaccaagtaccaggcgctggaactgcatgtcaggaagcaccccttcgtgtacgtctgtgccgtctgccgcaagaagttcgtcagctccatcaggctgcgcacccacatcaaagaggtgcacggggctgcccaggaggccttggtcttcaccagttccatcaaccagagcttctgcctcctggaacctggtggggacatccagcaagaagctctgggggaccagctacagctggtggaagaggagtttgccctccagggcgtgaatgcactcaaggaagaggcctgtcctggggacactcagctggaggagggccggaaggagccggaggcccctggggaaatgcctgccccagctgtgcacctggcctccccgcaggccgaaagcacagccctgccaccctgtgagctggaaaccaccgtggtctcctcctcagacctgcattctcaagaggtggtttcagatgattttttgttgaaaaatgatacctcctccgcagaggctcatgctgctcctgagaagcccccagacatgcagcacagaagctcagtccagacgcaaggtgaagtgatcacactactgctgtccaaggcccagagtgctgggtcagatcaggaaagccatggcgcccagagccccctaggggaagggcagaacatggctgtgctttcagctggtgacccagatcccagcaggtgtctcaggtcaaacccagctgaggcctcagacctcctccctccagtagctggtggtggggacaccatcacacatcagcctgactcttgcaaagctgcccctgagcaccggtcaggcatcaccgctttcatgaaggtcctgaacagtttacagaagaagcaaatgaacaccagcttgtgtgagcggatccggaaggtttatggagacctggagtgtgaatactgtggcaaacttttttggtaccaagtgcattttgatatgcatgtccgcacccacacccgggaacatctgtattattgctctcagtgtcattattcttccatcaccaaaaactgccttaaacgccacgtaattcagaaacacagtaacatcttgctgaagtgtcccaccgatggctgtgactactcaactccagataaatataagctacaggcacatcttaaagttcacacagcactggacaaaaggagttattcttgtcctgtttgtgaaaagtctttttcagaggatcgattgataaagtcacatatcaagaccaaccatcctgaggtctccatgagcaccatttctgaggttctcgggaggagggttcagctgaaagggctaattggaaagagagccatgaaatgcccatattgtgacttttatttcatgaagaatggctcagaccttcagcgtcatatttgggctcatgaaggtgtgaagcccttcaagtgttctttgtgtgagtatgcaactcgtagcaagagtaacctcaaggctcatatgaatcgtcacagcactgagaaaacccacctatgtgacatgtgtggcaagaaattcaaatcaaaagggacactgaaaagtcacaaactccttcacactgcagatgggaagcagtttaagtgcacggtgtgtgactacacagcggcccagaagccacagctgctgcggcacatggaacagcatgtctccttcaagcctttccgctgtgcccattgccattactcctgcaacatatctggctctctgaagcggcactacaacaggaagcaccctaatgaggagtatgccaacgtgggcaccggggagctggcagcggaggtgctcatccagcaaggtggtttgaagtgtcctgtttgcagctttgtatatggcaccaaatgggagttcaataggcacttgaagaacaaacatggcttgaaggtggtggaaattgatggagaccccaagtgggagacagcaacagaagctcctgaggagccctccacccagtatctccacatcacagaggccgaagaagacgttcaagggacacaggcagcggtggccgcgctccaggacctgagatacacctctgagagtggcgaccgactggaccccacggccgtgaacatcctgcagcagatcattgagctgggcgccgagacccatgacgccactgcccttgcctcggtggttgccatggcaccagggacggtgactgtggttaagcaggtcaccgaggaggagcccagctccaaccacacggtcatgatccaggagacggtccagcaagcgtccgtggagcttgccgagcagcaccacctggtggtgtcctccgacgacgtggagggcattgagacggtgactgtctacacgcagggcggggaggcctcggagttcatcgtctacgtgcaggaggccatgcagcctgtggaggagcaggctgtggagcagccggcccaggaactctagaggacatgtggcatcggatggccacagggcggggctgccaggctctgcaggcacccagggtggggaggccacccttcctgccctacccgcagaatggtgctctcctttgccctccctgcccagcagcctgataggactctcctagtccaacttggggtgggcaaggcagtcagcatcaccagcaataccacaggaccctcaccccagcatagacacacaccccctgacccttaccatctgcttcctgaaagacttcagtgtcagctcccctacacacaccccacaccttcaccccttgcttcaagattcaaacagagactcccagtccccctcagcatcttccctgaatcacagccccagctccttgacccccatctaggtgccaaatgttcatctgcaaccgctatgcagtctggtgagagggagacagccatcacatagaaagtgaccgtacggg

SEQ ID NO: 2677 - DNA, 4119 bp, Homo sapiens
cgcagaaacttgttgcaacaaacaggcgaccgcgggtgcccctagcagccagcggcagagtgggtgggcgggcgagagggaggggaaggctggcggacgccgcagcgaactggtgggcagacccggagtcgccgcgtaagcggggccggctcagtgcggtgcggcaggcgcggctgtgcggcagcggaagtcctttgttgcagcacagtccctggcagagccagagcctctccgcgcagcccagcccgagcgccgagcgccgcgcgccgccgccactgcagctcgcggccccttcgccttcgcccgcctttcccgcggctgatttgccttaaactccctaaaatctccgcagctctggttcctgttgcggccggtctctaattaacagaagatggcaaagcccagccacagcagctatgtccttcagcagctaaacaaccaaagagaatggggttttctctgtgactgctgtattgcaattgatgacatttactttcaagcacacaaggcagttctagctgcctgtagctcctattttagaatgtttttcatgaaccatcagcatagtactgcacaactgaatctcagcaacatgaaaattagtgcagaatgttttgatctcattttgcagtttatgtatttaggaaaaattatgacagctccctccagttttgagcagtttaaagtggcaatgaactacctacagctatacaatgttcctgactgtttagaagacatccaggatgcagattgttctagttcaaaatgttcctcttctgcttccagcaaacagaacagcaaaatgatatttggggtaagaatgtatgaagatactgtggctcgaaatggcaatgaagccaacaggtggtgtgcagagccaagttcaacggtaaatacaccacataatagagaggctgatgaagagtctttacaattaggtaattttcctgagccactatttgatgtatgtaaaaaaagttccgtgtccaaattatctactccaaaagaacgtgtgtcaagacgctttgggcggagttttacctgtgatagctgtggatttggctttagctgtgaaaaattattagatgagcatgtgctaacctgtactaacagacatttataccaaaacacaagatcttaccatagaatagtagatattagagatggaaaagacagtaacatcaaagctgaatttggtgaaaaagattcttccaaaacattttctgcacagacggacaaatacagaggagacacaagccaggctgctgatgattcagcttcaaccactggaagcagaaaaagtagcacagtggagtctgaaatagcaagcgaagagaaaagcagagctgctgagaggaaaaggattattattaagatggagccagaagatattcctacagatgaactgaaagactttaacattattaaagttactgataaagactgtaatgaatccactgacaatgatgaattagaagatgaacctgaagagccattttatagatactatgttgaagaagatgtcagcataaaaaaaagtggtaggaaaactctaaaacctcgaatgtcagtaagtgctgatgaaagaggtggtttagagaatatgaggccccctaacaacagcagtccagtacaagaggatgctgaaaatgcatcttgtgagctgtgtggacttacaataaccgaggaggacctgtcatctcattacttagccaaacacattgaaaatatctgtgcatgtggtaaatgtggacaaatacttgtaaagggtaggcagcttcaggaacatgctcaacgatgtggcgagccccaagatctgaccatgaatgggttaggaaatactgaggagaaaatggacttggaagagaatcctgatgagcagtccgaaataagagatatgtttgttgaaatgctggatgattttagggacaatcattaccagataaacagtatccaaaaaaagcagttatttaaacattctgcctgcccttttcgatgtcctaattgtggccagcgttttgaaactgaaaatctagtggttgaacatatgtctagctgcttagatcaagatatgtttaagagtgccatcatggaagaaaatgaaagagatcacagacgaaagcatttttgtaatctgtgtggaaaaggattttatcagcggtgtcacttaagagaacactatactgttcatactaaggaaaaacagtttgtttgtcaaacatgtggaaagcagtttttaagagagcgtcagttgcgactgcacaatgatatgcacaaaggcatggccagtggtgaaatagggccttctaaacctgtggagaagtgagagatctgaatttggagaggacatggggaagaatcaatcttcaacagataatctttaagtacagacccaggaatatcagatctgaagtggcaccatcttttctgtcttcctgacaaacttccatcaacccaaaaagttccagttgcaaagatccaagaaaactcagtaaagatcactttggaatcactttgttgtaacaaaattgattcatggtgactctaatatttgtgtaaatctgctgaagaaaagtaactagaaaattcatacaacatcagtggttacagctatactaaaataaaactttatatgctaattatcttcaagggtctttctaaaataaaaggggttgttaggctactgcaaatataaagagacataatcacaaatctatttatatagatataaataattctaaacttaaaatcactagaattatagcttaaatattatgaaatgtacttagtcaacttaaaaacttacaccaaaaatctgtagtttagagtgtaagaagtaatgggtacagagaaaaaaaatttaagaccaatattttaacaggataatttggttattactcactatagtaaaacacttgcccttcttccttttccactgtatatgccagtcacaatcttgatcatttatatgaatgaaactcccttttaaacctgttaacttgaaggagaacagaaatggtattacttcaatagtggtagatttccacaaatcagacacattattttcttctgaacttggcaatataacctaataaggcagaataagtttctgttaaaatacttattctcaatatttatgtataaaccatgcttctcagctttcaaatttcaagataaaatttaagtattcagtaaaatgatggttaacatgttttaaaaaatctttaatggagaagttaaatatttggtgagattttagtctggctataaatgctttgtttgatatatatatgtgcacatatatatattacttaaccatatgaattttatttccttattctgaatatacttgtagttttacttctttctgtttatgtacccaattccttatgattattttgtttcttctgcaatatcaagatgttatttattttgagaaatgcttatttttatgactatttattccaatgttttaacaagaagcacagagatttatagtattcttaatagtatgtgcagaagttacatcatttaaaaaacccttgctgtaaagtaggataacttgaatattcattctaataattagactaagtgaaaatctgagaaagagttaattgcaatgtgatagtgggtagaaaggagagaaaaacccactgaagggttcaaatacatgtgaattctactgctttaagagaaataaaacaaataagcctagggaaatattagagtctaaaaaaccctagagttaatctcttttgggaacataaggaggtatacagaactgcagacctctaaacataagtaggaaaaagaaaaataaaagaatattaccaataattaaaggtgccagatcaaaatagtaataaatcaacaaataatttttgattgactggtggaattagatttactaaataaaaatggcttaaattttgactgtactaactataaatgtaatgaattataataattataaatggtataaatgcattctacaatgtgattattttctgtattttagtatatagtataaaatggaattattgggttaaagtacttttattacatttcttaatccattgtttttacctaataaaatttcctcctctatattccaaagtt

SEQ ID NO: 2678 - DNA, 3834 bp, Homo sapiens
cgcagaaacttgttgcaacaaacaggcgaccgcgggtgcccctagcagccagcggcagagtgggtgggcgggcgagagggaggggaaggctggcggacgccgcagcgaactggtgggcagacccggagtcgccgcgtaagcggggccggctcagtgcggtgcggcaggcgcggctgtgcggcagcggaagtcctttgttgcagcacagtccctggcagagccagagcctctccgcgcagcccagcccgagcgccgagcgccgcgcgccgccgccactgcagctcgcggccccttcgccttcgcccgcctttcccgcggctgatttgccttaaactccctaaaatctccgcagctctggttcctgttgcggccggtctctaattaacagaagatggcaaagcccagccacagcagctatgtccttcagcagctaaacaaccaaagagaatggggttttctctgtgactgctgtattgcaattgatgacatttactttcaagcacacaaggcagttctagctgcctgtagctcctattttagaatgtttttcatgaaccatcagcatagtactgcacaactgaatctcagcaacatgaaaattagtgcagaatgttttgatctcattttgcagtttatgtatttaggaaaaattatgacagctccctccagttttgagcagtttaaagtggcaatgaactacctacagctatacaatgttcctgactgtttagaagacatccaggatgcagattgttctagttcaaaatgttcctcttctgcttccagcaaacagaacagcaaaatgatatttggggtaagaatgtatgaagatactgtggctcgaaatggcaatgaagccaacaggtggtgtgcagagccaagttcaacggtaaatacaccacataatagagaggctgatgaagagtctttacaattaggtaattttcctgagccactatttgatgtatgtaaaaaaagttccgtgtccaaattatctactccaaaagaacgtgtgtcaagacgctttgggcggagttttacctgtgatagctgtggatttggctttagctgtgaaaaattattagatgagcatgtgctaacctgtactaacagacatttataccaaaacacaagatcttaccatagaatagtagatattagagatggaaaagacagtaacatcaaagctgaatttggtgaaaaagattcttccaaaacattttctgcacagacggacaaatacagaggagacacaagccaggctgctgatgattcagcttcaaccactggaagcagaaaaagtagcacagtggagtctgaaatagcaagcgaagagaaaagcagagctgctgagaggaaaaggattattattaagatggagccagaagatattcctacagatgaactgaaagactttaacattattaaagttactgataaagactgtaatgaatccactgacaatgatgaattagaagatgaacctgaagagccattttatagatactatgttgaagaagatgtcagcataaaaaaaagtggtaggaaaactctaaaacctcgaatgtcagtaagtgctgatgaaagaggtggtttagagaatatgaggccccctaacaacagcagtccagtacaagaggatgctgaaaatgcatcttgtgagctgtgtggacttacaataaccgaggaggacctgtcatctcattacttagccaaacacattgaaaatatctgtgcatgtggtaaatgtggacaaatacttgtaaagggtaggcagcttcaggaacatgctcaacgatgtggcgagccccaagatctgaccatgaatgggttaggaaatactgaggagaaaatggacttggaagagaatcctgatgagcagtccgaaataagagatatgtttgttgaaatgctggatgattttagggacaatcattaccagataaacagtatccaaaaaaagcagttatttaaacattctgcctgcccttttcgatgtcctaattgtggccagcgttttgaaactgaaaatctagtggttgaacatatgtctagctgcttagatcaagatatgtttaagagtgccatcatggaagaaaatgaaagagatcacagacgaaagcatttttgtaatctgtgtggaaaaggattttatcagcggtgtcacttaagagaacactatactgttcatactaaggaaaaacagtttgtttgtcaaacatgtggaaagcagtttttaagagagcgtcagttgcgactgcacaatgatatgcacaaaggcatggccaggtatgtctgttccatttgtgatcaaggaaacttcagaaaacatgaccatgtacggcatatgatttctcatttatctgctggtgagactatatgccaggtctgctttcagatattcccaaataatgaacagttggagcagcacatggatgttcatctgtatacatgtggaatatgtggagcaaaatttaatttgaggaaagatatgagatcacattataatgccaagcatttgaaaagaacctgagtgattttctactgtactaatgtttagatgatagcagataaaacaccaaagcaaaggatatgagctatttaggaattgattatataagatgatttgttagaaacaaatttcaaggcccttttaactttaatatttttgtttaggattttaagtatctacatttaggtattaaatgtttatcatttttgttgtttcttaatagaattatttgtttttagtttttcttagctatgattaaaatttttaaatgtagactacaagtggttgttacccattcaatgactattaaactttagtttttcatcaataaggtgatgacttcactatttctatgtgtttttttttttttaaggttatcctgtgaaattttaaacccagaatcattggccatttctgtttaaattttaaaaattccttaagtaattatttgaaactatcccgtttgcttttagtgagttaactactctttattcccccttattaatgaaattcatattcttaaattgacaagcttattaggcaagttaggtgcactgaatctaacctttaaggttgacatgggctcaaacttggcctaaaaagattgatgaacctgaggaaatttttataaatgaatatttcctataattgataaaatattatcatttaattatcacatttaaaacttatattaagtgtaaattccagtggctttacctcacttgaaaaattagtggggataagccattttgttttgtgatattaaatttaactatgatagttaattaaaaagacatatcttgtattcattaaaaatattttaatttaaaatattctgatttctaaagtgtgttagcttatcaattatttttgtttataaatagactttaatagctctctaagaatatgacctctaaaggaaaagatgattttttacaatacatacttctggaactttgagatttgagaaagcttccatgtatattgataaatctaataaaataaagagatcaattataaacctggttgttctataaaagtagagtgcacaaaaaaatgtcttgtgttttatactgtctaagatttggaggaaatgtggcaaattgcagtttatcgccatattttattatcatttttttctgtaaaagactataaaacttgaggattataaaataatcacagagtatatcaatggaaacagtttatcattttttcagttaaagtagtagtattgttagttgttgctgacacagggtctacataattacatgtgaattaaaacattggcaaaactgacccaccaataaacacatctattgaat

SEQ ID NO: 2679 - DNA, 582 bp, Homo sapiens
actgcaagcagtggcgccggctcacgcacccctcggccgcctctcgcgcggcttcccgcgccggcagcccgcgatggccccacgtgaccgcgtgtctggtctctaattaacagaagatggcaaagcccagccacagcagctatgtccttcagcagctaaacaaccaaagagaatggggttttctctgtgactgctgtattgcaattgatgacatttactttcaagcacacaaggcagttctagctgcctgtagctcctattttagaatgtttttcatgaaccatcagcatagtactgcacaactgaatctcagcaacatgaaaattagtgcagaatgttttgatctcattttgcagtttatgtatttaggaaaaattatgacagctccctccagttttgagcagtttaaagtggcaatgaactacctacagctatacaatgttcctgactgtttagaagacatccaggatgcagattgttctagttcaaaatgttcctcttctgcttccagcaaacagaacagcaaaatgatatttggggtaagaatgtatgaagatactgtggctcgaaatggcaatgaag

SEQ ID NO: 2680 - DNA, 2825 bp, Homo sapiens
tagggacaagcctgagcgtcacaggctccccacaaacaaccgcgtgacccggggactttccccagggtgtgcaaaagcacaggcaccccctcagttctggggtgaagcacagtccctggcagagccagagcctctccgcgcagcccagcccgagcgccgagcgccgcgcgccgccgccactgcagctcgcggccccttcgccttcgcccgcctttcccgcggctgatttgccttaaactccctaaaatctccgcagctctggttcctgttgcggccgtgccctctggtggtcagaagatgctgtgctgtctcgttaggatgaatggattaaaatgtacttttcctcctctgcttctggagagggagagaggaatattccagaagccactgtgttccttctgctttctgtgtgggtctctaattaacagaagatggcaaagcccagccacagcagctatgtccttcagcagctaaacaaccaaagagaatggggttttctctgtgactgctgtattgcaattgatgacatttactttcaagcacacaaggcagttctagctgcctgtagctcctattttagaatgtttttcatgaaccatcagcatagtactgcacaactgaatctcagcaacatgaaaattagtgcagaatgttttgatctcattttgcagtttatgtatttaggaaaaattatgacagctccctccagttttgagcagtttaaagtggcaatgaactacctacagctatacaatgttcctgactgtttagaagacatccaggatgcagattgttctagttcaaaatgttcctcttctgcttccagcaaacagaacagcaaaatgatatttggggtaagaatgtatgaagatactgtggctcgaaatggcaatgaagccaacaggtggtgtgcagagccaagttcaacggtaaatacaccacataatagagaggctgatgaagagtctttacaattaggtaattttcctgagccactatttgatgtatgtaaaaaaagttccgtgtccaaattatctactccaaaagaacgtgtgtcaagacgctttgggcggagttttacctgtgatagctgtggatttggctttagctgtgaaaaattattagatgagcatgtgctaacctgtactaacagacatttataccaaaacacaagatcttaccatagaatagtagatattagagatggaaaagacagtaacatcaaagctgaatttggtgaaaaagattcttccaaaacattttctgcacagacggacaaatacagaggagacacaagccaggctgctgatgattcagcttcaaccactggaagcagaaaaagtagcacagtggagtctgaaatagcaagcgaagagaaaagcagagctgctgagaggaaaaggattattattaagatggagccagaagatattcctacagatgaactgaaagactttaacattattaaagttactgataaagactgtaatgaatccactgacaatgatgaattagaagatgaacctgaagagccattttatagatactatgttgaagaagatgtcagcataaaaaaaagtggtaggaaaactctaaaacctcgaatgtcagtaagtgctgatgaaagaggtggtttagagaatatgaggccccctaacaacagcagtccagtacaagaggatgctgaaaatgcatcttgtgagctgtgtggacttacaataaccgaggaggacctgtcatctcattacttagccaaacacattgaaaatatctgtgcatgtggtaaatgtggacaaatacttgtaaagggtaggcagcttcaggaacatgctcaacgatgtggcgagccccaagatctgaccatgaatgggttaggaaatactgaggagaaaatggacttggaagagaatcctgatgagcagtccgaaataagagatatgtttgttgaaatgctggatgattttagggacaatcattaccagataaacagtatccaaaaaaagcagttatttaaacattctgcctgcccttttcgatgtcctaattgtggccagcgttttgaaactgaaaatctagtggttgaacatatgtctagctgcttagatcaagatatgtttaagagtgccatcatggaagaaaatgaaagagatcacagacgaaagcatttttgtaatctgtgtggaaaaggattttatcagcggtgtcacttaagagaacactatactgttcatactaaggaaaaacagtttgtttgtcaaacatgtggaaagcagtttttaagagagcgtcagttgcgactgcacaatgatatgcacaaaggcatggccaggtatgtctgttccatttgtgatcaaggaaacttcagaaaacatgaccatgtacggcatatgatttctcatttatctgctggtgagactatatgccaggtctgctttcagatattcccaaataatgaacagttggagcagcacatggatgttcatctgtatacatgtggaatatgtggagcaaaatttaatttgaggaaagatatgagatcacattataatgccaagcatttgaaaagaacctgagtgattttctactgtactaatgtttagatgatagcagataaaacaccaaagcaaaggatatgagctatttaggaattgattatataagatgatttgttagaaacaaatttcaaggcccttttaactttaatatttttgtttaggattttaagtatctacatttaggtattaaatgtttatcatttttgttgtttcttaatagaattatttgtttttagtttttcttagctatgattaaaatttttaaatgta

SEQ ID NO: 2681 - DNA, 629 bp, Homo sapiens
agtgcggtgcggcaggcgcggctgtgcggcagcggaagtcctttgttgcagcacagtccctggcagagccagagcctctccgcgcagcccagcccgagcgccgagcgccgcgcgccgccgccactgcagctcgcggccccttcgccttcgcccgcctttcccgcggctgatttgccttaaactccctaaaatctccgcagctctggttcctgttgcggccgtgccctctggtggtcagaagatgctgtgctgtctcgttaggatgaatggattaaaatgtacttttcctcctctgcttctggagagggagagaggaatattccagaagccactgtgttccttctgctttctgtgtggcatgatgccttcttctgtagagtgggcgctttgcagaatacgtgttgaatgaaatcactgatctaggaaaagtaaaaattcctcaaatgaatacagaatacttgtgctactgctgatgatcaacactttatacagtgcctggtataccaaaggtctctaattaacagaagatggcaaagcccagccacagcagctatgtccttcagcagctaaacaaccaaagagaatggggttttctctgtgactgctgtattgcaattgatgacatttac

SEQ ID NO: 2682 - DNA, 509 bp, Homo sapiens
acagttcgcagttgtgactctgtaggcggaagcatagggacaagcctgagcgtcacaggctccccacaaacaaccgcgtgacccggggactttccccagggtctctaattaacagaagatggcaaagcccagccacagcagctatgtccttcagcagctaaacaaccaaagagaatggggttttctctgtgactgctgtattgcaattgatgacatttactttcaagcacacaaggcagttctagctgcctgtagctcctattttagaatgtttttcatgaaccatcagcatagtactgcacaactgaatctcagcaacatgaaaattagtgcagaatgttttgatctcattttgcagtttatgtatttaggaaaaattatgacagctccctccagttttgagcagtttaaagtggcaatgaactacctacagctatacaatgttcctgactgtttagaagacatccaggatgcagattgttctagttcaaaatgttcctcttctgctt

SEQ ID NO: 2683 - DNA, 2181 bp, Homo sapiens
gaaatgactactgtccggggcccgaggtgctgcctcgcacaatgcatcaaaggaggttgtgtccgtggtcgtaacctcttcgcgtgaaaggcaccgcctggtccagtctttgtgaaggaacaaaataagttcacttccttgggcaccgccacccaccctcagcaaatgacaaggctggagcgcagctcccaccgcacagttatttgcaaagtcccaggtgaactcgtggcgagagaaggaaaatgcgcgtcccgggcgcgggagtcagaaataccatcagaggaggggtactgtgactttaatagtaggccaaatgagaactcttattgctatcaacttctgcgacaactaaatgaacagagaaagaaaggtattctttgtgatgtcagcattgtggtaagcggaaaaatcttcaaagctcataagaacatcctggttgcaggcagccgtttctttaagactttatattgcttttcaaacaaagaaagccctaaccaaaacaatactacccacttagatattgctgcagttcaaggtttttcagtcatcttggacttcttgtattctggtaacctggtgctcacaagccaaaatgccattgaagttatgaccgtggccagctatcttcaaatgagtgaagttgttcaaacttgccgaaatttcattaaagatgccttaaatataagcattaaatcagaagctccagagtctgtagttgtggactataataatagaaaaccagttaatagagatggtctgtcttcatcacgggatcaaaaaattgccagtttttgggcaacacggaatcttaccaatttggcaagtaatgtaaagattgaaaatgatggttgtaatgtcgacgagggccaaatagaaaactaccaaatgaatgacagtagttgggtccaggatggatctcctgaaatggctgaaaatgaatctgaaggtcaaacaaaagtgtttatttggaataatatgggctcccagggaattcaagagactggcaaaacaaggaggaaaaaccaaactacaaaaagatttatttataatattccacctaataatgaaacgaatttagaagattgctcagtaatgcagccacctgttgcctatccagaagaaaatacactactcatcaaggaagaaccagatttagatggtgctctactctcggggccagatggtgataggaatgtgaatgcaaatttattggctgaagctggcactagtcaagatggaggtgatgctggtacttcacatgatttcaagtatggtttgatgcctggtccttcaaatgatttcaagtatggattgataccaggtacttcaaatgatttcaagtatggattgataccaggtgcttcaaatgatttcaagtatggattattgccagaatcttggccaaaacaagaaacctgggaaaatggtgaatcatctctaatcatgaacaagttaaaatgccctcattgtagctatgtagccaaatacagacgaacactaaaaaggcacttgctcattcacacaggagtgagatcatttagctgtgatatttgtggaaaactgtttactcgaagagaacatgtaaaaagacattccctggtgcataaaaaggataaaaaatacaaatgtatggtgtgtaagaagatcttcatgttagcagccagtgttggaataagacatggatctcgacgttatggtgtttgtgtagactgtgcagataaatcacagccaggagggcaagaaggtgtagatcagggacaggatacagaattccctcgggatgaagaatacgaggagaatgaagtaggagaagctgatgaagagctagttgatgatggagaagatcagaatgatccctctcgatgggatgaatcaggagaagtttgtatgtctctagatgattaactgacctactatactcctcaaggatgctgcatttggacctaatatgaatcgacaatttggattgttgaacttgaaggcttgcaaaatatggtacatgctggatagtagttatgttgctgtgaaaactgtagggtcaaagccttatagcaaaaaaaatttttttttatatttgcacaggactatacagcaaacaaccatgtggttggattacatggagtccccacatactcagtcagttatcaaagtaaaatattttttatttataggatatacagt

SEQ ID NO: 2684 - DNA, 6061 bp, Homo sapiens
cggtccgttgttcatttgccattcgacctccgccagggcctggtcggacggaaacgctccgccggctttattgtcgcttcgttatgtggcggagccgagcagtttagcgtgcctctcaccctcagcgcctgcgaagccggcggcggcgtcgggactcctcggcgcgcggaggaaggatatctgtgtggaggatcggtgtgtgcgcgcgcggctttaaagagggggcagcggagggtctccccgcactccgctgctcaacttcgaaggcctcgctcgctgcaggctcgctcctcacctctccgccgcccgcccccttctccgcgcgggacgctgcccggagcgcggcggggcgggggtggaggacgagagagcggtcggaggcgtcggcccggcagcggcagcggcagcggacgcgtgcagcagacccgggagcgagcgcgagccgggctgccgggcgagagggcgaggccgagccccgcgagaccggaacgccgggggcgggggcgagacagagggggagccgcggggagcgcgcgggacgcggcccgaggccgtgcgcgagccggggcaccgggcggcggcggcggcggcgcgcgccatgtcgttcagtgaaatgaaccgcaggacgctggcgttccgaggaggcgggttggtcaccgctagcggcggcggctccacgaacaataacgctggcggggaggcctcagcttggcctccgcagccccagccgagacagcccccgccgccagcgccgcccgcgcttcagccgcctaatgggcggggggccgacgaggaagtggaattggagggcctggagccccaagacctggaggcctccgccgggccggccgccggcgccgccgaggaagccaaggagttgctgctcccccaagacgcgggcggccccacctcgcttggcggtggcgcggggggccccctgctagcggaaaggaaccgtcggactctggccttccgaggcggcggcggcgggggtctcggcaacaatggcagtagccgcggccgccccgagacctcggtgtggcccttgaggcatttcaatgggcgagggccggcgactgtggatctggagctggacgcgctggaggggaaggagttgatgcaggacggcgcgtccctgagcgacagcaccgaggacgaggaggagggggcgagcctgggcgacggcagcggggcggaaggcggcagctgcagcagcagcaggcggtcgggcggcgatggcggggacgaagtggagggcagcggtgtgggagctggcgaaggagagactgtccagcacttcccgctcgcgcggcccaagtctctaatgcagaagctccaatgctccttccagacctcctggctcaaggactttccctggctgcgctattccaaggatactggtcttatgtcttgcggctggtgccaaaagacccctgcagatgggggaagcgtggaccttcccccagtggggcatgatgagctttcgcgagggacccgcaactacaagaaaaccctcctcctgaggcaccacgtctctaccgagcacaaactccacgaagccaacgcccaggagtcagaaataccatcagaggaggggtactgtgactttaatagtaggccaaatgagaactcttattgctatcaacttctgcgacaactaaatgaacagagaaagaaaggtattctttgtgatgtcagcattgtggtaagcggaaaaatcttcaaagctcataagaacatcctggttgcaggcagccgtttctttaagactttatattgcttttcaaacaaagaaagccctaaccaaaacaatactacccacttagatattgctgcagttcaaggtttttcagtcatcttggacttcttgtattctggtaacctggtgctcacaagccaaaatgccattgaagttatgaccgtggccagctatcttcaaatgagtgaagttgttcaaacttgccgaaatttcattaaagatgccttaaatataagcattaaatcagaagctccagagtctgtagttgtggactataataatagaaaaccagttaatagagatggtctgtcttcatcacgggatcaaaaaattgccagtttttgggcaacacggaatcttaccaatttggcaagtaatgtaaagattgaaaatgatggttgtaatgtcgacgagggccaaatagaaaactaccaaatgaatgacagtagttgggtccaggatggatctcctgaaatggctgaaaatgaatctgaaggtcaaacaaaagtgtttatttggaataatatgggctcccagggaattcaagagactggcaaaacaaggaggaaaaaccaaactacaaaaagatttatttataatattccacctaataatgaaacgaatttagaagattgctcagtaatgcagccacctgttgcctatccagaagaaaatacactactcatcaaggaagaaccagatttagatggtgctctactctcggggccagatggtgataggaatgtgaatgcaaatttattggctgaagctggcactagtcaagatggaggtgatgctggtacttcacatgatttcaagtatggtttgatgcctggtccttcaaatgatttcaagtatggattgataccaggtacttcaaatgatttcaagtatggattgataccaggtgcttcaaatgatttcaagtatggattattgccagaatcttggccaaaacaagaaacctgggaaaatggtgaatcatctctaatcatgaacaagttaaaatgccctcattgtagctatgtagccaaatacagacgaacactaaaaaggcacttgctcattcacacaggagtgagatcatttagctgtgatatttgtggaaaactgtttactcgaagagaacatgtaaaaagacattccctggtgcataaaaaggataaaaaatacaaatgtatggtgtgtaagaagatcttcatgttagcagccagtgttggaataagacatggatctcgacgttatggtgtttgtgtagactgtgcagataaatcacagccaggagggcaagaaggtgtagatcagggacaggatacagaattccctcgggatgaagaatacgaggagaatgaagtaggagaagctgatgaagagctagttgatgatggagaagatcagaatgatccctctcgatgggatgaatcaggagaagtttgtatgtctctagatgattaactgacctactatactcctcaaggatgctgcatttggacctaatatgaatcgacaatttggattgttgaacttgaaggcttgcaaaatatggtacatgctggatagtagttatgttgctgtgaaaactgtagggtcaaagccttatagcaaaaaaaatttttttttatatttgcacaggactatacagcaaacaaccatgtggttggattacatggagtccccacatactcagtcagttatcaaagtaaaatattttttatttataggatatacagtaactatttgggtcctatgaaaatagtccttaaagagcttacattcatgtgctactttaacatgaatggagaaaatccgtttatggaagtacagtgacaattgacccaatcactctgtccatcaaaccactcaggctagtttgtactagtagagttttgtttctatttttatttttattaattttattttttttaatacagattttcagtgaggggctttttcaaccccattggttctattttcttgtatttttccatttaatttgcttcataacttaaaccaagtctcttctagtcttaggtattatttctcgattttgtgctgatgggcatgtttataagaactggagaggtaatttattggaatgaactaactgacttcctccattcccctcttcctttttgacatgaattttactacttcacaaatgaagaatgatgttatgaagttaccgtggcgaagttgacaaataccactaaaatgattatgatttagaagtaactttcttctgctgctctaatctgataaatggttactatatgatattttctgacatggtatttggttttgggtatctgttactttggcactattcttgtttgcctctttatttttgccagtgtactatacctcagtcctatttgaaagacctaattgaaagaaaaatcatagaaataagtaaaatgatttgttttataatttatccaccatgtccagtttggttagcttgttatgcaatataagtgaaatatcaggtttttacccgtgtcccttttatcatgaaaattaacacaaaatgtgcattctcttttgtttcatacttagcgggatattgattgttttgaaattatgatcaatacttaatttatttttttctgtccttgaagtcactacaccttgatacagtctttctagtagtcaccatgattcaacagtctcaaaaatcttacaaataaaattctgagaagctttattattctataaattcttcagggtacaaagggtgacatattgaggtgaaattgtcagatttacttagcctggtgacatgaattagctgattgtggaactctcagcagcatttcacgtattgttaacatgtatggcatttattagcatattgtatattatataagattgagggatgtcatattttcagctttcttttaaataaaaattgagtatattttcctattttatatcaggtaactaaattatgctagttatgtggaaaaaattgcaaagatgctttgacagatataatccctttggtgctccatctgatcaaagttgaaaagttgatgttttttaagagacaagctttatcattgtctctgatttcagtagaataatggtttattgttagacaatgatgtttctgcttggataaatcaaagataaattacagttacatggttagatgcatcttttgtcatctatattgtagtttctacataactgtaaacctgacagataagaatagtttcggtttgatttttgtttaaaacagatgagtacttcttaatgttctagacaaatgagtaaaatgtatttctggtagaaattagttgggcaaagatactatgaatgaaaaagtattttaaacgtaaaatgttctttgtgaatatgtaagtatagtataaagatttctttcatcccatttatccccttcctttaaataaactagtttacaattggtagatctgtctatatataaatatatattaaagaacaaagatatatatctaaaaatcacctaaatctgctttattagactacagttcacttattgcatagaaactggacttggctttacattcttaatgtacttttacttttcctcaagatatgaacttactctcttgaagctgaattttcttttactacttaaatcatttatgtatatctggtaaattatgaccaaatttttgttagattgcatacagtaaattgaaatacacacttggtacactacgggattgttgtgcttttgtttggttttagttggaaataaggtttgatgtagatggcttgttactgttaatttaaaatattctataattgtccattactttatgttgtgttgtgacagatttggctatatttttagtcaattgaaatatgatactttaaaagtttgtttttaggtaatccaaaggaaaagtgtttatactcttgaatatattagcctcagcctatataaaaatttctttgaagtaaacattttaccggaaacagaattgacagatttttctacttgctgactgcctaacttattttgtttcatgatctcgagggactgccttttcccatctagatcttttaaaaaaatagttttagtactaaggtatactactggacatttctatttttttaagtgtattctttttctgacttacagtaaaatttcaggaagttgatagatactaagaacttatgattggtctcagaggtaacaatgaaatactcataattttgtctgtggaactctggcagaattatgttacacatttggcgaagttgtctcttgtaatttatattttaaatgaaaaagtattttagagcttttaa

SEQ ID NO: 2685 - DNA, 10132 bp, Homo sapiens
aaaggaggttgtgtccgtggtcgtaacctcttcgcgtgaaaggcaccgcctggtccagtctttgtgaaggaacaaaataagttcacttccttgggcaccgccacccaccctcagcaaatgacaaggctggagcgcagctcccaccgcacagttatttgcaaagtcccaggtgaactcgtggcgagagaaggaaaatgcgcgtcccgggcgcgggtagggcctggtcggacggaaacgctccgccggctttattgtcgcttcgttatgtggcggagccgagcagtttagcgtgcctctcaccctcagcgcctgcgaagccggcggcggcgtcgggactcctcggcgcgcggaggaaggatatctgtgtggaggatcggtgtgtgcgcgcgcggctttaaagagggggcagcggagggtctccccgcactccgctgctcaacttcgaaggcctcgctcgctgcaggctcgctcctcacctctccgccgcccgcccccttctccgcgcgggacgctgcccggagcgcggcggggcgggggtggaggacgagagagcggtcggaggcgtcggcccggcagcggcagcggcagcggacgcgtgcagcagacccgggagcgagcgcgagccgggctgccgggcgagagggcgaggccgagccccgcgagaccggaacgccgggggcgggggcgagacagagggggagccgcggggagcgcgcgggacgcggcccgaggccgtgcgcgagccggggcaccgggcggcggcggcggcggcgcgcgccatgtcgttcagtgaaatgaaccgcaggacgctggcgttccgaggaggcgggttggtcaccgctagcggcggcggctccacgaacaataacgctggcggggaggcctcagcttggcctccgcagccccagccgagacagcccccgccgccagcgccgcccgcgcttcagccgcctaatgggcggggggccgacgaggaagtggaattggagggcctggagccccaagacctggaggcctccgccgggccggccgccggcgccgccgaggaagccaaggagttgctgctcccccaagacgcgggcggccccacctcgcttggcggtggcgcggggggccccctgctagcggaaaggaaccgtcggactctggccttccgaggcggcggcggcgggggtctcggcaacaatggcagtagccgcggccgccccgagacctcggtgtggcccttgaggcatttcaatgggcgagggccggcgactgtggatctggagctggacgcgctggaggggaaggagttgatgcaggacggcgcgtccctgagcgacagcaccgaggacgaggaggagggggcgagcctgggcgacggcagcggggcggaaggcggcagctgcagcagcagcaggcggtcgggcggcgatggcggggacgaagtggagggcagcggtgtgggagctggcgaaggagagactgtccagcacttcccgctcgcgcggcccaagtctctaatgcagaagctccaatgctccttccagacctcctggctcaaggactttccctggctgcgctattccaaggatactggtcttatgtcttgcggctggtgccaaaagacccctgcagatgggggaagcgtggaccttcccccagtggggcatgatgagctttcgcgagggacccgcaactacaagaaaaccctcctcctgaggcaccacgtctctaccgagcacaaactccacgaagccaacgcccaggagtcagaaataccatcagaggaggggtactgtgactttaatagtaggccaaatgagaactcttattgctatcaacttctgcgacaactaaatgaacagagaaagaaaggtattctttgtgatgtcagcattgtggtaagcggaaaaatcttcaaagctcataagaacatcctggttgcaggcagccgtttctttaagactttatattgcttttcaaacaaagaaagccctaaccaaaacaatactacccacttagatattgctgcagttcaaggtttttcagtcatcttggacttcttgtattctggtaacctggtgctcacaagccaaaatgccattgaagttatgaccgtggccagctatcttcaaatgagtgaagttgttcaaacttgccgaaatttcattaaagatgccttaaatataagcattaaatcagaagctccagagtctgtagttgtggactataataatagaaaaccagttaatagagatggtctgtcttcatcacgggatcaaaaaattgccagtttttgggcaacacggaatcttaccaatttggcaagtaatgtaaagattgaaaatgatggttgtaatgtcgacgagggccaaatagaaaactaccaaatgaatgacagtagttgggtccaggatggatctcctgaaatggctgaaaatgaatctgaaggtcaaacaaaagtgtttatttggaataatatgggctcccagggaattcaagagactggcaaaacaaggaggaaaaaccaaactacaaaaagatttatttataatattccacctaataatgaaacgaatttagaagattgctcagtaatgcagccacctgttgcctatccagaagaaaatacactactcatcaaggaagaaccagatttagatggtgctctactctcggggccagatggtgataggaatgtgaatgcaaatttattggctgaagctggcactagtcaagatggaggtgatgctggtacttcacatgatttcaagtatggtttgatgcctggtccttcaaatgatttcaagtatggattgataccaggtacttcaaatgatttcaagtatggattgataccaggtgcttcaaatgatttcaagtatggattattgccagaatcttggccaaaacaagaaacctgggaaaatggtgaatcatctctaatcatgaacaagttaaaatgccctcattgtagctatgtagccaaatacagacgaacactaaaaaggcacttgctcattcacacaggagtgagatcatttagctgtgatatttgtggaaaactgtttactcgaagagaacatgtaaaaagacattccctggtgcataaaaaggataaaaaatacaaatgtatggtgtgtaagaagatcttcatgttagcagccagtgttggaataagacatggatctcgacgttatggtgtttgtgtagactgtgcagataaatcacagccaggagggcaagaaggtgtagatcagggacaggatacagaattccctcgggatgaagaatacgaggagaatgaagtaggagaagctgatgaagagctagttgatgatggagaagatcagaatgatccctctcgatgggatgaatcaggagaagtttgtatgtctctagatgattaactgacctactatactcctcaaggatgctgcatttggacctaatatgaatcgacaatttggattgttgaacttgaaggcttgcaaaatatggtacatgctggatagtagttatgttgctgtgaaaactgtagggtcaaagccttatagcaaaaaaaatttttttttatatttgcacaggactatacagcaaacaaccatgtggttggattacatggagtccccacatactcagtcagttatcaaagtaaaatattttttatttataggatatacagtaactatttgggtcctatgaaaatagtccttaaagagcttacattcatgtgctactttaacatgaatggagaaaatccgtttatggaagtacagtgacaattgacccaatcactctgtccatcaaaccactcaggctagtttgtactagtagagttttgtttctatttttatttttattaattttattttttttaatacagattttcagtgaggggctttttcaaccccattggttctattttcttgtatttttccatttaatttgcttcataacttaaaccaagtctcttctagtcttaggtattatttctcgattttgtgctgatgggcatgtttataagaactggagaggtaatttattggaatgaactaactgacttcctccattcccctcttcctttttgacatgaattttactacttcacaaatgaagaatgatgttatgaagttaccgtggcgaagttgacaaataccactaaaatgattatgatttagaagtaactttcttctgctgctctaatctgataaatggttactatatgatattttctgacatggtatttggttttgggtatctgttactttggcactattcttgtttgcctctttatttttgccagtgtactatacctcagtcctatttgaaagacctaattgaaagaaaaatcatagaaataagtaaaatgatttgttttataatttatccaccatgtccagtttggttagcttgttatgcaatataagtgaaatatcaggtttttacccgtgtcccttttatcatgaaaattaacacaaaatgtgcattctcttttgtttcatacttagcgggatattgattgttttgaaattatgatcaatacttaatttatttttttctgtccttgaagtcactacaccttgatacagtctttctagtagtcaccatgattcaacagtctcaaaaatcttacaaataaaattctgagaagctttattattctataaattcttcagggtacaaagggtgacatattgaggtgaaattgtcagatttacttagcctggtgacatgaattagctgattgtggaactctcagcagcatttcacgtattgttaacatgtatggcatttattagcatattgtatattatataagattgagggatgtcatattttcagctttcttttaaataaaaattgagtatattttcctattttatatcaggtaactaaattatgctagttatgtggaaaaaattgcaaagatgctttgacagatataatccctttggtgctccatctgatcaaagttgaaaagttgatgttttttaagagacaagctttatcattgtctctgatttcagtagaataatggtttattgttagacaatgatgtttctgcttggataaatcaaagataaattacagttacatggttagatgcatcttttgtcatctatattgtagtttctacataactgtaaacctgacagataagaatagtttcggtttgatttttgtttaaaacagatgagtacttcttaatgttctagacaaatgagtaaaatgtatttctggtagaaattagttgggcaaagatactatgaatgaaaaagtattttaaacgtaaaatgttctttgtgaatatgtaagtatagtataaagatttctttcatcccatttatccccttcctttaaataaactagtttacaattggtagatctgtctatatataaatatatattaaagaacaaagatatatatctaaaaatcacctaaatctgctttattagactacagttcacttattgcatagaaactggacttggctttacattcttaatgtacttttacttttcctcaagatatgaacttactctcttgaagctgaattttcttttactacttaaatcatttatgtatatctggtaaattatgaccaaatttttgttagattgcatacagtaaattgaaatacacacttggtacactacgggattgttgtgcttttgtttggttttagttggaaataaggtttgatgtagatggcttgttactgttaatttaaaatattctataattgtccattactttatgttgtgttgtgacagatttggctatatttttagtcaattgaaatatgatactttaaaagtttgtttttaggtaatccaaaggaaaagtgtttatactcttgaatatattagcctcagcctatataaaaatttctttgaagtaaacattttaccggaaacagaattgacagatttttctacttgctgactgcctaacttattttgtttcatgatctcgagggactgccttttcccatctagatcttttaaaaaaatagttttagtactaaggtatactactggacatttctatttttttaagtgtattctttttctgacttacagtaaaatttcaggaagttgatagatactaagaacttatgattggtctcagaggtaacaatgaaatactcataattttgtctgtggaactctggcagaattatgttacacatttggcgaagttgtctcttgtaatttatattttaaatgaaaaagtattttagagcttttaatgaaggggaagagtataaactttctttcatattcactctgtagttacagaccgtctcataaatcaagattgtgcattattagagttctcagagacagatacttccatatggacccctgttcatttttcttatttactagatattttgctaaatttagcacactagcaattaagagtttaaaaaagaagaaacgttataggaaagggaaactgaacagtaatgagtagctttgaaattggggaaaacacactagctgggttaggtacagctatcctaatggagaagagtgagctaaatgcgttaattcatgtaaagtgcttagaacactggtacataataggtgcataacacatcttaaagttgtttaataatagataagaaccaagaggaaaaagaaataagaaaagatgggggaaaggaaggagaaaataggaaatgaaaggattaggacttgggcatttatattaatacaaaatggtgtaaacggcctgaatatcactgtagtagtatcatacgggggaaagtgtgatggaaaataggtttaaaaatcttaatttttaaaactttagtaagctttatttatattttttaggattttctgaacatagcatgaagggtttagattcatttttctgaaaaacgattaaaaaaactaccaattttttttttgagtgcccacacttgccgttgtgctgtatacatgattttaccttaatcctctataaggtaggtgctaattgtctccattttatagatgaggaaaggctcagagaaattcagaaacttggctaatttaacacagctgtgacagagctcgaatttgaccacgtctgattctgaagcccatactctttcagggaggctctattgctgcctcattaaacaactcttgtagaatttcagctcttaatggagtctatggattatatttttcctataagacagctgtgtttagaattttgagtgtctttcctccccccaataaatttccttactactctttcttcataaagcagttgttttgtcactttgactatattaagacacatcagtgtagcacatgctcttaactggctgtggcattttaattttataaaagaatggtttttatctgaagaactagatagaaaccccagtttttgtgccgttcagtcacccagatccttaaacttaactatggtacataatatccacacttagaactaacaggtgtttagtcactttaggacttaaaatggaaagtttttttttttttcctgctgtatctctgctttcaactgaagttaaagaattctagatagtttaaaatgtgttagggataagcacacttcaaaagatgttttctagccctaaattttatgacattgggtacttaaatttggagtacactagctattgagaacaatattttgggttgaggagagatggttgaggccattatttagtgggagcattggcattttgaacactgtaaacaaaagaacacttccgcctgctgtttgtaaaagctctttgggaagatcttttacgaagaccaactttttaaaatgtaaattacctacctaatataagtgtcctaagacatgtatgtaaacttccggaactgttttgtctgtgtatttagaaaatacacaagaatctttattcaaacctaaaaatataaacttgtgagcactaaactgcttctggctttgtgaattttattgactgacatttaattcagatttctttgcaagtgtactaatttagactaattggggtaaggggaacaccttaatgaactttgacttatgtataattcagatatctttgtacttaaggcttacaagtttgaattatggaatactataagggttttttgtttatttgtatgtttttatatgaaagtacataaatgacagactacctccaagtaatcctgctttaattaatagcagtgatttgtaatcagtgtatcttttaagattctctacaggttttagaaaatattaaaaattccctgtaatttacatttgtgcataatcttggaaatgggttgaaaagcaaaggtaaactgcttcatcccatgttgtatatttgtggactgattgactacaagtgatgtgatgttataaatttgaagtctttgaaactttattaatgtagagaaaacataactagctttttaggttatttcaaagttagtaatagagcaaaggaaatcagaactggccagatattcagacttgacttagaaaaacaggagtttgttgattttgtttggagaagggcacaataaaggggagcccacatagcattataatgcctagtatctttaaacatgtaaagagctatcatgaggcagaagaattaagaaactttatatgtttctaaggggtcatgattgggaccattggctcaagattgaaaatcggtttttaattatccaaagatgaaatggggctgcttcagaaaaaggtctaccactggagataacgctatgaaaagtgaaagagattacttaatcattttgacaaaggcagtattgaccagacatttctatttcagagttggatttgtgcttagttttttttaggtgttgggacccttgtagttgctttttattttgcttagtcaacaaacactaaaatgataaaatttggtatgtataagtactggacgaaggatgttttgacactaaaaaggacataatttaggaaattaagaatttagacaccaagtttggcttaatagaaaaagtcactatctgaacttctttctttttcaccacaaatcaccgcagaccagtgtttgggagcaggtgtaggaaattgaattattggatctatgtttaggtaagaaaactaaaggtacttcagaatttaggctatgacataactgtctttctgaagtttaaagaaagaaagtgaactatagaaatctattcagctaattaaagtgaatgaaaaatattacagattccataactgcatggcgccttacctgctattaatactgccgccttactgtcagccagatgattttttcccaccacggccagtcttaaatttggcaataagaaaaagctaatcttccaagtgtaagtaggtatgtgttagaatcttggtgaaagataaacacaagacagtcttcttggcgcaggtcctaacagttggtgagataatacataagatggtttcaggattattgtagaattatttaggttgaaagagactgtaagagactaatgaagcatacccagagaggttgctacagtgactccagtcagttttaggacccaggactcctgaacttcaatttcagtattatttttctgtaccaaactcattcaataaatacttgagattagggataagtttgaagttagaagattccagagtacactcaaatagtatttggcacatagcttgttgatcaaaagtatttactaagtgagtgacaaaaggcactagcaactttaaggattttgcctattagtatcatatggcatgtagctatcaagccagtttcgtttagttattttgtgttgccaagcatatgatacgtggtgtcacactgagcctttgggatcctttccctggatacataaccctagtagataatgttactgcaagatgtaatgaccaaatccaacctactgcaaatgttactatggaaatctcaatgcaaaagtagcctttgtgattttttttttaaaccgtctccataacagaacacttagaattattagccatttgctgcaaagtatttgttttaaaatgtctggcatatacaccactaacatttaaatgcccaacattcggtctatacgtgaaaaaactagaagaaaagccctgttggagttttgatgtagagtgcaataatacatcaataaaggtattttaaaatga

SEQ ID NO: 2686 - DNA, 5386 bp, Homo sapiens
cggtccgttgttcatttgccattcgacctccgccagggcctggtcggacggaaacgctccgccggctttattgtcgcttcgttatgtggcggagccgagcagtttagcgtgcctctcaccctcagcgcctgcgaagccggcggcggcgtcgggactcctcggcgcgcggaggaaggatatctgtgtggaggatcggtgtgtgcgcgcgcggctttaaagagggggcagcggagggtctccccgcactccgctgctcaacttcgaaggcctcgctcgctgcaggctcgctcctcacctctccgccgcccgcccccttctccgcgcgggacgctgcccggagcgcggcggggcgggggtggaggacgagagagcggtcggaggcgtcggcccggcagcggcagcggcagcggacgcgtgcagcagacccgggagcgagcgcgagccgggctgccgggcgagagggcgaggccgagccccgcgagaccggaacgccgggggcgggggcgagacagagggggagccgcggggagcgcgcgggacgcggcccgaggccgtgcgcgagccggggcaccgggcggcggcggcggcggcgcgcgccatgtcgttcagtgaaatgaaccgcaggacgctggcgttccgaggaggcgggttggtcaccgctagcggcggcggctccacgaacaataacgctggcggggaggcctcagcttggcctccgcagccccagccgagacagcccccgccgccagcgccgcccgcgcttcagccgcctaatgggcggggggccgacgaggaagtggaattggagggcctggagccccaagacctggaggcctccgccgggccggccgccggcgccgccgaggaagccaaggagttgctgctcccccaagacgcgggcggccccacctcgcttggcggtggcgcggggggccccctgctagcggaaaggaaccgtcggactctggccttccgaggcggcggcggcgggggtctcggcaacaatggcagtagccgcggccgccccgagacctcggtgtggcccttgaggcatttcaatgggcgagggccggcgactgtggatctggagctggacgcgctggaggggaaggagttgatgcaggacggcgcgtccctgagcgacagcaccgaggacgaggaggagggggcgagcctgggcgacggcagcggggcggaaggcggcagctgcagcagcagcaggcggtcgggcggcgatggcggggacgaagtggagggcagcggtgtgggagctggcgaaggagagactgtccagcacttcccgctcgcgcggcccaagtctctaatgcagaagctccaatgctccttccagacctcctggctcaaggactttccctggctgcgctattccaaggatactggtcttatgtcttgcggctggtgccaaaagacccctgcagatgggggaagcgtggaccttcccccagtggggcatgatgagctttcgcgagggacccgcaactacaagaaaaccctcctcctgaggcaccacgtctctaccgagcacaaactccacgaagccaacgcccaggagtcagaaataccatcagaggaggggtactgtgactttaatagtaggccaaatgagaactcttattgctatcaacttctgcgacaactaaatgaacagagaaagaaaggtattctttgtgatgtcagcattgtggtaagcggaaaaatcttcaaagctcataagaacatcctggttgcaggcagccgtttctttaagactttatattgcttttcaaacaaagaaagccctaaccaaaacaatactacccacttagatattgctgcagttcaaggtttttcagtcatcttggacttcttgtattctggtaacctggtgctcacaagccaaaatgccattgaagttatgaccgtggccagctatcttcaaatgagtgaagttgttcaaacttgccgaaatttcattaaagatgccttaaatataagcattaaatcagaagctccagagtctgtagttgtggactataataatagaaaaccagttaatagagatggtctgtcttcatcacgggatcaaaaaattgccagtttttgggcaacacggaatcttaccaatttggcaagtaatgtaaagattgaaaatgatggttgtaatgtcgacgagggccaaatagaaaactaccaaatgaatgacagtagttgggtccaggatggatctcctgaaatggctgaaaatgaatctgaaggtcaaacaaaagtgtttatttggaataatatgggctcccagggaattcaagagactggcaaaacaaggaggaaaaaccaaactacaaaaagatttatttataatattccacctaataatgaaacgaatttagaagattgctcagtaatgcagccacctgttgcctatccagaagaaaatacactactcatcaaggaagaaccagatttagatggtgctctactctcggggccagatggtgataggaatgtgaatgcaaatttattggctgaagctggcactagtcaagatggaggtgatgctggtacttcacatgatttcaagtatggtttgatgcctggtgcttcaaatgatttcaagtatggattattgccagaatcttggccaaaacaagaaacctgggaaaatggtgaatcatctctaatcatgaacaagttaaaatgccctcattgtagctatgtagccaaatacagacgaacactaaaaaggcacttgctcattcacacaggagtgagatcatttagctgtgatatttgtggaaaactgtttactcgaagagaacatgtaaaaagacattccctggtgcataaaaaggataaaaaatacaaatgtatggtgtgtaagaagatcttcatgttagcagccagtgttggaataagacatggatctcgacgttatggtgtttgtgtagactgtgcagataaatcacagccaggagggcaagaaggtgtagatcagggacaggatacagaattccctcgggatgaagaatacgaggagaatgaagtaggagaagctgatgaagagctagttgatgatggagaagatcagaatgatccctctcgatgggatgaatcaggagaagtttgtatgtctctagatgattaactgacctactatactcctcaaggatgctgcatttggacctaatatgaatcgacaatttggattgttgaacttgaaggcttgcaaaatatggtacatgctggatagtagttatgttgctgtgaaaactgtagggtcaaagccttatagcaaaaaaaatttttttttatatttgcacaggactatacagcaaacaaccatgtggttggattacatggagtccccacatactcagtcagttatcaaagtaaaatattttttatttataggatatacagtaactatttgggtcctatgaaaatagtccttaaagagcttacattcatgtgctactttaacatgaatggagaaaatccgtttatggaagtacagtgacaattgacccaatcactctgtccatcaaaccactcaggctagtttgtactagtagagttttgtttctatttttatttttattaattttattttttttaatacagattttcagtgaggggctttttcaaccccattggttctattttcttgtatttttccatttaatttgcttcataacttaaaccaagtctcttctagtcttaggtattatttctcgattttgtgctgatgggcatgtttataagaactggagaggtaatttattggaatgaactaactgacttcctccattcccctcttcctttttgacatgaattttactacttcacaaatgaagaatgatgttatgaagttaccgtggcgaagttgacaaataccactaaaatgattatgatttagaagtaactttcttctgctgctctaatctgataaatggttactatatgatattttctgacatggtatttggttttgggtatctgttactttggcactattcttgtttgcctctttatttttgccagtgtactatacctcagtcctatttgaaagacctaattgaaagaaaaatcatagaaataagtaaaatgatttgttttataatttatccaccatgtccagtttggttagcttgttatgcaatataagtgaaatatcaggtttttacccgtgtcccttttatcatgaaaattaacacaaaatgtgcattctcttttgtttcatacttagcgggatattgattgttttgaaattatgatcaatacttaatttatttttttctgtccttgaagtcactacaccttgatacagtctttctagtagtcaccatgattcaacagtctcaaaaatcttacaaataaaattctgagaagctttattattctataaattcttcagggtacaaagggtgacatattgaggtgaaattgtcagatttacttagcctggtgacatgaattagctgattgtggaactctcagcagcatttcacgtattgttaacatgtatggcatttattagcatattgtatattatataagattgagggatgtcatattttcagctttcttttaaataaaaattgagtatattttcctattttatatcaggtaactaaattatgctagttatgtggaaaaaattgcaaagatgctttgacagatataatccctttggtgctccatctgatcaaagttgaaaagttgatgttttttaagagacaagctttatcattgtctctgatttcagtagaataatggtttattgttagacaatgatgtttctgcttggataaatcaaagataaattacagttacatggttagatgcatcttttgtcatctatattgtagtttctacataactgtaaacctgacagataagaatagtttcggtttgatttttgtttaaaacagatgagtacttcttaatgttctagacaaatgagtaaaatgtatttctggtagaaattagttgggcaaagatactatgaatgaaaaagtattttaaacgtaaaatgttctttgtgaatatgtaagtatagtataaagatttctttcatcccatttatccccttcctttaaataaactagtttacaattggtagatctgtctatatataaatatatattaaagaacaaagatatatatctaaaaatcacctaaatctgctttattagactacagttcacttattgcatagaaactggacttggctttacattcttaatgtacttttacttttcctcaagatatgaacttactctcttgaagctgaattttcttttactacttaaatcatttatgtatatctggtaaattatgaccaaatttttgttagattgcatacagtaaattgaaatacacacttggt

SEQ ID NO: 2687 - DNA, 6020 bp, Homo sapiens
ttttccagaagcctgaaaatatgcttttatgatgttgggagtctcaaacgtaaaaacggactcctaaccctctggatgtttcggctgaactctcaactgtccaccagctccccctacacgtggctccttagaaagcgtggaaaagggaaaaatgaaaagagaaactgccaggacttaagatgtctgcttaaagactccctcgaactgcagtgaagggtcctacccgcttccaaaatgtccacccgcattcctgacgtcactggatcggctccatcaagccagaaaacgagagtgcgctccaatcagggctcagtccccgcccttgccttgcgtcacttccggtggtgcagcagccattttgtcagtcgccagcggatcccgcgcgctggagaagtgcagttccccctggttaccaactcgcccgcttttccttcggactaagggagccgtcgaagagcgctcgccaaaggcgcagccgtttctccctacggtgccgccgctcctcctgcagccgcccgtaggtagcgggccgttttcctcacctgtccctgacaggcgccctcagggagccgcggtccgcgatgtcaagcgaggaaagctaccgggccatcctgcgttacctgacgaacgagcgcgagccgtatgcgccgggcaccgagggcaatgtcaagcgtaaaatccgaaaagctgccgcctgctacgtggtgcgcggcgggactctgtattaccagcggcggcagcggcaccgcaagaccttcgcggagctggaggtggtgctgcagccggagcgacgccgggacctcatcgaggcggcgcacctgggtcccggcggcactcaccacacccggcatcagacctggcactacttgtccaagacgtactggtggcgaggtatattgaagcaagtcaaagattacattaaacagtgtagcaaatgccaggagaaactagatcgatcccgtccaatatcagatgtttcagaaatgttggaagaattgggactagaccttgaatctggagaagaaagtaatgaatcggaagatgacctgagcaactttacttcatctccaactacagcatccaagcctgcaaaaaagaagccagtatccaaacatgaacttgtgtttgttgacaccaaaggagtggtaaaacgttcttctccaaaacattgtcaggctgtcttaaaacagctgaacgaacagagactttccaaccagttctgtgatgttactttgttaattgaaggagaagagtacaaagctcataaatctgttttgtcagcaaatagcgagtattttcgagatctttttattgagaaaggagctgtttccagtcatgaggctgtggtggatctttctggtttttgtaaggccagcttccttcctttactggaatttgcctatacttctgtactaagttttgatttctgtagcatggctgatgtagccatcttagctcgtcatcttttcatgtcagaagtcttagagatttgtgaaagtgtacataagctaatggaagagaagcagctaacagtatataagaagggcgaagtacaaacagttgcatccacccaggacttacgagtacagaatggaggtacagcacctcctgttgctagcagtgagggaaccacaacaagtttacctactgaacttggggattgtgaaattgtactactggtaaatggagaattgccagaagctgagcagaatggagaggtaggacgacagcctgagccccaggtttcttcagaggctgaatctgccctgtcatcagtaggatgtatagctgattcccatcctgaaatggagtctgttgatttaataacaaaaaacaaccagacagaactagaaacttcaaacaacagagaaaataacacagtttctaatatacaccctaaactttcaaaagagaatgtaattagtagctcgccagaggatagtggtatgggaaatgatatatcagctgaggatatttgtgccgaagacattccaaaacataggcagaaagttgaccaacctttaaaagatcaggaaaatctagttgcatcaacagcaaagacagactttggccctgatgatgatacttatagaagcaggcttcgacaacgttctgttaatgaaggggcatatattcgactacacaagggaatggagaaaaagctgcagaaacggaaagccgttcccaagtcagcagttcaacaggtggctcagaagttagttcaaagaggaaaaaagatgaaacagccaaaaagagatgctaaagagaacacagaagaagcatctcataaatgtggggaatgtggaatggtttttcagagacgatacgcccttataatgcacaaactgaaacatgaaagagctagagattacaaatgtccattgtgtaaaaaacagtttcagtacagtgcctctttgcgagcacatcttattcgtcataccagaaaagatgcaccctcttcatcctcgtccaattccacgtctaatgaagcatcgggaacatcatctgagaagggcagaaccaagcgggaatttatatgttccatatgtggaagaacattacctaaattatattctctccgaatacatatgttaaagcacacaggtgtaaagccacatgcatgccaggtctgtggaaagacttttatctataagcatggtctaaaattacatcagagtcttcatcaatcacagaagcagttccagtgtgaactgtgtgttaagtcatttgttaccaaacggagtcttcaagaacatatgagtattcacacaggagagtccaagtacctttgctcagtttgtggaaagtcttttcataggggctctggactcagcaagcacttcaagaaacaccaaccaaagcctgaggttcgaggctatcattgtactcaatgtgaaaaaagtttctttgaagctagagatcttcgccagcacatgaacaaacatcttggtgtgaagccattccagtgccaattttgtgataagtgctatagttggaagaaagattggtattcccatgtgaagtctcattctgtcactgagccttataggtgtaatatatgtggcaaagaattttatgaaaaagctttgttcagaaggcatgtaaagaaagctacccatgggaagaaaggaagagcaaagcaaaacctggaacgggtgtgtgaaaaatgtggaagaaaattcactcagctaagagagtataggagacacatgaacaaccatgaaggagttaagccatttgagtgcttaacatgtggagtagcttgggctgatgcccgatctctaaaacgccatgtcagaacacatactggtgaacggccctatgtctgtcctgtatgtagcgaagcctacatagatgctcgaacactccgtaaacatatgactaaattccacagagactatgtgccttgcaaaattatgctggaaaaagacacccttcagtttcataaccaaggaactcaagtggcacatgctgttagcatcttaacagcaggcatgcaggaacaagaaagcagtggtcctcaagaacttgagactgtggtagtgacaggagaaactatggaagctctggaagctgttgcagctactgaagagtatccatcggtatctacactttctgaccaaagtattatgcaagtggttaattatgtattagcacaacagcaaggacagaagctatctgaagttgcagaagctattcaaactgttaaagtagaggtagcacatatttcaggaggagaatgagtatgttaatgaagataaaaagaagtgacatctcttgtacactgaactcacagaacatttgtttacaattctgtgtgactgtctgcttggagtttacatatcaaagttctgggctgtttggtaacgtaacgtttccaaacattttgtctggccaatgggttctatagaaaagtccgtttagtgtagagaaattgaaaacagatctattaggttggtgcaattgcttttgcaccaacctaatatttgatggcagtggtttatcatgatataccttttatgaattaatgtttataaatgactgtactgaatttaaaaccgtacagtttcatttgcattttgacattactttattatacattttgcatttaaaaggctgcaccagttggcttttcttctgttttattctcaaaatatagagattctgtgatttatttgccctgtttatggattaaaaagaaaattctaatataaagcatttcaataggatgcataggtatattacgttttttaaatgctttagatctgtgattcttgacttactatttattttatccccttttaagtcagggatgctttattctattttaaagcacttatgagttacatgttgtaatcaagtttgcacaatatatttatctatatgaggaacccataaatgaatagctaatttttaaaatgccattaaaatgcatgaaatgcttattaaaaccttactatactatttcttcaaggcaagtaaattgaccatgagaaaagaacacagttattaaacactgttgacaggaaaattctccttgataacataggacaattaatggaaaaaaaaattctcattatttgcaaagaatgaacaagttaatgaacaaacaaactagatttggtatgttttcagcttttgtatcatgtttaattgtttaatttggttgaaaaactgcagttgagaaatcagatagcaatatagacattcacagcagctctgtggataccatgtaattgtcaggtaatttcagaatgttgaaaattattcagtgcagccctcatagtatcatacttgaagaaattgattacagttccactaaattgttgaagataaattatttttaaaggttatgaaaactaagttatattaattcatatgtttgatttttaaatcccacctcctcaagctatccaattttctgactttgaaaataaccatgagagatgccacatttctctctgggaaactaccactcaaagaataattgttaaaaattaagcttttaggtattagaagctgttataaagtataaaattaagatataagcagatcacatgtaaatcattcctaaagcacaagaaaagaatgtgccttgatgtacatatattactaagttgcctctcccagtttactttaaaaatggctttaaggataaagaataaatgtgatagctgtgcatgcattatatatttgcatttgcaaatttcccattgttttaacagctgtgtggctgactttcaattttaagacgtgaattgacatacagcccataactttataatggctgctcatttatcttatctttcagttagtggaaaaacatttcaacctgactaaaatttggaattgtgtcttttatgttccatcctctgttgttactagatttagtttaaaaattgtgtatgaccattaatgtatgtcataaacatgtaaataaaagatgttgaatcttgttgaaaagcatgaactttggagttgagcttgttactattttcagttcataaatcagttgttacttgatgtgttattaagttaatttatttttaaagggaaaggaaataaaacactaaaaaataacgattggaggaacacaatattaaaacttcttactcttacatataattgatatggacaagaggcaaggaaataatgggtagaagagggcagttccccagcaaaagcctggaaacccatggccctaaatgggaacaggcattcctgttttcatgcccaaatgttgccttttggcccaccacgccctcctatcctgtatccatataaaccctaaaccccaggctccatgagcagaagagtgttgcggcagaggagagaagagaggagcatctaaacgtccagaggagttcagctggggacggttggagaggagatcatcttcccactccatcccctttccagctccccatccatcctgctgagagccacctttatccagcaataaaatcccctgcatttaccatccttcaatttgtccatgtgacctgattcttcctggacgc

SEQ ID NO: 2688 - DNA, 1877 bp, Homo sapiens
cgcccacgcggagccggccccgcgcgcgcgcgcgtgtcccgtgcatccccgcgcctgcgcgctgcccaggccctgcccgtgtgtgggggtcgctgccggccccgggggggggtggggaaaataagggattaaaaaaacagcgcgcggaaccgggccagggttgcccacccccgccacaatggcctctggggtggaagtcctgcgcttccagctgcccggccacgaggccgcaacgctacggaacatgaaccagctccgggcagaggagcggttctgcgacgtgaccattgtggccgacagcctcaagtttcgaggccacaaggtcatcttggccgcctgctcacccttcctgcgggaccagttcctgctgaaccccagctcggagctgcaggtctccctgatgcacagtgcacgcatcgtggccgacttgctcctctcctgctacacgggcgccttggaattcgctgttagggacatcgtcaactaccttacagccgcctcctacctgcagatggagcacgtggtggagaaatgccggaatgccctcagccagttcattgagcccaaaataggcctcaaagaggatggggtcagtgaggctagccttgtgagcagcatcagcgccaccaagtccctcctccctccagccaggaccccaaagccagccccgaagcccccacccccacctcctctaccccctccactcctgcggccagtgaagctggagttcccactggatgaagacttggagctgaaagccgaggaagaggatgaggatgaggatgaggacgtgtctgacatctgcatcgtcaaggtggagtcggccctggaggtggcacaccggctcaaaccccctggaggcctgggagggggtctgggcattggaggctccgtgggtggccaccttggggagctggcccagagcagcgttccccccagcactgtagccccaccgcagggtgtggtgaaggcctgctatagcctgtcggaagatgcagaaggggagggcctgctgttgattcccggaggccgggccagcgtgggggccacctcgggcctggtggaagcagcagcggtggccatggctgcccggggggcggggggcagcctgggggcggggggcagccggggacccctgcctgggggcttctcaggtggaaaccccttaaagaacatcaagtgcacgaagtgcccggaagtgttccagggcgtggagaagctggtcttccacatgcgggcgcagcacttcatcttcatgtgccctcgctgtggcaagcagttcaaccacagcagcaacctcaaccgccacatgaacgtgcatcgtggtgtcaagtcacactcgtgcggcatctgcggcaagtgcttcacacagaagtccacccttcacgaccacctcaacctgcactcgggagcgcggccctaccgctgctcctactgcgacgtgcgcttcgcccacaagcctgccattaggcggcacctcaaggagcaacacggcaagaccacggccgagaacgtgctggaggccagtgtggccgagattaacgtcctcatccgctagccgcgcaggcgtggaggccaggaggctggggcccctgggctgcgtggaaaaagggctctttggcccaggagaattggggggtggggggtctggggcagaaaggtaagagtgggaggctgagcagatgcacacatcctgagagagggaagatgattccttggagagacttgctcttgagagtgcaagaatctggagctgggaaaagggttcttggaggccaggggaatacggggtcccagagaaagatttccttctcttagaagtgcatgtatatgtggagggagggaaaagggtcctatagaatgagggaagacaaaaa

SEQ ID NO: 2689 - DNA, 1875 bp, Homo sapiens
cgcccacgcggagccggccccgcgcgcgcgcgcgtcccgtgcatccccgcgcctgcgcgctgcccaggccctgcccgtgtgtgggggtcgctgccggccccgggggggggtggggaaaataagggattaaaaaaacagcgcgcggaaccgggccagggttgcccacccccgccacaatggcctctggggtggaagtcctgcgcttccagctgcccggccacgaggccgcaacgctacggaacatgaaccagctccgggcagaggagcggttctgcgacgtgaccattgtggccgacagcctcaagtttcgaggccacaaggtcatcttggccgcctgctcacccttcctgcgggaccagttcctgctgaaccccagctcggagctgcaggtctccctgatgcacagtgcacgcatcgtggccgacttgctcctctcctgctacacgggcgccttggaattcgctgttagggacatcgtcaactaccttacagccgcctcctacctgcagatggagcacgtggtggagaaatgccggaatgccctcagccagttcattgagcccaaaataggcctcaaagaggatggggtcagtgaggctagccttgtgagcagcatcagcgccaccaagtccctcctccctccagccaggaccccaaagccagccccgaagcccccacccccacctcctctaccccctccactcctgcggccagtgaagctggagttcccactggatgaagacttggagctgaaagccgaggaagaggatgaggatgaggatgaggacgtgtctgacatctgcatcgtcaaggtggagtcggccctggaggtggcacaccggctcaaaccccctggaggcctgggagggggtctgggcattggaggctccgtgggtggccaccttggggagctggcccagagcagcgttccccccagcactgtagccccaccgcagggtgtggtgaaggcctgctatagcctgtcggaagatgcagaaggggagggcctgctgttgattcccggaggccgggccagcgtgggggccacctcgggcctggtggaagcagcagcggtggccatggctgcccggggggcggggggcagcctgggggcggggggcagccggggacccctgcctgggggcttctcaggtggaaaccccttaaagaacatcaagtgcaccaagtgcccggaagtgttccagggcgtggagaagctggtcttccacatgcgggcgcagcacttcatcttcatgtgccctcgctgtggcaagcagttcaaccacagcagcaacctcaaccgccacatgaacgtgcatcgtggtgtcaagtcacactcgtgcggcatctgcggcaagtgcttcacacagaagtccacccttcacgaccacctcaacctgcactcgggagcgcggccctaccgctgctcctactgcgacgtgcgcttcgcccacaagcctgccattaggcggcacctcaaggagcaacacggcaagaccacggccgagaacgtgctggaggccagtgtggccgagattaacgtcctcatccgctagccgcgcaggcgtggaggccaggaggctggggcccctgggctgcgtggaaaaagggctctttggcccaggagaattggggggtggggggtctggggcagaaaggtaagagtgggaggctgagcagatgcacacatcctgagagagggaagatgattccttggagagacttgctcttgagagtgcaagaatctggagctgggaaaagggttcttggaggccaggggaatacggggtcccagagaaagatttccttctcttagaagtgcatgtatatgtggagggagggaaaagggtcctatagaatgagggaagacaaaaa

SEQ ID NO: 2690 - DNA, 1875 bp, Homo sapiens
cgcccacgcggagccggccccgcgcgcgcgcgcgtcccgtgcatccccgcgcctgcgcgctgcccaggccctgcccgtgtgtgggggtcgctgccgaccccgggggggggtggggaaaataagggattaaaaaaacagcgcgcggaaccgggccagggttgcccacccccgccacaatggcctctggggtggaagtcctgcgcttccagctgcccggccacgaggccgcaacgctacggaacatgaaccagctccgggcagaggagcggttctgcgacgtgaccattgtggccgacagcctcaagtttcgaggccacaaggtcatcttggccgcctgctcacccttcctgcgggaccagttcctgctgaaccccagctcggagctgcaggtctccctgatgcacagtgcacgcatcgtggccgacttgctcctctcctgctacacgggcgccttggaattcgctgttagggacatcgtcaactaccttacagccgcctcctacctgcagatggagcacgtggtggagaaatgccggaatgccctcagccagttcattgagcccaaaataggcctcaaagaggatggggtcagtgaggctagccttgtgagcagcatcagcgccaccaagtccctcctccctccagccaggaccccaaagccagccccgaagcccccacccccacctcctctaccccctccactcctgcggccagtgaagctggagttcccactggatgaagacttggagctgaaagccgaggaagaggatgaggatgaggatgaggacgtgtctgacatctgcatcgtcaaggtggagtcggccctggaggtggcacaccggctcaaaccccctggaggcctgggagggggtctgggcattggaggctccgtgggtggccaccttggggagctggcccagagcagcgttccccccagcactgtagccccaccgcagggtgtggtgaaggcctgctatagcctgtcggaagatgcagaaggggagggcctgctgttgattcccggaggccgggccagcgtgggggccacctcgggcctggtggaagcagcagcggtggccatggctgcccggggggcggggggcagcctgggggcggggggcagccggggacccctgcctgggggcttctcaggtggaaaccccttaaagaacatcaagtgcaccaagtgcccggaagtgttccagggcgtggagaagctggtcttccacatgcgggcgcagcacttcatcttcatgtgccctcgctgtggcaagcagttcaaccacagcagcaacctcaaccgccacatgaacgtgcatcgtggtgtcaagtcacactcgtgcggcatctgcggcaagtgcttcacacagaagtccacccttcacgaccacctcaacctgcactcgggagcgcggccctaccgctgctcctactgcgacgtgcgcttcgcccacaagcctgccattaggcggcacctcaaggagcaacacggcaagaccacggccgagaacgtgctggaggccagtgtggccgagattaacgtcctcatccgctagccgcgcaggcgtggaggccaggaggctggggcccctgggctgcgtggaaaaagggctctttggcccaggagaattggggggtggggggtctggggcagaaaggtaagagtgggaggctgagcagatgcacacatcctgagagagggaagatgattccttggagagacttgctcttgagagtgcaagaatctggagctgggaaaagggttcttggaggccaggggaatacggggtcccagagaaagatttccttctcttagaagtgcatgtatatgtggagggagggaaaagggtcctatagaatgagggaagacaaaaa

SEQ ID NO: 2691 - DNA, 1875 bp, Homo sapiens; identical to SEQ ID NO: 2689

SEQ ID NO: 2692 - DNA, 1875 bp, Homo sapiens; identical to SEQ ID NO: 2689

SEQ ID NO: 2693 - DNA, 3090 bp, Homo sapiens
accgaccgcggcggcagcagcagcagcagcagcgagaggcagaggcggcggcggcggggaggacagcacggccgaggctgcccagaggcgcctcctccacaccccccgccgcagcagcaccggcgacagattttttaaaaaatggatttggccaaccatggacttattctactgcaacagttaaacgctcagcgagagtttggtttcctgtgtgactgcacggttgcaatcggcgatgtatacttcaaggcacacaaatcagttcttgcttcattctccaattactttaagatgttgtttgtccatcagaccagtgagtgtgtccgcttgaaaccaactgacatacagcccgacatcttcagctatctcttacacttgatgtacactgggaagatggcgcctcagctcatcgacccggttcgattagaacagggcatcaagtttctgcacgcctacccgctcattcaggaagccagcctcgccagccagggagccttttctcaccctgaccaagttttcccactggcttcttcattgtatggcattcagattgcagatcatcagttgagacaagccaccaagattgcttcagcacctgaaaaactcgggcgagatccacggccacagacctccaggataagccaggagcaggtccctgaggcctcacagctctcccagctgacttcaaatctggcccaggtgaatcggacaaatatgactccctcagaccccctgcagacctcgctgtctccagaacttgtttccactcctgttcctccccctcctcccggggaggagaccaatctggaagcatcttcctccgatgagcagcctgcgtccctcacaatagcccacgtcaagccaagcatcatgaagaggaatgggagctttccaaagtactatgcctgccacctgtgtggacggcgcttcactctccggagcagcttacgtgaacacctccagatccacacaggagtacctttcacatctagccaacagggagaaagtcgcgtccccctgactctctgtagcaatgcagctgacctcgggaaagatgccatggaagtgcctgaagccgggatgataagtgacagtgagctgcagcacatctctgattctcccatcatcgatgggcagcagcagtcggaaaccccacccccctcagacattgctgacattgacaacctggagcaggccgaccaggagagggaggtgaagaggcggaagtacgagtgcacaatatgtggacgcaaatttatccagaaaagccactggagggaacacatgtacatacacaccgggaagcctttcaagtgcagcacttgtgacaaaagcttttgcagggccaaccaggctgcccgccacgtgtgcctcaaccagagcatcgacacttacaccatggtggacaaacagactctggaactctgcacatttgaggaagggagtcagatggacaacatgctggtgcaaacaaacaaaccctacaaatgcaacttgtgtgacaaaacattctccactcccaatgaggttgttaaacattcatgccaaaaccagaactcggatgtttttgccctagacgaagggcgatccattctcctgggcagtggggactcggaagtaacggagcctgaccacccagtgttagcttccatcaaaaaggaacaagaaaccgtcttactagactgaatgtcacttatctttttaaaaaactctcatttttacaaagactatcttccctcccttccctgaattcagaactgtagttctccatggcatgatacaaacaggtccttgttctcttctcctcttccccttttccacatcccagccccacctctgtaaaggctttgtgcattataaacctggaatgtatcgactttctttcaggggatattggaaagataatggtcattatacttataaactcaaattttgagaggttttagattattcagaagcatacttggaactaatgaagggtatataataaaacaactggaatccaatttggtaagctaaaattatgactttccctgggtaaaaagtcttctcagaaaaacaatgtcagaaaataacagcgtgctgcttagaaatacggctgggctctgtactatgcaaaatctagaaagtgtggggaaactttaaacccaagaaaacgttcttagtattcatcctccaggtgtcttacttcagaatgcatcctttgagattatgtccacttaagagaaatcatcagttaagaaatctactttaacaaaacaaaaaggagaaaaagtaataatgtgatggcaatcttaatttttgggtacaacatgacaagctgtgagtttgtgtgtttgtaagagaaaaatgtgtgggtacttgctaataaacaggtgaattaatgcacatccttatctcattgctggcttctttccaagttgagcaacaacaaaatgctgtatttgagtttctgacaaatttgttttaaaaatcaaatttgaatgtactattctataaattgcctttctgaatagaacatgacatgccattttctagcagctgccagtgataatttgttttacactaacttttaaatcagtgtgtgtactgcagggaaaaggatataggaatactcatcttacaggggaatttgtgaccagaagatgtagtaacttcaatgactgaaagtcaatgctgatagtttactggcaacattaattgaagcatcaaaaataaatggcaaagagaaatcaggacaaaaaatctaattgctgtttgggaaaaaacttgattttgatgtttattctccaggtttttggttgtttttttttctttcttctttcttaatgcctgaaattttctccattggcccgaaagcagtaaaaattgttcattaatcttccgttaggccaataaaagaagggcctcacaagacaaaacaggagccagaagtaaggactgaaggagaaggggagaatagctaatagctatagtatatgtatatgttaaaaactgaatatcccatcatcctatttcatgtatagttgagttctcaaatttgtaagtttttatacatcctttcattgaataaacgtttaattaaatgag

SEQ ID NO: 2694 - DNA, 2645 bp, Homo sapiens
gaataaatgcttcggccgaaccaagtcctgagctcccagcggaggaggggacctgatcttttaagagacccccccggccgccctcctcctttctttgttcctgtggctgggggggtatcccctccctccacaacatggagccatctcctctgtctcccagtggggcagcacttcccctgccgctgtcgctggctccgcccccactacccctgccagcagctgcagtggtacatgtgtccttccctgaggtgaccagtgccctcttggagtccctcaatcagcagcgtctgcagggccagctctgcgatgtatctatcagagtgcagggccgggagttccgggctcatcgggctgtcctggctgcctcctccccttacttccatgatcaggtcctactcaaaggcatgacctccatctcgctgcccagtgtcatggacccaggcgcctttgagactgtcctagcctccgcttacactggccgcctcagcatggctgctgctgacattgtcaacttccttacagtggggtctgtgctccaaatgtggcacattgtggacaagtgcactgaactactccgagaaggccgggcctcagctaccaccaccatcactactgctgcagccacctctgtcactgtccctggtgctggggtgccatccgggagtgggggcactgtggcccctgctaccatgggctctgcgcgctcccatgcctccagccgggccagtgagaatcaatctcccagcagcagcaactacttcagccccagggagtccactgatttctcatcttcctcccaagaggcatttgcagcttctgcagtgggcagtggggagcgtcgaggaggtggccctgtattcccagcccctgtcgttggcagtggaggggccacatctggaaagctgctgctggaggcagatgagctgtgcgatgatggtggggatgggaggggggcagtggttcctggggctgggctccggagacccacctacacaccccctagcatcatgccacagaaacactgggtatacgtgaagcgaggtggtaattgcccagcgccaacacccctggttccccaagacccagatctggaggaggaagaggaggaggaagatctggtgttgacctgtgaggatgatgaagatgaagaactagggggtagctccagggttccagtggggggagggcctgaggctaccctcagcataagtgatgtccgtaccctgagtgagcccccagacaagggggaggagcaggtcaacttctgtgagtcctccaatgactttggcccatatgagggtgggggtcctgtggcaggtcttgatgactcaggggggccaactccctcttcctatgccccctcccaccctcctcgaccgctccttcccttggacatgcagggcaaccagatcctggtcttcccgtcgtcgtcttcatcctcatcctcacaggctcctggccaaccaccagggaaccaagcagaacacggggcagtgaccgtggggggcacgtcggtggggagcctgggtgtgccgggtagcgttggtggggtccctggagggactggcagtggggacgggaataagatctttctgtgccattgtgggaaggccttctcccacaagagcatgcgggaccggcacgtgaacatgcacctcaatctgcggccgtttgactgccccgtgtgcaacaaaaagttcaagatgaagcaccatctgactgagcacatgaagacgcacacaggtctcaagccctacgagtgcggagtctgcgccaagaagttcatgtggcgagacagcttcatgcgccaccgaggacactgtgagcgccggcaccgcctgggcggggtcggggccgtacctgggcctgggactcccacggggccatccttgccgtccaagagagagtctcccggagtgggcgggggcagcggcgacgaagcgagtgcggccacgcccccgtccagcagacgtgtctggtccccacccagagtccacaaggtggagatgggcttcggtggaggtggaggagcaaactgaaggggcaggctactggggtggggtagctttcgggaaagggaataaggagcacgatgcaagggcgctgtggcccccgggtgatctcccaccacacttactgtcttcctttatctctgtggacttgtatatattctggaaggggaaccacagtttcaccatcgcccgcccattctactactcaacccctcccccccaaggtatttccagaactaaacccttcctttccctctgatgggtacactgaagcccctgctccacagagtagattgcacatggagggagggagagggggcgtgttgaacatcctgcagtcacagggtcaggggtcaggtggttgtagtctgtgcctgaagtctgtgtttgtgttgtcgtggagacaaggcctttgagccccacccttgtcctagaacctaccccctctcaaggatgcgctctttatttctaccctgtctctccccgccacccccgacttcccgtggaaattcccaactcggttctcatggaggagtgggtggagacaaggagggagtaagtcgtaggagtacaaggtttttattttttttaacagtgattaaaatatttattggtcatttacttggcttcccg

SEQ ID NO: 2695 - DNA, 2651 bp, Homo sapiens
cgcaagatggcggcgggaggggcccaggttgctgctctggccgccgagtgaggggcggggggggcccgggggcgcgcggcccgagacccccccggccgccctcctcctttctttgttcctgtggctgggggggtatcccctccctccacaacatggagccatctcctctgtctcccagtggggcagcacttcccctgccgctgtcgctggctccgcccccactacccctgccagcagctgcagtggtacatgtgtccttccctgaggtgaccagtgccctcttggagtccctcaatcagcagcgtctgcagggccagctctgcgatgtatctatcagagtgcagggccgggagttccgggctcatcgggctgtcctggctgcctcctccccttacttccatgatcaggtcctactcaaaggcatgacctccatctcgctgcccagtgtcatggacccaggcgcctttgagactgtcctagcctccgcttacactggccgcctcagcatggctgctgctgacattgtcaacttccttacagtggggtctgtgctccaaatgtggcacattgtggacaagtgcactgaactactccgagaaggccgggcctcagctaccaccaccatcactactgctgcagccacctctgtcactgtccctggtgctggggtgccatccgggagtgggggcactgtggcccctgctaccatgggctctgcgcgctcccatgcctccagccgggccagtgagaatcaatctcccagcagcagcaactacttcagccccagggagtccactgatttctcatcttcctcccaagaggcatttgcagcttctgcagtgggcagtggggagcgtcgaggaggtggccctgtattcccagcccctgtcgttggcagtggaggggccacatctggaaagctgctgctggaggcagatgagctgtgcgatgatggtggggatgggaggggggcagtggttcctggggctgggctccggagacccacctacacaccccctagcatcatgccacagaaacactgggtatacgtgaagcgaggtggtaattgcccagcgccaacacccctggttccccaagacccagatctggaggaggaagaggaggaggaagatctggtgttgacctgtgaggatgatgaagatgaagaactagggggtagctccagggttccagtggggggagggcctgaggctaccctcagcataagtgatgtccgtaccctgagtgagcccccagacaagggggaggagcaggtcaacttctgtgagtcctccaatgactttggcccatatgagggtgggggtcctgtggcaggtcttgatgactcaggggggccaactccctcttcctatgccccctcccaccctcctcgaccgctccttcccttggacatgcagggcaaccagatcctggtcttcccgtcgtcgtcttcatcctcatcctcacaggctcctggccaaccaccagggaaccaagcagaacacggggcagtgaccgtggggggcacgtcggtggggagcctgggtgtgccgggtagcgttggtggggtccctggagggactggcagtggggacgggaataagatctttctgtgccattgtgggaaggccttctcccacaagagcatgcgggaccggcacgtgaacatgcacctcaatctgcggccgtttgactgccccgtgtgcaacaaaaagttcaagatgaagcaccatctgactgagcacatgaagacgcacacaggtctcaagccctacgagtgcggagtctgcgccaagaagttcatgtggcgagacagcttcatgcgccaccgaggacactgtgagcgccggcaccgcctgggcggggtcggggccgtacctgggcctgggactcccacggggccatccttgccgtccaagagagagtctcccggagtgggcgggggcagcggcgacgaagcgagtgcggccacgcccccgtccagcagacgtgtctggtccccacccagagtccacaaggtggagatgggcttcggtggaggtggaggagcaaactgaaggggcaggctactggggtggggtagctttcgggaaagggaataaggagcacgatgcaagggcgctgtggcccccgggtgatctcccaccacacttactgtcttcctttatctctgtggacttgtatatattctggaaggggaaccacagtttcaccatcgcccgcccattctactactcaacccctcccccccaaggtatttccagaactaaacccttcctttccctctgatgggtacactgaagcccctgctccacagagtagattgcacatggagggagggagagggggcgtgttgaacatcctgcagtcacagggtcaggggtcaggtggttgtagtctgtgcctgaagtctgtgtttgtgttgtcgtggagacaaggcctttgagccccacccttgtcctagaacctaccccctctcaaggatgcgctctttatttctaccctgtctctccccgccacccccgacttcccgtggaaattcccaactcggttctcatggaggagtgggtggagacaaggagggagtaagtcgtaggagtacaaggtttttattttttttaacagtgattaaaatatttattggtcattta

SEQ ID NO: 2696 - DNA, 581 bp, Homo sapiens
aataaatgcttcggccgaaccaagtcctgagctcccagcggaggaggggacctgatcttttaagagacccccccggccgccctcctcctttctttgttcctgtggctgggggggtatcccctccctccacaacatggagccatctcctctgtctcccagtggggcagcacttcccctgccgctgtcgctggctccgcccccactacccctgccagcagctgcagtggtacatgtgtccttccctgaggtgaccagtgccctcttggagtccctcaatcagcagcgtctgcagggccagctctgcgatgtatctatcagagtgcagggccgggagttccgggctcatcgggctgtcctggctgcctcctccccttacttccatgatcaggtcctactcaaaggcatgacctccatctcgctgcccagtgtcatggacccaggcgcctttgagactgtcctagcctccgcttacactggccgcctcagcatggctgctgctgacattgtcaacttccttacagtggggtctgtgctccaaatgtggcacattgtggacaagtgcactgaactactccgagaag

SEQ ID NO: 2697 - DNA, 581 bp, Homo sapiens; identical to SEQ ID NO: 2696

SEQ ID NO: 2698 - DNA, 2651 bp, Homo sapiens; identical to SEQ ID NO: 2695

SEQ ID NO: 2699 - DNA, 2645 bp, Homo sapiens; identical to SEQ ID NO: 2694

SEQ ID NO: 2700 - DNA, 2047 bp, Homo sapiens
ctttcccttccctgtgactggagtggggagcctgaggatgcccctgggaccgcctcataggaccccagctgagggcccagcagttggcttgggggcctgactctggcatcttataagaagtgccagaggtgaggccctaagaaaacgagcctcgggagccagcccaagaccaggcattcagtgccagtctttgagaaccactgtctgccaaaatgtctgaaagatcagatctccttcacttcaagtttgaaaattatggagattcaatgttacaaaaaatgaacaaattaagagaagagaataaattttgtgatgttacagttctcatagatgatattgaggtacagggacataaaattgtgtttgctgcaggttcccccttcttaagagaccaatttttactgaatgattccagagaggtgaaaatctccatattacagagttccgaagtggggagacaattgctcttatcctgttatagtggtgtgctggaattccctgagatggaactggtaaattacttgactgctgcaagttttcttcagatgagccacattgtagaacggtgcacacaggccctgtggaagtttataaagccaaaacaaccaatggatagtaaagagggatgtgaaccacagagtgcttctccccagtcaaaagaacagcagggagatgccagaggctccccaaagcaggactcaccttgtattcatccatctgaagacagtatggatatggaggacagtgatattcagattgttaaggtagaatctattggggatgtatcagaggttagaagtaaaaaagatcagaaccagtttatttcttctgaacccactgctttacattcatcagagccccagcactccctgataaattcaactgtggaaaacagagtaagtgaaatagaacaaaaccatctccacaattatgccctttcttatacaggcagtgataacatcatcatggcctcaaaagatgtctttggccctaatattcgaggtgtagacaaaggcctacagtggcatcaccagtgcccaaagtgtaccagggtgtttcgtcacctggagaactacgccaaccatttaaaaatgcacaaactctttatgtgtctactctgcggcaagactttcactcagaaaggcaaccttcatcgacacatgcgtgtgcatgccggaattaaacctttccagtgtaaaatctgtgggaaaaccttttctcagaagtgttccttacaggatcatcttaaccttcacagtggagataagccccataaatgtaactattgtgatatggtttttgcacataaaccagttttgaggaaacaccttaaacagctgcatggcaaaaacagctttgataatgccaatgagagaaatgtacaagacctcacagtggattttgattcttttgcatgtacaacagtcacagactctaaagggtgtcagccacaacccgatgcaacacaggtcctggatgcaggtaaactggcccaagctgtcctgaacttaagaaatgatagtacttgtgtgaattgagtaggggcttcatgctcacaactcgaactgactgacaatgtggcaatagtcttagtctttttaggagtgattttgctagtttgacttctccaaagcctctgtgtaggtggtagggagtgagtcaaagcactaatagaccaggcaacttaccacttggagtggatttgccttacttttgccctctcccattttctgttttgagttatttatcttgtaaagtctgttttcctttcccaaggaataattccttttgtctacctaacattgacttatgtcttagactgacactgttttaggcttttcactaggcacattccgaaggtaccaacaagttaataacgtcacctactctccactaatagatgctatgctaagagaagtgaataatctttctttggtagaaaataggctgagatataaggtgatattgctattgacctgaaaatgtgatagaacttctggttgcctattgattattcctccatgtctgataaatgaatctgcttcct

SEQ ID NO: 2701 - DNA, 4443 bp, Homo sapiens
ggagccccgaggggccggagctcctggcggtgccggatcctgacggcggccttcccccgggtctgtctgccaaaatgtctgaaagatcagatctccttcacttcaagtttgaaaattatggagattcaatgttacaaaaaatgaacaaattaagagaagagaataaattttgtgatgttacagttctcatagatgatattgaggtacagggacataaaattgtgtttgctgcaggttcccccttcttaagagaccaatttttactgaatgattccagagaggtgaaaatctccatattacagagttccgaagtggggagacaattgctcttatcctgttatagtggtgtgctggaattccctgagatggaactggtaaattacttgactgctgcaagttttcttcagatgagccacattgtagaacggtgcacacaggccctgtggaagtttataaagccaaaacaaccaatggatagtaaagagggatgtgaaccacagagtgcttctccccagtcaaaagaacagcagggagatgccagaggctccccaaagcaggactcaccttgtattcatccatctgaagacagtatggatatggaggacagtgatattcagattgttaaggtagaatctattggggatgtatcagaggttagaagtaaaaaagatcagaaccagtttatttcttctgaacccactgctttacattcatcagagccccagcactccctgataaattcaactgtggaaaacagagtaagtgaaatagaacaaaaccatctccacaattatgccctttcttatacaggcagtgataacatcatcatggcctcaaaagatgtctttggccctaatattcgaggtgtagacaaaggcctacagtggcatcaccagtgcccaaagtgtaccagggtgtttcgtcacctggagaactacgccaaccatttaaaaatgcacaaactctttatgtgtctactctgcggcaagactttcactcagaaaggcaaccttcatcgacacatgcgtgtgcatgccggaattaaacctttccagtgtaaaatctgtgggaaaaccttttctcagaagtgttccttacaggatcatcttaaccttcacagtggagataagccccataaatgtaactattgtgatatggtttttgcacataaaccagttttgaggaaacaccttaaacagctgcatggcaaaaacagctttgataatgccaatgagagaaatgtacaagacctcacagtggattttgattcttttgcatgtacaacagtcacagactctaaagggtgtcagccacaacccgatgcaacacaggtcctggatgcaggtaaactggcccaagctgtcctgaacttaagaaatgatagtacttgtgtgaattgagtaggggcttcatgctcacaactcgaactgactgacaatgtggcaatagtcttagtctttttaggagtgattttgctagtttgacttctccaaagcctctgtgtaggtggtagggagtgagtcaaagcactaatagaccaggcaacttaccacttggagtggatttgccttacttttgccctctcccattttctgttttgagttatttatcttgtaaagtctgttttcctttcccaaggaataattccttttgtctacctaacattgacttatgtcttagactgacactgttttaggcttttcactaggcacattccgaaggtaccaacaagttaataacgtcacctactctccactaatagatgctatgctaagagaagtgaataatctttctttggtagaaaataggctgagatataaggtgatattgctattgacctgaaaatgtgatagaacttctggttgcctattgattattcctccatgtctgataaatgaatctgcttcctaccatttgtacttgtcttggagctggctataaagaagtatgctggtttgttatgtactcttttcaacagtatcatagcccaacttcatctcattgaattgttcacatataccagagtactctctcttgaggaacacctgcaggcagatagttagggatgaccatgaggagcataatcaacagggatagaagtacacttatacaacagcacttacatgggcggtttctctggtagcatgtcccataagaggccatatgcttataattaatgtgtaacttgttgatgcttttgagatcaggactgctccaggcacgctaaaaatgtgctaaagtatagtgggctctctaaaaagaggctatttgggagtctctgaattttgtttcagagtttagccatcagaaaggtgagtttggccatcagagttttgtcctgtgcaccataaaagtctctgaattttcgtttcctcatgtaccttaatttctaaaacggatgataaaagttaggttggacacagaaggggcaatcaaatttctgtattcagatacctcttaaaggtacactgtgccaccttgctgcctttgattgcaaatacaaagttaattttcaaaaaggaaaaacaaaacagctctttttcctaaaacacatgttgtacttcagacctaaaattctaagtcttatttgtttctcacccatgagttagatttaggtaatagtattagtagagtccttagagaatcttaagaggtcatttactccacctctttcattttaaattggggtatccaaagcctgaagaggtggcctggccaatattgaccaaggtataactaaatatgagctagcatcttcttccttcttctcgctatcccttggctttaaaagatttagtacatgaagaataatgcattagcaaaaagctcctagtttgtgtttcccctttgtgtctccctgttggctttctgagacaacctgaattttgccaacaaaatatcgcagagggatttatattaattattttttagttagatgaatattatattcttcccatccaagtgagtgatttgctaggtttgtttagggagggaaaaagcaagaataatgtgagaagaatctaaatgcgaagttgattttgtgtggaaaactgtttattagtttccatcaggattttctgtttttatttttgagctatgagagtgcatgcagatttgaaaaattaggcttgcatagtcagaggggatcttcaattgttatatttgatacgtttacatgtatcattgttatcatatgtaaattatcatcatgtgagtcagatgtgaagtatgatttttgtcttttgttcaaatatttaaaatgataatacagttgagtggtaagactaataggtaccttatgcctaacatcactcattatatggtctaatgatgcttcctagcattgtgatttttacatgatccagccaaagagtaccaattctatgcaatagtgagactctaccctgtcaaccaaacagcattttttggtattttctgtcaacatcatttcttcacagggaaatttcaagttggagtgcttcgtttgctcacattcatgtcttgtttttgttactggtttgaagactaaaaggcacgggttcaaataagattggtctctttggttggagactatttctgggttcattcagttgttcaagaaacattagttaagcacctactgttgctagacactatgctagatactgaggataatgaaggtaagattgatatagtccctgccctcatggagcttatagtctcatgtggtcttagtgaaacaaagtctcaatttgcttttatactagaaataataaagaaagctgccttgctgtattcgatcagttaaaatcagcaactttgtgcttttgtatcagtaaaacatttagttctcaccttttgaaaatgcaaaccactgaagtgatttacagtctcctccatttttggctggagaggtgttctgtttctgtgagacatttttctaatttttgtggaacttcactttcctccttctttgcttatacgtgtttgttagattatattgcaaagaagtcaagttactgatatccagtattttacagaggaagatgactttcaaaactagtcatatttctgtagaggaggaagatttttaaaacctttatcattcagcatttgtattttatggatccccaggagaactaaaaaggagatgactctctaccatagtttggtttaaaaaaaaattactctgtcagttatttatttattatttaatactaaactccaaactgaagtggctctgaggtaaatcagatatgattttaatttaagtttctttattagcagatctataaatggaaggtgaccaatgtcactgcttctaaaatactgtcctaaacaacccagaagattttatttcagctcatgaatagctgttctaaatctgttgtatgttagacatactatgaactacctcttcacttattatggggaagtttccttaataaaagtgtgacgattaaa

SEQ ID NO: 2702 - DNA, 2978 bp, Homo sapiens
aattaaagctgagaaggtgggaaggggcggagctcgccctgtggctgctcggtggtgggtgaggtatcagctttctccgctagttcccaccctggtagtccttagcccctggaatgcgtgagggagatgcttagggagttctcgaagtggggcgtagaggcatcgcctggcaaggcctgggagcgaaaaagatctctacttcgtggagccgttggacgctaccggggagccactggtggggaccttttttgggccccctttccttcgtggggtactatggagttcccagaacacagtcagcagctgctgcagagcctccgggagcagcggtcccagggtttcctttgtgactgcaccgtgatggtgggtagtacccagttcttggcccatcgggctgtgctggcctcctgcagcccattcttccagcttttctacaaggagcgggaattggacaagagggatctggtgtgtattcacaatgaaattgtcacagccccagcctttgggctgcttctggactttatgtatgctggccagctgaccctgagaggggatacccctgtggaggatgtgctggcagctgccagctacttgcacatgaatgacatcgtcaaggtgtgtaagcggcggcttcaagcccgggccctggcagaggcagacagtaccaagaaggaggaggaaaccaactcacagcttcctagtttggagtttttgtctagtacttcccgtggcacccaaccttcgttggcatctgctgagacatcaggccactggggcaaaggggaatggaaaggctctgctgctccctcacctactgtccgtcctccagatgagccaccaatgtctagtggggctgacactacacagcctggcatggaggttgacgcaccacatctgcgggcacctcatccaccagtggctgatgtctctcttgccagccctagtagctccactgagaccattcctacaaactacttctcttctggcatctcagcagtttcattggagccactgccatctcttgatgtgggtcctgagagtctgagggtggtggaaccaaaggatcctggaggaccactgcaaggcttctatcccccagcctcagccccaacgtcagccccagcccctgtctcagctccagttccatcccaggctccagccccagctgaagctgagctggtccaggtgaaagttgaagctattgtgatctctgatgaagagactgatgtgtcagatgaacagcctcagggtcctgagagagctttcccatctggaggagcagtgtatggggcacagccctcccagccagaggcttttgaagacccaggggcagcaggactggaggaggtggggccaagtgaccacttcctgccaacagaccctcatctaccctaccatctgctgccaggtgcagggcagtatcatcgaggactggtgacctcacctctgcctgcacccgcatccctgcatgagccactttacctgtcttctgagtacgaagcagctccaggaagctttggggtttttactgaggatgttcccacctgcaagacatgtgggaagaccttctcatgctcttacacactacggcgacatgccacggtgcacacacgtgagcgaccctatgagtgccgctactgcctgcggagctacacgcagtcaggggacctctaccgccacatccgcaaggctcacaatgaggacctggccaaacgcagcaaaccagatccagaagtgggaccccttctaggggtgcagcctctccctggctccccaacagcagacagacagagcagcagtggtggagggccacctaaagattttgtattggccccaaaaactaacatctaagggagcatgagctgatgctaggctgctcttaccatccttagatggcagctcagaaggttggtggcaccttatcacccctgctgggtgacaagaataaaggctctgcccaggctgaaagttcctacccttttttttttttaatcttttatttttttgagacagagtctcactctgtcacccagactggagtgcagtggcgcgatctcggctcactgcaagctcagcctccccgattcacgccattctcctgcctcagcctcccgagtagctgggactacaggcgcctatcaccatgcctggctaattttttttgatttttagtagagacagggtttcaccgtgttagccaggatggtctcgatcttctgacagatctgacctcgtgatccgcccatctccacctcccgcagtgctgggattacaggcatgagccaccgcgcccagctgcctttttttttttgagtcttgctctgtcactgaggctggagtgcagtggcgcaatttcagctcactgcaacctctgcctcccaggttcaagcgattcctttttttttttttttttttgagacagagtctcactctgtcccccaggctggagtgcagtggcgcgatcttggcccaccacgcccgcctaattttttgtattttttagtagagacggggtttcaccgtgttagtcaggatggtctcgatctcctgacctcgtgatccacccgcctcagcctcccaaagtgctgggattacaggcttgagccaccgtgcctggcctcaagcgattctcttaactcagcctcttgagtagctgggattacaggaacgcgccaccacgcccagctaattcctgtatttttagtagagacagggtttcaccatgttggccaggctggtctcaaattcctgaccccaggtgatctgcccaccttggccttaaaaagtgctgggattaaaggcgtgagccaccatgcccagcctcctacccttttctttgcccagccagataagcaggactttatggggcaaagcctatgtcagctctctccaagggcactgggaattttcctgaggtgtaatcgcttctcactgtatgttctggaacataaagctagcaatgaaggtatttctttgaa

SEQ ID NO: 2703 - DNA, 2024 bp, Homo sapiens
agactttcctccaggggcttcctcactggggaattgccggaaagagcaaacaaaaaaggcgctggtgtaggctccaaaataaacacatctgaattcatgatggcatcgacagaggctcttattggattaaaagtttcaaaacaaacaataacgctttggaaaaagggttgaatgcaccctcaggcacgaccatggagaaaggtgggaacatacaattggagattcctgacttcagcaactctgtcctgagccatctaaaccagttgcgcatgcagggccgtctctgtgatattgtggtcaatgtgcaaggacaagcttttcgggctcacaaagtggtgctggctgccagctccccctatttccgggatcacatgtccttgaatgagatgagtacagtctccatttcagtcatcaagaaccctactgtttttgaacagctcctttctttctgttacacagggcggatatgcctgcaactggcagatatcatcagctacctaacagctgccagttttctgcaaatgcagcatattatagacaaatgtacacagatcctggagggcattcatttcaaaattaatgtggctgaggttgaagcagaattaagtcaaacaaggacaaagcatcaagagagacctccagagtctcacagggttacaccaaatctcaaccgctcccttagcccacgacataataccccaaagggaaaccggcgaggtcaggttagtgctgtgctggatatcagagagctaagtcctcctgaggagtccaccagccctcagatcattgaaccaagttctgatgtagagagccgggagcccattcttcggatcaaccgagcaggacagtggtatgtggagacaggagtggcggaccgtgggggtcggagtgatgatgaagttagagttcttggagcagtacacatcaaaactgaaaatctggaggagtggcttgggcctgagaatcagccttctggagaagatgggagtagtgcagaggaagtaacagccatggtgattgataccacaggccatggttctgtaggacaggaaaattatactttagggtcttcaggagccaaggtggctcggccaacaagcagtgaagttgacagatttagcccctccggcagtgttgttcccttgacagagagacacagagccagaagtgagtctcctgggagaatggatgagcctaagcaacccagctcccaggtagaagagtcagcaatgatgggagtaagtggctatgtggagtatctccgagagcaggaagtatctgagcggtggttccggtacaaccctcgtctcacctgcatctattgcgccaaatctttcaaccagaagggaagcctggaccgccacatgcgcctacacatggggatcacaccattcgtctgccgcatgtgtggcaagaagtatacccggaaagatcagctggagtatcatatccgcaagcacacaggcaacaagccctttcactgtcatgtctgtggcaaaagtttccccttccaggccatcttgaatcagcactttcgcaaaaaccaccctggctgtatacccctggaggggcctcacagcatctcccctgaaacaactgtcacatctcgaggacaagctgaggaagagtcaccttcacaggaagagacagttgctcctggggaagctgtccagggctctgtgtccaccactgggccagactgaaacatccagggggagggggctgaccctcttcccctatgagccataagcagccagcatcagagccatgggctgatacttagattcacaaaatgccacatcactaggccagaagatgctcccaagatgttgccaaactggaggatcagcaacttacacaaaagcactaaaggctcctcccttcttattgcccgcctcacactttggaaaataatcaagcaaatcaactttctaattcagggatcaacagccttggtttgttaactttataagaaaaaaggttttttaacaaaacgatgatgataaatggtcatttatctatca

SEQ ID NO: 2704 - DNA, 2153 bp, Homo sapiens
agctctcacccctccagtgccgacggtagcgaaagactttcctccaggggcttcctcactggggaattgccggaaagagcaaacaaaaaaggcgctggtgtaggctccaaaataaacacatctgaattcatgatggcatcgacagaggctcttattggattaaaagtttcaaaacaaacaataacgctttggaaaaagggttgaatgcaccctcaggcacgaccatggagaaaggtgggaacatacaattggagattcctgacttcagcaactctgtcctgagccatctaaaccagttgcgcatgcagggccgtctctgtgatattgtggtcaatgtgcaaggacaagcttttcgggctcacaaagtggtgctggctgccagctccccctatttccgggatcacatgtccttgaatgagatgagtacagtctccatttcagtcatcaagaaccctactgtttttgaacagctcctttctttctgttacacagggcggatatgcctgcaactggcagatatcatcagctacctaacagctgccagttttctgcaaatgcagcatattatagacaaatgtacacagatcctggagggcattcatttaaaattaatgtggctgaggttgaagcagaattaagtcaaacaaggacaaagcatcaagagagacctccagagtctcacagggttacaccaaatctcaaccgctcccttagcccacgacataataccccaaagggaaaccggcgaggtcaggttagtgctgtgctggatatcagagagctaagtcctcctgaggagtccaccagccctcagatcattgaaccaagttctgatgtagagagccgggagcccattcttcggatcaaccgagcaggacagtggtatgtggagacaggagtggcggaccgtgggggtcggagtgatgatgaagttagagttcttggagcagtacacatcaaaactgaaaatctggaggagtggcttgggcctgagaatcagccttctggagaagatgggagtagtgcagaggaagtaacagccatggtgattgataccacaggccatggttctgtaggacaggaaaattatactttagggtcttcaggagccaaggtggctcggccaacaagcagtgaagttgacagatttagcccctccggcagtgttgttcccttgacagagagacacagagccagaagtgagtctcctgggagaatggatgagcctaagcaacccagctcccaggtagaagagtcagcaatgatgggagtaagtggctatgtggagtatctccgagagcaggaagtatctgagcggtggttccggtacaaccctcgtctcacctgcatctattgcgccaaatctttcaaccagaagggaagcctggaccgccacatgcgcctacacatggggatcacaccattcgtctgccgcatgtgtggcaagaagtatacccggaaagatcagctggagtatcatatccgcaagcacacaggcaacaagccctttcactgtcatgtctgtggcaaaagtttccccttccaggccatcttgaatcagcactttcgcaaaaaccaccctggctgtatacccctggaggggcctcacagcatctcccctgaaacaactgtcacatctcgaggacaagctgaggaagagtcaccttcacaggaagagacagttgctcctggggaagctgtccagggctctgtgtccaccactgggccagactgaaacatccagggggagggggctgaccctcttcccctatgagccataagcagccagcatcagagccatgggctgatacttagattcacaaaatgccacatcactaggccagaagatgctcccaagatgttgccaaactggaggatcagcaacttacacaaaagcactaaaggctcctcccttcttattgcccgcctcacactttggaaaataatcaagcaaatcaactttctaattcagggatcaacagccttggtttgttaactttataagaaaaaaggttttttaacaaaacgatgatgataaatggtcatttatctatcagtcatgtttgaacactgtactttggtccatatcatcttggtggctataattgcccggatctaaaaaatgcagcaggagcctcaaccatccgaagcag

SEQ ID NO: 2705 - DNA, 2323 bp, Homo sapiens
aacctccctcaatcttcctctcatccagtatcaccttcttcccaccccttaagtccgccccttttccccgcccttcctcgccattgtgggcagagacatgaccgtccacgtgatgccgtgctcccgccctcctcccgactgaggaggaagagcagagaggggagggggcgcgagctctcacccctccagtgccgacggtagcgaaagactttcctccaggggcttcctcactggggaattgccggaaagagcaaacaaaaaaggcgctggtgtaggctccaaaataaacacatctgaattcatgatggcatcgacagaggctcttattggattaaaagtttcaaaacaaacaataacgctttggaaaaagcagggttgaatgcaccctcaggcacgaccatggagaaaggtgggaacatacaattggagattcctgacttcagcaactctgtcctgagccatctaaaccagttgcgcatgcagggccgtctctgtgatattgtggtcaatgtgcaaggacaagcttttcgggctcacaaagtggtgctggctgccagctccccctatttccgggatcacatgtccttgaatgagatgagtacagtctccatttcagtcatcaagaaccctactgtttttgaacagctcctttctttctgttacacagggcggatatgcctgcaactggcagatatcatcagctacctaacagctgccagttttctgcaaatgcagcatattatagacaaatgtacacagatcctggagggcattcatttcaaaattaatgtggctgaggttgaagcagaattaagtcaaacaaggacaaagcatcaagagagacctccagagtctcacagggttacaccaaatctcaaccgctcccttagcccacgacataataccccaaagggaaaccggcgaggtcaggttagtgctgtgctggatatcagagagctaagtcctcctgaggagtccaccagccctcagatcattgaaccaagttctgatgtagagagccgggagcccattcttcggatcaaccgagcaggacagtggtatgtggagacaggagtggcggaccgtgggggtcggagtgatgatgaagttagagttcttggagcagtacacatcaaaactgaaaatctggaggagtggcttgggcctgagaatcagccttctggagaagatgggagtagtgcagaggaagtaacagccatggtgattgataccacaggccatggttctgtaggacaggaaaattatactttagggtcttcaggagccaaggtggctcggccaacaagcagtgaagttgacaggtagaagagtcagcaatgatgggagtaagtggctatgtggagtatctccgagagcaggaagtatctgagcggtggttccggtacaaccctcgtctcacctgcatctattgcgccaaatctttcaaccagaagggaagcctggaccgccacatgcgcctacacatggggatcacaccattcgtctgccgcatgtgtggcaagaagtatacccggaaagatcagctggagtatcatatccgcaagcacacaggcaacaagccctttcactgtcatgtctgtggcaaaagtttccccttccaggccatcttgaatcagcactttcgcaaaaaccaccctggctgtatacccctggaggggcctcacagcatctcccctgaaacaactgtcacatctcgaggacaagctgaggaagagtcaccttcacaggaagagacagttgctcctggggaagctgtccagggctctgtgtccaccactgggccagactgaaacatccagggggagggggctgaccctcttcccctatgagccataagcagccagcatcagagccatgggctgatacttagattcacaaaatgccacatcactaggccagaagatgctcccaagatgttgccaaactggaggatcagcaacttacacaaaagcactaaaggctcctcccttcttattgcccgcctcacactttggaaaataatcaagcaaatcaactttctaattcagggatcaacagccttggtttgttaactttataagaaaaaaggttttttaacaaaacgatgatgataaatggtcatttatctatcagtcatgtttgaacactgtactttggtccatatcatcttggtggctataattgcccggatctaaaaaatgcagcaggagcctcaaccatccgaagcagccaaccgcaagagaggaggtagtcatgatggtgatgaggaggagaaatttctcctcttccttccctggcataacatgcatttttgtgtttcaag

SEQ ID NO: 2706 - DNA, 2300 bp, Homo sapiens
cacttccgggacggtgttccggcccattccggcccatttccacccccggagctctcacccctccagtgccgacggtagcgaaagactttcctccaggggcttcctcactggggaattgccggaaagagcaaacaaaaaaggcgctggtgtaggctccaaaataaacacatctgaattcatgatggcatcgacagaggctcttattggattaaaagtttcaaaacaaacaataacgctttggaaaaagcagggttgaatgcaccctcaggcacgaccatggagaaaggtgggaacatacaattggagattcctgacttcagcaactctgtcctgagccatctaaaccagttgcgcatgcagggccgtctctgtgatattgtggtcaatgtgcaaggacaagcttttcgggctcacaaagtggtgctggctgccagctccccctatttccgggatcacatgtccttgaatgagatgagtacagtctccatttcagtcatcaagaaccctactgtttttgaacagctcctttctttctgttacacagggcggatatgcctgcaactggcagatatcatcagctacctaacagctgccagttttctgcaaatgcagcatattatagacaaatgtacacagatcctggagggcattcatttcaaaattaatgtggctgaggttgaagcagaattaagtcaaacaaggacaaagcatcaagagagacctccagagtctcacagggttacaccaaatctcaaccgctcccttagcccacgacataataccccaaagggaaaccggcgaggtcaggttagtgctgtgctggatatcagagagctaagtcctcctgaggagtccaccagccctcagatcattgaaccaagttctgatgtagagagccgggagcccattcttcggatcaaccgagcaggacagtggtatgtggagacaggagtggcggaccgtgggggtcggagtgatgatgaagttagagttcttggagcagtacacatcaaaactgaaaatctggaggagtggcttgggcctgagaatcagccttctggagaagatgggagtagtgcagaggaagtaacagccatggtgattgataccacaggccatggttctgtaggacaggaaaattatactttagggtcttcaggagccaaggtggctcggccaacaagcagtgaagttgacagatttagcccctccggcagtgttgttcccttgacagagagacacagagccagaagtgagtctcctgggagaatggatgagcctaagcaacccagctcccaggtagaagagtcagcaatgatgggagtaagtggctatgtggagtatctccgagagcaggaagtatctgagcggtggttccggtacaaccctcgtctcacctgcatctattgcgccaaatctttcaaccagaagggaagcctggaccgccacatgcgcctacacatggggatcacaccattcgtctgccgcatgtgtggcaagaagtatacccggaaagatcagctggagtatcatatccgcaagcacacaggcaacaagccctttcactgtcatgtctgtggcaaaagtttccccttccaggccatcttgaatcagcactttcgcaaaaaccaccctggctgtatacccctggaggggcctcacagcatctcccctgaaacaactgtcacatctcgaggacaagctgaggaagagtcaccttcacaggaagagacagttgctcctggggaagctgtccagggctctgtgtccaccactgggccagactgaaacatccagggggagggggctgaccctcttcccctatgagccataagcagccagcatcagagccatgggctgatacttagattcacaaaatgccacatcactaggccagaagatgctcccaagatgttgccaaactggaggatcagcaacttacacaaaagcactaaaggctcctcccttcttattgcccgcctcacactttggaaaataatcaagcaaatcaactttctaattcagggatcaacagccttggtttgttaactttataagaaaaaaggttttttaacaaaacgatgatgataaatggtcatttatctatcagtcatgtttgaacactgtactttggtccatatcatcttggtggctataattgcccggatctaaaaaatgcagcaggagcctcaaccatccgaagcagccaaccgcaagagaggaggtagtcatgatggtgatgaggaggagaaatttctcctcttccttccctggcataacatgcatttttgtgtttcaag

SEQ ID NO: 2707 - DNA, 1368 bp, Homo sapiens
cacttccgggacggtgttccggcccattccggcccatttccacccccggagctctcacccctccagtgccgacggtagcgaaagactttcctccaggggcttcctcactggggaattgccggaaagagcaaacaaaaaaggcgctggtgtaggctccaaaataaacacatctgaattcatgatggcatcgacagaggctcttattggattaaaagtttcaaaacaaacaataacgctttggaaaaagggttgaatgcaccctcaggcacgaccatggagaaaggtgggaacatacaattggagattcctgacttcagcaactctgtcctgagccatctaaaccagttgcgcatgcagggccgtctctgtgatattgtggtcaatgtgcaaggacaagcttttcgggctcacaaagtggtgctggctgccagctccccctatttccgggatcacatgtccttgaatgagatgagtacagtctccatttcagtcatcaagaaccctactgtttttgaacagctcctttctttctgttacacagggcggatatgcctgcaactggcagatatcatcagctacctaacagctgccagttttctgcaaatgcagcatattatagacaaatgtacacagatcctggagggcattcatttcaaaattaatgtggctgaggttgaagcagaattaagtcaaacaaggacaaagcatcaagagagacctccagagtctcacagggttacaccaaatctcaaccgctcccttagcccacgacataataccccaaagggaaaccggcgaggtcaggttagtgctgtgctggatatcagagagctaagtcctcctgaggagtccaccagccctcagatcattgaaccaagttctgatgtagagagccgggagcccattcttcggatcaaccgagcaggacagtggtatgtggagacaggagtggcggaccgtgggggtcggagtgatgatgaagttagagttcttggagcagtacacatcaaaactgaaaatctggaggagtggcttgggcctgagaatcagccttctggagaagatgggagtagtgcagaggaagtaacagccatggtgattgataccacaggccatggttctgtaggacaggaaaattatactttagggtcttcaggagccaaggtggctcggccaacaagcagtgaagttgacagatttagcccctccggcagtgttgttcccttgacagagagacacagagccagaagtgagtctcctgggagaatggatgagcctaagcaacccagctcccaggtatggagttgtggatttagaactgctttggtggttggaggaattgctactgtgtatgaatagaaaataatg

SEQ ID NO: 2708 - DNA, 2940 bp, Homo sapiens
gggatttcacttccgggacggtgttccggcccattccggcccatttccacccccggagctctcacccctccagtgccgacggtagcgaaagactttcctccaggggcttcctcactggggaattgccggaaagagcaaacaaaaaaggcgctggtgtaggctccaaaataaacacatctgaattcatgatggcatcgacagaggctcttattggattaaaagtttcaaaacaaacaataacgctttggaaaaagcagggttgaatgcaccctcaggcacgaccatggagaaaggtgggaacatacaattggagattcctgacttcagcaactctgtcctgagccatctaaaccagttgcgcatgcagggccgtctctgtgatattgtggtcaatgtgcaaggacaagcttttcgggctcacaaagtggtgctggctgccagctccccctatttccgggatcacatgtccttgaatgagatgagtacagtctccatttcagtcatcaagaaccctactgtttttgaacagctcctttctttctgttacacagggcggatatgcctgcaactggcagatatcatcagctacctaacagctgccagttttctgcaaatgcagcatattatagacaaatgtacacagatcctggagggcattcatttcaaaattaatgtggctgaggttgaagcagaattaagtcaaacaaggacaaagcatcaagagagacctccagagtctcacagggttacaccaaatctcaaccgctcccttagcccacgacataataccccaaagggaaaccggcgaggtcaggttagtgctgtgctggatatcagagagctaagtcctcctgaggagtccaccagccctcagatcattgaaccaagttctgatgtagagagccgggagcccattcttcggatcaaccgagcaggacagtggtatgtggagacaggagtggcggaccgtgggggtcggagtgatgatgaagttagagttcttggagcagtacacatcaaaactgaaaatctggaggagtggcttgggcctgagaatcagccttctggagaagatgggagtagtgcagaggaagtaacagccatggtgattgataccacaggccatggttctgtaggacaggaaaattatactttagggtcttcaggagccaaggtggctcggccaacaagcagtgaagttgacagatttagcccctccggcagtgttgttcccttgacagagagacacagagccagaagtgagtctcctgggagaatggatgagcctaagcaacccagctcccaggtagaagagtcagcaatgatgggagtaagtggctatgtggagtatctccgagagcaggaagtatctgagcggtggttccggtacaaccctcgtctcacctgcatctattgcgccaaatctttcaaccagaagggaagcctggaccgccacatgcgcctacacatggggatcacaccattcgtctgccgcatgtgtggcaagaagtatacccggaaagatcagctggagtatcatatccgcaagcacacaggcaacaagccctttcactgtcatgtctgtggcaaaagtttccccttccaggccatcttgaatcagcactttcgcaaaaaccaccctggctgtatacccctggaggggcctcacagcatctcccctgaaacaactgtcacatctcgaggacaagctgaggaagagtcaccttcacaggaagagacagttgctcctggggaagctgtccagggctctgtgtccaccactgggccagactgaaacatccagggggagggggctgaccctcttcccctatgagccataagcagccagcatcagagccatgggctgatacttagattcacaaaatgccacatcactaggccagaagatgctcccaagatgttgccaaactggaggatcagcaacttacacaaaagcactaaaggctcctcccttcttattgcccgcctcacactttggaaaataatcaagcaaatcaactttctaattcagggatcaacagccttggtttgttaactttataagaaaaaaggttttttaacaaaacgatgatgataaatggtcatttatctatcagtcatgtttgaacactgtactttggtccatatcatcttggtggctataattgcccggatctaaaaaatgcagcaggagcctcaaccatccgaagcagccaaccgcaagagaggaggtagtcatgatgctaatacaacaacctgagtgagtagaaattccttaaggtttagatttctgcttttagtcacatcttgaagcagatgtttatgacatatttgaagatgatccactgagtttcctataaagtaatagaatcctaactatagtggttctttaagaaccactgaaaaaacagaattgcagtgcagggaacaaagcttaaaatgtgtttcctctggaagccaagatgctaaaaaaggggtcactaatagtgtgactgaagtccgtctctagaatggctatctgttagatagcagaaatatttagaatgtatatggcatttctaatatttttacaaaaataattttaaatcatgtaactcgaattttttttaaaaagtctgttttctttttggaaaactggcacaataaaaataacactaatataattccattgtatatgcatgtgcattgaacccagagtgggtatactaaagatagttcatgcaaataacttatgggaagtttggctattttttcatgtatgtttataaatatatttagtcatctactgtgaccttggtagcacagaagcattttgttagctgtatcattaattctaaaaatcaaattcttggcatagtaggctatgagagctttttgttacttggtattttggctaagaaaattatttcttgcactttctatttgtaaagatgttataac

SEQ ID NO: 2709 - DNA, 6170 bp, Homo sapiens
gaagcggcggcggcgatggtgctcggggcgccgcagagccggattaactgtgctgataaggaggtaatttcataggagctgctaagatgggcatgaggatcaaactgcaaagcaccaaccaccccaacaacctgctgaaggaactcaacaagtgccggctctcagagaccatgtgcgacgtcaccattgtggtggggagccgctccttcccggcccacaaggctgtgctggcctgtgcagctggctacttccagaacctcttcctgaatactgggcttgatgctgccaggacctatgtggtggacttcatcacccctgccaactttgagaaggttctgagctttgtctacacttcagaactcttcacagacctgatcaatgttggggtcatctacgaggtagctgagcgtctgggtatggaggacctcctccaggcctgtcactctacctttcctgatctggagagcactgccagggccaagcccctgaccagcaccagtgagagccactctggtaccctgagttgtccttcggcagaacctgcccatccccttggagaactccgaggtggtggggactaccttggtgctgatagaaactatgtgttgcccagtgatgctggagggagctataaagaggaagagaagaatgttgccagtgacgctaaccatagcctgcatctgccgcaaccgcccccaccaccgccaaagacagaagaccatgacacccctgctcccttcacgtccattcctagcatgatgacccagccactcctaggcactgtcagcacgggcatccagaccagcacgagctcctgccagccatacaaagttcaaagcaatggagacttcagtaaaaacagcttcctcacccctgacaatgcagtagacattaccactgggaccaactcctgtctgagcaatagtgagcactccaaagatcctggctttgggcagatggatgagctccagctcgaggacctgggggatgatgacttgcagtttgaagaccctgctgaggatataggcacaactgaggaggtgattgagctgagtgatgacagtgaggatgagttggcttttggagagaatgacaatcgggagaataaggccatgccctgccaggtgtgcaagaaagttctagagcccaacattcaactgatccggcagcatgctcgggaccatgtggacctgctgacgggcaactgcaaggtctgcgagacccacttccaggaccgaaactcccgggtaactcatgtcctgtcccacattggtattttccttttctcctgcgacatgtgtgaaactaagttctttacccagtggcagctgacccttcaccgacgggatggaatatttgagaacaacatcattgtccaccccaacgatcccctgccagggaagctgggtctcttttcaggggcagcctccccagagctgaaatgcgctgcctgtgggaaagtattggccaaagatttccatgtggtccggggccacatccttgaccatctaaacttgaagggccaggcctgcagtgtctgcgaccagcgtcaccttaacctctgcagcctcatgtggcacacgctgtcccatctcggcatctcagtcttctcctgttctgtctgtgcgaacagctttgtggactggcatcttctagagaagcacatggctgtgcaccaaagtctggaagacgccctcttccactgccgcttgtgcagccagagcttcaagtcagaggctgcctatcgctaccacgtcagccagcacaaatgcaacagtggccttgatgcacggcctggttttgggctgcagcacccagctctccagaagcggaagctgccagcagaggagtttctgggtgaagagctggcgctgcagggccaacctgggaacagcaagtatagctgcaaggtctgtggcaaaagatttgcccacacaagcgaattcaactaccaccggcggatccacacgggggagaagccataccaatgtaaggtgtgccacaagttctttcgaggccgctcgaccatcaagtgccacctaaagacacactcgggggccctcatgtaccgctgcacagtctgtgggcactacagttccacccttaacctcatgagcaaacatgttggtgtgcacaaaggcagcctcccccctgacttcaccatcgagcagaccttcatgtacatcatccattccaaagaggcggataagaacccggacagttgactgggtcccggcagagccacggggagctcccaagcagcagccaggatgctgatatctaagaggtgttggtccctccccagctgaagttataattttgccttggtaggaattctgttctgtgttgtgtttaaagaagaaaagaagaagaaatagcacataagctgttactgttgttgagaagcaacagccctatcacatttacctccatacctgttcttgcccatgcagggctatgtttttcattcttttgaggctggttttgggatctagtcaagcagttggtgtccactagacccccttccccagcctctctagttttagtttactgataggttttatgctgctaagaatccaaccaacagcctcacttaacagaggaggtaaagggaggttttcactgtgggtgttactgcaggcctccaactgggatgaccagcaatgagaaagattttgggaatgtgatcattcagaaaagacaggtcagcagggcagtcccctcaggttccagccctcagcagggacaagacatcagggatgttggtgtctgcttatctacagccctaatctgctgattgaacagtgaaaatcttttggcagctagatccatactaggcacagagctttctatttaggtcagaaagctttgggatgaacccctgccagccagaaggggtgtcctgcagtgccaccagaagtggcagcctggatggacaggagaggtttctcttttctcctcatttccaaagaaacaggattttatggagtgatggcccgggacgtccggccttctgtggggcagagaggatagggaaccactttgatatagtcatctgttttggccacttctgttggccatgagtgtcttggtggagaggtggggatgtatctgacagcagcagccttgccttaatttatatctggtctcccgtccagaagtgtttggcccgtggtgtagatgagctgactccatgaagtggtggagtggcagaccgcgagcccttcaggattaaagggacctgagtaactggtggtgtgtagcagggtgtgcgttctgactgtctgtcctagtcgggtaacctgtttactttgtgctaacagtgccggagctttgtcagctcacctttgacctgctggaatttatcctgatctgtcgttgccatcacctccagggggcgctattggatggcagctggttcaggccctccgtgggtggctgcagagtgtgccggcacagcccacgcagctggttagctccactcttacttggttttctaaggggctttgcccaaagaagtcttgagggatagggccctcgatcttgcatacttgtgaggtgccacctcagtagctcatactacctcaccctgctcaggtgagctctgggagtccctggcctcagccctggcactgcccctggtgggattcagcaacaccccgggctgtttcacaagcaagtggttttcattaactcacaaagcctttttggacattaatatttatttatttttgtttttgtatacacattacccagcatctcttttgtataagagactttaggaaaatgagtttctccccagcaagtagccatattccagagaacagccttgaccagagatgtggagaaccaggggtataactaagggaagacatgtcaagcccttaagcaaattcttcttctccagattgtctctagcataataaacccagggaacactttaggccatgggtgtatgttctataaagttcgggacagttaaattccaggcctttcatcccccttccttcctgtgatggagtagattggggacagggttgaggggaacaagtgacatgaatgacctatttgcacagtttggaagcctcctgtctttatttatattgagatgtcagacaaaccaaagctccatccttgttggacctgctgcttctccccagccctgaactgataaagcctcagagttggagtgcctggctctctggtggggtgaccattagatgaagggacttgtacagtggccagtttaaaggtccacctttgaccatctaaacccaccttgttcagtgtcctctgaggacatcctcatcaggaaagcagtgttgagactcttcattgctgactggcttctccctttcttactcacactgaccattagaatttaagaaggaaatgtgtaacagactacagtcaagtgtctgctacattttcaagcatgagcaatccctcccagactgttggtgaggactgatttttgaaatgctggtgtgagagaggtggtaattacaggaaccagccgagtggctgagagcagataaatgtgctggagaaacctttttccttaacagagggcatcatggatgctgggtggtctgtgtacttaacctgaaactgtgaagttttccctttttgccagtaaaccaaaaagcagatccttgaaacttggcccttgaaacacgaaacagaaaactgcatcccctgatcccccgggggctgatcagattgatcagggtggctcagttggtcccagtcagatacgtcataggatcagtagctcatgagatttgttgaccaaaccctctccctgttggtgacccctgtattcacacctgaacttcccgtttccccccaccccaccaaagtcatgtctgcttcctctgcctccagctcaccctcttctgaatggttttgcttgaaacactatattgtggcagagggcaccctgggatacctggtagaaggtattcattttattttgcatttttaattgttttgactttctgttcatttgattttgttgctccctctctcctggaacctagtttactactctcttctgtgttactctgaagttctgtttaagccttgaacatcctcttctcccattttcttggtatgtactcaggaccagctacatcatttgtggagccctcttattcataaattattaaaaatttcaaggtggtggtcatagagcattaaaccaaatatgaggccattcccaacttgttttccgaggggaaaatggtaatacttgtgtggcacccggggttaaacagcagaggctccatgtggccagaggcagagattagtatcctggcactccagtgacccactgggtgactcactgatgccacagcacccgctaggaagctctgctgaaccttagtatttggtcctaaattttatgactccatggagttcccgtagtccatggctagttaggaagaaaggaggtgggataagggtcaggcccaggtgacccctaagaaccaggagatgggtaaaagtttttttttatattctgcttttctgatctgtgagtacctgtttgtctccaggccaaacctttgggcttaaatatctttttcctagacaggtttttgctagtgttgaattttcttcttcctctggcctccttctgtgcccctttccccaagcccaagactgcttaacttccaaagcaaattctagatagacactgtatttattggtatgggagtgggctctatggggtggtctgcacccatctgggactcttttccctaaatcctgcaccaaatgagtcaggaggcagggtgcacagcattagtttcaatgtggttatgcatcataagcttaacatcagaatgaaaatgaaactcgattttgatgtttctttaaaacccttcccctgtccaatccactcgccgcccccaccttgaatagctaaagtctcttatgaaacagagaagagttgttgacgtctaactccttccattaaattaataagtactgacctcctaatatttaagtgtttactatctattgctgtaaagttttgtatattttgtaaacttttttccccaaatagtagatgtctaaaatcattgtacatctgattcttttatattccattgttcagcacaaagtgtggtttttatttagaataaaaaaagaaatttgaaatg

SEQ ID NO: 2710 - DNA, 2833 bp, Homo sapiens
atctagttttcctttataaatcacttaagacacttatgaagtttcttgttctgaaattgctgtactgcaatgaagaagaggagaaaggttacttcaaatcttgagaagatccatctaggctatcataaagattcttcagaaggaaatgttgcagtggagtgtgaccaagtgacctatactcattctgcaggaagaccaactcctgaagctcttcactgttaccaggaacttcctccctctccagatcagagaaagcttttaagttctttgcagtataataagaatttgctaaaatatttaaatgatgataggcagaagcaaccatctttttgtgatttacttatcatagtggaaggaaaagaatttagtgcacataaagtagtcgttgctgtcggcagtagttattttcatgcgtgtttgagcaaaaatccaagcactgatgttgtcaccctggatcacgtaacacattcagtttttcagcatttgcttgaatttctttacacatcagaattttttgtgtacaaatatgaaatacctcttgttttagaggctgcaaaatttttggacattatagatgcagtgaagttgttaaataacgaaaatgttgccccttttcattcagagctaactgaaaagtcatcaccagaagaaacactaaatgaattaactggaagactatcaaataatcatcagtgcaaattctgtagtagacatttttgttataaaaagtctttagagaatcatttggctaaaacccataggtcccttttattagggaaaaaacatgggttaaaaatgctggagagaagtttctccgcaagaagatcaaaaaggaatcggaagtgccctgttaagtttgatgacaccagcgatgatgaacaggaaagtggtgatgggtcagacaatttgaatcaagaaaattttgataaggaaaagtcagatagaaatgattctgaggaccctggaagtgaatataatgctgaagaagatgagctagaggaggagatgtcagatgagtactctgacattgaagaacaaagtgaaaaggatcataatgatgcagaagaagaacctgaggctggtgattctgtaggaaatgttcatgaggggttaactccagtggtcattcagaacagcaacaaaaaaatattgcagtgtcctaaatgtgataaaacatttgaccgaataggaaaatatgagagccacacccgtgttcacacaggtgagaagccctttgagtgtgatatttgtcaccagcgctattcaacaaagtctaacctaactgttcacagaaagaagcacagtaatgaaacagaatttcataagaaggagcacaagtgcccttattgtaataaacttcatgcaagcaagaagactttagccaagcatgttaagagatttcatcctgaaaatgcacaagaatttatttccattaagaagactaagagtgaaagttggaaatgtgatatttgtaagaaatcttttactcgaagaccacacttggaggaacatatgattctacattctcaagataaaccttttaagtgtacctattgtgaagaacattttaaatcacggtttgctcggttaaagcatcaagaaaagttccatctgggtccttttccatgtgatatatgtggtcgccagtttaacgacactggaaatttgaaacgtcatatagaatgtactcatggtggaaagagaaaatggacttgctttatctgtggaaaatcagtacgagaaagaactactttgaaagaacatttgagaatccacagtggagaaaagcctcacctttgtagtatttgtgggcaaagttttcgtcatggaagttcgtatagacttcacttacgagtacatcatgatgataaaagatatgagtgcgatgaatgtggaaaaacatttatccgtcatgatcaccttacaaagcacaaaaaaatacattcaggtgaaaaagctcatcagtgtgaagaatgtggaaaatgttttggtcgtagggatcatctcactgttcattacaaaagcgtacaccttggagagaaagtgtggcaaaaatataaagcaacatttcatcaatgtgatgtttgtaagaaaatttttaaaggcaaatcaagtctggaaatgcattttcgaacgcattcaggtgaaaaaccatacaagtgtcaaatttgcaatcagtcttttagaattaagaaaacattaacaaaacacctggttattcattctgatgcccgacctttcaactgtcagcactgtaatgcaacatttaagcggaaagacaagctgaaataccacattgaccatgttcatgaaataaaatctcctgatgatcctctcagtacttctgaggaaaaacttgtatccttgccagttgagtactcatctgatgacaaaatctttcaaacagaaacaaaacaatatatggaccagcccaaagtttatcagtcggaagccaagacgatgttacagaatgtatctgctgaagtatgtgttccagtaactctggttccagttcagatgcctgacactccgagtgacctagtgcgtcatactaccacactcccaccatcttctcatgagattctgtcaccacagccacagtcaactgattatccacgagcagcggatttagcttttctggaaaaatatactcttactcctcaacctgcaaatatagttcacccagttcgacctgaacaaatgctagatcctagagaacaatcttatcttggaacattactgggccttgatagcactactggtgttcaaaatatttctacgaatgagcatcattcatgagtaaatctaaacattccacagatttttggatggt

SEQ ID NO: 2711 - DNA, 5695 bp, Homo sapiens
tgagaggatcacctgagcccaggagtttgagactacagtagctatgatggtgccactacactccagcctgggtaaaagagtgagacctcatctctttaaaaaaaaattctgccaggagcggtggttcatgcctataatcccaacactttaggaggctgaggctggtggatcacttgaagccaggaattcaagacgaacctgggcaaaaagtgagacccctgtctctacaaaaaaaattaattttttaaaaaaactagctgggcagctggcgtggtggctcacacctgtaatcccagcactttgggaggctgaggtgggtggatcatgcggtcaggagttcgagaccagcctggccaacatagtgaaaccccatctctactaaaaatacaaaaaaaaaaaattaaccaggtgtagtggcgggcgcctataatcccagctacttgggaggccaaggcaggagaatcgctcgaaaccagaaggtggaggtggcagtgagccgagatcacaccattgcactccagcctgggcaacaagagcaaaactctatctcaaaaaaaaaaaaaaaaactagctggacatggtggcatgtacatacagtcccagctactcaggaggctgaagcaggatgatagcttgattacccaagagttcaaggctgcagtgaactatgattgtgccactgcactccagcctgggcaacagagcaagaccccatctcgtttaaaaaaaaattatattatttgaatgggtatcttgtttgttttaactgtaaatatttacagtacttggttttacttgggagatttgtatagcttacaaatcttgtccctatggattcagttctcttacccacagacacagaaccaaaatcaggagttccacaaggagtggtggtgagtcctgcctttggcaaacacgcacctgcaagctttgctctagggattgaatcccttacccagtggggcccataggctagaggactttgtggaactttggaacttgtcttaacaatggaggaggggataaaataagtttatctttgggctggaatttgtactaatttttctttctcttgtagcaccgaacaagatttgtgatgaaatggagcctggaacaaactcttttcgggtagaatttcctgatttttccagcaccattctacagaaactgaaccagcagcgccagcaaggacaattatgtgacgtctccattgttgtccaaggccacattttccgggcacacaaagccgttcttgctgccagttcaccctacttttgtgaccaggtactcctgaaaaacagcaggagaattgttttgcctgatgtgatgaacccaagagtgtttgagaacattctcctatctagttatacaggacgtctagtaatgcccgctccagaaattgttagttacttgacagcggcaagcttcctccagatgtggcatgtggtagacaaatgcactgaagttttagagggaaaccctacagtcctttgtcagaagctaaatcatggcagtgaccaccagtcaccaagcagcagtagttataatggcctggtagagagctttgagctgggctctgggggtcatactgattttcccaaagcccaagaactgagagatggtgaaaatgaagaggagagcaccaaagacgagctgtcatcccagctcaccgagcacgaatacctgcccagcaactcgtccacagagcatgaccgcctgagcacggaaatggcaagccaggatggggaggagggcgccagcgacagcgccgagttccactacacccggcccatgtacagcaagcccagcatcatggctcacaaacgctggatccacgtgaagcccgagcgcttagaacaggcttgcgagggcatggatgtgcacgcgacctacgacgagcaccaggtcacagagtccatcaacaccgtgcagacagagcacacggtgcagccttcgggagtggaggaggacttccacatcggggagaagaaagtggaagctgagtttgatgaacaggctgatgaaagcaattatgatgagcaggtggatttctatggctcttccatggaagagttttccggagagaggtcagatgggaatctaattgggcacagacaggaggctgccctcgcagcaggttacagtgagaatattgaaatggtaacagggattaaagaagaagcttcccacttaggattctcagccactgacaagctgtatccttgtcagtgtgggaaaagtttcactcacaagagtcagagagatcggcacatgagcatgcacctcggtcttcggccttacggctgtggggtctgcggtaagaaattcaaaatgaagcaccatctcgtgggccacatgaaaattcacacaggcataaagccgtatgagtgtaatatctgtgcaaagaggtttatgtggagggacagtttccaccggcatgtgacttcttgtactaagtcctacgaagctgcaaaggctgagcagaatacaactgaggctaactaaaaataggatctggcccttgagtggcatgcacaaaaataaactatggtaattaatgcaaatctgggcacagatgatgcgtgctacttgctattatgagagaagcttaaaaaaaaaaaggaagatatttctgaaagaccagctctaagtaggccaattaaaaaaatctaattcctcaaatttgtgtgttccagtcctggcctggaatgggtaatggggtgagttaacccaccgcccagctggcaagggaaaccttctgactggttgtgatcgaaacaggtggacagagacacctgcacttggaactggactccacccaccagttccattttgggtggcagcagctttggatcactcattattacaaggtcatgctgaaattttattttgctcttgctatagatacttaggtaatgtggatttgttttggtagctatttcactgaaggaagtgctacttatataaaagctagaaataatgtgattcctaggatgagaaattggttaacagagctctgttgtctggttttagtctttctaaaggatattttaactaaaactatggagatgctaagagagtgactttctaaatatgaaacagataatttacggtacaaggctgacatagtgcccttgtcagtttctgtaagatgccactactgtcacaaggtgtttcagactcttgataaggcagtgttttgtattttagttctaacattgagtttggacaattttatctaattgtaattctctagggtgccagagataggtatttctcattggtttgctttcccaaatcctgtttggttaattgtagcctccatacagtggggtcttctctgtggctggtagacaccaagctgctgtgactgaccacggtaccacgggctgccacagcccctgctctgtcttagattatggtgctttacaaagagagtggtccatgaccacacttagtgagaaggagccacaagttgtggctgagagttccctgtgaacttgagtagttcatagagtgctaaggtgacactccaccaaccagagtgagagggcagataggcaggattctatgagtggttatacttaagggggacaaaactgcccaagaagaatcttgagaatacactctttcaaggtgggggagatactctttagagggtacactgagctaatactaccagttctttatgagcactggaatgtgtttgtaaaaggagtcctaagtttagcaaggtagtctacagaaccatgctcccacattatagataaagctgcttaaacttaaaagtccacaaagctacgccgaccagaaaaaaaaaattaaaaaaacaaacaagaaaagcaactattctgagaccttttctgcccatcagttagatgatttaggttaaaaagaaaggtaatattgcacatgcttttaagctgtgtaacatacctgaggttatcaccagggtaggacagggtgctactaccatgtcatcttttccacaatcgtactgggttatttacttctaaatagaaacttttttttcttaaaataaaaataatttttcttggatttggggtgaaattttatttgaaaagtttggctttgctgtaatgtaatagacattgctggcaatggcctctgattctcaagctcctaacaccagggtgtttacttgttgaacattgtctggaaagaggaaagaaaatacttatttaccagttaactcttgtaagcaagattacaaacagggatttattcacaacactgtatcattctcgatatataaaaagcactttgtatttaaaactttattataaatatatatatatattgtttttttttaaacctagaaactagatattacctcttggttgtttgccacattaatagcttctcttagtattgaaacgttactggttagcagtcttttctctgtgtacctgacacacgtatactgaggggattgtacaatcaagcctattgtctccttttctttcactcatggtagaggccagtgggttttaggtatgatcctagccattatatttgaggagaaattgttctattactcctactaatttcagtactaaggtggtgatgccattttgttctgccaaaaactgatcaccctctcccatggtattagcagagcattttctgcctgtttggaaggtttgatgtcctgtttctcattgaagactatttacatgatcattaggacattgcaggagaagtctgagaggtaaaaatacagatattctgggagagtcgtggtccttcagttctgctgaaatcagcatagtgcccttgtcatgaggaagagtttctgttcagccaagagtggtggcacgcttgggtggtagttttggaagcagtcagttgtgctaggacttatttaatatgttgtgaagagaagagtgtcttcttgaaagccttatgtgtccatcagctactaaatgtagaacttaaataagttgctcacatctgttcttttagtgttttgtggtatttgaggttttggcaaaaattgggatttttttatcaggcagccagagcctgggaggtggtagggtgtctgaaatgctggccatgttcagagaggcaggagaagggggttgctttcatttgaatattaaaagtgaatttttgtaaactctggtttttacctttttttcatccccacgttgagttggaggaatagtctcttctcttcacctcaatatagctttagaaaatctttatccttcctaataagtttggatggttgtgggtaacattgttcaaacaatctttcagggatcacgtcaatggcctacaaccaagctatttgtcccctactttgagtcttaactgtggtttttcttcaatccccatgggaaagggcttcaaggcaccaccagtggtatttaatattcatacttggggccaggcatggtggctcacgcctgtaatcccagcactttgggaggccgagatgggtggatcacctgaggtcaggagtttgtgaccagcctgaccaacatagtgaaaccccatctctactaaaaatacaaaaattagccaggcgtggtggcgcacacctgtaatcccagctactcgggaggcggaggcaggagaatcacttgaacctgggaggcggaggttgcagtgagccgcgattgcaccaccacactccagcctgcgcgacagatcgagactctgtctc

SEQ ID NO: 2712 - DNA, 5965 bp, Homo sapiens
tttccgggggctgaaggcacaggctgaatctgttgcggcagctgaggctacaacaggcctgcgccggcggcagagaggatatcttgggcgggggatgtgagcgctgagcccttggcagaagtcaatgtgattttaatttgaagcaaaactgaaatgggttcttcttcctcattctattcatgttgctttttgatggccatggcataaggaactctatcccaggaatacagctttgcattagcaccgaacaagatttgtgatgaaatggagcctggaacaaactcttttcgggtagaatttcctgatttttccagcaccattctacagaaactgaaccagcagcgccagcaaggacaattatgtgacgtctccattgttgtccaaggccacattttccgggcacacaaagccgttcttgctgccagttcaccctacttttgtgaccaggtactcctgaaaaacagcaggagaattgttttgcctgatgtgatgaacccaagagtgtttgagaacattctcctatctagttatacaggacgtctagtaatgcccgctccagaaattgttagttacttgacagcggcaagcttcctccagatgtggcatgtggtagacaaatgcactgaagttttagagggaaaccctacagtcctttgtcagaagctaaatcatggcagtgaccaccagtcaccaagcagcagtagttataatggcctggtagagagctttgagctgggctctgggggtcatactgattttcccaaagcccaagaactgagagatggtgaaaatgaagaggagagcaccaaagacgagctgtcatcccagctcaccgagcacgaatacctgcccagcaactcgtccacagagcatgaccgcctgagcacggaaatggcaagccaggatggggaggagggcgccagcgacagcgccgagttccactacacccggcccatgtacagcaagcccagcatcatggctcacaaacgctggatccacgtgaagcccgagcgcttagaacaggcttgcgagggcatggatgtgcacgcgacctacgacgagcaccaggtcacagagtccatcaacaccgtgcagacagagcacacggtgcagccttcgggagtggaggaggacttccacatcggggagaagaaagtggaagctgagtttgatgaacaggctgatgaaagcaattatgatgagcaggtggatttctatggctcttccatggaagagttttccggagagaggtcagatgggaatctaattgggcacagacaggaggctgccctcgcagcaggttacagtgagaatattgaaatggtaacagggattaaagaagaagcttcccacttaggattctcagccactgacaagctgtatccttgtcagtgtgggaaaagtttcactcacaagagtcagagagatcggcacatgagcatgcacctcggtcttcggccttacggctgtggggtctgcggtaagaaattcaaaatgaagcaccatctcgtgggccacatgaaaattcacacaggcataaagccgtatgagtgtaatatctgtgcaaagaggtttatgtggagggacagtttccaccggcatgtgacttcttgtactaagtcctacgaagctgcaaaggctgagcagaatacaactgaggctaactaaaaataggatctggcccttgagtggcatgcacaaaaataaactatggtaattaatgcaaatctgggcacagatgatgcgtgctacttgctattatgagagaagcttaaaaaaaaaaaggaagatatttctgaaagaccagctctaagtaggccaattaaaaaaatctaattcctcaaatttgtgtgttccagtcctggcctggaatgggtaatggggtgagttaacccaccgcccagctggcaagggaaaccttctgactggttgtgatcgaaacaggtggacagagacacctgcacttggaactggactccacccaccagttccattttgggtggcagcagctttggatcactcattattacaaggtcatgctgaaattttattttgctcttgctatagatacttaggtaatgtggatttgttttggtagctatttcactgaaggaagtgctacttatataaaagctagaaataatgtgattcctaggatgagaaattggttaacagagctctgttgtctggttttagtctttctaaaggatattttaactaaaactatggagatgctaagagagtgactttctaaatatgaaacagataatttacggtacaaggctgacatagtgcccttgtcagtttctgtaagatgccactactgtcacaaggtgtttcagactcttgataaggcagtgttttgtattttagttctaacattgagtttggacaattttatctaattgtaattctctagggtgccagagataggtatttctcattggtttgctttcccaaatcctgtttggttaattgtagcctccatacagtggggtcttctctgtggctggtagacaccaagctgctgtgactgaccacggtaccacgggctgccacagcccctgctctgtcttagattatggtgctttacaaagagagtggtccatgaccacacttagtgagaaggagccacaagttgtggctgagagttccctgtgaacttgagtagttcatagagtgctaaggtgacactccaccaaccagagtgagagggcagataggcaggattctatgagtggttatacttaagggggacaaaactgcccaagaagaatcttgagaatacactctttcaaggtgggggagatactctttagagggtacactgagctaatactaccagttctttatgagcactggaatgtgtttgtaaaaggagtcctaagtttagcaaggtagtctacagaaccatgctcccacattatagataaagctgcttaaacttaaaagtccacaaagctacgccgaccagaaaaaaaaaattaaaaaaacaaacaagaaaagcaactattctgagaccttttctgcccatcagttagatgatttaggttaaaaagaaaggtaatattgcacatgcttttaagctgtgtaacatacctgaggttatcaccagggtaggacagggtgctactaccatgtcatcttttccacaatcgtactgggttatttacttctaaatagaaacttttttttcttaaaataaaaataatttttcttggatttggggtgaaattttatttgaaaagtttggctttgctgtaatgtaatagacattgctggcaatggcctctgattctcaagctcctaacaccagggtgtttacttgttgaacattgtctggaaagaggaaagaaaatacttatttaccagttaactcttgtaagcaagattacaaacagggatttattcacaacactgtatcattctcgatatataaaaagcactttgtatttaaaactttattataaatatatatatatattgtttttttttaaacctagaaactagatattacctcttggttgtttgccacattaatagcttctcttagtattgaaacgttactggttagcagtcttttctctgtgtacctgacacacgtatactgaggggattgtacaatcaagcctattgtctccttttctttcactcatggtagaggccagtgggttttaggtatgatcctagccattatatttgaggagaaattgttctattactcctactaatttcagtactaaggtggtgatgccattttgttctgccaaaaactgatcaccctctcccatggtattagcagagcattttctgcctgtttggaaggtttgatgtcctgtttctcattgaagactatttacatgatcattaggacattgcaggagaagtctgagaggtaaaaatacagatattctgggagagtcgtggtccttcagttctgctgaaatcagcatagtgcccttgtcatgaggaagagtttctgttcagccaagagtggtggcacgcttgggtggtagttttggaagcagtcagttgtgctaggacttatttaatatgttgtgaagagaagagtgtcttcttgaaagccttatgtgtccatcagctactaaatgtagaacttaaataagttgctcacatctgttcttttagtgttttgtggtatttgaggttttggcaaaaattgggatttttttatcaggcagccagagcctgggaggtggtagggtgtctgaaatgctggccatgttcagagaggcaggagaagggggttgctttcatttgaatattaaaagtgaatttttgtaaactctggtttttacctttttttcatccccacgttgagttggaggaatagtctcttctcttcacctcaatatagctttagaaaatctttatccttcctaataagtttggatggttgtgggtaacattgttcaaacaatctttcagggatcacgtcaatggcctacaaccaagctatttgtcccctactttgagtcttaactgtggtttttcttcaatccccatgggaaagggcttcaaggcaccaccagtggtatttaatattcatacttggggccaggcatggtggctcacgcctgtaatcccagcactttgggaggccgagatgggtggatcacctgaggtcaggagtttgtgaccagcctgaccaacatagtgaaaccccatctctactaaaaatacaaaaattagccaggcgtggtggcgcacacctgtaatcccagctactcgggaggcggaggcaggagaatcacttgaacctgggaggcggaggttgcagtgagccgcgattgcaccaccacactccagcctgcgcgacagatcgagactctgtctcaaaaaaaaaaaaaaaattcatacttatgccatgcttttacctttagatacacacgttacagtaatccacgtggtgaagtgcatgtcaccgttaactaaggaaggactgcggtaacttaccctgcagggctgtaggttgcctgcaggcgctccaggcccccagcctgttgattccgatttctaggtctcatcttcctctggtcccttttggccactactttaaaagcttgcccaaagggatcccctccattctagtgggcatttgctgaactaacctgcccctaaggctggcttctaaccaccggggaaagctgcttagcctccagggctccctccttgagaggctcacacacccccaagctgctgtggagtgaatttgagacggagcagaagctgcaaagctgtgctttccctggggaaggggatgtgctgcggcctcctgggtgggcgtggagagggcgccatcacaacgagtccaggtttttgcttttggaaggtctctgataatttaggggtgctggaaaccagcactgtgttatccccaatccctcctgtgccaccagttttgtgatttaggttgctttagtgggtgactaacttttgttcagtgaaaccagggtttgtttggggtttttttctttgctacttacatatttaaaggtacaagtttcttatttcaaatctctactgatagtgccctatggggagatgctggaacacattttgcaaatgtgacttttttttttttttttaatttttgcttgaagcctgtgtcatgttagttgctgctgccttctttccttttgtgaggttcccaatgtttcgtccagaaaagtactttatttatgcaagtcaggtgactcttaggccacaaaaccatttgatgataaacagattatcattaggtgcatatcttattgatattttgtgaaatgttatgcctatgttgcaaaagttgaatagttttgtctttatatattgctgtcttcagtgtacagcatggttttacttaattgaatgttaatgtttaatattttcttcttatagaagagatcatgcccttttgtatgacatgttttaataaatgttatctgtcaactttgtaaaa

SEQ ID NO: 2713 - DNA, 5851 bp, Homo sapiens
cgggaagcgtttccgggggctgaaggcacaggctgaatctgttgcggcagctgaggctacaacaggcctgcgccggcggcagagaggatatcttgggcgggggatgtgagcgctgagcccttggcagcaccgaacaagatttgtgatgaaatggagcctggaacaaactcttttcgggtagaatttcctgatttttccagcaccattctacagaaactgaaccagcagcgccagcaaggacaattatgtgacgtctccattgttgtccaaggccacattttccgggcacacaaagccgttcttgctgccagttcaccctacttttgtgaccaggtactcctgaaaaacagcaggagaattgttttgcctgatgtgatgaacccaagagtgtttgagaacattctcctatctagttatacaggacgtctagtaatgcccgctccagaaattgttagttacttgacagcggcaagcttcctccagatgtggcatgtggtagacaaatgcactgaagttttagagggaaaccctacagtcctttgtcagaagctaaatcatggcagtgaccaccagtcaccaagcagcagtagttataatggcctggtagagagctttgagctgggctctgggggtcatactgattttcccaaagcccaagaactgagagatggtgaaaatgaagaggagagcaccaaagacgagctgtcatcccagctcaccgagcacgaatacctgcccagcaactcgtccacagagcatgaccgcctgagcacggaaatggcaagccaggatggggaggagggcgccagcgacagcgccgagttccactacacccggcccatgtacagcaagcccagcatcatggctcacaaacgctggatccacgtgaagcccgagcgcttagaacaggcttgcgagggcatggatgtgcacgcgacctacgacgagcaccaggtcacagagtccatcaacaccgtgcagacagagcacacggtgcagccttcgggagtggaggaggacttccacatcggggagaagaaagtggaagctgagtttgatgaacaggctgatgaaagcaattatgatgagcaggtggatttctatggctcttccatggaagagttttccggagagaggtcagatgggaatctaattgggcacagacaggaggctgccctcgcagcaggttacagtgagaatattgaaatggtaacagggattaaagaagaagcttcccacttaggattctcagccactgacaagctgtatccttgtcagtgtgggaaaagtttcactcacaagagtcagagagatcggcacatgagcatgcacctcggtcttcggccttacggctgtggggtctgcggtaagaaattcaaaatgaagcaccatctcgtgggccacatgaaaattcacacaggcataaagccgtatgagtgtaatatctgtgcaaagaggtttatgtggagggacagtttccaccggcatgtgacttcttgtactaagtcctacgaagctgcaaaggctgagcagaatacaactgaggctaactaaaaataggatctggcccttgagtggcatgcacaaaaataaactatggtaattaatgcaaatctgggcacagatgatgcgtgctacttgctattatgagagaagcttaaaaaaaaaaaggaagatatttctgaaagaccagctctaagtaggccaattaaaaaaatctaattcctcaaatttgtgtgttccagtcctggcctggaatgggtaatggggtgagttaacccaccgcccagctggcaagggaaaccttctgactggttgtgatcgaaacaggtggacagagacacctgcacttggaactggactccacccaccagttccattttgggtggcagcagctttggatcactcattattacaaggtcatgctgaaattttattttgctcttgctatagatacttaggtaatgtggatttgttttggtagctatttcactgaaggaagtgctacttatataaaagctagaaataatgtgattcctaggatgagaaattggttaacagagctctgttgtctggttttagtctttctaaaggatattttaactaaaactatggagatgctaagagagtgactttctaaatatgaaacagataatttacggtacaaggctgacatagtgcccttgtcagtttctgtaagatgccactactgtcacaaggtgtttcagactcttgataaggcagtgttttgtattttagttctaacattgagtttggacaattttatctaattgtaattctctagggtgccagagataggtatttctcattggtttgctttcccaaatcctgtttggttaattgtagcctccatacagtggggtcttctctgtggctggtagacaccaagctgctgtgactgaccacggtaccacgggctgccacagcccctgctctgtcttagattatggtgctttacaaagagagtggtccatgaccacacttagtgagaaggagccacaagttgtggctgagagttccctgtgaacttgagtagttcatagagtgctaaggtgacactccaccaaccagagtgagagggcagataggcaggattctatgagtggttatacttaagggggacaaaactgcccaagaagaatcttgagaatacactctttcaaggtgggggagatactctttagagggtacactgagctaatactaccagttctttatgagcactggaatgtgtttgtaaaaggagtcctaagtttagcaaggtagtctacagaaccatgctcccacattatagataaagctgcttaaacttaaaagtccacaaagctacgccgaccagaaaaaaaaaattaaaaaaacaaacaagaaaagcaactattctgagaccttttctgcccatcagttagatgatttaggttaaaaagaaaggtaatattgcacatgcttttaagctgtgtaacatacctgaggttatcaccagggtaggacagggtgctactaccatgtcatcttttccacaatcgtactgggttatttacttctaaatagaaacttttttttcttaaaataaaaataatttttcttggatttggggtgaaattttatttgaaaagtttggctttgctgtaatgtaatagacattgctggcaatggcctctgattctcaagctcctaacaccagggtgtttacttgttgaacattgtctggaaagaggaaagaaaatacttatttaccagttaactcttgtaagcaagattacaaacagggatttattcacaacactgtatcattctcgatatataaaaagcactttgtatttaaaactttattataaatatatatatatattgtttttttttaaacctagaaactagatattacctcttggttgtttgccacattaatagcttctcttagtattgaaacgttactggttagcagtcttttctctgtgtacctgacacacgtatactgaggggattgtacaatcaagcctattgtctccttttctttcactcatggtagaggccagtgggttttaggtatgatcctagccattatatttgaggagaaattgttctattactcctactaatttcagtactaaggtggtgatgccattttgttctgccaaaaactgatcaccctctcccatggtattagcagagcattttctgcctgtttggaaggtttgatgtcctgtttctcattgaagactatttacatgatcattaggacattgcaggagaagtctgagaggtaaaaatacagatattctgggagagtcgtggtccttcagttctgctgaaatcagcatagtgcccttgtcatgaggaagagtttctgttcagccaagagtggtggcacgcttgggtggtagttttggaagcagtcagttgtgctaggacttatttaatatgttgtgaagagaagagtgtcttcttgaaagccttatgtgtccatcagctactaaatgtagaacttaaataagttgctcacatctgttcttttagtgttttgtggtatttgaggttttggcaaaaattgggatttttttatcaggcagccagagcctgggaggtggtagggtgtctgaaatgctggccatgttcagagaggcaggagaagggggttgctttcatttgaatattaaaagtgaatttttgtaaactctggtttttacctttttttcatccccacgttgagttggaggaatagtctcttctcttcacctcaatatagctttagaaaatctttatccttcctaataagtttggatggttgtgggtaacattgttcaaacaatctttcagggatcacgtcaatggcctacaaccaagctatttgtcccctactttgagtcttaactgtggtttttcttcaatccccatgggaaagggcttcaaggcaccaccagtggtatttaatattcatacttggggccaggcatggtggctcacgcctgtaatcccagcactttgggaggccgagatgggtggatcacctgaggtcaggagtttgtgaccagcctgaccaacatagtgaaaccccatctctactaaaaatacaaaaattagccaggcgtggtggcgcacacctgtaatcccagctactcgggaggcggaggcaggagaatcacttgaacctgggaggcggaggttgcagtgagccgcgattgcaccaccacactccagcctgcgcgacagatcgagactctgtctcaaaaaaaaaaaaaaaattcatacttatgccatgcttttacctttagatacacacgttacagtaatccacgtggtgaagtgcatgtcaccgttaactaaggaaggactgcggtaacttaccctgcagggctgtaggttgcctgcaggcgctccaggcccccagcctgttgattccgatttctaggtctcatcttcctctggtcccttttggccactactttaaaagcttgcccaaagggatcccctccattctagtgggcatttgctgaactaacctgcccctaaggctggcttctaaccaccggggaaagctgcttagcctccagggctccctccttgagaggctcacacacccccaagctgctgtggagtgaatttgagacggagcagaagctgcaaagctgtgctttccctggggaaggggatgtgctgcggcctcctgggtgggcgtggagagggcgccatcacaacgagtccaggtttttgcttttggaaggtctctgataatttaggggtgctggaaaccagcactgtgttatccccaatccctcctgtgccaccagttttgtgatttaggttgctttagtgggtgactaacttttgttcagtgaaaccagggtttgtttggggtttttttctttgctacttacatatttaaaggtacaagtttcttatttcaaatctctactgatagtgccctatggggagatgctggaacacattttgcaaatgtgacttttttttttttttttaatttttgcttgaagcctgtgtcatgttagttgctgctgccttctttccttttgtgaggttcccaatgtttcgtccagaaaagtactttatttatgcaagtcaggtgactcttaggccacaaaaccatttgatgataaacagattatcattaggtgcatatcttattgatattttgtgaaatgttatgcctatgttgcaaaagttgaatagttttgtctttatatattgctgtcttcagtgtacagcatggttttacttaattgaatgttaatgtttaatattttcttcttatagaagagatcatgcccttttgtatgacatgttttaataaatgttatctgtcaactttgtaaaa

SEQ ID NO: 2714 - DNA, 710 bp, Homo sapiens
acaggctgaatctgttgcggcagctgaggctacaacaggcctgcgccggcggcagagaggatatcttgggcgggggatgtgagcgctgagcccttggcagcaccgaacaagatttgtgatgaaatggagcctggaacaaactcttttcgggtagaatttcctgatttttccagcaccattctacagaaactgaaccagcagcgccagcaaggacaattatgtgacgtctccattgttgtccaaggccacattttccgggcacacaaagccgttcttgctgccagttcaccctacttttgtgaccaggtactcctgaaaaacagcaggagaattgttttgcctgatgtgatgaacccaagagtgtttgagaacattctcctatctagttatacaggacgtctagtaatgcccgctccagaaattgttagttacttgacagcggcaagcttcctccagatgtggcatgtggtagacaaatgcactgaagttttagagggaaaccctacagtcctttgtcagaagctaaatcatggcagtgaccaccagtcaccaagcagcagtagttataatggcctggtagagagctttgagctgggctctgggggtcatactgattttcccaaagcccaagaactgagagatggtgaaaatgaagaggagagcaccaaagacgagctgtcatcccagctcaccgagcacgaatacctgcc

SEQ ID NO: 2715 - DNA, 2350 bp, Homo sapiens
gtggggcgcgggcaatggagcagagtatgggagaacgcgctcggagtaaagcacacggcgcggcgaaggcgtggcgggagtgtgcggcgccggacccgggaagctggcctgggcgccgggtctcgagtgcaggcctttgttctgaagtgtccaggccggccttgcggcgtcgggactgaggaatggagcccgtcgcggggcggggcgggaaaggaaggttcaagtctctcgggttgatgcgcaagtttccgtccccatcggccggacagattagaatcctttcaggtgctagatggcggctgcagaggctgtgcatcacatacacctgcagaacttctcacgctctctgcttgagaccctcaatgggcagaggcttgggggacacttctgtgacgtgactgtgcgcattcgtgaagcttcgctgcgtgcccaccgctgcgtgctggcggccggctcacccttcttccaagacaagctgctgctcggccactctgagatccgtgtgcctccggtggtgcccgcgcagacagtgcgacagctggtagagttcctgtacagcggttcgctcgttgtggcgcagggtgaagccctgcaggtgctcacggccgcgtcagtgcttcgcatacagacagttatcgacgaatgcacgcagattatcgcccgcgctcgagccccgggcacctctgcgcccacgcccctgcccacccctgtgcccccgccactcgcacctgcgcagctgcgtcaccgcctgcgccacctgctggctgcacgtcccccggggcaccccggtgctgcacacagccgtaagcagcgccagcccgcgcgtttgcagctgccagcgcccccaacacctgccaaggctgaggggcctgatgctgacccctcactgtccgcggcccctgatgaccgaggtgacgaggatgacgaggaaagtgacgatgagaccgatggcgaggatggcgaaggtggcggcccaggcgagggccaggcacctccttccttcccagactgtgctgctggcttcctcactgctgctgctgacagcgcgtgcgaggagccccctgcacccactggcctcgctgactacagtggtgccgggagagattttcttcggggagctgggtcagctgaggacgtatttccagacagctatgtatccacttggcacgacgaggatggcgctgtccccgaaggctgtcccactgagacccctgtccagcccgactgcatactgtctggatcccgcccgcctggtgtgaagaccccagggccgcccgttgcactcttcccctttcacttgggtgcccctgggccacccgcaccacccccttcagcaccatcggggccagcccctgcgcccccacccgccttctaccccacactccagcccgaggcagcccccagtactcagctgggggaggtcccggctccctctgctgctcccaccacggccccctcaggcacccctgctcgcaccccaggtgctgagccacctacgtatgagtgcagccactgtcgcaagacgttcagctcccggaaaaactacaccaagcacatgttcatccactcgggggagaagccgcaccagtgcgccgtgtgctggcgatccttctctctacgcgactacctgctcaaacacatggtcacgcacaccggcgtgcgcgccttccagtgcgccgtctgcgccaagcgcttcacgcagaagagctcgctcaacgtgcacatgcgcactcaccggcccgagcgcgcgccctgccccgcctgcggcaaggtcttctcgcaccgcgcgctgctggagcgccacctggcggcgcaccctgcgccctgatggcgctggggcctggcctcgcccacggtggatccggggcctcccgcacagtcggccacgcccgctgcgggacccgtggttcccgccactagaccacgctccctcctgagcgcaggtcctctctctcccttcaccctttctccataccagggcctaagtccgccttactcctctcctccatgtacttgaaccctccaggtggtgccgggctggggctggggctggttagaccacttctgagaactggactatttcctgcgtaaaccgggcgctcaggcgcttggacccggcccaagatttgactccggttctcaccccgccctctcctggggtggtggtgggggctggggggccgcttgcctgccccagggtcaggctgggcaaggtccctagctctctacccaagctgttactccctcatggggcgcctaaggagactcaagtggacccatcatatatgggggctgggcctcgggactctcgctctaataaaggactgtaggccatggggcctaaaccacg

SEQ ID NO: 2716 - DNA, 5190 bp, Homo sapiens
ggcgagcgcgcagctcggacccgcccggacgcagcgccctcccggcggcggcggcgatcaccggcgccggcccggcggccgcggcgcccgccctcgcccgcgccccatggggtcacagcacagagtctgtagaagaggcgacaccagggcttccaaatgaacaaccgaaaggaagatatggaaatcacgtcccactaccggcacctgctgcgggagctcaacgagcagaggcagcacggcgtcctgtgcgacgtctgcgtggtcgtggagggcaaggtcttcaaggcgcacaagaacgtcctgctgggcagcagccgctacttcaagacgctctactgccaggtgcagaagacgtcggagcaggccacggtcacgcacctggacatcgtcacggcccagggcttcaaggccatcatcgacttcatgtactcagcgcacctggcgctcaccagcaggaacgtcatcgaggtgatgtcagccgccagcttcctgcagatgacggacatcgtgcaagcctgccacgacttcatcaaggcggcgctggacatcagcatcaagtcggacgcctcagatgagcttgcggagttcgagatcggcgcctcgtccagcagcagcacggaagctctcatctcggccgtgatggctgggaggagcatctccccgtggctggcacggcgaacgagtcctgccaattcttccggagactcggccatcgccagctgtcacgacggagggagcagctacgggaaagaggatcaggagcccaaggccgatggccctgatgatgtttcttcacagcctctatggcctggagacgtgggctacgggcctctgcgcatcaaggaagagcaggtttcaccgtctcagtacggagggagcgagctgccttctgccaaggacggtgcagtacagaactctttctcagagcagagtgctggtgatgcctggcagcccacgggccgaaggaagaatcggaaaaacaaagagaccgtccggcacatcacacagcaggtggaagatgacagccgggccagctccccggtgccgtccttcctgccgacgtcggggtggccgttcagcagccgagactcaaatgcggacctgtccgtcaccgaagccagcagctccgacagccgaggagagagggccgagctctatgcacaggtggaggagggtctcctgggaggagaagccagctatctgggccctcccctcaccccagagaaggacgacgccctgcatcaggccaccgcggtggccaacctgcgcgcggcgctcatgagtaagaacagcctgctgtcgctgaaggccgacgtgctgggggatgacggctccctgctgttcgagtacctgcccagaggggcccactcgctgtccctgaatgagttcacggtgatcaggaagaagttcaagtgtccgtactgcagcttctcggccatgcaccagtgcatcctcaagcgacacatgcgctcgcacacgggagagcggccctacccctgcgagatctgcgggaagaagttcacgcggcgcgagcacatgaagcgccacacgctggtccacagcaaggacaagaagtatgtgtgcaaggtgtgcagccgcgtcttcatgtccgccgccagcgtgggcatcaggcatggctccaggcgccacggtgtgtgcaccgactgtgctggccgcggcatggccgggcccctggaccatggcggcggaggcggcgagggctctccagaggcgctgttcccaggcgacgggccctatctggaggaccctgaggacccacgaggggaggcggaggagctgggcgaggacgacgagggcctggcccctgaggatgcgctgttggcggacgacaaggatgaggaagactcgccgcggccgcgcagccccccaggaggccctgacaaggacttcgcctggctctcctaggcccgcccgccggcagggtcggtggctgcctcgctccgtccacccgtgtgtgtgtccggtgggtctccactgcggggccagggccacgctcacccctctcgcggcccctcctctgcttccccctgaacccaccccccacggaaaccagccctgcgggctaagcaggtgcgaccccagcaagaggggtgctctgggaccagacatgaagtgagttgggggagggcacagggtgggtttgagtgaagggagagcacggtcctaagtccccagcaggtggtgcgggtgtgtgagtggcccctgtgatggccagcctggcttggacacgtgatgggcctgtggccgggtccagtgggcactgggcggggtggtgtgttcggcccagaggcccctggcctgagcaggtgcagagttttacagacacccggtcagcccggctggagcccgccctcccctcccctagcagccaggtcactgcctgtggctgcagccgtggcccgtggtgcagccgtggcccatggcagcctgtagaatccaggtgcacagagagccctgccaccgtcttacctctgggctttggtgcttaacacacaacacagctgcagaccctgctggaggccgagggctccaggtgctatcttaggtggacacagccctgggggctccttccaggaggggaccctcagccctgtgccccccaccacttcaggccacaccaggttccctctgcaagggcctcggctcagtcgtgtgcacttcctcggagagccttgggctgccacgtccaccccgggctctgcccgtcctgttctgcccatggcccagcccggccgctcctgctgacccctcctggacgggctggagctgggctcctgcctttgctgctaacactggaggcggtgttcctaactgcagtgtgctgcttacacctccccgcgtgggtaaccaaatttttaagtagtcagagacatatcgaggtagttacataaaattattttgtttggcattatttttctcactcgaagaaactatatagggttgtttttcctttagcttgtgctcaagtcctcttgctgtgttttcagaagcactcacatgttctttcttttcctgagtgaaaagcaaaggtcccacggtgtgtgctgtggtgcaccgcctggctttgggggtcccggaggcaggctgcctagactcacagcctcgggaccgttgccacggcctgtcttctcgttcaggcctgcctctgacagcactcaccatgaggacattccatccttcaccccctcctctggcacaggccaccactgcggtgctgtgccttcagatgggaggtgggcgcggtggcctcctccttccctccaggacctgcccgtgtgaagaccccccggagtgctgagcttcagggctgcgtggaaagagtttttactctctttttctagcctgtataccaggcttttccccacattgtcaggtagagcaccagcttccctgaccgctgctgctcggggagggctggggctggccgggggtcctgtggaggagtacatggaggactccaggtacagcgcaggagtcacggcttttgttttttgacattggcccccggttctaccaatgacagggtgccctggctggagctgtcatcacacacacccctcagctcggaggctgtgggctcctcaaagctggagaaagaggccaagatttttctgcacacggagtgtggggataggagccgggccaagcgctggcccctcagcggtgagccctgcccactcttaccgagcaaggtgggtggctctggcacgagtcccccagggggagagcatggctaccagggagctgcagcggagccctccagccctcaccccaggccagccccaccccggcctctttgagaattctcagaactttgtacctttcccctgatttttaaaccctttttctaaacagactgactttcttacaaaatgcatttggaaaccagacctttgctacccaccaatgtctctgggttttgtaccagtccctgctctcaggccaccctgcccaggacccaggcccgcctccccctccacactcaggatgtcctgctccatctggccggctcactccgtgtggcctgcctttgctgaccgttttggggttccccgccggagctacaggggcattttcttccctaaaaccaacagtgtcccactgacctccccaagtgtttgctgcgtggcagatttcctgttcttgttcgcagtttgccgactgaagagtgtgggatttccgaggcccaggtgagcacgtccatctcaggaggcgtggagggaaaagacatgtcatgaagggttttttttatgtgactgatttttttttaaatcgatgttcaaactaataaatatttttttatgaagaggaaaaatgtgtagattacatttcacattttgtatttttgtttgtgtctgtttgtattttggtgtttacaacaccaaagtgggaaatacagtccattggggatggtgttatttgggggcggggagggggcagggacaccacgatttttctgtcaagctctggatcctgaccaggttgtacactggggctctctgagctttgggacacaggacactgccagggctacgtagggaactgactcagaagacgcagcttactgcttccaactttgcacatcttcctctttaaaaaactgagaaaatgcaaaaactggaactttttgcaatattataaaagaagtaatcttattttagctcattctgtgacatgtgcgactcttaagaaagccatacttaatggtggtggttttttttagatcttatattgtgttttgtatgcagcccttttagaactacttgtagtgagggtgctgtgtgtgcttttcttaaatatttatttttttcaacatgctttcaacctgtcaacaaaaacaaaacacacaaaaaaagggcagtgtttgaagattgttgatttttttctggggataatctatattatattgacttcctattacttattataaacctgtgtttgtattggagatgtgtctactattgggggaagaggttctcgtaatcgctcggtgggaaatcatggctctgccgtcctgcctctctgtggccgtgggttcacgtggcctctgcggtgagtctccaagtttctgcctaggcgcctgtgcgtttcctttctgtgacgggattagcttagacatccttgcaaagcgatcactttcaataaattgggaaattgctgctccagcag

SEQ ID NO: 2717 - DNA, 2335 bp, Homo sapiens
gacggacggacggacggaccgagcagccccggcgagcgcgcagctcggacccgcccggacgcagcgccctcccggcggcggcggcgatcaccggcgccggcccggcggccgcggcgcccgccctcgcccgcgccccatggggtcacagagtctgtagaagaggcgacaccagggcttccaaatgaacaaccgaaaggaagatatggaaatcacgtcccactaccggcacctgctgcgggagctcaacgagcagaggcagcacggcgtcctgtgcgacgtctgcgtggtcgtggagggcaaggtcttcaaggcgcacaagaacgtcctgctgggcagcagccgctacttcaagacgctctactgccaggtgcagaagacgtcggagcaggccacggtcacgcacctggacatcgtcacggcccagggcttcaaggccatcatcgacttcatgtactcagcgcacctggcgctcaccagcaggaacgtcatcgaggtgatgtcagccgccagcttcctgcagatgacggacatcgtgcaagcctgccacgacttcatcaaggcggcgctggacatcagcatcaagtcggacgcctcagatgagcttgcggagttcgagatcggcgcctcgtccagcagcagcacggaagctctcatctcggccgtgatggctgggaggagcatctccccgtggctggcacggcgaacgagtcctgccaattcttccggagactcggccatcgccagctgtcacgacggagggagcagctacgggaaagaggatcaggagcccaaggccgatggccctgatgatgtttcttcacagcctctatggcctggagacgtgggctacgggcctctgcgcatcaaggaagagcaggtttcaccgtctcagtacggagggagcgagctgccttctgccaaggacggtgcagtacagaactctttctcagagcagagtgctggtgatgcctggcagcccacgggccgaaggaagaatcggaaaaacaaagagaccgtccggcacatcacacagcaggtggaagatgacagccgggccagctccccggtgccgtccttcctgccgacgtcggggtggccgttcagcagccgagactcaaatgcggacctgtccgtcaccgaagccagcagctccgacagccgaggagagagggccgagctctatgcacaggtggaggagggtctcctgggaggagaagccagctatctgggccctcccctcaccccagagaaggacgacgccctgcatcaggccaccgcggtggccaacctgcgcgcggcgctcatgagtaagaacagcctgctgtcgctgaaggccgacgtgctgggggatgacggctccctgctgttcgagtacctgcccagaggggcccactcgctgtccctgaatgagttcacggtgatcaggaagaagttcaagtgtccgtactgcagcttctcggccatgcaccagtgcatcctcaagcgacacatgcgctcgcacacgggagagcggccctacccctgcgagatctgcgggaagaagttcacgcggcgcgagcacatgaagcgccacacgctggtccacagcaaggacaagaagtatgtgtgcaaggtgtgcagccgcgtcttcatgtccgccgccagcgtgggcatcaggcatggctccaggcgccacggtgtgtgcaccgactgtgctggccgcggcatggccgggcccctggaccatggcggcggaggcggcgagggctctccagaggcgctgttcccaggcgacgggccctatctggaggaccctgaggacccacgaggggaggcggaggagctgggcgaggacgacgagggcctggcccctgaggatgcgctgttggcggacgacaaggatgaggaagactcgccgcggccgcgcagccccccaggaggccctgacaaggacttcgcctggctctcctaggcccgcccgccggcagggtcggtggctgcctcgctccgtccacccgtgtgtgtgtccgggtgccctggctggagctgtcatcacacacacccctcagctcggaggctgtgggctcctcaaagctggagaaagaggccaagatttttctgcacacggagtgtggggataggagccgggccaagcgctggcccctcagcggtgagccctgcccactcttaccgagcaagtttgccgactgaagagtgtgggatttccgaggcccaggtgagcacgtccatctcaggaggcgtggagggaaaagacatgtcatgaagggttttttttatgtgactgatttttttttaaatcgatgttcaaactaataaatatttttttatgaagagg

SEQ ID NO: 2718 - DNA, 4212 bp, Homo sapiens
acagagtctgtagaagaggcgacaccagggcttccaaatgaacaaccgaaaggaagatatggaaatcacgtcccactaccggcacctgctgcgggagctcaacgagcagaggcagcacggcgtcctgtgcgacgtctgcgtggtcgtggagggcaaggtcttcaaggcgcacaagaacgtcctgctgggcagcagccgctacttcaagacgctctactgccaggtgcagaagacgtcggagcaggccacggtcacgcacctggacatcgtcacggcccagggcttcaaggccatcatcgacttcatgtactcagcgcacctggcgctcaccagcaggaacgtcatcgaggtgatgtcagccgccagcttcctgcagatgacggacatcgtgcaagcctgccacgacttcatcaaggcggcgctggacatcagcatcaagtcggacgcctcagatgagcttgcggagttcgagatcggcgcctcgtccagcagcagcacggaagctctcatctcggccgtgatggctgggaggagcatctccccgtggctggcacggcgaacgagtcctgccaattcttccggagactcggccatcgccagctgtcacgacggagggagcagctacgggaaagaggatcaggagcccaaggccgatggccctgatgatgtttcttcacagcctctatggcctggagacgtgggctacgggcctctgcgcatcaaggaagagcaggtttcaccgtctcagtacggagggagcgagctgccttctgccaaggacggtgcagtacagaactctttctcagagcagagtgctggtgatgcctggcagcccacgggccgaaggaagaatcggaaaaacaaagagaccgtccggcacatcacacagcaggtggaagatgacagccgggccagctccccggtgccgtccttcctgccgacgtcggggtggccgttcagcagccgagactcaaatgcggacctgtccgtcaccgaagccagcagctccgacagccgaggagagagggccgagctctatgcacaggtggaggagggtctcctgggaggagaagccagctatctgggccctcccctcaccccagagaaggacgacgccctgcatcaggccaccgcggtggccaacctgcgcgcggcgctcatgagtaagaacagcctgctgtcgctgaaggccgacgtgctgggggatgacggctccctgctgttcgagtacctgcccagaggggcccactcgctgtccctgaatgagttcacggtgatcaggaagaagttcaagtgtccgtactgcagcttctcggccatgcaccagtgcatcctcaagcgacacatgcgctcgcacacgggagagcggccctacccctgcgagatctgcgggaagaagttcacgcggcgcgagcacatgaagcgccacacgctggtccacagcaaggacaagaagtatgtgtgcaaggtgtgcagccgcgtcttcatgtccgccgccagcgtgggcatcaggcatggctccaggcgccacggtgtgtgcaccgactgtgctggccgcggcatggccgggcccctggaccatggcggcggaggcggcgagggctctccagaggcgctgttcccaggcgacgggccctatctggaggaccctgaggacccacgaggggaggcggaggagctgggcgaggacgacgagggcctggcccctgaggatgcgctgttggcggacgacaaggatgaggaagactcgccgcggccgcgcagccccccaggaggccctgacaaggacttcgcctggctctcctaggcccgcccgccggcagggtcggtggctgcctcgctccgtccacccgtgtgtgtgtccggtgggtctccactgcggggccagggccacgctcacccctctcgcggcccctcctctgcttccccctgaacccaccccccacggaaaccagccctgcgggctaagcaggtgcgaccccagcaagaggggtgctctgggaccagacatgaagtgagttgggggagggcacagggtgggtttgagtgaagggagagcacggtcctaagtccccagcaggtggtgcgggtgtgtgagtggcccctgtgatggccagcctggcttggacacgtgatgggcctgtggccgggtccagtgggcactgggcggggtggtgtgttcggcccagaggcccctggcctgagcaggtgcagagttttacagacacccggtcagcccggctggagcccgccctcccctcccctagcagccaggtcactgcctgtggctgcagccgtggcccgtggtgcagccgtggcccatggcagcctgtagaatccaggtgcacagagagccctgccaccgtcttacctctgggctttggtgcttaacacacaacacagctgcagaccctgctggaggccgagggctccaggtgctatcttaggtggacacagccctgggggctccttccaggaggggaccctcagccctgtgccccccaccacttcaggccacaccaggttccctctgcaagggcctcggctcagtcgtgtgcacttcctcggagagccttgggctgccacgtccaccccgggctctgcccgtcctgttctgcccatggcccagcccggccgctcctgctgacccctcctggacgggctggagctgggctcctgcctttgctgctaacactggaggcggtgttcctaactgcagtgtgctgcttacacctccccgcgtgggtaaccaaatttttaagtagtcagagacatatcgaggtagttacataaaattattttgtttggcattatttttctcactcgaagaaactatatagggttgtttttcctttagcttgtgctcaagtcctcttgctgtgttttcagaagcactcacatgttctttcttttcctgagtgaaaagcaaaggtcccacggtgtgtgctgtggtgcaccgcctggctttgggggtcccggaggcaggctgcctagactcacagcctcgggaccgttgccacggcctgtcttctcgttcaggcctgcctctgacagcactcaccatgaggacattccatccttcaccccctcctctggcacaggccaccactgcggtgctgtgccttcagatgggaggtgggcgcggtggcctcctccttccctccaggacctgcccgtgtgaagaccccccggagtgctgagcttcagggctgcgtggaaagagtttttactctctttttctagcctgtataccaggcttttccccacattgtcaggtagagcaccagcttccctgaccgctgctgctcggggagggctggggctggccgggggtcctgtggaggagtacatggaggactccaggtacagcgcaggagtcacggcttttgttttttgacattggcccccggttctaccaatgacagggtgccctggctggagctgtcatcacacacacccctcagctcggaggctgtgggctcctcaaagctggagaaagaggccaagatttttctgcacacggagtgtggggataggagccgggccaagcgctggcccctcagcggtgagccctgcccactcttaccgagcaaggtgggtggctctggcacgagtcccccagggggagagcatggctaccagggagctgcagcggagccctccagccctcaccccaggccagccccaccccggcctctttgagaattctcagaactttgtacctttcccctgatttttaaaccctttttctaaacagactgactttcttacaaaatgcatttggaaaccagacctttgctacccaccaatgtctctgggttttgtaccagtccctgctctcaggccaccctgcccaggacccaggcccgcctccccctccacactcaggatgtcctgctccatctggccggctcactccgtgtggcctgcctttgctgaccgttttggggttccccgccggagctacaggggcattttcttccctaaaaccaacagtgtcccactgacctccccaagtgtttgctgcgtggcagatttcctgttcttgttcgcagtttgccgactgaagagtgtgggatttccgaggcccaggtgagcacgtccatctcaggaggcgtggagggaaaagacatgtcatgaagggttttttttatgtgactgatttttttttaaatcgatgttcaaactaataaatatttttttatgaagagg

SEQ ID NO: 2719 - DNA, 3781 bp, Homo sapiens
gagcaagggggccactcagcagtggtcaggtcacacggctagaggggcacagtggggcctgggcctctggtccctactcctctggtccctctgtctcctggccctgggccagtcaccttagatgatttgatcgctgcggttgtagtcctgggatttaaatctcctgccctgggtggccctatgcagcatgaggccgccagttgctggttgagaagacaactgactccccggcggctgagttctcgctggtggaggacgtggcgctgcactttgcctgcttgatgggccgcctgaacgagcagcgcctcttccagcctgacctctgcgacgtggacttggtgctggtgccccagcgcagcgtctttccggcacacaagggtgtgctagccgcctacagccagttcttccactcactcttcacccagaacaagcagctgcagcgtgtggagctgtccctggaggcactggcacctggtggcctgcagcagatcctcaacttcatctatacgtccaagctgctggtcaacgcggccaacgtccacgaggtgctcagcgccgcctcattgctgcagatggctgacatcgctgcgtcctgccaagagctgctggacgcccgctctctaggcccaccaggtccgggcactgtggccctggcccagccggctgccagctgcactccagctgcgccgccctactactgtgacatcaagcaggaggccgacaccccaggcctgcccaagatctatgcccgcgagggccctgacccttactcggtgcgtgttgaggacggggcagggactgctggtggcacagtgcctgccaccattgggccagcccagcccttctttaaggaggagaaggagggtggtgtcgaggaggccggtgggcccccagccagcttgtgcaagctggagggtggagaagagttggaggaagagcttgggggttctggcacctacagccgcagggagcaatcccagatcatcgtggaggtgaacctcaacaaccagacactgcacgtgtccacggggccagaggggaagccaggtgccgggccaagcccagccaccgtggttctgggccgggaggacgggctgcagagacactcggacgaggaggaggaggacgacgaggaggaggaggaggaagaagaggaagaggaaggtggtggcagtggacgggaggaggaggaggaggaagagggtggcagtcagggagaagaggaagaagaggaggaggacgggcacagtgagcaggaagaggaagaggaggaggaagaggaggaagggcctagtgagcaggatcaagagagctctgaggaggaggagggggaggagggggaggctgggggcaagcaggggccacggggaagccgaagcagccgggcagacccccctccccacagtcacatggccacacggtcccgggagaacgcccggcgccggggtacccctgaacctgaagaagctgggcggcggggtgggaagaggccaaagccaccccctggagtggcctctgcatcggcccgagggccgccagccactgatgggctgggggccaaggtgaagctggaggagaagcagcaccatccatgccagaagtgcccacgagttttcaacaaccgctggtacctggagaaacacatgaatgtgacccacagccgcatgcagatctgcgaccagtgcggcaagcgcttcctgctggagagcgagctgctgctgcacaggcagacagactgcgagcgcaacatccagtgtgtgacatgtggcaaagctttcaagaagctttggtccctccatgagcataacaagattgtgcacggctacgcagagaagaagttctcatgcgagatctgtgagaagaagttctacaccatggcccacgtgcgtaagcacatggttgcccacaccaaggacatgcccttcacctgcgagacctgcggaaagtccttcaagcgcagcatgtccctcaaggtgcactcactgcagcactcaggggagaagccgttcagatgtgagaactgcaatgagcgcttccagtacaagtaccagctgcggtcacacatgagcatccacattggccacaagcagttcatgtgccaatggtgcggcaaggacttcaacatgaagcagtacttcgatgagcacatgaagacccacacaggagagaagccgtacatctgcgagatctgtggcaagagcttcaccagccggcccaacatgaagcggcaccggcgcacgcacacgggcgagaagccgtacccgtgcgacgtgtgtggccagcgcttccgcttctccaacatgctcaaggcccacaaggagaagtgcttccgcgtcagccacaccctggccggcgacggcgtccccgctgccccaggcctgcccccaacccagccccaggcgcacgcactgcccctgctcccggggctgccccagaccctgccgcccccgccccacctgccgcccccgcctccgctcttccccaccactgccagccccggcgggaggatgaacgccaacaactagctgccgagctgcacccgtgcacccgctggggcctggagtcagggcccactccaggagggacccactgccttcccggggagcacagtagtgcgggcctgggccctgctccacctccagaagtggctggatgtaccctgcctgaggccccgacgaggaggggtatgcaggctggcaggccccagagctggtggagggcatctcactcccaagtgccccccctttctgtgactccttgaagcctttacttttttttttttttggaagtgaaggaaaaagaaactatttacagcactcccctccaggtgaggggggtgctgggggtctgcagcagaaagaaaggggcctgggcagcaggtgtggccagtccctctgccaaggcctgtgccagaggggttggccagttggagcctgggtcagcctcagcagcctatccccatgtcctctatgcccctaatttgcttcctcatcttggagggtttggggagaagttggcgtgccacccccacaacccctgaggaggtgtagacccagtctgagagccgcaagcactgaggcagggcctgagactggacctgggtgagcgtggggggtggagggtggcgaggtgcggagactgcagaccagtgcttcactgtgtggagtggggcaggcaggggctggaccccagggacttgccttccccacccactctgctgccagcaggcccagggatccctgacctgcaccaggtggcaccaagggtcctgagtcctggagatgtccccagaagctgctgtgcctcacagcgctgtgagccagaccctccttgggcagacaggctgactggcagcaccagctttgggggcagagtcctaggatgaggcttgggcagtgctggtagggtttcaaggtgctattagtggggcaggggcagggcggctgctcacagagcaccccagttcctcaccagctactctggccatatatcccacaccagaaggaacaagtgtggctgtgtccatctctgctcccccaaaggcccgctctaggccttatcctccctctaggtcctgccacaacctgtccctggctggctccagcgtcctcgtccctcctgggcctgtgcaccggtgggtggggcgcccatagcactgccggtaaaggagcctgcatgttcaggcccctcgggggattggggggactggggaggcgcagcctagacccaattgcttgcccccatgaggctagcactaataggaaacccttttttgttgtca

SEQ ID NO: 2720 - DNA, 5507 bp, Homo sapiens
gagcaagggggccactcagcagtggtcaggtcacacggctagaggggcacagtggggcctgggcctctggtccctactcctctggtccctctgtctcctggccctgggccagtcaccttagatgatttgatcgctgcggttgtagtcctgggatttaaatctcctgccctgggtggccctatgcagcatgaggccgccagttgctggttgagaagacaactgactccccggcggctgagttctcgctggtggaggacgtggcgctgcactttgcctgcttgatgggccgcctgaacgagcagcgcctcttccagcctgacctctgcgacgtggacttggtgctggtgccccagcgcagcgtctttccggcacacaagggtgtgctagccgcctacagccagttcttccactcactcttcacccagaacaagcagctgcagcgtgtggagctgtccctggaggcactggcacctggtggcctgcagcagatcctcaacttcatctatacgtccaagctgctggtcaacgcggccaacgtccacgaggtgctcagcgccgcctcattgctgcagatggctgacatcgctgcgtcctgccaagagctgctggacgcccgctctctaggcccaccaggtccgggcactgtggccctggcccagccggctgccagctgcactccagctgcgccgccctactactgtgacatcaagcaggaggccgacaccccaggcctgcccaagatctatgcccgcgagggccctgacccttactcggtgcgtgttgaggacggggcagggactgctggtggcacagtgcctgccaccattgggccagcccagcccttctttaaggaggagaaggagggtggtgtcgaggaggccggtgggcccccagccagcttgtgcaagctggagggtggagaagagttggaggaagagcttgggggttctggcacctacagccgcagggagcaatcccagatcatcgtggaggtgaacctcaacaaccagacactgcacgtgtccacggggccagaggggaagccaggtgccgggccaagcccagccaccgtggttctgggccgggaggacgggctgcagagacactcggacgaggaggaggaggacgacgaggaggaggaggaggaagaagaggaagaggaaggtggtggcagtggacgggaggaggaggaggaggaagagggtggcagtcagggagaagaggaagaagaggaggaggacgggcacagtgagcaggaagaggaagaggaggaggaagaggaggaagggcctagtgagcaggatcaagagagctctgaggaggaggagggggaggagggggaggctgggggcaagcaggggccacggggaagccgaagcagccgggcagacccccctccccacagtcacatggccacacggtcccgggagaacgcccggcgccggggtacccctgaacctgaagaagctgggcggcggggtgggaagaggccaaagccaccccctggagtggcctctgcatcggcccgagggccgccagccactgatgggctgggggccaaggtgaagctggaggagaagcagcaccatccatgccagaagtgcccacgagttttcaacaaccgctggtacctggagaaacacatgaatgtgacccacagccgcatgcagatctgcgaccagtgcggcaagcgcttcctgctggagagcgagctgctgctgcacaggcagacagactgcgagcgcaacatccagtgtgtgacatgtggcaaagctttcaagaagctttggtccctccatgagcataacaagattgtgcacggctacgcagagaagaagttctcatgcgagatctgtgagaagaagttctacaccatggcccacgtgcgtaagcacatggttgcccacaccaaggacatgcccttcacctgcgagacctgcggaaagtccttcaagcgcagcatgtccctcaaggtgcactcactgcagcactcaggggagaagccgttcagatgtgagaactgcaatgagcgcttccagtacaagtaccagctgcggtcacacatgagcatccacattggccacaagcagttcatgtgccaatggtgcggcaaggacttcaacatgaagcagtacttcgatgagcacatgaagacccacacaggagagaagccgtacatctgcgagatctgtggcaagagcttcaccagccggcccaacatgaagcggcaccggcgcacgcacacgggcgagaagccgtacccgtgcgacgtgtgtggccagcgcttccgcttctccaacatgctcaaggcccacaaggagaagtgcttccgcgtcagccacaccctggccggcgacggcgtccccgctgccccaggcctgcccccaacccagccccaggcgcacgcactgcccctgctcccggggctgccccagaccctgccgcccccgccccacctgccgcccccgcctccgctcttccccaccactgccagccccggcgggaggatgaacgccaacaactagctgccgagctgcacccgtgcacccgctggggcctggagtcagggcccactccaggagggacccactgccttcccggggagcacagtagtgcgggcctgggccctgctccacctccagaagtggctggatgtaccctgcctgaggccccgacgaggaggggtatgcaggctggcaggccccagagctggtggagggcatctcactcccaagtgccccccctttctgtgactccttgaagcctttacttttttttttttttggaagtgaaggaaaaagaaactatttacagcactcccctccaggtgaggggggtgctgggggtctgcagcagaaagaaaggggcctgggcagcaggtgtggccagtccctctgccaaggcctgtgccagaggggttggccagttggagcctgggtcagcctcagcagcctatccccatgtcctctatgcccctaatttgcttcctcatcttggagggtttggggagaagttggcgtgccacccccacaacccctgaggaggtgtagacccagtctgagagccgcaagcactgaggcagggcctgagactggacctgggtgagcgtggggggtggagggtggcgaggtgcggagactgcagaccagtgcttcactgtgtggagtggggcaggcaggggctggaccccagggacttgccttccccacccactctgctgccagcaggcccagggatccctgacctgcaccaggtggcaccaagggtcctgagtcctggagatgtccccagaagctgctgtgcctcacagcgctgtgagccagaccctccttgggcagacaggctgactggcagcaccagctttgggggcagagtcctaggatgaggcttgggcagtgctggtagggtttcaaggtgctattagtggggcaggggcagggcggctgctcacagagcaccccagttcctcaccagctactctggccatatatcccacaccagaaggaacaagtgtggctgtgtccatctctgctcccccaaaggcccgctctaggccttatcctccctctaggtcctgccacaacctgtccctggctggctccagcgtcctcgtccctcctgggcctgtgcaccggtgggtggggcgcccatagcactgccggtaaaggagcctgcatgttcaggcccctcgggggattggggggactggggaggcgcagcctagacccaattgcttgcccccatgaggctagcactaataggaaacccttttttgttgtcatttaatgtctttattcctgcctttaatatggggaggaaggttccataagctacatgtttcctagttaagctctttcctattgtgtttatacagttttgtttgttatactctttgcaccttaaacccccaccactccccgacactattgccttcccagcatggctggagtgggaagaggcttgggccccgggggaatggttagggggactgaacccctctgaccttatgaggcccatggcactggggcagggagctggggacattttaatcatcaataaacgaagcactttattctgtacagatttgggcaggcccaaggtgcccgagtgatctgaggatttataatccaagccacaccaccctggttgttctctgggcttggagggtacagtgccagcagcttccttgcccaattgatgttggagctgtagacgtacgctcaggcgctcctgctgtcctgggggagagaaggttcgcccctccccgaggaagaaggcttctggtcaggacccccaccccaaggctggggactccaggctcctgctttactgtagctctttttcttccttgcactccttgatctttgggcttccgtgatgtcctcagggtccccccctccctgttgctatttttaatctctagtcccagtgcctggcagctctttggagctggctcacattttcccaaaaaaagttgatctctcccagtgggctgtaggcagggtcctccatgggtttccaacccccatcactggcaccaggatctcccacaggcactggtggtgtcatcacctgctggccccactacagcctgagtaggcctgagtggccgtggccaggctgagacctgtcaggccatactgacaagcagaggtcagagacactggtggggagctggcaatgaaaccctgtcctgggacatgggtttcatgttcttgtacacttcccctctgggatcaggtgaggggtccagacagctgaccagacagcttgacagctggtcaagacggtcacgggagctctaggtgggcacaaccaacccctctcctgggaggcccctgccccactggggataggagcctgtgtccctggtgctaagcactctcttcacttgggccattgttggtgggggctcctttccggccagaccacaaggccagaagcaataatggcacctcagcagttccagtatggataggggttcctgttttactagcttttacatctttttatttaaaacaaaacaacacaaaaaaacaatgtgcccccagatgtcagaatgaggcgactagggcaccatactcactttccagggctgggggaagggggacgcaggatcatcccctcccaaggagatctgtgggggtcccaccgtccatctggacttctcagcctgtttggctagaactcaggcctggagtctgggtctgccccctccccggctccttggggctctctggtctcaggccagctggcgatgggtggctagagtgatgaactcaagccctgtggccacagttctgggagccttcaaccctggctcatgctgccatagtctccacggtgcccttcacagagggcttggtagtggcagaatggccatgcccaggtgtgtgttgagaccattgacaactgctcgtgtacaggcaccccacagccccagagcatggggcacagcaggcatgcgagtgagaggatgaaggggaataaagtcagtacaactcgtg

SEQ ID NO: 2721 - DNA, 3775 bp, Homo sapiens
gagcaagggggccactcagcagtggtcaggtcacacggctagaggggcacagtggggcctgggcctctggtccctactcctctggtccctctgtctcctggccctgggccagtcaccttagatgatttgatcgctgcggttgtagtcctgggatttaaatctcctgccctgggtggccctatgcagcatgaggccgccagttgctggttgagaagacaactgactccccggcggctgagttctcgctggtggaggacgtggcgctgcactttgcctgcttgatgggccgcctgaacgagcagcgcctcttccagcctgacctctgcgacgtggacttggtgctggtgccccagcgcagcgtctttccggcacacaagggtgtgctagccgcctacagccagttcttccactcactcttcacccagaacaagcagctgcagcgtgtggagctgtccctggaggcactggcacctggtggcctgcagcagatcctcaacttcatctatacgtccaagctgctggtcaacgcggccaacgtccacgaggtgctcagcgccgcctcattgctgcagatggctgacatcgctgcgtcctgccaagagctgctggacgcccgctctctaggcccaccaggtccgggcactgtggccctggcccagccggctgccagctgcactccagctgcgccgccctactactgtgacatcaagcaggaggccgacaccccaggcctgcccaagatctatgcccgcgagggccctgacccttactcggtgcgtgttgaggacggggcagggactgctggtggcacagtgcctgccaccattgggccagcccagcccttctttaaggaggagaaggagggtggtgtcgaggaggccggtgggcccccagccagcttgtgcaagctggagggtggagaagagttggaggaagagcttgggggttctggcacctacagccgcagggagcaatcccagatcatcgtggaggtgaacctcaacaaccagacactgcacgtgtccacggggccagaggggaagccaggtgccgggccaagcccagccaccgtggttctgggccgggaggacgggctgcagagacactcggacgaggaggaggaggacgacgaggaggaggaggaggaagaagaggaagaggaaggtggtggcagtggacgggaggaggaggaggaggaagagggtggcagtcagggagaagaggaagaagaggaggaggacgggcacagtgagcaggaagaggaagaggaggagaagcagcaccatccatgccagaagtgcccacgagttttcaacaaccgctggtacctggagaaacacatgaatgtgacccacagccgcatgcagatctgcgaccagtgcggcaagcgcttcctgctggagagcgagctgctgctgcacaggcagacagactgcgagcgcaacatccagtgtgtgacatgtggcaaagctttcaagaagctttggtccctccatgagcataacaagattgtgcacggctacgcagagaagaagttctcatgcgagatctgtgagaagaagttctacaccatggcccacgtgcgtaagcacatggttgcccacaccaaggacatgcccttcacctgcgagacctgcggaaagtccttcaagcgcagcatgtccctcaaggtgcactcactgcagcactcaggggagaagccgttcagatgtgagaactgcaatgagcgcttccagtacaagtaccagctgcggtcacacatgagcatccacattggccacaagcagttcatgtgccaatggtgcggcaaggacttcaacatgaagcagtacttcgatgagcacatgaagacccacacaggagagaagccgtacatctgcgagatctgtggcaagagcttcaccagccggcccaacatgaagcggcaccggcgcacgcacacgggcgagaagccgtacccgtgcgacgtgtgtggccagcgcttccgcttctccaacatgctcaaggcccacaaggagaagtgcttccgcgtcagccacaccctggccggcgacggcgtccccgctgccccaggcctgcccccaacccagccccaggcgcacgcactgcccctgctcccggggctgccccagaccctgccgcccccgccccacctgccgcccccgcctccgctcttccccaccactgccagccccggcgggaggatgaacgccaacaactagctgccgagctgcacccgtgcacccgctggggcctggagtcagggcccactccaggagggacccactgccttcccggggagcacagtagtgcgggcctgggccctgctccacctccagaagtggctggatgtaccctgcctgaggccccgacgaggaggggtatgcaggctggcaggccccagagctggtggagggcatctcactcccaagtgccccccctttctgtgactccttgaagcctttacttttttttttttttggaagtgaaggaaaaagaaactatttacagcactcccctccaggtgaggggggtgctgggggtctgcagcagaaagaaaggggcctgggcagcaggtgtggccagtccctctgccaaggcctgtgccagaggggttggccagttggagcctgggtcagcctcagcagcctatccccatgtcctctatgcccctaatttgcttcctcatcttggagggtttggggagaagttggcgtgccacccccacaacccctgaggaggtgtagacccagtctgagagccgcaagcactgaggcagggcctgagactggacctgggtgagcgtggggggtggagggtggcgaggtgcggagactgcagaccagtgcttcactgtgtggagtggggcaggcaggggctggaccccagggacttgccttccccacccactctgctgccagcaggcccagggatccctgacctgcaccaggtggcaccaagggtcctgagtcctggagatgtccccagaagctgctgtgcctcacagcgctgtgagccagaccctccttgggcagacaggctgactggcagcaccagctttgggggcagagtcctaggatgaggcttgggcagtgctggtagggtttcaaggtgctattagtggggcaggggcagggcggctgctcacagagcaccccagttcctcaccagctactctggccatatatcccacaccagaaggaacaagtgtggctgtgtccatctctgctcccccaaaggcccgctctaggccttatcctccctctaggtcctgccacaacctgtccctggctggctccagcgtcctcgtccctcctgggcctgtgcaccggtgggtggggcgcccatagcactgccggtaaaggagcctgcatgttcaggcccctcgggggattggggggactggggaggcgcagcctagacccaattgcttgcccccatgaggctagcactaataggaaacccttttttgttgtcatttaatgtctttattcctgcctttaatatggggaggaaggttccataagctacatgtttcctagttaagctctttcctattgtgtttatacagttttgtttgttatactctttgcaccttaaacccccaccactccccgacactattgccttcccagcatggctggagtgggaagaggcttgggccccgggggaatggttagggggactgaacccctctgaccttatgaggcccatggcactggggcagggagctggggacattttaatcatcaataaacgaagcactttattctgt

SEQ ID NO: 2722 - DNA, 2889 bp, Homo sapiens
gttgtcgtgatgattccgcggccagcggatcgctgcgagtggccttgaaggcagctgctgcaggtgaagagtaggcggcggggcagagagcggcctccgagggtcacctgaatggttgagcatggaccctgttgctacccacagctgccatctgctccagcaactgcatgagcagcgaatccaaggcctgctttgtgactgtatgttggtggtaaaaggagtctgctttaaagcgcataagaatgtcctggcagcattcagccagtattttaggagcctctttcagaattcttcaagccagaagaatgatgtttttcacttggatgttaaaaatgtcagtggcatagggcagatcctggacttcatgtacacttctcatctagatcttaaccaggacaatatacaagtaatgctggacacagcacagtgtttgcaagttcaaaatgttctgagtctgtgtcacacatttttaaaatcagccactgtagtacagccacctggcatgccttgtaatagtacattgtctctacaaagcaccctgaccccagatgccacttgtgttatcagtgaaaactacccccctcatttactgcaggaatgttcagcagatgcacagcagaacaaaacgttggatgaatcgcatccgcatgcttcaccatcagttaatcgtcatcactccgcaggtgaaatctcaaaacaagctcctgatacttcagatggcagctgcacagaactgcctttcaaacagccaaattactattacaaactcagaaacttttacagtaagcagtaccataaacacgcagctggtcccagtcaggagagagttgttgagcagccttttgctttcagcacctctacagaccttaccacggtagagagccagccttgtgccgtcagtcattctgaatgcatcctggagtctcccgagcacttaccttccaacttcctggcccagcctgtgaatgactctgccccacaccctgagtcagacgccacatgccaacaacctgtcaagcagatgaggctcaaaaaggccattcatctgaagaagctcaatttcctgaagtcacagaaatacgcagagcaagtatctgaacccaagtcagatgatggtttgacaaagaggttggaatctgctagtaaaaataccctagagaaagctagcagccaaagtgctgaagaaaaagaaagtgaagaagtcgtcagttgtgagaattttaattgcattagtgagacggagaggcctgaagacccggctgccctggaagaccagtcccagacacttcagtcccagagacaatacgcgtgtgaattatgcgggaaaccttttaaacacccaagcaacttggagcttcacaaacggtctcatacaggtgagaaaccttttgaatgtaacatttgtgggaaacatttctctcaggcaggtaacttgcagactcacttacgacggcattctggtgaaaaaccatacatctgcgagatctgtggaaagaggtttgcagcctctggcgacgtccagcgtcacattattattcactcaggagaaaaaccacacttgtgtgacatctgtggtcgagggtttagtaacttcagtaatttgaaggagcacaaaaagacacacacggctgataaagtcttcacctgtgatgagtgtggaaagtcttttaatatgcaaaggaagttagtaaagcacagaattcggcacacgggggagcggccttacagctgctctgcctgcgggaaatgttttgggggatcaggtgacctccgcaggcatgtccgcactcacactggggagaagccgtacacatgtgagatctgtaacaagtgctttacccgctctgcggtgctccggcggcacaagaagatgcactgcaaagctggtgacgagagcccagatgtgctggaggagctcagccaagccatcgagacctccgacctcgagaaatctcagagctcagactctttctcccaagacacgtctgtgacgctgatgccagtgtcggttaaactccctgtccacccagtggaaaattctgtggcagaatttgatagccactctggcggctcctattgtaagttacggtccatgatccaacctcatggagttagtgaccaggagaagctgagtttggatcctggtaaacttgccaagccccagatgcagcagacacagcctcaggcctatgcttactcggatgtggacaccccagccggtggcgaaccactgcaggccgatggcatggccatgatccgttcctctctggctgctttggacaaccacggcggtgaccccctgggcagtcgagcatcttccaccacttataggaactcagagggtcagtttttctccagcatgactctctgggggctagcgatgaagacgctgcagaatgaaaacgagttagaccagtgatgtaccgcgcttctccacggtagaggcgtgttctcagtttagcaggctggtgttaaggctgtaggaggacccagtttccccatgacagtgccttctaactagccagagaataggtagcttccctcctgatgatggctcataatctgaagcatcttgagctgggggtgtgagggggagggcctgctggctcaccgtgaggcagccgcgggagggagcgctgacgtcacagaagcgaaggcttgatgctgtctcagcagcctcagctgtgggggggaagcgcgtgtgcatcgtgtcaactactgtacatgttggtcatgtgaaaggaattatatatgtatagtattacaagtatttttgcatttttacaagattgaaatttgtagcattttgtattatttacacagaatttatttgtatatgaaactcataccataatttaattcgaataaatgaaacttttctatatatta

SEQ ID NO: 2723 - DNA, 2576 bp, Homo sapiens
agtggaagtgacgccaacggaagcaggaaggcggttccggcaagccaagggggcgttgtcgtgatgattccgcggccagcggatcgctgcgagtggccttgaaggcagctgctgcaggtgaagagtaggcggcggggcagagagcggcctccgagggtcacctgaatggttgagcatggaccctgttgctacccacagctgccatctgctccagcaactgcatgagcagcgaatccaaggcctgctttgtgactgtatgttggtggtaaaaggagtctgctttaaagcgcataagaatgtcctggcagcattcagccagtattttaggagcctctttcagaattcttcaagccagaagaatgatgtttttcacttggatgttaaaaatgtcagtggcatagggcagatcctggacttcatgtacacttctcatctagatcttaaccaggacaatatacaagtaatgctggacacagcacagtgtttgcaagttcaaaatgttctgagtctgtgtcacacatttttaaaatcagccactgtagtacagccacctggcatgccttgtaatagtacattgtctctacaaagcaccctgaccccagatgccacttgtgttatcagtgaaaactacccccctcatttactgcaggaatgttcagcagatgcacagcagaacaaaacgttggatgaatcgcatccgcatgcttcaccatcagttaatcgtcatcactccgcaggtgaaatctcaaaacaagctcctgatacttcagatggcagctgcacagaactgcctttcaaacagccaaattactattacaaactcagaaacttttacagtaagcagtaccataaacacgcagctggtcccagtcaggagagagttgttgagcagccttttgctttcagcacctctacagaccttaccacggtagagagccagccttgtgccgtcagtcattctgaatgcatcctggagtctcccgagcacttaccttccaacttcctggcccagcctgtgaatgactctgccccacaccctgagtcagacgccacatgccaacaacctgtcaagcagatgaggctcaaaaaggccattcatctgaagaagctcaatttcctgaagtcacagaaatacgcagagcaagtatctgaacccaagtcagatgatggtttgacaaagaggttggaatctgctagtaaaaataccctagagaaagctagcagccaaagtgctgaagaaaaagaaagtgaagaagtcgtcagttgtgagaattttaattgcattagtgagacggagaggcctgaagacccggctgccctggaagaccagtcccagacacttcagtcccagagacaatacgcgtgtgaattatgcgggaaaccttttaaacacccaagcaacttggagcttcacaaacggtctcatacagggaaatgttttgggggatcaggtgacctccgcaggcatgtccgcactcacactggggagaagccgtacacatgtgagatctgtaacaagtgctttacccgctctgcggtgctccggcggcacaagaagatgcactgcaaagctggtgacgagagcccagatgtgctggaggagctcagccaagccatcgagacctccgacctcgagaaatctcagagctcagactctttctcccaagacacgtctgtgacgctgatgccagtgtcggttaaactccctgtccacccagtggaaaattctgtggcagaatttgatagccactctggcggctcctattgtaagttacggtccatgatccaacctcatggagttagtgaccaggagaagctgagtttggatcctggtaaacttgccaagccccagatgcagcagacacagcctcaggcctatgcttactcggatgtggacaccccagccggtggcgaaccactgcaggccgatggcatggccatgatccgttcctctctggctgctttggacaaccacggcggtgaccccctgggcagtcgagcatcttccaccacttataggaactcagagggtcagtttttctccagcatgactctctgggggctagcgatgaagacgctgcagaatgaaaacgagttagaccagtgatgtaccgcgcttctccacggtagaggcgtgttctcagtttagcaggctggtgttaaggctgtaggaggacccagtttccccatgacagtgccttctaactagccagagaataggtagcttccctcctgatgatggctcataatctgaagcatcttgagctgggggtgtgagggggagggcctgctggctcaccgtgaggcagccgcgggagggagcgctgacgtcacagaagcgaaggcttgatgctgtctcagcagcctcagctgtgggggggaagcgcgtgtgcatcgtgtcaactactgtacatgttggtcatgtgaaaggaattatatatgtatagtattacaagtatttttgcatttttacaagattgaaatttgtagcattttgtattatttacacagaatttatttgtatatgaaactcataccataatttaattcgaataaatgaaacttttctatatatt

SEQ ID NO: 2724 - DNA, 502 bp, Homo sapiens
cggccagcggatcgctgcgagtggccttgaaggcagctgctgcaggtcacctgaatggttgagcatggaccctgttgctacccacagctgccatctgctccagcaactgcatgagcagcgaatccaaggcctgctttgtgactgtatgttggtggtaaaaggagtctgctttaaagcgcataagaatgtcctggcagcattcagccagtattttaggagcctctttcagaattcttcaagccagaagaatgatgtttttcacttggatgttaaaaatgtcagtggcatagggcagatcctggacttcatgtacacttctcatctagatcttaaccaggacaatatacaagtaatgctggacacagcacagtgtttgcaagttcaaaatgttctgagtctgtgtcacacatttttaaaatcagccactgtagtacagccacctggcatgccttgtaatagtacattgtctctacaaagcaccctgaccccagatgccacttgt

SEQ ID NO: 2725 - DNA, 2380 bp, Homo sapiens
gttgtcgtgatgattccgcggccagcggatcgctgcgagtggccttgaaggcagctgctgcaggtgaagagtaggcggcggggcagagagcggcctccgagggtcacctgaatggttgagcatggaccctgttgctacccacagctgccatctgctccagcaactgcatgagcagcgaatccaaggcctgctttgtgactgtatgttggtggtaaaaggagtctgctttaaagcgcataagaatgtcctggcagcattcagccagtattttaggagcctctttcagaattcttcaagccagaagaatgatgtttttcacttggatgttaaaaatgtcagtggcatagggcagatcctggacttcatgtacacttctcatctagatcttaaccaggacaatatacaagtaatgctggacacagcacagtgtttgcaagttcaaaatgttctgagtctgtgtcacacatttttaaaatcagccactgtagtacagccacctggcatgccttgtaatagtacattgtctctacaaagcaccctgaccccagatgccacttgtgttatcagtgaaaactacccccctcatttactgcaggaatgttcagcagatgcacagcagaacaaaacgttggatgaatcgcatccgcatgcttcaccatcagttaatcgtcatcactccgcaggtgaaatctcaaaacaagctcctgatacttcagatggcagctgcacagaactgcctttcaaacagccaaattactattacaaactcagaaacttttacagtaagcagtaccataaacacgcagctggtcccagtcaggagagagttgttgagcagccttttgctttcagcacctctacagaccttaccacggtagagagccagccttgtgccgtcagtcattctgaatgcatcctggagtctcccgagcacttaccttccaacttcctggcccagcctgtgaatgactctgccccacaccctgagtcagacgccacatgccaacaacctgtcaagcagatgaggctcaaaaaggccattcatctgaagaagctcaatttcctgaagtcacagaaatacgcagagcaagtatctgaacccaagtcagatgatggtttgacaaagaggttggaatctgctagtaaaaataccctagagaaagctagcagccaaagtgctgaagaaaaagaaagtgaagaagtcgtcagttgtgagaattttaattgcattagtgagacggagaggcctgaagacccggctgccctggaagaccagtcccagacacttcagtcccagagacaatacgcgtgtgaattatgcgggaaaccttttaaacacccaagcaacttggagcttcacaaacggtctcatacaggtttgcagcctctggcgacgtccagcgtcacattattattcactcaggagaaaaaccacacttgtgtgacatctgtggtcgagggtttagtaacttcagtaatttgaaggagcacaaaaagacacacacggctgataaagtcttcacctgtgatgagtgtggaaagtcttttaatatgcaaaggaagttagtaaagcacagaattcggcacacgggggagcggccttacagctgctctgcctgcgggaaatgttttgggggatcaggtgacctccgcaggcatgtccgcactcacactggggagaagccgtacacatgtgagatctgtaacaagtgctttacccgctctgcggtgctccggcggcacaagaagatgcactgcaaagctggtgacgagagcccagatgtgctggaggagctcagccaagccatcgagacctccgacctcgagaaatctcagagctcagactctttctcccaagacacgtctgtgacgctgatgccagtgtcggttaaactccctgtccacccagtggaaaattctgtggcagaatttgatagccactctggcggctcctattgtaagttacggtccatgatccaacctcatggagttagtgaccaggagaagctgagtttggatcctggtaaacttgccaagccccagatgcagcagacacagcctcaggcctatgcttactcggatgtggacaccccagccggtggcgaaccactgcaggccgatggcatggccatgatccgttcctctctggctgctttggacaaccacggcggtgaccccctgggcagtcgagcatcttccaccacttataggaactcagagggtcagtttttctccagcatgactctctgggggctagcgatgaagacgctgcagaatgaaaacgagttagaccagtgatgtaccgcgcttctccacggtagaggcgtgttctcagtttagcaggctggtgttaaggctgtaggaggacccagtttcccca

SEQ ID NO: 2726 - DNA, 4627 bp, Homo sapiens
gcgaactggctggaggagctaggggactagaggcggggtgggaggggggcgggtggaagggggaggaagtcccgtaacggagacgctggtcaggacgttcccacctcctctgacactgccgagtccgatcggagaggggtcaccgcctccttcagcgaggaggaggggggcggagcccgactcaggatcatggattttcctggtcactttgaacaaatcttccagcagctgaactaccagagacttcatggccagctctgtgattgtgtcattgtagtggggaatagacactttaaagcccaccgctccgtgctggcagcatgcagcacgcatttccgagccctgttctcagtggcagaaggagatcagaccatgaacatgatccagctggatagcgaggtggtgacagcagaggcctttgctgcactgattgacatgatgtatacctccaccctcatgctgggggagagcaatgtaatggatgtcttattggcagcctctcacctgcatttgaactctgttgttaaggcatgtaaacattacttaacgacaaggacgctgcccatgtctccccccagtgagcgcgttcaggagcagagcgcccgcatgcagcgctcctttatgctacagcagctgggactaagcatcgtgagctcagccctcaattccagccagaatggcgaggagcagccagcccccatgagctcttccatgcgcagtaacctggatcagcgcacgcccttccccatgagacgccttcataagcgcaagcagtctgcagaggagcgggccaggcagcgcctccgaccctccatagatgagtctgccatttcagatgttacaccggagaatgggccttcaggggttcattctcgggaggagttcttttcaccagattctctgaaaattgtggataatcctaaagctgatggaatgactgataaccaggaagatagtgcgatcatgtttgatcagtcttttggcactcaagaagatgcccaggtgcccagccagtctgataacagtgctggcaacatggcacagttgtccatggcctctcgtgcaactcaggttgagactagttttgatcaggaagctgcacctgagaaaagtagttttcagtgtgaaaaccctgaggttggccttggtgagaaggagcacatgagagtggtggttaaatctgagcccctgagctcacctgagcctcaggatgaagtgagcgatgtgacctcacaagcagaaggcagcgagtctgtggaagtggaaggagttgtggtcagtgccgagaagatagacctcagccctgaaagcagtgatcggagtttttcagatccccagtctagcacagacagggtaggtgatatccatattttggaagtcacaaataacctagagcataagtccacttttagtatttcgaattttcttaacaagagcagaggaaataactttactgcaaatcagaacaatgatgataatattccaaacaccactagtgactgcaggctggagagtgaggccccctatttgttgagtccagaggctgggcctgcaggtgggccctcctctgcccctggctcccatgtagagaacccatttagtgaacctgcagactcccacttcgtcaggcctatgcaggaggtgatgggcctgccgtgtgtgcagacttcaggctaccaaggaggagaacagtttgggatggacttttccaggtctggtttgggcctccactcctccttctccagggtaatgataggttccccaaggggaggagccagtaactttccttactaccgccgcatagctcccaaaatgccagttgtaacttccgtcaggagctcacagatcccagaaaactctaccagttctcagctaatgatgaatggagctacgtcctcatttgaaaatggccatccttcccagcctggccctccacagttgaccagggcatctgcagatgttctgtcaaagtgcaagaaggccttatcagagcacaatgttttggttgtagagggagctcgcaagtatgcctgcaaaatctgctgcaaaacttttctgactttgacagattgcaagaagcacatccgtgttcacacaggtgaaaagccttacgcctgcctgaagtgtggcaagaggtttagtcagtccagccacctgtataagcactcaaagactacctgcctgcgctggcagagcagcaatcttcccagcactttgctctagctgtttgtccttacaagacaacgctgaggccagttgtcagactgaatttcttttggtaagcagttaatgcctttgggttcgaggcttccagctgcccagtggctcttaaacagtttagcaactaataaccggagaactaacatgtagtatttgtgctgctgcatttctgagtgaagtgcacgtcttgggaaagggatgcaatccctgaaaccaggtgcttccttggggttgagtaatgcagtcagaaagtagtttgtaattgatattaaaagtggcacatttaaaaatttaaaaattgaagtgcaaaaaaaattttttagcaatttttgtaaaactgtgtagcatttaaatttcctataccttctgatgggagtattatatccctgtatagtgatgcaaaatgcacttatgtgtaaccagtggtgatttggtgcctgtcttaaaggaaggcctttgaggacacacctgtctgccacaaatgctttaaagtgtatcatgagctagtcctaggcctcaaagtactgtattttttatttttacctgatttgcagtcataaacactgcactttggtgctgacactgggtccagagtgagcattctcttggactattagatgtatatacttttgaatacatcactgttggatagatgttttaacagttttttctggtttaaaaaccaaattgtaaatggagtgtgtacttgtagagagtgacaaggtattgtttccctatgtgctgtttgagcagtattttaaccaacttgtattacagatgttacagttccatgttaggaagtcagaaaagacttgtgtttgtctttgttctgctgatgtggagtcatgttttgtggggtcttccatggcacatttacctgttgctccgtccagatgttgagggccagtctaggctgacacatcctacccgaggacaagcctgttctccatttcttcactctcccctccccatatagcaactctcccaggtttagattaccgttttcgacgacagattaaccaaaaatgccccacacaggttttattactgttatatactatacttttaacagtacagaccctaaattttattatttgttgctcccccaatctgataccaaatgtttaaagttgtttgaaatccaaacatggtagtgttcatgggtaaatattttctaggctatgtaagagttagcagcccatagcatagaagtaatcaagtagcatctgagactgttggaggcactagggcctctctgggccctacagcctcacttccccagcctcaccttgctgtcctctgacactgccatcagggctgttagtggcacctgtatgaggccaagtgtgcgtccaggggaacagcacaggttaatgcgtctccctagaactcatgaagtcagtttaattcatgcatgaacatgagttcattttatgttttatatagctttcttagacataccaaaccatcattcataaatcagataaattattcagtttttgtgtttagaaagctaagtatgtgtagctggaaacaaaaatgagcgtgttttctctcctgttaatctagagtgtgcagttacacatgtgtggataatttcatgttccaggggcgcttggcatctcccatggactgattcccaggaagaaaagcccaaagggaaacccacgattcctttcgagtagatgtgggaaagagcccattggaggatatgaggtcctgtgaaattcagttgtgtgtgtggctccttgttagcagtcatgttgacatggtgttaggaggctccccatccaccctttacatgatgtagggaccagtgtcttgtgagattaaccttgggacacagtgggttagcctggagaaaatgagaggccctgcctggacccagggagaggagccagtgacacaggcagagcggtgcagccctccttcccttccatttggaggaggtggtgccaggagcctgcccgcttacctctgctgaagcataagtggactttgcttttggggcttatctctgatacatgctggagccctgcctctccactgctagatggaacctggaatctctcatctacctcttagtctgtcagtttctacgtgtgagaagcaagcttgtgggccagtgtccttgtacatgctgtagcacttaaaaaataattccagggttccctggaaaaccagtcccagggttcctatgatctgtagtttctacctggattataactggttttgggtacctgaattttgattggttagccttaattatagtctggcgtgatcatgtagaatcttttctggtgaacagatcataaagttctatcaaggagttctatcaaggcatccatgtcagtggtgctatgctggttacaacttgagatttttgaaataaaaaatttgtcatatt

SEQ ID NO: 2727 - DNA, 4106 bp, Homo sapiens
gtgttttcttccaggctaagtccatcttccggcttgggcagacgctgccgcggaatccttgactctagttttctgagtcgattgtgatcatggctgctgagtctgatgttctgcatttccagtttgaacagcaaggagatgtggtcttgcagaaaatgaatcttttgagacagcagaatttattttgtgatgtatcaatttacattaatgacactgagttccaggggcacaaggtgattttggctgcttgctccacttttatgagagatcagtttttactcacacagtcaaaacatgtcagaatcaccatcttacagagtgcagaagttggcagaaaattgttactgtcttgctatactggagcacttgaagttaaaaggaaagagcttttgaaatacttgactgctgccagttaccttcagatggttcacattgtggaaaagtgcacagaagctttgtcaaagtatctggaaattgatctttctatgaaaaacaacaaccaacacactgacctgtgtcagtcttctgatcctgatgttaagaatgaagatgaaaattctgataaagactgtgagataattgaaatttcagaagatagtcctgtaaacatagatttccatgttaaagaagaggaaagcaatgctttgcagtctacagtagagagtctgacatcagagagaaaggaaatgaagtcaccagagctgtctacagtagacataggttttaaagacaatgaaatttgtatccttcatgtagaatccatcagtacagctggtgtcgaaaatgggcagttttcacagccttgtacctcttcaaaagcaagcatgtatttctctgaaacacagcattcattgatcaattctacagttgagagcagagtggctgaagttcctgggaatcaagatcagggcttattttgtgagaatactgaaggaagttatggtacagtgagtgagattcagaatctggaggaaggttattcactgaggcaccagtgccccaggtgtcctcgaggctttcttcatgttgaaaactatctgcgccaccttaaaatgcataaactattcttatgcttacagtgcggaaaaacatttacacagaagaaaaatctcaaccgacacatccgaggacacatgggcatacggccctttcagtgtactgtgtgcttgaagacatttactgccaaaagcacacttcaggaccacttgaacatacacagtggggatcggccatacaaatgccactgttgtgatatggatttcaagcacaagtctgctctcaaaaagcacttaacctctgtccatggcagaagcagtggtgaaaaactatctaggcctgatctcaaaaggcaaagtctactataattataatcacagacttgttatataaagtttgtattattctattacgcaagtctttctgtagagatgcagcatttgtaatatttcatccccccaatctttgtttcttatattttgtcggcttacacataatcattctttctgaacttctaacagttccaaagttatgggaggcacagtaaagctgatgggattctgtctcatctcataccttacatataagtctcagtagtatccctagagaaatagtgttcctctcttatatattcttgattctagtgacaaaggatccagcagtatttgcagattccgatttggagtctctaggtaattgatttaagtataaaatccaatcatataaaaactttaatgaattaggataacaagaagagaaaataaaggtaaaaacactattacctgtttctagtcactttagaacagatggcactaaaaaaatttttttttaactttttaccagctgttcttggattccaaactaaacaccaagatacttttcattttaaaatgtataaagtaacaattcagattcacttgggaatagcagaatttttttatacagggttaataatccttaaaatacttttatttccatgccttattagtatacatacttaagaaatggttcattgggcccgagtttcttgattttatttaatacaatcggatttaataattttgtggccagtaaaattataccattggcatgaagctgtgaaaaatgagaaattctacctttaccagggatatctgttctactgttttaaaagttcctctctattttattttttatttaacatgaagtaaaattgaaatttcttcttggtgtatagttctgtgaattttaacagaaagatttgtgcaccactactgcagtcggtacagaacagttccttcactcccaatagctctcttatgctgtccctttgtagtcagctccttctagctctaatcctggcaacagttctccgtcactattattttgccttttctggactgtcatataaacagaatcttatagtacgttccctcttgaaatgctttttcacccagcataatgactttgaggttcatccatgtcattttaaattttgaattggcaatatatattctagctgttactagatgagcaatttaaaaaggtgtagctattagtgttgtattttttcatttacattaatgtaatttccattcactatgtgttgataaaaatcttaaccatccctagagttttatatttccaaaaatatgccaaaaggaaaactatgactgtatgattattttagcgagagtcatatttgagatggtgttctgagccatagttctctaacatctccgtctacatataacacaaaacttttataaattattttaacaaagattaaaatatactgcagggcaaataatattctctaaaacacaggaactgcttttcgtaaagaagactgactagatgcatctttctttgaagctgttctagtcctcctctagttaacttagctttatgtagaatttctactgtatttaatttctattgaagcccttctgtattttaaaatgtaatatactttgtaccatttataaaaattgtgtgatgaatgaatcacatgttcgttgttataagtgttaacctttttttgacaattttgtgggaaagacattctccactgaattttaactttccttgagactttcaagaatgcaggtctcgtttgatgaaaaaaccgacttcataacccaatgttactagttagcgacattgtgctgaatttctccttgaactttttaactttatatgtaaaataactttgatcttggtcatttgaaagatcatttccaggtctaaaattccatgattttgtatttaattcttcctgagaacagaagaggggaaagcaagagaggacggttttgtgtctttatgaactttgttacttaagtactccattggagacataatttttctaattagtggatctttttccactggaaagtgtgatagctcattgctaatttttcattcatagttcattgcttccatttgacctaagattggccatttgttggtgtgaaaatattttcttttcagaaatagtttactagtgattgaagtacttttcttatttttgcttcctattataaaatggcgtggggggaagggggaaggatggagatgggaggagagggtaaaagaatagtactctgattttttaagaattagtatctactatcttggatatttgaaaaaaaattggttgaaactatgtttaagttttatgtgtgccttgtaagattgttgtaaaattttttgtgagcactttgagatttttgctgggggaggggtgttttgtgaaagtgatggttattatttatattatttattcctgttcagtagcacggaatgatctccaaacattcctaggagagtgtctgtttgcatgatatgtctaaaaattttcaggaaaatggaatctttttttaaagttcaggtatgacaaagtatagaatttattcatttaacatattcacatttagtttatgtttctgatatgacagaaaaatgaaaagtgtttgagttcagcctcttcatttactccatttacatataaaagatcttgaaaaggtagttgttacttcgttgtcagagaaaaacacttgccctttttcctgggatgtaactatcttacatgtttacataagaaataataaactggaggtgggaatgga

SEQ ID NO: 2728 - DNA, 4440 bp, Homo sapiens
cgccgccgcgcgagggagcgaccagggcagcgcgacgcgggcagagcgagcgccgcggaccccggaggcgagcggccgagggagcccagtcccaacttcgggccccggccccgcgcgccccggcccggccccgcgaggtctcggcgcggaagatggccggcggcgtggacggccccatcgggatcccgttccccgaccacagcagcgacatcctgagtgggctgaacgagcagcggacgcagggcctgctgtgcgacgtggtgatcctggtggagggccgcgagttccccacgcaccgctcggtgctggccgcctgcagccagtacttcaagaagctgttcacgtcgggcgccgtggtggaccagcagaacgtgtacgagatcgacttcgtcagcgccgaggcgctcaccgcgctcatggacttcgcctacacggccacgctcaccgtcagcacagccaacgtgggtgacatcctcagcgccgcccgcctgctggagatccccgccgtgagccacgtgtgcgccgacctcctggaccggcagatcctggcggccgacgcgggcgccgacgccgggcagctggaccttgtagatcaaattgatcagcgcaacctcctccgcgccaaggagtacctcgagttcttccagagcaaccccatgaacagcctgccccccgcggccgccgccgccgctgccagcttcccgtggtccgcctttggggcgtccgatgatgacctggatgccaccaaggaggccgtggccgccgctgtggccgccgtggccgcgggcgactgcaacggcttagacttctatgggccgggccccccggccgagcggcccccgacgggggacggggacgagggcgacagcaacccgggtctgtggccagagcgggatgaggacgcccccaccgggggtctctttccgccgccggtggccccgccggccgccacgcagaacggccactacggccgcggcggagaggaggaggccgcctcgctgtcggaggcggcccccgagccgggcgactctccgggcttcctgtcgggagcggccgagggcgaggacggggacgggcccgacgtggacgggctggcggccagcacgctgctgcagcagatgatgtcatcggtgggccgggcgggggccgcggcgggggacagcgacgaggagtcgcgggccgacgacaagggcgtcatggactactacctgaagtacttcagcggcgcccacgacggcgacgtctacccggcctggtcgcagaaggtggagaagaagatccgagccaaggccttccagaagtgccccatctgcgagaaggtcatccagggcgccggcaagctgccgcgacacatccgcacccacacgggcgagaagccctacgagtgcaacatctgcaaggtccgcttcaccaggcaggacaagctgaaggtgcacatgcggaagcacacgggcgagaagccgtacctgtgccagcagtgcggcgccgcctttgcccacaactacgacctgaagaaccacatgcgcgtgcacacgggcctgcgcccctaccagtgcgacagctgctgcaagaccttcgtccgctccgaccacctgcacagacacctcaagaaagacggctgcaacggcgtcccctcgcgccgcggccgcaagccccgcgtccggggcggggcgcccgaccccagcccgggggccaccgcgacccccggcgcccccgcccagcccagctcccccgacgcccggcgcaacggccaggagaagcactttaaggacgaggacgaggacgaggacgtggccagccccgacggcttgggccggttgaatgtagcgggcgccggtggaggaggtgacagcggaggtggccccggggccgccaccgacggtaacttcacagccggactcgcctaaaaaccaaaaagagaaaacagaaacccgagaaagagagagacagagagagagaaaaaaaatcacccaccacccccccaaaaacacaaaaaaagaaaatctatctatatacagatatctatatctatatatatatatacagatatatatatatgacgcgtcacagaatctagggtagcgctttctcagatttccctcctttctgacgtttttctccctccgcaggggccccggccctccctggctccccttccccccaccaccccatcgctgggtttcggggcttggtttggggttttttgtaggacacaaggaatccgagaccccgcacagccccctgggcacccggcatggggcctggggcccgatccgaggccctgggctggggggagggtagacgtgggggcgctggggggggactggggtgggcttttaatttcctcccctcgctggtttctatgagtctttcagacaagaccttaaatgatttctgtctgctctgagcggacgttaaaatgggcccccgtcccccgacccgcaccctccttcctcagggcacttactaagggaggggtctccctctccatctccccagtggcctccccgcctccaaccctgcctgcggcctccccccgtcgcccaccccacgtctcctggccactgagacacaaacctatttatttctaggcctggagaaaggagatcggactggggttcccggtggggcgccaggatggctcctgggggtgctcctgccgccttccttcacggcacttacaaccggcgggacccccagggaccacccctcagggcgcccccccacccccgcccggtccacctagacccccacgtttggagattcaaaacttctgtcttcgtcctctcccccgagccccctctcccaaatttttaaagcactttttagatttttttttctctttcctccttaaaaacaaaatttatatatagatatatatatatatataaataatatacttttcctcagaggagcaggcaacagtgtgggataaacagagtcacgatcagaggaaccccagggtctggtgatggcagggatggggggagagagagaaaatccacaaattccaatgtcacaaaagcaataaaacaaactagaaaaaaaaaaggttttacaaaatgaaaggaaggaaaaaaaaaaaggcaaccaaccacattagaagtcttggcactttgtaacggaacgggtactacactttatcttaattcttaatttaaaaacatgtttacaagttacaaccaacttctatgaaaagttgaaaagacaaaaaaaaaaaaaaaaagcgagcgagagagagagcgagagagagagcgagagcagaagaaattcctaaaagtcgatttatttttgtacaaaataataaaaaaaaaaacccaccacaaacgtagaatccacttctgttccccaaaaagcgagaaggggggttcaggaggaagccatcgcaggggacctgggagacgccccgaggtgtttgtgcttcacccccagacgtcagcctcgaaggcaggactgtggggtgttcgtgctgtgttccccccgctccccctttctgtccccttttttggttctgacgtgaagaggtcttagcgcccgcttctgtccacggggtctctccttcctcctccctagctcagggatgggccttccagccggagcaccccgatccccatccggcaccccccaatcccccaacacgcctgtccctcccgcatggccaccaaggagctggaccttggatgcgcctaccctgctgaggtgggtgacaggggccccccacctccagggccttagaaccaccgcccctctccccaccccaggcacccctctttttactcaaaggcactgactgtaatccagggggactgggacctgcctccccccaacctctggctcccacaaggcccggtgttgaccgagccacaggccacggacaggggccggggttggggagactatgtcgccagatgccaggacgccctcaccccgtttgcatatgcaatgctagcatgggaccccgaaaatagacgctctgctgcactgagacttcttgtcaatgcccaaccggcgggggggtgtctccctgcccccgacccccccatacccccttctctgtgacacacacatcttctcgtctctttttctttcattgttaaagggaagctttttaagaaggcaattttcatattgtttctacaggatggttttggttcccttcccttcccacccccccttaagcctgtcagccccctccaaatgtctcaggatcccccctctcccctggggctgggtgacagcaccccggctgcgttcacaccccagtgtcacagggcgagctgttctggagagaaaaccatctgtcgtggctgagcggggagcttgaacacccaggccagggacacccctccccagctcccagagaggccccctgaggggtgagccctctttccaccttcccctatccatgcaccccctcgcaataaaaccaactctaaaatc

SEQ ID NO: 2729 - DNA, 2129 bp, Homo sapiens
tcacctgtctgaacctcagtttccttgtctgtgaaacagatgatgatcatacttcagagggttctggaagatgaaatgagtgtaaagtactcagaagggtgactggcatgcagtcatccctcaataagtattggctaaagttggtcctctttccccagacccctgtgggctgagcgctcttaatctcccctctacttgactctgcaggagaagatggggagccccgaggatgacctgattgggattccattcccggaccacagcagtgagctcctgagctgcctcaatgagcagcgccagctgggccacctatgtgacctcaccatccggacgcagggccttgaataccgcacccacagggctgtgctagctgcctgtagccactacttcaagaagcttttcactgagggcggtggcggagctgtcatgggggccgggggtagcgggacggccactgggggagcaggggccggtgtgtgtgagctggactttgtagggccagaggcactaggcgccctccttgaatttgcctatacagccacactgaccaccagcagcgccaacatgccagctgtgctccaggctgcccgcctgctggagatcccgtgtgtcatcgctgcttgcatggagattctgcagggcagtgggctagaagctcccagcccggacgaggatgactgtgagcgagcccgccagtatctggaggcctttgccacagccacggcctctggagttcccaatggtgaagacagtcctccacaggtgcccctcccaccacctccgccaccgccacctcggcctgttgcccgccgcagccgcaagccccggaaagctttcctgcaaaccaagggggccagagcaaaccacctagtccctgaggtgcccacagtgcccgcccatcccttgacctatgaggaggaggaggtggcgggcagagtgggcagcagtgggggcagtgggccgggggacagctacagccctcccacaggaactgcctcccctcctgagggtccccagagctacgaaccctatgagggtgaggaagaagaagaggagctggtatatcccccagcctatgggctggcgcagggtggcgggcccccgctgtccccagaggagctgggctcagatgaggatgccatcgatcctgacctgatggcctacctaagctccctgcaccaggacaacctggcaccaggcctggacagccaagacaagctggtgcgcaaacgccgctcccagatgcctcaggagtgccctgtctgccacaagatcatccatggggcaggcaaactgcctcgccacatgaggacccacacaggcgagaagccctttgcctgcgaggtctgcggtgttcgattcaccaggaacgacaagctgaagatccacatgcggaagcacacgggagagcgcccctactcatgcccgcactgcccagcccgcttcctgcacagctacgacctcaagaaccacatgcacctgcacacaggggaccggccctatgagtgccacctgtgccacaaggctttcgccaaggaggaccacctgcagcgccacctcaaaggccagaactgcctggaggtgcgcacccgacggcgccgcaaggacgatgcaccaccccactacccaccaccctctaccgctgctgcatcccccgctggcctcgacctctccaatggccacctggacaccttccgcctctctctagctcgattctgggagcagtcagcccccactgggcccccggtctctaccccagggccccctgatgacgatgaggaggaaggggcacccaccacaccccaggctgaaggtgccatggagtcctcttaaagagggacgagggccagactgaagcagcacaaggccggggacacccatgccaagcagtgggagcacgcaggacagacacagcaggggtctggggcacggagccttgctggcatcagcatcagcccttcctcccagagccctcattccaattccaagctaagaaggtattggggcagaggctccccaaattggggtgatcccccaaggagtgatacatatattgtgtatatatttacagctgtattgtaaaagtggggtccctgtccccagctgctcctggggagtagaagcaataa

SEQ ID NO: 2730 - DNA, 3594 bp, Homo sapiens
agctggaggacaggtgagacagcaggacaggaccggagcagggccccaagcccccgggcctggtgggggacgcgcttcttcccacactgtgagcctcagcagctccagccagcggacccgacggctgagaggagaagatggggagccccgaggatgacctgattgggattccattcccggaccacagcagtgagctcctgagctgcctcaatgagcagcgccagctgggccacctatgtgacctcaccatccggacgcagggccttgaataccgcacccacagggctgtgctagctgcctgtagccactacttcaagaagcttttcactgagggcggtggcggagctgtcatgggggccgggggtagcgggacggccactgggggagcaggggccggtgtgtgtgagctggactttgtagggccagaggcactaggcgccctccttgaatttgcctatacagccacactgaccaccagcagcgccaacatgccagctgtgctccaggctgcccgcctgctggagatcccgtgtgtcatcgctgcttgcatggagattctgcagggcagtgggctagaagctcccagcccggacgaggatgactgtgagcgagcccgccagtatctggaggcctttgccacagccacggcctctggagttcccaatggtgaagacagtcctccacaggtgcccctcccaccacctccgccaccgccacctcggcctgttgcccgccgcagccgcaagccccggaaagctttcctgcaaaccaagggggccagagcaaaccacctagtccctgaggtgcccacagtgcccgcccatcccttgacctatgaggaggaggaggtggcgggcagagtgggcagcagtgggggcagtgggccgggggacagctacagccctcccacaggaactgcctcccctcctgagggtccccagagctacgaaccctatgagggtgaggaagaagaagaggagctggtatatcccccagcctatgggctggcgcagggtggcgggcccccgctgtccccagaggagctgggctcagatgaggatgccatcgatcctgacctgatggcctacctaagctccctgcaccaggacaacctggcaccaggcctggacagccaagacaagctggtgcgcaaacgccgctcccagatgcctcaggagtgccctgtctgccacaagatcatccatggggcaggcaaactgcctcgccacatgaggacccacacaggcgagaagccctttgcctgcgaggtctgcggtgttcgattcaccaggaacgacaagctgaagatccacatgcggaagcacacgggagagcgcccctactcatgcccgcactgcccagcccgcttcctgcacagctacgacctcaagaaccacatgcacctgcacacaggggaccggccctatgagtgccacctgtgccacaaggctttcgccaaggaggaccacctgcagcgccacctcaaaggccagaactgcctggaggtgcgcacccgacggcgccgcaaggacgatgcaccaccccactacccaccaccctctaccgctgctgcatcccccgctggcctcgacctctccaatggccacctggacaccttccgcctctctctagctcgattctgggagcagtcagcccccactgggcccccggtctctaccccagggccccctgatgacgatgaggaggaaggggcacccaccacaccccaggctgaaggtgccatggagtcctcttaaagagggacgagggccagactgaagcagcacaaggccggggacacccatgccaagcagtgggagcacgcaggacagacacagcaggggtctggggcacggagccttgctggcatcagcatcagcccttcctcccagagccctcattccaattccaagctaagaaggtattggggcagaggctccccaaattggggtgatcccccaaggagtgatacatatattgtgtatatatttacagctgtattgtaaaagtggggtccctgtccccagctgctcctggggagtagaagcaataatgtatttctaatttgtgggtcccacttcggctatgcgggtttctagggggtgggggcttgggaccaaagccttgccccgcccctatgccccttgggggttttggctgtgtaagggggtgaaggactgcccctccctttcgagacccctccttcctggtttctgttcctttttcctggcagtgaattatgcaaagggggccggcaaaggaagggtaggtgggggaaagccaggtggaagcttgaaagactgggggactgggcctgtaaggaaggagccatcccagtccccctccgccctgctcccggcgctgagtcatggggtcgtggagaagggggcggggtggcctgattggctcgcctgcccctgggggcagtagaggggccccgcccagctaggggagccgctccgttccactcccctccctagccctccctccccacggccctgggcagggaatgtcttgttcccgccgctccctccccggggccagagggcagggcgggccgggcggcgtcctaccctcttctcctcctccccatctcctccccgcccaggtgcgagccggagccgccgccaccgctgccgcccctgactcacgccgcccccgggctggcgcagcgaagggtgtgggacagggtaaggggttggaagagccttgtggagagcgggcgagccggcgccatctggcggccatgctctgagtgggcgagcgccccccgcggccactggagcgagctgtcttcacgctcctcatccaccccagctggtgagcggcgcccccttgccaaggcagtgggcacagaacttctcgcttggccgcaggggaaggggctgcggacctgtgggaaagtgatccccttcccagatccttgccagccgggcttcctgtcaggcaggggagaataatccccactctgctcttaggattgaatccacccccattctgtacatagcctcttctgttggtcttgttgaaatctagtttcagatttttaactacccaattctgctgggggtgggggacacccccccttcctcgctgggtgctggaccccttttgcagcctgggctctgccttgcactatttccccttcctggcctgacggctcctccccctccttaaaaggggcaggttcaggggcccggtgctcttcctcccttccatgcacccccatgcccatttgcacagctgcccaggtacccctaacagtggggaggggtcacagggagggggtagcgggaccagtccctgttatctatttaaaaagtgatgatgtaatatattggggtggcggggagatcgggttgtcctgggcctcatcttagcatttcaggtgatggggggagcccagggctggggagacctggggcccagccccagaaagtggggacaatgtggcctcccttctccctactttcggctttcccagtcagtgccttagggggagaggcactccccccctcctattcccttccccccaccccaactcccccacctcgggtgtaagcgacaggaagaaataataataatttaagattc

SEQ ID NO: 2731 - DNA, 2237 bp, Homo sapiens
aactgaccgcggccttctgaccaggaccggagcagggccccaagcccccgggcctggtgggggacgcgcttcttcccacactgtgagcctcagcagctccagccagcggacccgacggctgagaggagccccagaaccaggactgggggatttggagctgggcagagacttaacccccacagcaccgggaagcagccaactcccctcgcctccttcccccttcgtggcttgcggtctctcttccccgcctcggcccccaggaagtgaagatgttacagcctggtcctcatcctccctcaccccaagctgctgctcctggagaagcctggccaggcccctctcaggctccctggcagagcctagaggagaagatggggagccccgaggatgacctgattgggattccattcccggaccacagcagtgagctcctgagctgcctcaatgagcagcgccagctgggccacctatgtgacctcaccatccggacgcagggccttgaataccgcacccacagggctgtgctagctgcctgtagccactacttcaagaagcttttcactgagggcggtggcggagctgtcatgggggccgggggtagcgggacggccactgggggagcaggggccggtgtgtgtgagctggactttgtagggccagaggcactaggcgccctccttgaatttgcctatacagccacactgaccaccagcagcgccaacatgccagctgtgctccaggctgcccgcctgctggagatcccgtgtgtcatcgctgcttgcatggagattctgcagggcagtgggctagaagctcccagcccggacgaggatgactgtgagcgagcccgccagtatctggaggcctttgccacagccacggcctctggagttcccaatggtgaagacagtcctccacaggtgcccctcccaccacctccgccaccgccacctcggcctgttgcccgccgcagccgcaagccccggaaagctttcctgcaaaccaagggggccagagcaaaccacctagtccctgaggtgcccacagtgcccgcccatcccttgacctatgaggaggaggaggtggcgggcagagtgggcagcagtgggggcagtgggccgggggacagctacagccctcccacaggaactgcctcccctcctgagggtccccagagctacgaaccctatgagggtgaggaagaagaagaggagctggtatatcccccagcctatgggctggcgcagggtggcgggcccccgctgtccccagaggagctgggctcagatgaggatgccatcgatcctgacctgatggcctacctaagctccctgcaccaggacaacctggcaccaggcctggacagccaagacaagctggtgcgcaaacgccgctcccagatgcctcaggagtgccctgtctgccacaagatcatccatggggcaggcaaactgcctcgccacatgaggacccacacaggcgagaagccctttgcctgcgaggtctgcggtgttcgattcaccaggaacgacaagctgaagatccacatgcggaagcacacgggagagcgcccctactcatgcccgcactgcccagcccgcttcctgcacagctacgacctcaagaaccacatgcacctgcacacaggggaccggccctatgagtgccacctgtgccacaaggctttcgccaaggaggaccacctgcagcgccacctcaaaggccagaactgcctggaggtgcgcacccgacggcgccgcaaggacgatgcaccaccccactacccaccaccctctaccgctgctgcatcccccgctggcctcgacctctccaatggccacctggacaccttccgcctctctctagctcgattctgggagcagtcagcccccactgggcccccggtctctaccccagggccccctgatgacgatgaggaggaaggggcacccaccacaccccaggctgaaggtgccatggagtcctcttaaagagggacgagggccagactgaagcagcacaaggccggggacacccatgccaagcagtgggagcacgcaggacagacacagcaggggtctggggcacggagccttgctggcatcagcatcagcccttcctcccagagccctcattccaattccaagctaagaaggtattggggcagaggctccccaaattggggtgatcccccaaggagtgatacatatattgtgtatatatttacagctgtattg

SEQ ID NO: 2732 - DNA, 1925 bp, Homo sapiens
aaagcaagctggaggacaggtgagacagcaggacaggaccggagcagggccccaagcccccgggcctggtgggggacgcgcttcttcccacactgtgagcctcagcagctccagccagcggacccgacggctgagagtgtcctaaccgctttggagagcgataacttgagttaaagcacctgtctgtgcctggcctccagcagatcttggtccagtgagaagatggggagccccgaggatgacctgattgggattccattcccggaccacagcagtgagctcctgagctgcctcaatgagcagcgccagctgggccacctatgtgacctcaccatccggacgcagggccttgaataccgcacccacagggctgtgctagctgcctgtagccactacttcaagaagcttttcactgagggcggtggcggagctgtcatgggggccgggggtagcgggacggccactgggggagcaggggccggtgtgtgtgagctggactttgtagggccagaggcactaggcgccctccttgaatttgcctatacagccacactgaccaccagcagcgccaacatgccagctgtgctccaggctgcccgcctgctggagatcccgtgtgtcatcgctgcttgcatggagattctgcagggcagtgggctagaagctcccagcccggacgaggatgactgtgagcgagcccgccagtatctggaggcctttgccacagccacggcctctggagttcccaatggtgaagacagtcctccacaggtgcccctcccaccacctccgccaccgccacctcggcctgttgcccgccgcagccgcaagccccggaaagctttcctgcaaaccaagggggccagagcaaaccacctagtccctgaggtgcccacagtgcccgcccatcccttgacctatgaggaggaggaggtggcgggcagagtgggcagcagtgggggcagtgggccgggggacagctacagccctcccacaggaactgcctcccctcctgagggtccccagagctacgaaccctatgagggtgaggaagaagaagaggagctggtatatcccccagcctatgggctggcgcagggtggcgggcccccgctgtccccagaggagctgggctcagatgaggatgccatcgatcctgacctgatggcctacctaagctccctgcaccaggacaacctggcaccaggcctggacagccaagacaagctggtgcgcaaacgccgctcccagatgcctcaggagtgccctgtctgccacaagatcatccatggggcaggcaaactgcctcgccacatgaggacccacacaggcgagaagccctttgcctgcgaggtctgcggtgttcgattcaccaggaacgacaagctgaagatccacatgcggaagcacacgggagagcgcccctactcatgcccgcactgcccagcccgcttcctgcacagctacgacctcaagaaccacatgcacctgcacacaggggaccggccctatgagtgccacctgtgccacaaggctttcgccaaggaggaccacctgcagcgccacctcaaaggccagaactgcctggaggtgcgcacccgacggcgccgcaaggacgatgcaccaccccactacccaccaccctctaccgctgctgcatcccccgctggcctcgacctctccaatggccacctggacaccttccgcctctctctagctcgattctgggagcagtcagcccccactgggcccccggtctctaccccagggccccctgatgacgatgaggaggaaggggcacccaccacaccccaggctgaaggtgccatggagtcctcttaaagagggacgagggccagactgaagcagcacaaggccggggacacccatgccaagcagtgggagcacgcaggacagacacagca

SEQ ID NO: 2733 - DNA, 1943 bp, Homo sapiens
caaataccttttgtttctctcacgttggggctacttgttttagggcgcaaaggaacggcctcgaaagggggtccttccccagccgagaaccaggaatcttccctcggcccgcgcgcgcgaccggccggtgcgccgcggcccgcggacaatcctccaaacacagactgtttgacttagaatcttcccttttttactccattcaagagcagcattcataaatttccagaatggagatctcctctcatcagtctcacctcctgcagcaactgaacgagcagcgcaggcaagatgtattttgtgactgcagtattctagttgaagggaaggtcttcaaagcacatcgaaatgtattattcgctagtagcggctactttaaaatgcttctttctcagaattcaaaggagacgagtcagccaaccacagctacatttcaggctttctcccctgacacttttacagttatcttggacttcgtatattctggcaaactgtctcttactggtcagaatgtcatagaagtgatgtcggctgctagcttccttcagatgactgatgtcataagtgtatgtaagacttttattaaatcttccttagacattagtgagaaagaaaaagatcgctatttcagtctctcagataaagatgccaattctaatggtgtagaacgttcctctttttatagtggtggctggcaagaaggaagcagttctccacgttctcacctaagcccagagcaaggaacaggtataataagtggaaaatcttggaataagtataattatcatccagcctcccagaagaatactcaacaacccttggccaagcatgaaccaaggaaagagtccattaaaaagaccaaacatttgagattgtcacagccttctgaagttactcattataagtcaagcaaacgagaagtacgaacatctgattcttccagccatgtttcccagtctgaagaacaagcacagattgatgctgaaatggactctactcctgttggctatcagtacggtcaaggatctgatgtcacatccaaaagctttccagatgatctgcctcggatgcgattcaagtgcccgtactgcacacatgtggtgaagcggaaggcagacctaaagcgccaccttcgttgtcatacaggagaaaggccctatccatgtcaagcttgtggaaaaagatttagcaggctagaccatctaagtagccattttcgaacaatggagataaggattccagatggcacttgagtgaagatgagaatagatcctatgtggagattgtagaagatgggtctggtgatctggtcatccaacaggttgatgatagtgaagaagaagaagaaaaagaaattaagcccaacattaggtagctgtaatgtgaaccaacagagctggcatgtctgcaatttacattgacttcctgtatctctctctttctatggtcggagtctagttaacaaatttatcacactgactttaaagaaatgatctgatataacttgcatgctttctgaacaggccattgtatccattctgaactttgttgccctaaaatgtgttgctgcactggaaagaaagaactagcttgagttggcttgatggatgaacaattatcctcttactttcattacaatcctcttactttattccagagatacctttttcttttaatattggaggatctacttagcaaacttttttcaaagaaaatactttaaataaattcaccacaaccaaactttatgtaagacaatttcaaggtgtttcaaaaacacataactaccaatgtttaatttcacagggaaccagttaagagcacatttaaggatctggcaacccaccttactaaacaaattagtctttctattaatttgagatctgaaacaacctgtcattactctgatatcctgaacgtttaaggattatggaagaagactaaag

SEQ ID NO: 2734 - DNA, 1920 bp, Homo sapiens
agcaaataccttttgtttctctcacgttggggctacttgttttagggcgcaaaggaacggcctcgaaagggggtccttccccagccgagaaccaggaatcttccctcggcccgcgcgcgcgaccggccggtgcgccgcggcccgcggacaatcctccaaacacagactgtttgacttagaatcttcccttttttactccattcaagagcagcattcataaatttccagaatggagatctcctctcatcagtctcacctcctgcagcaactgaacgagcagcgcaggcaagatgtattttgtgactgcagtattctagttgaagggaaggtcttcaaagcacatcgaaatgtattattcgctagtagcggctactttaaaatgcttctttctcagaattcaaaggagacgagtcagccaaccacagctacatttcaggctttctcccctgacacttttacagttatcttggacttcgtatattctggcaaactgtctcttactggtcagaatgtcatagaagtgatgtcggctgctagcttccttcagatgactgatgtcataagtgtatgtaagacttttattaaatcttccttagacattagtgagaaagaaaaagatcgctatttcagtctctcagataaagatgccaattctaatggtgtagaacgttcctctttttatagtggtggctggcaagaaggaagcagttctccacgttctcacctaagcccagagcaaggaacaggtataataagtggaaaatcttggaataagtataattatcatccagcctcccagaagaatactcaacaacccttggccaagcatgaaccaaggaaagagtccattaaaaagaccaaacatttgagattgtcacagccttctgaagttactcattataagtcaagcaaacgagaagtacgaacatctgattcttccagccatgtttcccagtctgaagaacaagcacagattgatgctgaaatggactctactcctgttggctatcagtacggtcaaggatctgatgtcacatccaaaagctttccagatgatctgcctcggatgcgattcaagtgcccgtactgcacacatgtggtgaagcggaaggcagacctaaagcgccaccttcgttgtcatacaggagaaaggccctatccatgtcaagcttgtggaaaaagatttagcaggctagaccatctaagtagccattttcgaacaattcaccaggcatgtaaactcatctgcagaaaatgtaaacgtcatgtgacagatctaacagggcaagtggtacaggagggaaccaggcgctacagactgtgtaatgagtgtcttgcagaatttggcatagacagcctccccattgacttggaagctgaacaacatcttatgtccccatcagatggagataaggattccagatggcacttgagtgaagatgagaatagatcctatgtggagattgtagaagatgggtctggtgatctggtcatccaacaggttgatgatagtgaagaagaagaagaaaaagaaattaagcccaacattaggtagctgtaatgtgaaccaacagagctggcatgtctgcaatttacattgacttcctgtatctctctctttctatggtcggagtctagttaacaaatttatcacactgactttaaagaaatgatctgatataacttgcatgctttctgaacaggccattgtatccattctgaactttgttgccctaaaatgtgttgctgcactggaaagaaagaactagcttgagttggcttgatggatgaacaattatcctcttactttcattacaatcctcttactttattccagagatacctttttcttttaatattggaggatctacttagcaaacttttttcaaagaaaatactttaaataaattcaccacaacc

SEQ ID NO: 2735 - DNA, 4008 bp, Homo sapiens
ggtgctccgtggctgcgctgctggaacccgctggaagagatacaggtttgctctggagcagcagcagctggcggagcaatggagatgcaatcctattatgccaagcttttgggggagctgaatgaacagagaaagagggactttttctgtgactgcagcatcattgtggaagggcggatcttcaaggcccacaggaacattttgtttgctaacagcggctacttccgagccctgctcattcactatatccaggacagcgggcggcatagcaccgcctccttggacattgtcacctctgatgccttctccatcatcttagatttcctctattctgggaagttggatttgtgtggggagaatgtgattgaagtgatgtcggctgccagctacctgcagatgaatgacgtggtgaacttctgcaagacatacattaggtcatccctcgacatttgccgaaagatggagaaggaggctgctgtggctgcagcagtggcggcggcagcggcggcggctgcagcggcggcagcagcggcggctcatcaggttgacagtgaaagccccagttcaggccgggaggggacctcctgtggtaccaagagcttggtctcctctccagccgagggagaaaagagcgtggagtgcctgagagagtccccttgcggtgactgcggagactgccaccccttggaactggtggtgagagacagccttggcggtggctcggctgacagcaacctctctactccacccaaacggatagagcccaaggtggaatttgatgctgatgaagtggaggtggacgttggtgaacagctgcagcagtatgctgccccgctgaacctggcccacgtggaggaggccttgccaagcggccaggcggttgacttggcttacagcaactaccacgtgaagcagttcctggaggcgctcttgcgcaacagcgctgccccgagcaaggatgatgcagaccatcacttttctaggagtttggaaggaagaccagaaggtgcaggagtagccatgagttccatgatggatgtccaggctgactggtatggagaggactcaggtgatgtgctggtggtccccatcaagctccacaagtgtcctttctgcccttacactgccaaacagaagggcatcctcaagcggcacatccgttcacacacaggcgagcggccctacccctgtgagacctgcggcaagaggttcactcgacaagagcacctgcggagccacgcactgagtgtccacagatccaaccgtccaatcatctgcaagggctgcaggagaacattcacgagtcacctgtcccaggggctgcggcgcttcgggctgtgtgacagctgcacctgcgttacagacacacccgatgatgatgatgatttgatgcccatcaaccttagcttggtggaggcttcatctgaaagccaagaaaagagcgacacagacaatgactggccaatctatgtggagtcgggtgaggaaaatgaccctgctggagatgattctgatgacaaaccacaaattcagcctaacttatcagaccgagagacacttacgtagcaataaattggtggggaagaggaggttttaaaacttgttagtgctcgttctgttgttgaaagataccatttgtccaattttgtggaaccctgagaggaacattttttcactgttattatatgtgcatttttattagactatctgatagaggttggattttgtgactcaaaggacagataacctttttgtgtggtgcccttggtttctgagggctttgctggccactccttaattctgagtgagtcaaagcaggccctgaggtctcctgtttttcttgctgtgtgtccaaactctggttaggagaaagataagaaaatctccaggcttgtttttatattgattcagtcctctgcattcctttgttatcatcctctttctctaaaaaccattaagttttgggatcaagtttacctttgccaagcctttcctaatgaattccacattaaattttctggcaaagtattaaagagaaaccttcattgatataaagcaggcagggcggtctggctacatgatcataaaaggtactccctaaatctagaacaattttaaaggcttggaatacttatgggcagacgaacatgggaatgatctgaaaggctcattatggcatcctgacttgcccagttgaattaaattttaagttagccctgagaagggaggctatgaccccaggtctggatggtttccctgtctggtttggcatttgacgattctacacatacaacctgttctgttatcataaaacaactcatttgggcaaaactcaaaatgctcccctactttttccagcaatttccaaaagctggagctgtgtaacttggaaatgtagctgcctctggcattcttttacttagtttatgctgatgtagggcaggtgagcccaaaaattggggcttagcccagaggagttcttggcttcacccaggaaagaattcaagggcaagccagtggtgttagacagcagcttgtattgaagcagcagtgcccaacagcagctaaggggccgctcctcgtggagcagggctacaccataggcagtgtgcccagagtagtagctcagaggcaggtcggcacttatatttatacccacttttagttacatgcaaattaaggggcagattatgcagcaatatttaggaaaatggtggtaacttccaagccgctgggtggttgccatgataaggggcagtgacttccaggtgttgccatggcaatggtaattgacatggcacagtgataagtgtttcttatggaaatctgcttcctgcaccaccctcccaccaccgccctgttttagctagtcctcaatttggtccatgtccgagtccggcctttggagttgagtcctgccttctacctccttgcctagaactttaattggagggaaagtataagcccataatgccaagtaacatttctaaaatgttcatcttttaaaagatcttcatgagggaaagggaaggttagtagcagaacaggtttttaaaagcagtctacctttcgcccactttccagccacacaattattgtaacaaaagaggctgaactctttaaagggctaaagggcaggcagtgttaggaattcggaatgtaattgaaggcaatttccataattttgtcttatgttaaaatatccaaaatggattttaaaagaaatcttcttgtcttcctttaagtgtagttgtctttcaaaaggtggtaaaagtcacttttatttctacctcttgaacaacaaaaaagtcaaaaacattataaattggcttgtaaatgttagccaaagcattagacaggtgtttaagtcgtacttctcaatagtagttaaaactggaacagtgcaactcaaactctggcccacagagaggccctgttctgtaaactgttttctaccagtctgctacaaggaaagtcagaaattaagaatacacatatagaaatgttgataacactttgacattgctgtgactcatggctttgtcttcttgagtgaggtatggaccagttcagttctggtcagctagagggccacatggtgcagaggttggataccagcctgtacagcaggaccacgtattggtctgcagtagaatggaaaatttaaaacttctcttatcacaggtagttcgataaatatcattcttggctgtgtgcggtggctcacgcctataatcccagcactttgggaggccaaggcagatggaacacttgaggtcaggagttcgataccagcctgaccaacatggcgaaaccccgtctctagcaaaaatacaaaaattagtcaggagtggtggcatgtgcctgtaatcccagctactcaggaggctgtggcgagaggaacacttgagcctggaaaaggttgcagtgagctggaatcgtgccactccactccagcctgggcaacagtgtgagaccttgtctcaaaaaaataataataaaataaat

SEQ ID NO: 2736 - DNA, 2716 bp, Homo sapiens
ttccggtctgggacggagctgtagcggcactgtaactgcgagggcagcgccgcgtgtgtaacggcgggggcgtgtcggcgggaaggacaatcgggccgggactcgcggtgtccgggtgaccgcggcttcccgggagcagacctctgtgggcactgtgaggcggaacggagcggcggggcaggagctgttctgggcagccttcatcccgcgtggagtctacccccaagcccttctcctcttcccaattcttgtcaccttcgaggaggccatggaaaccccaacacctttgccgcctgtacccgcctccccgacctgcaacccagccccacggacaatccagatcgagttcccacagcatagctcgtctctgctggaatctctgaaccgccacaggctagagggaaagttctgtgatgtgtccctcctggtgcagggccgggaacttagggctcataaagcagtgttagctgctgcctctccttacttccatgacaagctgcttctgggggatgcgcctcgtctcactctaccgagtgtcattgaagccgatgccttcgaggggctgctccagctcatttattcagggcgtctccgcctgccactggatgctcttcctgctcatctccttgtggccagtggccttcaaatgtggcaggtagtagatcagtgctcagaaattcttagagaattagaaacttcaggtggtggaatttcagcccgtggaggaaactcctaccatgcccttctttccactacatcctctacaggaggctggtgcattcgctcttcgcctttccagaccccagtacagtcctctgcttctactgaaagccctgcttccactgagagccctgtgggaggggagggaagtgaactgggagaagtgctgcaaattcaggtggaagaagaagaggaggaggaggaagatgatgatgatgaggaccaggggtcagccacactctctcagactcctcagccccagagagtatcaggggtttttccccgtcctcatggaccccacccactgcccatgactgctactccccgaaagcttccagagggtgagagtgcaccacttgagcttcctgcccctcctgcactgccccccaaaatcttctacattaagcaggaacccttcgagcctaaggaggagatatcaggaagcggaactcagcctggaggagcaaaggaggaaaccaaagtgttttctggaggggacactgaagggaatggggagctagggttcttgttgccttcagggccagggccaacatctgggggagggggtccatcctggaaaccagtggatcttcatgggaatgaaatcctgtcagggggtggaggacctgggggagcaggccaggccgtgcatgggcctgtgaagctaggggggacaccccctgcagatggaaaacgctttggttgcctgtgtgggaagcggtttgcagtgaagccaaagcgtgaccggcacatcatgctgaccttcagccttcggccttttggctgtggcatctgcaacaagcgcttcaagctgaagcaccatctgacagagcacatgaagacccatgctggagccctgcatgcctgtccccactgtggccgtcggttccgagtccatgcctgttttctccgccaccgggacctatgcaagggccagggctgggccactgcccactggacttacaagtgactgctgaggctatacactagcttctagaacaagataaccactgctgctgatggatacttttccctcactgccatggcacaccagtcatggatcttgtaatcatgccaagagaatagatacattatggacctcttgttcttagatatgggcctctcagcctggcagatgtggaaactcaaatttctcgtcccactccaggttttggctagccaaccctgcaggaaagtggtttataggccattcatacttaagttgatcacttgcccatggtggacatttttgtggtggtgatgtccattaaggaaaccagattttcaattatttagtgagagaagagttagagcaaaagacagtggtaaatgttttattccgtctccatgaggaattgaaggagttggtctccacctagagatacatttgatttacagcttaagtaattcagaggctaagctctaagcttttttctctcattgctggaatgatttaagcagaagtccttttgtgtacttttaaaattgtatctttccaggagcccctcagattgtaccttgctttctcaccaatagacaccttcccgacacttttttaatgttgtagctgagcactttaacaagttgagcattccatgtttcattcttagaaccttctttaatagagggtcttccctcaacagcctgtgcctctggtctacctttgaccaccactgataactaatatattggtcacaatgactggaatgtgactagtgatctcaggagatggcactgtcctaaagtgctgtcagggtggcaccactgctctctgaacaacttaccttggtcagagggactcaggtttgggacagcacaagctgaaggctggagagtaacttgcatagtaggaccatacctcttcctttcccatcccacccacatatgatagacagcccctctgttgagatatggaggggacagatactggaatcgggggtgggacttgcagttacttaaaattttttaataaactgtgccctgaaacctaaactga

SEQ ID NO: 2737 - DNA, 2716 bp, Homo sapiens
ttccggtctgggacggagctgtagcggcactgtaactgcgagggcagcgccgcgtgtgtaacggcgggggcgtgtcggcgggaaggacaatcgggccgggactcgcggtgtccgggtgaccgcggcttcccgggagcagacctctgtgggcactgtgaggcggaacggagcggcggggcaggagctgttctgggcagccttcatcccgcgtggagtctacccccaagcccttctcctcttcccaattcttgtcaccttcgaggaggccatggaaaccccaacacctttgccgcctgtacccgcctccccgacctgcaacccagccccacggacaatccagatcgagttcccacagcatagctcgtcgctgctggaatctctgaaccgccacaggctagagggaaagttctgtgatgtgtccctcctggtgcagggccgggaacttagggctcataaagcagtgttagctgctgcctctccttacttccatgacaagctgcttctgggggatgcgcctcgtctcactctaccgagtgtcattgaagccgatgccttcgaggggctgctccagctcatttattcagggcgtctccgcctgccactggatgctcttcctgctcatctccttgtggccagtggccttcaaatgtggcaggtagtagatcagtgctcagaaattcttagagaattagaaacttcaggtggtggaatttcagcccgtggaggaaactcctaccatgcccttctttccactacatcctctacaggaggctggtgcattcgctcttcgcctttccagaccccagtacagtcctctgcttctactgaaagccctgcttccactgagagccctgtgggaggggagggaagtgaactgggagaagtgctgcaaattcaggtggaagaagaagaggaggaggaggaagatgatgatgatgaggaccaggggtcagccacactctctcagactcctcagccccagagagtatcaggggtttttccccgtcctcatggaccccacccactgcccatgactgctactccccgaaagcttccagagggtgagagtgcaccacttgagcttcctgcccctcctgcactgccccccaaaatcttctacattaagcaggaacccttcgagcctaaggaggagatatcaggaagcggaactcagcctggaggagcaaaggaggaaaccaaagtgttttctggaggggacactgaagggaatggggagctagggttcttgttgccttcagggccagggccaacatctgggggagggggtccatcctggaaaccagtggatcttcatgggaatgaaatcctgtcagggggtggaggacctgggggagcaggccaggccgtgcatgggcctgtgaagctaggggggacaccccctgcagatggaaaacgctttggttgcctgtgtgggaagcggtttgcagtgaagccaaagcgtgaccggcacatcatgctgaccttcagccttcggccttttggctgtggcatctgcaacaagcgcttcaagctgaagcaccatctgacagagcacatgaagacccatgctggagccctgcatgcctgtccccactgtggccgtcggttccgagtccatgcctgttttctccgccaccgggacctatgcaagggccagggctgggccactgcccactggacttacaagtgactgctgaggctatacactagcttctagaacaagataaccactgctgctgatggatacttttccctcactgccatggcacaccagtcatggatcttgtaatcatgccaagagaatagatacattatggacctcttgttcttagatatgggcctctcagcctggcagatgtggaaactcaaatttctcgtcccactccaggttttggctagccaaccctgcaggaaagtggtttataggccattcatacttaagttgatcacttgcccatggtggacatttttgtggtggtgatgtccattaaggaaaccagattttcaattatttagtgagagaagagttagagcaaaagacagtggtaaatgttttattccgtctccatgaggaattgaaggagttggtctccacctagagatacatttgatttacagcttaagtaattcagaggctaagctctaagcttttttctctcattgctggaatgatttaagcagaagtccttttgtgtacttttaaaattgtatctttccaggagcccctcagattgtaccttgctttctcaccaatagacaccttcccgacacttttttaatgttgtagctgagcactttaacaagttgagcattccatgtttcattcttagaaccttctttaatagagggtcttccctcaacagcctgtgcctctggtctacctttgaccaccactgataactaatatattggtcacaatgactggaatgtgactagtgatctcaggagatggcactgtcctaaagtgctgtcagggtggcaccactgctctctgaacaacttaccttggtcagagggactcaggtttgggacagcacaagctgaaggctggagagtaacttgcatagtaggaccatacctcttcctttcccatcccacccacatatgatagacagcccctctgttgagatatggaggggacagatactggaatcgggggtgggacttgcagttacttaaaattttttaataaactgtgccctgaaacctaaactga

SEQ ID NO: 2738 - DNA, 2054 bp, Homo sapiens
gtgcggggatggggtccgcccgcggcgttgggcgcgctcgccagcccaggggtcgccatgaccgagtggcccaggcccgagcgaagcccgcgcgcggtcacatgggagcccgacaccatttggaggagattcagagaagcccctgattgctgattctgtccgcctgccacaccggctctgtccggagccactgggactcgggatccagtccacacacacccctcagaggggcactgtggccagagaaatgcttccacggcccaaagcccctgcctcccccagacgcccccagaccccaaccccgagtgagcaggacgcagaccctgggccagcaagccccagggacaccgaagcccagcgtctgcgcttccggcagttccagtaccacgtggcgagcgggccgcacctcgcgctgggccagctctggacgctgtgccgccagtggctgaggcccgaggcgcgctccaaggagcagatgctggagctgctggtgctggagcagttcctgggcgcgctgcccagcaagatgcggacctgggtgcagtcacagggcccccgaagctgcagggaggccgccagcctggtggaggacctcacacagatgtgccagcaggaagttctggtatctctggactcggtcgaaccccaggactggagtttcggtgaggaggaagatgggaagagtccaaggtcccagaaagaaccatcgcaggcgtctgagctgattctggatgcagtggcagcagccccagcactccccgaggaaagtgagtggctggagactacccagctccagcagagtctgcacaccagggcggaggccgaagcgccccgcgcccctggcttgctggggtcccgggcccgcttgcctctgaagccgagtatctgggacgagcctgaggaccttctcgcagggccctcctcagacctgcgggcagaagggactgtgatctcgagccccaagggtccaagtgctcagagaatcagtccccgaaggagaaacaggaacactgaccagagcggccgccaccagccatccctcaagcacaccaaaggtggtacccaagaggctgttgcaggcatctcggtagtgccgcgtgggccccgaggtgggcggcccttccagtgtgccgactgtgggatggtcttcacctgggtcacccacttcatcgagcaccagaagacccatcgcgaggaagggccctttccgtgccccgagtgtggcaaggtcttcctgcacaactccgtcctcactgagcatggcaagatccacctgctggagccaccgaggaagaaagccccccggagcaagggcccccgggagtccgtcccacccagggatggagcccagggcccagtggcccctcgcagccccaaaagacccttccagtgtagcgtctgcgggaaggccttcccctggatggtccacctcattgaccaccagaagctccacacggcccacggccacatgtgaatggccagcctcgggcctcggccacccggccctgagtccctggggggagctgatgggccccagaagatgggggacatcccccagccccaccaacccctggccaccttgggactcctcttgaaggacacaagctgtttctcggaagaccctggacacctgctccgaagccaagcacgggatggggcttcccagggtctcagctgagaagcagcagttccacagcacagcctggtcagtcctgcgcactatagttttgcaagtggcttgaagaggagtttcattcgcgtcccatctttcagaagccttgtccaggtctccctgttagcacctgactcagcggcagcttctgccgctgggttttcatttcactgtggatatccctgaggccatgagggtgggagccggcctgggcagctccaactccagagaagggtacagctgaccccggctgccctcctgccagcttagcccccttggaacctaacagataaacagggttttgtttttttccttttttgggtaaagtacatgcaacataaaatttaccatttcagtcattaaaaatgaacagttcagtggc

SEQ ID NO: 2739 - DNA, 952 bp, Homo sapiens
agcggaccaatggcggccgcccgcggcgcgcagggtgcggggatggggtccgcccgcggcgttgggcgcgctcgccagcccaggggtcgccatgaccgagtggcccaggcccgagcgaagcccgcgcgcgacctcagcccaggaccctggaggatgctgaggggctacagcccccctccctagagtctccagggtcacatgggagcccgacaccatttggaggagattcagagaagcccctgattgctgattctgtccgcctgccacaccggctctgtccggagccactgggactcgggatccagtccacacacacccctcagaggggcactgtggccagagaaatgcttccacggcccaaagcccctgcctcccccagacgcccccagaccccaaccccgagtgagcaggacgcagaccctgggccagcaagccccagggacaccgaagcccagcgtctgcgcttccggcagttccagtaccacgtggcgagcgggccgcacctcgcgctgggccagctctggacgctgtgccgccagtggctgaggcccgaggcgcgctccaaggagcagatgctggagctgctggtgctggagcagttcctgggcgcgctgcccagcaagatgcggacctgggtgcagtcacagggcccccgaagctgcagggaggccgccagcctggtggaggacctcacacagatgtgccagcaggaaggtgagaggcgcaggcttcctgccccgggccgggccagggggcctgacgtctccgaggaccgaactgccctccttcccgcccacatcgctcccacccctgcccggcccctcccgaccagcaaacctctcctgccccgcggctgtgtttttaattatttttacatataaatgtgctgcacgcctcatctgcctcgaatttctcactcagtcggtgattaaagatccctccatttcccatg

SEQ ID NO: 2740 - DNA, 2463 bp, Homo sapiens
cagcccagaggaccccaggcgaccagagtccaggctgaggcccgaggtggctcaccagctgttcagatgcttccagtatcaggaggacatggggccacgggcgtccctgagccggctccgggagctctgcggccactggctgcggccggctctgcacaccaagaaacagatcctggagctgctggtgctggagcagttcctgagtgtgctgcctccgcacctcctgggccgcctgcaggggcagccgctcagggatggggaggaggtggtgctgctgctcgagggcatccaccgggagcccagccacgcggggccgctggattttagttgtaatgctggcaagagttgtccccgtgcagacgtcaccttggaggaaaaggggtgtgcttcccaggtccccagccacagccccaagaaggaattgcctgcggaagagccttcagtgctgggcccatcggatgagcctccccgaccccagccaagggctgcccagcctgctgagccgggacagtggaggcttcccccaagttcaaagcagccgctgagcccggggccccagaagacattccaggccctgcaagaaagcagtccccagggcccctcaccatggccagaggagagttcccgagatcaggagctggcggctgtgctggagtgcctgacctttgaggatgtgccagagaataaggcgtggcctgcacaccccctgggattcggaagcagaaccccagacaaggaggaatttaaacaagaagagcccaaaggggctgcctggcccactcccatcttagcagagtcccaggcagatagtcctggggtgccgggagagccttgcgcccagtcgctcggacggggcgctgcggctagcggccctggtgaagatgggtcccttcttggcagcagtgaaattttggaggtcaaagtggctgagggcgtccccgagcccaatccggagttgcagttcatctgcgcggactgcggggtgagcttcccgcagctgtctcgcctgaaggcgcaccagctgcgctcgcacccggctgggcgctccttcctgtgcctttgctgcgggaagagcttcggccgcagctccattctcaagctgcacatgcgcactcacacggacgagcggccgcacgcctgccacctgtgcggccaccgcttccgccagagctcgcacctgagcaagcacctgctgacccactcctccgaacccgccttcctgtgcgcagagtgcggccgcggcttccagcgccgcgccagccttgtgcagcacctgctggcgcacgcccaggaccagaagccgccctgcgctcctgagagtaaggccgaagcgccgccactgaccgatgtcctgtgctcccactgcggccagagcttccagcgccgctccagcctcaagcgccacctgcggatccacgccagggacaaggaccgccggtcctccgaaggctccggcagccgccgccgggactccgaccggaggcccttcgtgtgcagcgactgcggcaaggccttccggcgcagcgagcacctggtggcccaccggagggtgcacacgggcgagcggcccttctcctgccaggcttgcggccgcagcttcacgcagagctcgcagctggtcagccaccaacgggtgcacacgggcgagaagccctacgcctgtccgcagtgcgggaagcgctttgtgcgccgggccagccttgcccgccacctgctgacccacggtggccctcggccccaccactgcacccagtgcgggaagagtttcggccagacccaggatctggcccgccaccagcgcagccacacgggcgagaagccctgccgctgcagcgagtgcggtgagggcttcagccagagcgcccacctggcgcgccaccagcgcatccacacaggggagaagccccacgcctgcgacacctgcggccaccgtttccgcaatagctccaacctggcccgccatcgccgcagccacacgggcgagcggccctacagctgtcagacgtgcggtcgcagcttccggcgcaacgcgcatctgcggcggcacctggctacccatgcggagcccgggcaggagcaggccgagcccccgcaggagtgcgtggagtgcgggaagagcttcagccgcagctgcaatctgctgcgacacctgctggtgcacacgggcgccaggccctactcctgcacgcagtgtggccgcagcttcagccgcaactcccacctgctgcgccacctgcgcacccacgcccgcgagacgctgtactagcttggcccgccttccgccagccgcgccctgcgccacctacccggggtcctccacagcggaggcctgcaggaatgtcccttcccaccacaccccacttccctctccttccactttcacagctgtccttccctggccgaggcattgctttctggcctcagctatgtaattaaaacgcccgaagtaaaatggccttctcc

SEQ ID NO: 2741 - DNA, 2195 bp, Homo sapiens
cagcccagaggaccccaggcgaccagagtccaggctgaggcccgaggtggctcaccagctgttcagatgcttccagtatcaggaggacatggggccacgggcgtccctgagccggctccgggagctctgcggccactggctgcggccggctctgcacaccaagaaacagatcctggagctgctggtgctggagcagttcctgagtgtgctgcctccgcacctcctgggccgcctgcaggggcagccgctcagggatggggaggaggtggtgctgctgctcgagggcatccaccgggagcccagccacgcggggccgctggtccccagggcccctcaccatggccagaggagagttcccgagatcaggagctggcggctgtgctggagtgcctgacctttgaggatgtgccagagaataaggcgtggcctgcacaccccctgggattcggaagcagaaccccagacaaggaggaatttaaacaagaagagcccaaaggggctgcctggcccactcccatcttagcagagtcccaggcagatagtcctggggtgccgggagagccttgcgcccagtcgctcggacggggcgctgcggctagcggccctggtgaagatgggtcccttcttggcagcagtgaaattttggaggtcaaagtggctgagggcgtccccgagcccaatccggagttgcagttcatctgcgcggactgcggggtgagcttcccgcagctgtctcgcctgaaggcgcaccagctgcgctcgcacccggctgggcgctccttcctgtgcctttgctgcgggaagagcttcggccgcagctccattctcaagctgcacatgcgcactcacacggacgagcggccgcacgcctgccacctgtgcggccaccgcttccgccagagctcgcacctgagcaagcacctgctgacccactcctccgaacccgccttcctgtgcgcagagtgcggccgcggcttccagcgccgcgccagccttgtgcagcacctgctggcgcacgcccaggaccagaagccgccctgcgctcctgagagtaaggccgaagcgccgccactgaccgatgtcctgtgctcccactgcggccagagcttccagcgccgctccagcctcaagcgccacctgcggatccacgccagggacaaggaccgccggtcctccgaaggctccggcagccgccgccgggactccgaccggaggcccttcgtgtgcagcgactgcggcaaggccttccggcgcagcgagcacctggtggcccaccggagggtgcacacgggcgagcggcccttctcctgccaggcttgcggccgcagcttcacgcagagctcgcagctggtcagccaccaacgggtgcacacgggcgagaagccctacgcctgtccgcagtgcgggaagcgctttgtgcgccgggccagccttgcccgccacctgctgacccacggtggccctcggccccaccactgcacccagtgcgggaagagtttcggccagacccaggatctggcccgccaccagcgcagccacacgggcgagaagccctgccgctgcagcgagtgcggtgagggcttcagccagagcgcccacctggcgcgccaccagcgcatccacacaggggagaagccccacgcctgcgacacctgcggccaccgtttccgcaatagctccaacctggcccgccatcgccgcagccacacgggcgagcggccctacagctgtcagacgtgcggtcgcagcttccggcgcaacgcgcatctgcggcggcacctggctacccatgcggagcccgggcaggagcaggccgagcccccgcaggagtgcgtggagtgcgggaagagcttcagccgcagctgcaatctgctgcgacacctgctggtgcacacgggcgccaggccctactcctgcacgcagtgtggccgcagcttcagccgcaactcccacctgctgcgccacctgcgcacccacgcccgcgagacgctgtactagcttggcccgccttccgccagccgcgccctgcgccacctacccggggtcctccacagcggaggcctgcaggaatgtcccttcccaccacaccccacttccctctccttccactttcacagctgtccttccctggccgaggcattgctttctggcctcagctatgtaattaaaacgcccgaagtaaaatggccttctcc

SEQ ID NO: 2742 - DNA, 1328 bp, Homo sapiens
cggcccggaagtgcccggctgaagcggccgggcgccgattggtgtctttgagtctagtctttgttcggggctgtccaaaggacgctagctgttgcacctgttcctccctgcgcgtaagatagaggataaatctcctggcaaagcccagaatgaccacagccctggaacctgaggaccaaaaaggacttctgataattaaggcagaggaccattactggggacaggattccagctcacaaaagtgcagtcctcacaggagggaactctatagacaacacttcaggaagctctgctatcaggatgcacctggaccccgtgaagctcttacccagctgtgggagctctgccgtcagtggctgaggccagaatgccacaccaaggagcagattttagacctgctggtgctagaacagttcctgagcattcttcctaaagacctgcaagcatgggtgcgtgcacaccatccagagactggagaggaggcagtgacggtactggaggatctggagagagagcttgatgaacctggaaagcaggtcccaggcaattcagaaagacgggacatactcatggacaagttggcccccttgggaaggccatatgaatcactgactgtccagctccatcccaaaaagacccagctggagcaggaagctgggaaaccacaaaggaatggtgataaaactaggactaagaatgaagagttgttccagaaggaagatatgcccaaagacaaggaattccttggggagataaatgacagactgaacaaagatactcctcagcatcctaagtccaaagatattattgaaaatgagggcagatcagaatggcaacagagggaaagaagacgatataaatgtgatgaatgtgggaaaagtttcagtcatagctcagaccttagtaaacacaggagaactcacacgggagagaagccctataaatgtgatgagtgtggaaaagccttcattcagcgctcacatctcattggacatcatagagtacacacgggagtaaaaccctataaatgtaaagaatgtgggaaagacttcagtgggcgcacaggtcttattcagcatcagagaatccacacaggtgaaaaaccctatgaatgtgatgagtgtggaaggcctttccgagtaagttcagctcttattagacatcaaagaattcataccgcaaataaactctactaatatagcagtaatatcaaaagttctttggacactcaggcctaactagttatcaaagaatctattttagaaaccttgagtttcctcaatgtggtcaaagcttcagtcatcattaaacttctctggaccaaagaa

SEQ ID NO: 2743 - DNA, 2926 bp, Homo sapiens
gcgtctgattggccatgcgcactgtcacctgtcacggctcccttgctcgccccggtgcgcggcacagcctcgcggcattgtgggagtcgtagtccgcggtgaggcccagtgcgcaggcgcagtttgccggccgccatcgcgcactggggctccgggcggctgggaccggcctggggtagctgcgcagcaggtgggtcggtcccggggatgcagcgcgggggtcagagagcgaccccaacagggtagacggtgaggacgcctcagtgggcagcgttagggaaaggggccagggtgttcccggggttggggtgcgagcccccgctgtgcgtccaggaggccgagggtctggcatcccttcgcgtggagtgcggggcaggggccgggtccccccggaggtggctgagatccagatcggtgaggggccctgcaggcaggtctgtgggttctggcaccacctgagcccactgggcatctggtcatccctggcacctctcctttggagccaccttgtccctggctagacagtcacattttccagtgccgttttggaaagatgttgcctttggagaaggcgtttgcctcccccaggagctccccagccccgccggatctgcccacgccggggtcagcagccggagtccagcaggaagaacccgagaccatccctgagaggacccctgctgacctggagttctcccgcctgcgtttccgggaatttgtctaccaggaggctgccgggccccaccagaccctggcccggctgcatgagctgtgccgccagtggctgatgcctgaggcgcgctccaaggagcagatgctggagctgctggtgctggagcagttcctgggcatcctgcctgataaggtccggccctgggtggtggcacagtaccctgagagctgcaagaaggcagcctccctggtggagggcctcgctgatgtcctggaagagccagggatgctgctgggctcccctgcgggctcatcctcaattcttagcgatggagtgtacgagaggcacatggaccctctgctgctaccaggcgagctcgcgagccccagccaggcccttggagctggggagatcccggcaccttctgagacaccctggctttctccggaccccctgtttctggaacagaggagggtcagagaagcaaagaccgaagaggacggccctgccaacaccgagcagaagctgaagtcctttccagaggaccctcagcacctgggggagtggggccacctggaccctgccgaggagaacctgaagagctaccggaagctgctcctgtgggggtatcagctttcccagcctgacgctgcctccaggctggacactgaggaactccggttggtggaaagagatccacaaggaagcagcctcccagaaggcgggaggcggcaggagagcgctgggtgcgcctgcgaggaggccgcccccgcgggggtgctgcctgagctgcctacggaggcgccccctggggacgcccttgccgatcccccgtcgggcaccactgaggaggaggaagagcagcctgggaaggccccggacccgcaggacccccaggacgcggagtccgactctgccaccggatcgcagaggcagtccgtcatccagcagcctgccccggacaggggcacggcgaaactgggaaccaagaggccgcaccccgaggatggggacgggcagagcctcgagggcgtctctagctccggcgacagcgcagggctggaggccgggcagggccctggggctgacgagccgggcttgtcccgcgggaagccctatgcctgcggcgagtgcggggaggccttcgcgtggctctcgcacctgatggagcaccacagcagccatggcggccggaagcgctacgcctgtcagggctgctggaagaccttccacttcagcctggccctagccgagcaccagaagacccacgagaaggagaaaagctacgcgctggggggcgcccggggcccccaaccgtccacccgcgaagcccaggcgggggctagggcgggcggtcccccagagagcgtggagggcgaggctccccccgcacccccagaggcgcagaggtgagccgctgtgctgtcccgttccggaggggccgctttgccggccgtgaatcccagacgaggcattgggcctttccacgcccctgggtggcggcttcctgtggtgtttgtggacgtcctctgcctgtgccctgaatccgctcctgaggctaagcgctcccaacgagaagggtccacgggaagccctcacctctgtaaacacaccctgggccagcgctcgcatccgaggggagccgccggatgtggaagaagactcggctttcctgcagccatttagtgccgccccatgctaggttatttgacattgtgcagtgtagagttgccttaaagtgcgtgatctgccagtgctttcttcaagtcacccttgccccgattcctcctgtttgcgctccccagggttgctcaagtggaaattttgtcagctgtttagccttttcgtacttggcgtgatgtcaacttcacttctaatctgcaaaagcagaagctgtttcctagtttacctcgcgtgtgtttacctatatggagtagctcgcagagatcacagaaatgcttgcagcctaaggcagggttttcagaccgtgggtcccagcccatttagtaaaatgggaaatcaattagcaagtggtcaccagcattacacagcaatgaagcagaataaagtaggccagaatgcatcatgtagtaaaggcaaatactgttttgtgaaacttttcacccatacatctaaatgtgagaactggttgcaatgtaagacatttcttgctgggaagttgtgagcaaaataagttgaaaacactaataaagatctgtctgtctgagcaaaggagactaaactccttgggct

SEQ ID NO: 2744 - DNA, 2216 bp, Homo sapiens
gcgtctgattggccatgcgcactgtcacctgtcacggctcccttgctcgccccggtgcgcggcacagcctcgcggcattgtgggagtcgtagtccgcggtgaggcccagtgcgcaggcgcagtttgccggccgccatcgcgcactggggctccgggcggctgggaccggcctggggtagctgcgcagcaggtgggtcggtcccggggatgcagcgcgggggtcagagagcgaccccaacagggtagacgggatgctgctgggctcccctgcgggctcatcctcaattcttagcgatggagtgtacgagaggcacatggaccctctgctgctaccaggcgagctcgcgagccccagccaggcccttggagctggggagatcccggcaccttctgagacaccctggctttctccggaccccctgtttctggaacagaggagggtcagagaagcaaagaccgaagaggacggccctgccaacaccgagcagaagctgaagtcctttccagaggaccctcagcacctgggggagtggggccacctggaccctgccgaggagaacctgaagagctaccggaagctgctcctgtgggggtatcagctttcccagcctgacgctgcctccaggctggacactgaggaactccggttggtggaaagagatccacaaggaagcagcctcccaggcgggaggcggcaggagagcgctgggtgcgcctgcgaggaggccgcccccgcgggggtgctgcctgagctgcctacggaggcgccccctggggacgcccttgccgatcccccgtcgggcaccactgaggaggaggaagagcagcctgggaaggccccggacccgcaggacccccaggacgcggagtccgactctgccaccggatcgcagaggcagtccgtcatccagcagcctgccccggacaggggcacggcgaaactgggaaccaagaggccgcaccccgaggatggggacgggcagagcctcgagggcgtctctagctccggcgacagcgcagggctggaggccgggcagggccctggggctgacgagccgggcttgtcccgcgggaagccctatgcctgcggcgagtgcggggaggccttcgcgtggctctcgcacctgatggagcaccacagcagccatggcggccggaagcgctacgcctgtcagggctgctggaagaccttccacttcagcctggccctagccgagcaccagaagacccacgagaaggagaaaagctacgcgctggggggcgcccggggcccccaaccgtccacccgcgaagcccaggcgggggctagggcgggcggtcccccagagagcgtggagggcgaggctccccccgcacccccagaggcgcagaggtgagccgctgtgctgtcccgttccggaggggccgctttgccggccgtgaatcccagacgaggcattgggcctttccacgcccctgggtggcggcttcctgtggtgtttgtggacgtcctctgcctgtgccctgaatccgctcctgaggctaagcgctcccaacgagaagggtccacgggaagccctcacctctgtaaacacaccctgggccagcgctcgcatccgaggggagccgccggatgtggaagaagactcggctttcctgcagccatttagtgccgccccatgctaggttatttgacattgtgcagtgtagagttgccttaaagtgcgtgatctgccagtgctttcttcaagtcacccttgccccgattcctcctgtttgcgctccccagggttgctcaagtggaaattttgtcagctgtttagccttttcgtacttggcgtgatgtcaacttcacttctaatctgcaaaagcagaagctgtttcctagtttacctcgcgtgtgtttacctatatggagtagctcgcagagatcacagaaatgcttgcagcctaaggcagggttttcagaccgtgggtcccagcccatttagtaaaatgggaaatcaattagcaagtggtcaccagcattacacagcaatgaagcagaataaagtaggccagaatgcatcatgtagtaaaggcaaatactgttttgtgaaacttttcacccatacatctaaatgtgagaactggttgcaatgtaagacatttcttgctgggaagttgtgagcaaaataagttgaaaacactaataaagatctgtctgtctgagcaaaggagactaaactccttgggct

SEQ ID NO: 2745 - DNA, 2571 bp, Homo sapiens
gaatatcgcatccgggaactctgcgcgcccatgcggagagtcggagggcgagctgacgaggacgctacggcggcgggaagtctgtgggttctggcaccacctgagcccactgggcatctggtcatccctggcacctctcctttggagccaccttgtccctggctagacagtcacattttccagtgccgttttggaaagatgttgcctttggagaaggcgtttgcctcccccaggagctccccagccccgccggatctgcccacgccggggtcagcagccggagtccagcaggaagaacccgagaccatccctgagaggacccctgctgacctggagttctcccgcctgcgtttccgggaatttgtctaccaggaggctgccgggccccaccagaccctggcccggctgcatgagctgtgccgccagtggctgatgcctgaggcgcgctccaaggagcagatgctggagctgctggtgctggagcagttcctgggcatcctgcctgataaggtccggccctgggtggtggcacagtaccctgagagctgcaagaaggcagcctccctggtggagggcctcgctgatgtcctggaagagccagggatgctgctgggctcccctgcgggctcatcctcaattcttagcgatggagtgtacgagaggcacatggaccctctgctgctaccaggcgagctcgcgagccccagccaggcccttggagctggggagatcccggcaccttctgagacaccctggctttctccggaccccctgtttctggaacagaggagggtcagagaagcaaagaccgaagaggacggccctgccaacaccgagcagaagctgaagtcctttccagaggaccctcagcacctgggggagtggggccacctggaccctgccgaggagaacctgaagagctaccggaagctgctcctgtgggggtatcagctttcccagcctgacgctgcctccaggctggacactgaggaactccggttggtggaaagagatccacaaggaagcagcctcccagaaggcgggaggcggcaggagagcgctgggtgcgcctgcgaggaggccgcccccgcgggggtgctgcctgagctgcctacggaggcgccccctggggacgcccttgccgatcccccgtcgggcaccactgaggaggaggaagagcagcctgggaaggccccggacccgcaggacccccaggacgcggagtccgactctgccaccggatcgcagaggcagtccgtcatccagcagcctgccccggacaggggcacggcgaaactgggaaccaagaggccgcaccccgaggatggggacgggcagagcctcgagggcgtctctagctccggcgacagcgcagggctggaggccgggcagggccctggggctgacgagccgggcttgtcccgcgggaagccctatgcctgcggcgagtgcggggaggccttcgcgtggctctcgcacctgatggagcaccacagcagccatggcggccggaagcgctacgcctgtcagggctgctggaagaccttccacttcagcctggccctagccgagcaccagaagacccacgagaaggagaaaagctacgcgctggggggcgcccggggcccccaaccgtccacccgcgaagcccaggcgggggctagggcgggcggtcccccagagagcgtggagggcgaggctccccccgcacccccagaggcgcagaggtgagccgctgtgctgtcccgttccggaggggccgctttgccggccgtgaatcccagacgaggcattgggcctttccacgcccctgggtggcggcttcctgtggtgtttgtggacgtcctctgcctgtgccctgaatccgctcctgaggctaagcgctcccaacgagaagggtccacgggaagccctcacctctgtaaacacaccctgggccagcgctcgcatccgaggggagccgccggatgtggaagaagactcggctttcctgcagccatttagtgccgccccatgctaggttatttgacattgtgcagtgtagagttgccttaaagtgcgtgatctgccagtgctttcttcaagtcacccttgccccgattcctcctgtttgcgctccccagggttgctcaagtggaaattttgtcagctgtttagccttttcgtacttggcgtgatgtcaacttcacttctaatctgcaaaagcagaagctgtttcctagtttacctcgcgtgtgtttacctatatggagtagctcgcagagatcacagaaatgcttgcagcctaaggcagggttttcagaccgtgggtcccagcccatttagtaaaatgggaaatcaattagcaagtggtcaccagcattacacagcaatgaagcagaataaagtaggccagaatgcatcatgtagtaaaggcaaatactgttttgtgaaacttttcacccatacatctaaatgtgagaactggttgcaatgtaagacatttcttgctgggaagttgtgagcaaaataagttgaaaacactaataaagatctgtctgtctgagcaaaggagactaaactccttgggct

SEQ ID NO: 2746 - DNA, 1934 bp, Homo sapiens
gaatatcgcatccgggaactctgcgcgcccatgcggagagtcggagggcgagctgacgaggacgctacggcggcgggaagtctgtgggttctggcaccacctgagcccactgggcatctggtcatccctggcacctctcctttggagccaccttgtccctggctagacagtcacattttccagtgccgttttggaaagatgttgcctttggagaaggcgtttgcctcccccaggagctccccagccccgccggatctgcccacgccggggtcagcagccggagtccagcaggaagaacccgagaccatccctgagaggacccctgctgacctggagttctcccgcctgcgtttccgggaatttgtctaccaggaggctgccgggccccaccagaccctggcccggctgcatgagctgtgccgccagtggctgatgcctgaggcgcgctccaaggagcagatgctggagctgctggtgctggagcagttcctgggcatcctgcctgataaggtccggccctgggtggtggcacagtaccctgagagctgcaagaaggcagcctccctggtggagggcctcgctgatgtcctggaagagccagggatgctgctgggctcccctgcgggctcatcctcaattcttagcgatggagtgtacgagaggcacatggaccctctgctgctaccaggcgagctcgcgagccccagccaggcccttggagctggggagatcccggcaccttctgagacaccctggctttctccggaccccctgtttctggaacagaggagggtcagagaagcaaagaccgaagaggacggccctgccaacaccgagcagaagctgaagtcctttccagaggaccctcagcacctgggggagtggggccacctggaccctgccgaggagaacctgaagagctaccggaagctgctcctgtgggggtatcagctttcccagcctgacgctgcctccaggctggacactgaggaactccggttggtggaaagagatccacaaggaagcagcctcccagaaggcgggaggcggcaggagagcgctgggtgcgcctgcgaggaggccgcccccgcgggggtgctgcctgagctgcctacggaggcgccccctggggacgcccttgccgatcccccgtcgggcaccactgaggaggaggaagagcagcctgggaaggccccggacccgcaggacccccaggacgcggagtccgactctgccaccggatcgcagaggcagtccgtcatccagcagcctgccccggacaggggcacggcgaaactgggaaccaagaggccgcaccccgaggatggggacgggcagagcctcgagggcgtctctagctccggcgacagcgcagggctggaggccgggcagggccctggggctgacgagccgggcttgtcccgcgggaagccctatgcctgcggcgagtgcggggaggccttcgcgtggctctcgcacctgatggagcaccacagcagccatggcggccggaagcgctacgcctgtcagggctgctggaagaccttccacttcagcctggccctagccgagcaccagaagacccacgagaaggagaaaagctacgcgctggggggcgcccggggcccccaaccgtccacccgcgaagcccaggcgggggctagggcgggcggtcccccagagagcgtggagggcgaggctccccccgcacccccagaggcgcagaggtgagccgctgtgctgtcccgttccggaggggccgctttgccggccgtgaatcccagacgaggcattgggcctttccacgcccctgggtggcggcttcctgtggtgtttgtggacgtcctctgcctgtgccctgaatccgctcctgaggctaagcgctcccaacgagaagggtccacgggaagccctcacctctgtaaacacaccct

SEQ ID NO: 2747 - DNA, 993 bp, Homo sapiens
ccattgttctcggtgccccacgggcttgagccggggtgaatctggaggggccgggccgagcccgggggcgctttcgcacgcgaagcaaccgctagagcaggacctggtctcccgagagcgggactacttgttgatatttgaggagggaagtgtcttacctgagagcctggctggagaagactgaggtccaaggcttgaagcctaagtgattgccccaggactgtggatgatggctgcagacatcccgagagtgaccactccgctgagctccttggtccaggtgcctcaagaggaagatagacaggaggaggaggtcaccaccatgatcctggaggatgactcctgggtgcaagaagctgtgctgcaggaggatggccctgagtctgagccctttccccagagtgctggcaagggcggcccccaggaggaggtgaccaggggaccacagggtgcactcggccgcctccgagagctctgccggcgctggctgagaccagaggtacacaccaaggagcagatgttaaccatgctgccaaaggaaattcaggcttggctgcaagagcatcggcctgaaagcagtgaggaggcagcggccctggtggaagacttgacccagacccttcaggacagtgctgtagctgtcgttgcttcccttccggtggaggtgaccagtttgtaatgaacttctggatctccagtcagatactatggaggagagagtgatggagggctgaggagaggcctcaggttgttatttggttggggaggcacagagcagaggttcaggtctcagcaggtgtcagaggtgattacagcccttcccatccaccttgcagcaggggctttgtgcctttcatctttaactgggcacctgagatgggaaccaatggggaccatcccagacacatgggtttgtctgtccctgacttctgcctctgagattgtctttgttggtctttgtttaataaacgccccgaccttcctcatgattgc

SEQ ID NO: 2748 - DNA, 3464 bp, Homo sapiens
atgatggctgcagacatcccgagagtgaccactccgctgagctccttggtccaggtgcctcaagaggaagatagacaggaggaggaggtcaccaccatgatcctggaggatgactcctgggtgcaagaagctgtgctgcaggaggaggtgaccaggggaccacagggtgcactcggccgcctccgagagctctgccggcgctggctgagaccagaggtacacaccaaggagcagatgttaaccatgctgccaaaggaaattcaggcttggctgcaagagcatcggcctgaaagcagtgaggaggcagcggccctggtggaagacttgacccagacccttcaggacagtgattttgagatacagagtgaaaatggggagaactgtaatcaagacatgtttgagaatgaatcacgtaagatattctcggaaatgcctgaaggtgaaagtgctcagcactccgatggggaaagtgactttgagagagatgctggcatccagaggctccagggacacagcccaggtgaggaccacggggaggtggtttctcaggacagggaagttggccagctcataggcctgcagggcacctacctaggggagaagccctacgaatgtccccagtgtgggaagaccttcagccggaaatcccacctcatcacacacgagaggacccacacaggagagaaatactacaaatgtgatgaatgtggaaaaagctttagtgatggttcaaattttagtagacaccaaaccactcacaccggggagaagccctacaaatgcagagactgtgggaagagctttagccggagtgccaacctcataacccaccagaggatccacacgggggaaaagcccttccagtgtgccgagtgtggcaagagcttcagcaggagtcccaacctcattgcacatcagcgcacccacacaggagagaaaccctactcgtgccccgagtgtggaaagagctttggcaaccgatccagccttaacacgcatcaggggatccacactggagaaaagccctacgaatgtaaagaatgcggcgaaagctttagttacaactccaatctaatcagacaccagagaatccacacaggagagaaaccctacaaatgtaccgactgtgggcagaggttcagccagagttcagccctcatcacccaccggagaacccacacaggagagaaaccctaccagtgcagcgagtgtgggaaaagcttcagccgcagctctaacctggccacacaccggagaacccacatggtggagaagccctataagtgtggggtgtgtgggaagagcttcagccagagctccagtctgattgcacaccagggcatgcacacaggggagaaaccctacgagtgcctgacatgtggggagagcttcagctggagctccaacctcctcaagcaccagaggatccacacgggagagaaaccctacaaatgcagcgagtgtgggaaatgcttcagccagcgctcccagctcgtagtgcaccagcggacccacacgggcgagaagccctacaaatgcctcatgtgcggcaagagcttcagccggggctccattctggtcatgcaccagagagcccatttgggagacaagccctacaggtgccctgagtgtgggaaaggctttagctggaactcagtcctcattatacatcagcgaatccacactggggagaagccctacaaatgccccgagtgtggcaaaggcttcagcaacagctctaactttatcacacatcagagaactcacatgaaagagaaactttattgaagtggcaaagagtgaaagtgagggactggcctggagtgggagttgccacactgccccaacagtgattccctttcaaagagctgtgcttcctaaacattctggggggttttgccagagtcttccccttgctcatcctcatttccaggacactgtcattttagtggtctgagtcaagtcccgtatacattcaagaacagggcataggcgtggaaggtctggaaagttgggtctttttcccttacattgggtgacttgattggccccctctcatgattcctctgtgcctcagtttcctctttggtaaaatggggggaaatgtttctccatgtggaatggaagacagcatggcccacaacgtgggccgagtcctcagagaaatactggaaatcattggtgtggttctggttgttttgttgttttgctgccacgttgttgggctaaggtgccttcaccccaagctgttagtgttccagggcaccccaagctgtcagttagaatctgctcttctggctttggtgtcttgggctttgatttcaggtcaagatggaggggcttctccagttctgagtcacccacgtgaaggtaaagaccctttctatttccagaaagtgtcaggagcacagaaacttgaggaagtacagcctggagccagtgtcccagtgtcctttccattggtaagagttggacagggccttcaggaaaggggtaaaccgaggacatttcagtgcttgcttttgtctctgcctactgtcctgtggtagatcagctaccaggggaacacatttgttctcgtggggttttgtcctggagagtgtagtgaagtccgagagccctagctgccaacccatggtggatggtaacttctgtctcatcaagagtaaaacagtcctgcacacagcagggtgggtttgtgcctttggcccaacaggtacatagccccataatttctgaattattctatgcacttgtttccctcttcttttattttttatttgatatatgccgagctagaatcctgtcgggtagcttttgtatactaagaacattattattattattatttttgagacggagtctcactctgtcacccaggctggagtgcagtggtgccatctcagctcactgcaagctccgcctcccgggttcacgccattctcctgcctcagcctcccgagtagctgggactacaggtgcccaccaccacacccagctaatttctttttttgtatttttagtagagacggggtttcaccgcgttagccaggatggtttcgatctcctgtcctcgtgatctgcccgccttggcctcccgaagtgctgggattacaggcgtgagccagcgcacccggccaagaacattatttttaaagaagtgttaactttgaggacatatctgttccctggagatatttgggcttgaatcaggagtttgtcctacaggtgtcgcccttgatctcaggatgctaccagggctttgttctcgggatcctcgcacctggagagtgaagacgggcatgacggcaggtgaaggggtttgctgtgaaggaagaggagataaggcatttccaggaaatgggaaactgcctcctcctacacatggggcctgtgctcagaatgggcttagttcttataggatggatgctcagtattccttaataaagtagagttccattctt

SEQ ID NO: 2749 - DNA, 906 bp, Homo sapiens
ggggtgaatctggaggggccgggccgagcccgggggcgctttcgcacgcgaagcaaccgctagagcaggacctggtctcccgagagcgggactacttgttgatatttgaggagggaagtgtcttacctgagagcctggctggagaagactgaggtccaaggcttgaagcctaagtgattgccccaggactgtggatgatggctgcagacatcccgagagtgaccactccgctgagctccttggtccaggtgcctcaagaggaagatagacaggaggaggaggtcaccaccatgatcctggaggatgactcctgggtgcaagaagctgtgctgcaggaggatggccctgagtctgagccctttccccagagtgctggcaagggcggcccccaggaggaggtgaccaggggaccacagggtgcactcggccgcctccgagagctctgccggcgctggctgagaccagaggtacacaccaaggagcagatgttaaccatgctgccaaaggaaattcaggcttggctgcaagagcatcggcctgaaagcagtgaggaggcagcggccctggtggaagacttgacccagacccttcaggacagtgaaacagcttcctgcgtacatggctgccctgtgtgattccagttgcagcctcacctcctttgcctctctgaaccaaagaagccagccctgcttaccccagttcccaaacacaggaagtgattttctgcctgagctttctgagttctgttccctcccaccccagggctctccatgcttattcattgcatttccttcctcattgcttttacccagtctgctgttttgggaagccctgacatgtattttggtgcctacatattttatcttctgatctcactgaaaataaaattggattttacttgttttc

SEQ ID NO: 2750 - DNA, 578 bp, Homo sapiens
gtccattgttctcggtgccccacgggcttgagccggggtgaatctggaggggccgggccgagcccgggggcgctttcgcacgcgaagcaaccgctagagcaggacctggtctcccgagaggctggagtgcaatggcctgatctccgctcaccgcatcctctgcctcccgggttcaagcgattctcctgcctcagcctccggagtagctgggattacgggcatgcgccaccacgcctggctaattttgtttttagtagagacgaggtttctccgtgttggtcaggctggtctcgatcttccgacctcaggtgatccgcccgcctcaacctgccaaagtgctaggattacaggtctgagccaccgcgcccggctcgggactacttgttgatatttgaggagggaagtgtcttacctgagagcctggctggagaagactgaggtccaaggcttgaagcctaagtgattgccccaggactgtggatgatggctgcagacatcccgagagtgaccactccgctgagctccttggtccaggtgcctcaagaggaagatagacaggaggaggaggtcaccaccat

SEQ ID NO: 2751 - DNA, 3813 bp, Homo sapiens
gggcctctcccgtccattgttctcggtgccccacgggcttgagccggggtgaatctggaggggccgggccgagcccgggggcgctttcgcacgcgaagcaaccgctagagcaggacctggtctcccgagaggtgagccggagaggcaggcctggagccacgcggaccccgggcagtagcccgagcgggactacttgttgatatttgaggagggaagtgtcttacctgagagcctggctggagaagactgaggtccaaggcttgaagcctaagtgattgccccaggactgtggatgatggctgcagacatcccgagagtgaccactccgctgagctccttggtccaggtgcctcaagaggaagatagacaggaggaggaggtcaccaccatgatcctggaggatgactcctgggtgcaagaagctgtgctgcaggaggatggccctgagtctgagccctttccccagagtgctggcaagggcggcccccaggaggaggtgaccaggggaccacagggtgcactcggccgcctccgagagctctgccggcgctggctgagaccagaggtacacaccaaggagcagatgttaaccatgctgccaaaggaaattcaggcttggctgcaagagcatcggcctgaaagcagtgaggaggcagcggccctggtggaagacttgacccagacccttcaggacagtgattttgagatacagagtgaaaatggggagaactgtaatcaagacatgtttgagaatgaatcacgtaagatattctcggaaatgcctgaaggtgaaagtgctcagcactccgatggggaaagtgactttgagagagatgctggcatccagaggctccagggacacagcccaggtgaggaccacggggaggtggtttctcaggacagggaagttggccagctcataggcctgcagggcacctacctaggggagaagccctacgaatgtccccagtgtgggaagaccttcagccggaaatcccacctcatcacacacgagaggacccacacaggagagaaatactacaaatgtgatgaatgtggaaaaagctttagtgatggttcaaattttagtagacaccaaaccactcacaccggggagaagccctacaaatgcagagactgtgggaagagctttagccggagtgccaacctcataacccaccagaggatccacacgggggaaaagcccttccagtgtgccgagtgtggcaagagcttcagcaggagtcccaacctcattgcacatcagcgcacccacacaggagagaaaccctactcgtgccccgagtgtggaaagagctttggcaaccgatccagccttaacacgcatcaggggatccacactggagaaaagccctacgaatgtaaagaatgcggcgaaagctttagttacaactccaatctaatcagacaccagagaatccacacaggagagaaaccctacaaatgtaccgactgtgggcagaggttcagccagagttcagccctcatcacccaccggagaacccacacaggagagaaaccctaccagtgcagcgagtgtgggaaaagcttcagccgcagctctaacctggccacacaccggagaacccacatggtggagaagccctataagtgtggggtgtgtgggaagagcttcagccagagctccagtctgattgcacaccagggcatgcacacaggggagaaaccctacgagtgcctgacatgtggggagagcttcagctggagctccaacctcctcaagcaccagaggatccacacgggagagaaaccctacaaatgcagcgagtgtgggaaatgcttcagccagcgctcccagctcgtagtgcaccagcggacccacacgggcgagaagccctacaaatgcctcatgtgcggcaagagcttcagccggggctccattctggtcatgcaccagagagcccatttgggagacaagccctacaggtgccctgagtgtgggaaaggctttagctggaactcagtcctcattatacatcagcgaatccacactggggagaagccctacaaatgccccgagtgtggcaaaggcttcagcaacagctctaactttatcacacatcagagaactcacatgaaagagaaactttattgaagtggcaaagagtgaaagtgagggactggcctggagtgggagttgccacactgccccaacagtgattccctttcaaagagctgtgcttcctaaacattctggggggttttgccagagtcttccccttgctcatcctcatttccaggacactgtcattttagtggtctgagtcaagtcccgtatacattcaagaacagggcataggcgtggaaggtctggaaagttgggtctttttcccttacattgggtgacttgattggccccctctcatgattcctctgtgcctcagtttcctctttggtaaaatggggggaaatgtttctccatgtggaatggaagacagcatggcccacaacgtgggccgagtcctcagagaaatactggaaatcattggtgtggttctggttgttttgttgttttgctgccacgttgttgggctaaggtgccttcaccccaagctgttagtgttccagggcaccccaagctgtcagttagaatctgctcttctggctttggtgtcttgggctttgatttcaggtcaagatggaggggcttctccagttctgagtcacccacgtgaaggtaaagaccctttctatttccagaaagtgtcaggagcacagaaacttgaggaagtacagcctggagccagtgtcccagtgtcctttccattggtaagagttggacagggccttcaggaaaggggtaaaccgaggacatttcagtgcttgcttttgtctctgcctactgtcctgtggtagatcagctaccaggggaacacatttgttctcgtggggttttgtcctggagagtgtagtgaagtccgagagccctagctgccaacccatggtggatggtaacttctgtctcatcaagagtaaaacagtcctgcacacagcagggtgggtttgtgcctttggcccaacaggtacatagccccataatttctgaattattctatgcacttgtttccctcttcttttattttttatttgatatatgccgagctagaatcctgtcgggtagcttttgtatactaagaacattattattattattatttttgagacggagtctcactctgtcacccaggctggagtgcagtggtgccatctcagctcactgcaagctccgcctcccgggttcacgccattctcctgcctcagcctcccgagtagctgggactacaggtgcccaccaccacacccagctaatttctttttttgtatttttagtagagacggggtttcaccgcgttagccaggatggtttcgatctcctgtcctcgtgatctgcccgccttggcctcccgaagtgctgggattacaggcgtgagccagcgcacccggccaagaacattatttttaaagaagtgttaactttgaggacatatctgttccctggagatatttgggcttgaatcaggagtttgtcctacaggtgtcgcccttgatctcaggatgctaccagggctttgttctcgggatcctcgcacctggagagtgaagacgggcatgacggcaggtgaaggggtttgctgtgaaggaagaggagataaggcatttccaggaaatgggaaactgcctcctcctacacatggggcctgtgctcagaatgggcttagttcttataggatggatgctcagtattccttaataaagtagagttccattctt

SEQ ID NO: 2752 - DNA, 581 bp, Homo sapiens
gttctcggtgccccacgggcttgagccggggtgaatctggaggggccgggccgagcccgggggcgctttcgcacgcgaagcaaccgctagagcaggacctggtctcccgagagacggagttttgcttttgttgcccaggctggagtgcaatggcctgatctccgctcaccgcatcctctgcctcccgggttcaagcgattctcctgcctcagcctccggagtagctgggattacgggcatgcgccaccacgcctggctaattttgtttttagtagagacgaggtttctccgtgttggtcaggctggtctcgatcttccgacctcaggtgatccgcccgcctcaacctgccaaagtgctaggattacaggtctgagccaccgcgcccggctcgggactacttgttgatatttgaggagggaagtgtcttacctgagagcctggctggagaagactgaggtccaaggcttgaagcctaagtgattgccccaggactgtggatgatggctgcagacatcccgagagtgaccactccgctgagctccttggtccaggtgcctcaagaggaagatagacaggagga

SEQ ID NO: 2753 - DNA, 2914 bp, Homo sapiens
gcctaagtgattgccccaggactgtggatgatggctgcagacatcccgagagtgaccactccgctgagctccttggtccaggtgcctcaagaggaagatagacaggaggaggaggtcaccaccatgatcctggaggatgactcctgggtgcaagaagctgtgctgcaggaggatggccctgagtctgagccctttccccagagtgctggcaagggcggcccccaggaggaggtgaccaggggaccacagggtgcactcggccgcctccgagagctctgccggcgctggctgagaccagaggtacacaccaaggagcagatgttaaccatgctgccaaaggaaattcaggcttggctgcaagagcatcggcctgaaagcagtgaggaggcagcggccctggtggaagacttgacccagacccttcaggacagtgattttgagatacagagtgaaaatggggagaactgtaatcaagacatgtttgagaatgaatcacgtaagatattctcggaaatgcctgaaggtgaaagtgctcagcactccgatggggaaagtgactttgagagagatgctggcatccagaggctccagggacacagcccaggtgaggaccacggggaggtggtttctcaggacagggaagttggccagctcataggcctgcagggcacctacctaggggagaagccctacgaatgtccccagtgtgggaagaccttcagccggaaatcccacctcatcacacacgagaggacccacacaggagagaaatactacaaatgtgatgaatgtggaaaaagctttagtgatggttcaaattttagtagacaccaaaccactcacaccggggagaagccctacaaatgcagagactgtgggaagagctttagccggagtgccaacctcataacccaccagaggatccacacgggggaaaagcccttccagtgtgccgagtgtggcaagagcttcagcaggagtcccaacctcattgcacatcagcgcacccacacaggagagaaaccctactcgtgccccgagtgtggaaagagctttggcaaccgatccagccttaacacgcatcaggggatccacactggagaaaagccctacgaatgtaaagaatgcggcgaaagctttagttacaactccaatctaatcagacaccagagaatccacacaggagagaaaccctacaaatgtaccgactgtgggcagaggttcagccagagttcagccctcatcacccaccggagaacccacacaggagagaaaccctaccagtgcagcgagtgtgggaaaagcttcagccgcagctctaacctggccacacaccggagaacccacatggtggagaagccctataagtgtggggtgtgtgggaagagcttcagccagagctccagtctgattgcacaccagggcatgcacacaggggagaaaccctacgagtgcctgacatgtggggagagcttcagctggagctccaacctcctcaagcaccagaggatccacacgggagagaaaccctacaaatgcagcgagtgtgggaaatgcttcagccagcgctcccagctcgtagtgcaccagcggacccacacgggcgagaagccctacaaatgcctcatgtgcggcaagagcttcagccggggctccattctggtcatgcaccagagagcccatttgggagacaagccctacaggtgccctgagtgtgggaaaggctttagctggaactcagtcctcattatacatcagcgaatccacactggggagaagccctacaaatgccccgagtgtggcaaaggcttcagcaacagctctaactttatcacacatcagagaactcacatgaaagagaaactttattgaagtggcaaagagtgaaagtgagggactggcctggagtgggagttgccacactgccccaacagtgattccctttcaaagagctgtgcttcctaaacattctggggggttttgccagagtcttccccttgctcatcctcatttccaggacactgtcattttagtggtctgagtcaagtcccgtatacattcaagaacagggcataggcgtggaaggtctggaaagttgggtctttttcccttacattgggtgacttgattggccccctctcatgattcctctgtgcctcagtttcctctttggtaaaatggggggaaatgtttctccatgtggaatggaagacagcatggcccacaacgtgggccgagtcctcagagaaatactggaaatcattggtgtggttctggttgttttgttgttttgctgccacgttgttgggctaaggtgccttcaccccaagctgttagtgttccagggcaccccaagctgtcagttagaatctgctcttctggctttggtgtcttgggctttgatttcaggtcaagatggaggggcttctccagttctgagtcacccacgtgaaggtaaagaccctttctatttccagaaagtgtcaggagcacagaaacttgaggaagtacagcctggagccagtgtcccagtgtcctttccattgtagagacggggtttcaccgcgttagccaggatggtttcgatctcctgtcctcgtgatctgcccgccttggcctcccgaagtgctgggattacaggcgtgagccagcgcacccggccaagaacattatttttaaagaagtgttaactttgaggacatatctgttccctggagatatttgggcttgaatcaggagtttgtcctacaggtgtcgcccttgatctcaggatgctaccagggctttgttctcgggatcctcgcacctggagagtgaagacgggcatgacggcaggtgaaggggtttgctgtgaaggaagaggagataaggcatttccaggaaatgggaaactgcctcctcctacacatggggc

SEQ ID NO: 2754 - DNA, 2242 bp, Homo sapiens
cgtccattgttctcggtgccccacgggcttgagccggggtgaatctggaggggccgggccgagcccgggggcgctttcgcacgcgaagcaaccgctagagcaggacctggtctcccgagagcgggactacttgttgatatttgaggagggaagtgtcttacctgagagcctggctggagaagactgaggtccaaggcttgaagcctaagtgattgccccaggactgtggatgatggctgcagacatcccgagagtgaccactccgctgagctccttggtccaggtgcctcaagaggaagatagacaggaggaggaggtcaccaccatgatcctggaggatgactcctgggtgcaagaagctgtgctgcaggaggatggccctgagtctgagccctttccccagagtgctggcaagggcggcccccaggaggaggtgaccaggggaccacagggtgcactcggccgcctccgagagctctgccggcgctggctgagaccagaggtacacaccaaggagcagatgttaaccatgctgccaaaggaaattcaggcttggctgcaagagcatcggcctgaaagcagtgaggaggcagcggccctggtggaagacttgacccagacccttcaggacagtgattttgagatacagagtgaaaatggggagaactgtaatcaagacatgtttgagaatgaatcacgtaagatattctcggaaatgcctgaaggtgaaagtgctcagcactccgatggggaaagtgactttgagagagatgctggcatccagaggctccagggacacagcccaggtgaggaccacggggaggtggtttctcaggacagggaagttggccagctcataggcctgcagggcacctacctaggggagaagccctacgaatgtccccagtgtgggaagaccttcagccggaaatcccacctcatcacacacgagaggacccacacaggagagaaatactacaaatgtgatgaatgtggaaaaagctttagtgatggttcaaattttagtagacaccaaaccactcacaccggggagaagccctacaaatgcagagactgtgggaagagctttagccggagtgccaacctcataacccaccagaggatccacacgggggaaaagcccttccagtgtgccgagtgtggcaagagcttcagcaggagtcccaacctcattgcacatcagcgcacccacacaggagagaaaccctactcgtgccccgagtgtggaaagagctttggcaaccgatccagccttaacacgcatcaggggatccacactggagaaaagccctacgaatgtaaagaatgcggcgaaagctttagttacaactccaatctaatcagacaccagagaatccacacaggagagaaaccctacaaatgtaccgactgtgggcagaggttcagccagagttcagccctcatcacccaccggagaacccacacaggagagaaaccctaccagtgcagcgagtgtgggaaaagcttcagccgcagctctaacctggccacacaccggagaacccacatggtggagaagccctataagtgtggggtgtgtgggaagagcttcagccagagctccagtctgattgcacaccagggcatgcacacaggggagaaaccctacgagtgcctgacatgtggggagagcttcagctggagctccaacctcctcaagcaccagaggatccacacgggagagaaaccctacaaatgcagcgagtgtgggaaatgcttcagccagcgctcccagctcgtagtgcaccagcggacccacacgggcgagaagccctacaaatgcctcatgtgcggcaagagcttcagccggggctccattctggtcatgcaccagagagcccatttgggagacaagccctacaggtgccctgagtgtgggaaaggctttagctggaactcagtcctcattatacatcagcgaatccacactggggagaagccctacaaatgccccgagtgtggcaaaggcttcagcaacagctctaactttatcacacatcagagaactcacatgaaagagaaactttattgaagtggcaaagagtgaaagtgagggactggcctggagtgggagttgccacactgccccaacagtgattccctttcaaagagctgtgcttcctaaacattctggggggttttgccagagtcttccccttgctcatcctcatttccaggacactgtcattttagtggtctg

SEQ ID NO: 2755 - DNA, 460 bp, Homo sapiens
ctctcccgtccattgttctcggtgccccacgggcttgagccggggtgaatctggaggggccgggccgagcccgggggcgctttcgcacgcgaagcaaccgctagagcaggacctggtctcccgagaggtgatccgcccgcctcaacctgccaaagtgctaggattacaggtctgagccaccgcgcccggctcgggactacttgttgatatttgaggagggaagtgtcttacctgagagcctggctggagaagactgaggtccaaggcttgaagcctaagtgattgccccaggactgtggatgatggctgcagacatcccgagagtgaccactccgctgagctccttggtccaggtgcctcaagaggaagatagacaggaggaggaggtcaccaccatgatcctggaggatgactcctgggtgcaagaagctgtgctgcaggaggatggccctgagtctga

SEQ ID NO: 2756 - DNA, 2005 bp, Homo sapiens
acttccgggtgcgcggtcccgaggtacgcggtgcggtctcccggtacccggagcggctctgattcatggtttaacttgtggccctaaagaactggaaacccaaaggaacgaatattcctgccccacagagtcccatctttggtgaggctgtttctggagtttacatgatgaccaaggtactaggcatggccccagttctgggccctaggcctccacaggagcaggtggggcctctgatggtaaaagtcgaggagaaagaagagaaaggcaagtaccttcctagcctggagatgttccgccagcgcttcaggcagtttgggtaccatgatacccctggaccccgagaggccctgagccaactccgggtgctctgctgtgagtggctgaggcccgagatccacaccaaggagcagatcctggagctactggtgctggagcagttcctgaccatcctgccccaggagctccaggcctgggtgcaggagcattgcccggagagcgctgaagaggctgtcactctcctcgaagatctggagcgggaactggatgagccaggacaccaggtctcaactcctccaaacgaacagaaaccggtgtgggagaagatatcctcctcaggaactgcaaaggaatccccgagcagcatgcagccacagcccttggagaccagtcacaaatacgagtcttgggggcccctgtacatccaagagtctggtgaggagcaggagttcgctcaagatccaagaaaggtccgagattgcagattgagtacccagcacgaggaatcagcagatgagcagaaaggttctgaagcagaggggctcaaaggggatataatttctgtgattatcgccaataaacctgaggccagcttagagaggcagtgcgtaaaccttgaaaatgaaaaaggaacaaaaccccctcttcaagaggcaggctccaagaaaggtagagaatcagttcctactaaacctaccccaggagagagacgttatatatgtgctgaatgtggcaaagcctttagtaatagctcaaatctcaccaaacacaggagaacacacactggggagaaaccttacgtgtgcaccaagtgtgggaaagctttcagccacagctcaaacctcaccctccactacagaacacacttggtggaccggccctatgactgtaagtgtggaaaagcttttgggcagagctcagaccttcttaaacatcagagaatgcacacagaagaggcgccatatcagtgcaaagattgtggcaaggctttcagcgggaaaggcagcctcattcgtcactatcggatccacactggggagaagccttatcagtgtaacgaatgtgggaagagcttcagtcagcatgcgggcctcagctcccaccagagactccacaccggagagaagccatataagtgtaaggagtgtgggaaagccttcaaccacagctccaacttcaataaacaccacagaatccacaccggggaaaagccctactggtgtcatcactgtggaaagaccttctgtagcaagtccaatctttccaaacatcagcgagtccacactggagagggagaagcaccgtaactttcaagcgctcctgttgttgtcgttgttttaaactttagaatctgaaaaccagaaagaagtcttgtcattgcagcagcatcgattccggtgatagagtttgtatcactcaacatcaggggatgcctgaggagtgcgagctccacagcaacatggcaggcaggaggtcctcagaaggtgtcaggaggttccacactcgccagttcactggagcagagtcccttcgccacacttagggtcccagtaagccatgccagcattaccttttgcgtagttaaacagacgtgtatccagtctagttaaggaagaaacattaagattgtttaatttttaacatatattcaagaattttaatttgtaaagaattgagccacattgaacacaattgaatgagattcagaataaacttataacatctt

SEQ ID NO: 2757 - DNA, 1873 bp, Homo sapiens
attttcttaggtttaacttgtggccctaaagaactggaaacccaaaggaacgaatattcctgccccacagagtcccatctttggtgaggctgtttctggagtttacatgatgaccaaggtactaggcatggccccagttctgggccctaggcctccacaggagcaggtggggcctctgatggtaaaagtcgaggagaaagaagagaaaggcaagtaccttcctagcctggagatgttccgccagcgcttcaggcagtttgggtaccatgatacccctggaccccgagaggccctgagccaactccgggtgctctgctgtgagtggctgaggcccgagatccacaccaaggagcattgcccggagagcgctgaagaggctgtcactctcctcgaagatctggagcgggaactggatgagccaggacaccaggtctcaactcctccaaacgaacagaaaccggtgtgggagaagatatcctcctcaggaactgcaaaggaatccccgagcagcatgcagccacagcccttggagaccagtcacaaatacgagtcttgggggcccctgtacatccaagagtctggtgaggagcaggagttcgctcaagatccaagaaaggtccgagattgcagattgagtacccagcacgaggaatcagcagatgagcagaaaggttctgaagcagaggggctcaaaggggatataatttctgtgattatcgccaataaacctgaggccagcttagagaggcagtgcgtaaaccttgaaaatgaaaaaggaacaaaaccccctcttcaagaggcaggctccaagaaaggtagagaatcagttcctactaaacctaccccaggagagagacgttatatatgtgctgaatgtggcaaagcctttagtaatagctcaaatctcaccaaacacaggagaacacacactggggagaaaccttacgtgtgcaccaagtgtgggaaagctttcagccacagctcaaacctcaccctccactacagaacacacttggtggaccggccctatgactgtaagtgtggaaaagcttttgggcagagctcagaccttcttaaacatcagagaatgcacacagaagaggcgccatatcagtgcaaagattgtggcaaggctttcagcgggaaaggcagcctcattcgtcactatcggatccacactggggagaagccttatcagtgtaacgaatgtgggaagagcttcagtcagcatgcgggcctcagctcccaccagagactccacaccggagagaagccatataagtgtaaggagtgtgggaaagccttcaaccacagctccaacttcaataaacaccacagaatccacaccggggaaaagccctactggtgtcatcactgtggaaagaccttctgtagcaagtccaatctttccaaacatcagcgagtccacactggagagggagaagcaccgtaactttcaagcgctcctgttgttgtcgttgttttaaactttagaatctgaaaaccagaaagaagtcttgtcattgcagcagcatcgattccggtgatagagtttgtatcactcaacatcaggggatgcctgaggagtgcgagctccacagcaacatggcaggcaggaggtcctcagaaggtgtcaggaggttccacactcgccagttcactggagcagagtcccttcgccacacttagggtcccagtaagccatgccagcattaccttttgcgtagttaaacagacgtgtatccagtctagttaaggaagaaacattaagattgtttaatttttaacatatattcaagaattttaatttgtaaagaattgagccacattgaacacaattgaatgagattcagaataaacttataacatcttg

SEQ ID NO: 2758 - DNA, 820 bp, Homo sapiens
gaggtacgcggtgcggtctcccggtacccggagcggctctgattcatgtagagacggggtttcaccgtgttagccagaatggtctcgatctcctgacctcgtgatctgcccgcctcgggcctcccaaagtgctggaattacaggtgtgagccacggcgccgggccccctagggattttcaggtttaacttgtggccctaaagaactggaaacccaaaggaacgaatattcctgccccacagagtcccatctttggtgaggctgtttctggagtttacatgatgaccaaggtactaggcatggccccagttctgggccctaggcctccacaggagcaggtggggcctctgatggtaaaagtcgaggagaaagaagagaaaggcaagtaccttcctagcctggagatgttccgccagcgcttcaggcagtttgggtaccatgatacccctggaccccgagaggccctgagccaactccgggtgctctgctgtgagtggctgaggcccgagatccacaccaaggagcagatcctggagctactggtgctggagcagttcctgaccatcctgccccaggagctccaggcctgggtgcaggagcattgcccggagagcgctgaagaggctgtcactctcctcgaagatctggagcgggaactggatgagccaggacaccaggtctcaactcctccaaacgaacagaaaccggtgtgggagaagatatcctcctcaggaactgcaaaggaatccccgagcagcatgcagccacagcccttggagaccagtcacaaatacgagtcttgggggcccctgtacatccaa

SEQ ID NO: 2759 - DNA, 1984 bp, Homo sapiens
atgacgcacttccgggtgcgcggtcccgaggtacgcggtgcggtctcccggtacccggagcggctctgattcatgtagagacggggtttcaccgtgttagccagaatggtctcgatctcctgacctcgtgatctgcccgcctcgggcctcccaaagtgctggaattacaggtgtgagccacggcgccgggccccctagggattttcagagtcccatctttggtgaggctgtttctggagtttacatgatgaccaaggtactaggcatggccccagttctgggccctaggcctccacaggagcaggtggggcctctgatggtaaaagtcgaggagaaagaagagaaaggcaagtaccttcctagcctggagatgttccgccagcgcttcaggcagtttgggtaccatgatacccctggaccccgagaggccctgagccaactccgggtgctctgctgtgagtggctgaggcccgagatccacaccaaggagcagatcctggagctactggtgctggagcagttcctgaccatcctgccccaggagctccaggcctgggtgcaggagcattgcccggagagcgctgaagaggctgtcactctcctcgaagatctggagcgggaactggatgagccaggacaccaggtctcaactcctccaaacgaacagaaaccggtgtgggagaagatatcctcctcaggaactgcaaaggaatccccgagcagcatgcagccacagcccttggagaccagtcacaaatacgagtcttgggggcccctgtacatccaagagtctggtgaggagcaggagttcgctcaagatccaagaaaggtccgagattgcagattgagtacccagcacgaggaatcagcagatgagcagaaaggttctgaagcagaggggctcaaaggggatataatttctgtgattatcgccaataaacctgaggccagcttagagaggcagtgcgtaaaccttgaaaatgaaaaaggaacaaaaccccctcttcaagaggcaggctccaagaaaggagaacacacactggggagaaaccttacgtgtgcaccaagtgtgggaaagctttcagccacagctcaaacctcaccctccactacagaacacacttggtggaccggccctatgactgtaagtgtggaaaagcttttgggcagagctcagaccttcttaaacatcagagaatgcacacagaagaggcgccatatcagtgcaaagattgtggcaaggctttcagcgggaaaggcagcctcattcgtcactatcggatccacactggggagaagccttatcagtgtaacgaatgtgggaagagcttcagtcagcatgcgggcctcagctcccaccagagactccacaccggagagaagccatataagtgtaaggagtgtgggaaagccttcaaccacagctccaacttcaataaacaccacagaatccacaccggggaaaagccctactggtgtcatcactgtggaaagaccttctgtagcaagtccaatctttccaaacatcagcgagtccacactggagagggagaagcaccgtaactttcaagcgctcctgttgttgtcgttgttttaaactttagaatctgaaaaccagaaagaagtcttgtcattgcagcagcatcgattccggtgatagagtttgtatcactcaacatcaggggatgcctgaggagtgcgagctccacagcaacatggcaggcaggaggtcctcagaaggtgtcaggaggttccacactcgccagttcactggagcagagtcccttcgccacacttagggtcccagtaagccatgccagcattaccttttgcgtagttaaacagacgtgtatccagtctagttaaggaagaaacattaagattgtttaatttttaacatatattcaagaattttaatttgtaaagaattgagccacattgaacacaattgaatgagattcagaataaacttataacatcttgt

SEQ ID NO: 2760 - DNA, 3126 bp, Homo sapiens
ctgcggttgtcaaggattcagagcagatgtgatctgcgctaggtggcatctcctctcacggatgcctcgatctcggggtttccagaagaaaagatcaagggagaattatcaagaatagattatttttctgaatagttaaacctttgatggccataaccttgacccttcagactgcagagatgcaggaaggacttctggcagtgaaggtaaaggaggaagaggaggaacattcctgtgggccagaatcaggcctgtcaagaaataaccctcataccagagagatctttcgtagacgcttcaggcagttctgctatcaggagtcccctgggccccgggaggctcttcaaagactccaggagctctgccatcagtggctgagaccagagatgcacaccaaggagcagatcctagagctgctggtgctggagcagttcctgactatcctgcctgaggagctccaggcctgggtcagacagcaccgtcctgtgagtggagaggaggcagtgactgtgctggaggatttggagagagagctggatgacccaggagagcaggtcctgagccatgctcatgaacaggaagagtttgtaaaggagaaggcaactccaggagcagctcaggagtcatcaaatgaccaattccaaaccttggaagagcaacttgggtataatttgcgagaggtgtgcccagttcaagagattgatggcaaggctgggacttggaatgtggagttagccccaaagagggagatttctcaggaagtgaaatctcttatacaagttcttggaaaacagaatggtaatattactcagattcctgagtatggagatacctgtgaccgtgagggcagattggaaaagcaaagggtgagctcttcagtggagagaccctatatctgtagtgaatgtggaaaaagcttcacccagaattccatccttatcgagcaccagagaacacacacaggtgagaagccttatgaatgtgatgagtgtgggcgggccttcagccagaggtcaggcctattccagcaccagagactccacactggggagaagcgctaccagtgcagtgtttgtggcaaagccttcagccagaatgccgggcttttccatcacctcagaattcacactggggagaagccttaccagtgcaatcagtgcaataagagttttagtcgacgttcagtcctcattaagcatcagagaattcacactggagagagaccttatgaatgtgaagaatgtggcaagaacttcatttaccattgcaacctaatccagcatcggaaagtccacccagtggctgaatcaagctagctccttggaacaggtaggggataatatttcttactttgtccctgctgtgtcctctagcatagaaaagttcaagggaaagccagtaaaaattcccttacttttatgcagagagaagcataatatcttaaatacatctgccgagttctctgatcagtgacatccacagctttgcaatactgaatgttgcctcttgtgttgatttcatcatgtatgctgtagacctagtttcacacacatctgtgcaagaagttttctatttcaggaaaacttcttcatcctagtttttaaaaactttttttaaaagtttaaaatagttatatgtaggctgagtacaaaataatctcaaatgcagttcaccgagtatttaaaaattaacttaaaaataattgtaataaaattcataatataggtttcctgacttctttccattcacataaaatatgataatttgttttgtaacctacaaaaaggggcagatgaatcctcctatataaatgtagatttatagtaagttagatttctatagattttttagttagcctttaggaaccaaggaactgaagcagccatatgttattagcagctcagtggctcctcataacaaatattgctcatgattttaaatttacgcagaggctaagaaacttagctaaaaatctgatatctcacctcagatttcttattggaaaatacaggcctctttgtatttttcccgtaacatataatgagcatttttttgtttttgcctttttctcctttattcaatattttgtatggaaaatttgaaacatattcaagattgaagagaagagtatgatcactctttcatgttgattgtttttataacctccacattttctcagcatttactattgattaccaccaagatcataaataaaaaaatttatttcccttaacattgacttagtaactctttacaaagctttacacaaggtccaggagacaaagaaatggaaaacctatggtgaaaacaatctggtttggaatacacccaaatacccaatacatagcaagtaactttagaataacagaatcactctaagggaccttagagatcacttctgcttgctcttatttgacagataagagaaaaggaagttctgggaagtaactaagatcatacagccagttaaaagcagagctggaactagaaccctgtctcctacttcctagtgtaacattctattaagccactggaggcattatatcaccaaataaaaattacaagtatatggaatttataggatttataagtcactgaagttgctcaacaaacccacccatttatatgtttcaataaagcacaactcctctatttaatttacagtggagtccaggaaagactcttctcatttattcctcattgaaagcattttatttttgtaattattatttttagcttttaaaatttaatttactcagtaggacttttttaaaaagataattcattcttcacctggttcaaaaatcaaaataatacaaaaaggtctactttccctttataagtagccattgtactagtttcttatgtatctttcagtgtttctttatgtaaatataggcaaatatgaatgtataatcttatttcttccattactcaggaagatggcatattatttatactcttctaataccttgctgttttcatgaaagaatataatctttagagatgtccacatcataacagaacttcttcattctttttataagtgaatagaattttatttgttcatactccatagtttaacaaactcctatagatgaaaaatctcactattttaaaatgtta

SEQ ID NO: 2761 - DNA, 4440 bp, Homo sapiens
attccttctgatagtgccatctttctctgccctaggaagaaacacctcttacagtcatctgcaggggattctccaaggacatgggaagatagatgtaagccctggaacccagactcctaagcgaagggaagctgcattctgctattaatgatggccaaatcagctctaagagagaatggcactaactctgagaccttccgacagcgtttcaggagattccattaccaggaggtggctgggccgcgggaggctttcagccaactctgggaactttgctgtcggtggctaaggccggaggtgcgcaccaaggagcagattgtagaactgttggtgctagagcagttcctgaccgtcttacctggggagatccagaattgggtacaggaacaatgtccagaaaatggagaggaggcagtgactctcgtggaagatttagaaagagagcctggaagacctagatcttcggtcacagtctctgtgaaggggcaggaagtgcgcttggagaagatgacacccccgaaatcatcacaagagttattaagtgttcggcaggagtcagtggaaccccagcccaggggtgtacccaagaaagagagggcaagaagcccagacctgggaccacaggagcagatgaacccaaaggagaagctcaaaccttttcaaaggagcggttttgaagctggatttgagaatgaagataattcaaaacgggatatttctgaggaagtacaactgcataggacattacttgcaagatctgaaaggaaaattccccggtatcttcatcagggtaaaggcaatgagagtgactgtagatcaggaagacagtgggcaaagacctcaggggagaaaagaggaaaactgacactcccggagaagagcttaagtgaagtcctaagtcaacagagaccttgcttgggagagagaccctataaatatctcaaatacagcaaaagctttggtccaaactcccttctcatgcatcaggtatcccaccaggtggaaaatccatataaatgtgctgattgtgggaaaagcttcagtcggagtgcacgactcattagacaccggagaatccacactggagagaaaccttataaatgtcttgactgtggaaaaagtttccgtgacagttcaaatttcatcacccataggagaatccacacaggagagaaaccttatcaatgtggtgagtgtgggaaatgcttcaatcagagctcaagccttatcattcaccagagaacccacacaggagaaaagccctatcaatgtgaagagtgtggaaaaagcttcaataacagttctcattttagtgcacatcggaggatacacacaggagagagaccccatgtgtgtcctgactgtggaaagagtttcagtaagagttctgacttacgtgcacatcatagaacccacacaggagagaaaccctatgggtgtcatgactgtggtaagtgcttcagtaaaagctctgcccttaataagcacggagaaatccatgcacgggaaaagcttctgacacagtcagctcccaagtaagcccctgaggatatataacggaaagaggctcaataaatgtattgtttagaaagtcttccaatagtgagattcatctactattctgtgtccagttagcttaggaaattcactttaggatttatgccactgtttgttccttgtttttcctgatctagactcaaatccccaaggcagtctaaagaatgaaaggaagatttcagtccctctctttgcctgcatctgaattgatggataacatcttttccctctcagtgcctatggtgttcccttaatataagcacagaggacaaggtaatagatcctatgaatttgataagcatccttctttactcattctgtcattcagctgcattttgacaggaaaaacccattacatttcgagaagaagttatgagactttgcccattaggtgggtctagctcttttttttttttttggagacggagttttgctcttgttgcccaggctggagtgcaatggcacgatctcagctcactgcaacctctgcttcccgggttcaagtgattctcctgcctcagcctcccaagtggctggaattacaagcatgcgccaccatgcccagctaattttatatttttagtagagatggggtttctccatgttgggcaggctggtctcaaactcccgacctcaggtgatctgcctgcctcggcctcccaaagtgctgggattacaggcatgagccactgcgccgggcttttttttttcgagatggagtctcactctgtcgtccaggctggagtgcagtggcatgatctcagctcactgcaacctctgccttctgggttcaaacaattttcctgcctcagcctcctgagtagctgggattacagccacctgccaccataccaggctaaattttgcatttttagtagagatggggtttcaccatgttggccaggctggttttgaattgacctcatgatctgcctgcctaggtctcccaaagtgctgggattacaggtgtgagccactgcacccggcccagctcttctttatacaataatggaaatgctaaaatgaatgactcttcctgctcacttaaacctgtgctcaaaatgacatatttgtcaggcaccctcttcatttaccttaaagaaggagagtttaatgtccatcttggttctgccctatgaatcatcttgtcaagaacaggtgttcttatgcagaaacaatgaaaaccttatactgaagtgtgaaccctggatttcttagtttcttctgagtcctagaagaagggttggaatagaataatacatttacaggatttaggttggttttctttctgtccagtctcatctgaatttcgtctgtctcttgtggtccagaagttccacagagcaacgcagctgcatgtggtgacaggtagagcagttaaagctgccaataggaactcgtccatattccacacacctggtatagtgttatgccctccatgggcacttacctgcaataagcagaagccactgccacattcccgtgtattgggaaaatggactactgtgtgcgaacaggccctttaccctaatggcagggaagatggattatctttggccagtggagctgccaatctagacatacacattcaactgaatacaattaaaagcagttctttaaatgcaaatataattactcatctttataatacaatagtattaactgcccatatgctcatagtatgatgagccctgtatagcacaaggtcaacaggtcctctccttgtccttacaatctaaagcagatgacactgacatggacaaacaagtgcacatgcatagttgcggcagttttagagaaatctagaaagctaggtagcaacactatgcataaatgttgtggtccaatgcattagtttgctttaacaaaaatctgggaggtattttttctctttattcaggaaggcttcatgaagcaggaagtggtcaaaggagggaaggttactggttaaattatgataggaagaactttccataactagttgcaaaattgagtgctgggtgggttgaggaatgggaaaaagggggagcaaggtgttttgtgtagatggaacaaagggcaaaggatagactgtaaggaaggccagataaagcttggagtagcatgagaacttgaggaatagtatgatatgggctgtgcagcaggcagagagaatcaccttagctgaaacatgggtgttaggagcagaccatgaggtggtagaaccatcatctatagtaaatcaggtactacgctataactattgataaggaaacagctgactgccactgaaagaataagcagttttaggggactagctcctatgggagataaaggtcagaaatcgtagtatctgatgaagatattttgatgagcaggtgagaagaaagataaacatggccagatggccaaggactgggataagtagccgtttcacattcaattagaattctgtggctggaataagatcagggagagcagtaggaagatatagtattctataattcatagcttgttgtgttagagattaattaggattctgctgttgaatcttagtacaaaaaaatctaatatttattaggaattaagggaagatggtacttctgttatgttgcctaagcagacaggaagctacaagaaacaccagtctgaagcagtgcctcaggatctcagatgatttaggaagtgtgctgtaatgtcaaaaaaaaaaaaaagtattgtctttagtatatctatgtatagtctcgtgggaaaagcattggttgtggtatcaacagatattctggttccagatgtcttgtaagttaacctgcctccatttccctttctgtaaagcaaaataatgtttacacctaatctgtctctcagggataccatattaataaaaatcatgtctataaagtg

SEQ ID NO: 2762 - DNA, 5595 bp, Homo sapiens
agtgccatctttctctgccctaggaagaaacacctcttacagtcatctgcaggggattctccaaggacatgggaagatagatgtaagccctggaacccagactcctaagcgaagggaagctgcattctgctattaatgatggccaaatcagctctaagagagaatggcactaactctgagaccttccgacagcgtttcaggagattccattaccaggaggtggctgggccgcgggaggctttcagccaactctgggaactttgctgtcggtggctaaggccggaggtgcgcaccaaggagcagattgtagaactgttggtgctagagcagttcctgaccgtcttacctggggagatccagaattgggtacaggaacaatgtccagaaaatggagaggaggcagtgactctcgtggaagatttagaaagagagcctggaagacctagatcttcggtcacagtctctgtgaaggggcaggaagtgcgcttggagaagatgacacccccgaaatcatcacaagagttattaagtgttcggcaggagtcagtggaaccccagcccaggggtgtacccaagaaagagagggcaagaagcccagacctgggaccacaggagcagatgaacccaaaggagaagctcaaaccttttcaaaggagcggattgccatttcctaaatccggtgtggtctccaggttggagcaaggagagccatggatcccagatctgctgggctctaaggagaaagaacttccaagtggcagccacataggagacagacgagtgcatgctgatctgttaccatccaagaaagatagaagaagctgggtggaacaggatcactggagctttgaagatgagaaggtggcaggtgtgcactggggctatgaagagaccagaacgctcctcgcaattctcagccagactgagttttatgaggctctcagaaactgccataggaacagccaagtgtatggggctgtggctgagcggctcagggaatatggcttcctccggaccctggaacagtgtcggaccaagttcaaaggtctccagaagagctatcggaaagtcaagagcggccacccacctgagacctgccccttctttgaagagatggaagccctgatgagtgctcaggtcattgccctgcccagtaatggcctggaagcagcagcctctcactctggcctggtaggcagcgatgctgagactgaagagccagggcagaggggctggcagcatgaggagggagcagaagaggctgtggctcaggagtctgacagtgatgacatggatctagaggcgaccccccaggaccccaactcagctgcacctgttgtgttcagaagcccaggtggtgtacactggggctatgaagagaccaagacttaccttgcaattcttagtgagacccagttttatgaagccctccggaactgtcaccgcaacagccagctgtatggagcagtggctgagaggttatgggaatatggctttcttaggaccccagaacagtgtcggaccaagtttaaaagcctgcaaaccagctatcggaaagttaagaatggccaggcaccagagacctgtcccttctttgaagagatggatgctttggtgagtgtccgggttgctgccccacccaatgatggccaggaagagactgcttcttgccccgtccaggggaccagtgaggctgaagctcagaagcaagctgaggaagcagacgaggccacagaggaagattctgatgatgatgaagaggatactgagatacccccaggggctgtcataacccgtgctccagtgttattccaaagcccccgtggttttgaagctggatttgagaatgaagataattcaaaacgggatatttctgaggaagtacaactgcataggacattacttgcaagatctgaaaggaaaattccccggtatcttcatcagggtaaaggcaatgagagtgactgtagatcaggaagacagtgggcaaagacctcaggggagaaaagaggaaaactgacactcccggagaagagcttaagtgaagtcctaagtcaacagagaccttgcttgggagagagaccctataaatatctcaaatacagcaaaagctttggtccaaactcccttctcatgcatcaggtatcccaccaggtggaaaatccatataaatgtgctgattgtgggaaaagcttcagtcggagtgcacgactcattagacaccggagaatccacactggagagaaaccttataaatgtcttgactgtggaaaaagtttccgtgacagttcaaatttcatcacccataggagaatccacacaggagagaaaccttatcaatgtggtgagtgtgggaaatgcttcaatcagagctcaagccttatcattcaccagagaacccacacaggagaaaagccctatcaatgtgaagagtgtggaaaaagcttcaataacagttctcattttagtgcacatcggaggatacacacaggagagagaccccatgtgtgtcctgactgtggaaagagtttcagtaagagttctgacttacgtgcacatcatagaacccacacaggagagaaaccctatgggtgtcatgactgtggtaagtgcttcagtaaaagctctgcccttaataagcacggagaaatccatgcacgggaaaagcttctgacacagtcagctcccaagtaagcccctgaggatatataacggaaagaggctcaataaatgtattgtttagaaagtcttccaatagtgagattcatctactattctgtgtccagttagcttaggaaattcactttaggatttatgccactgtttgttccttgtttttcctgatctagactcaaatccccaaggcagtctaaagaatgaaaggaagatttcagtccctctctttgcctgcatctgaattgatggataacatcttttccctctcagtgcctatggtgttcccttaatataagcacagaggacaaggtaatagatcctatgaatttgataagcatccttctttactcattctgtcattcagctgcattttgacaggaaaaacccattacatttcgagaagaagttatgagactttgcccattaggtgggtctagctcttttttttttttttggagacggagttttgctcttgttgcccaggctggagtgcaatggcacgatctcagctcactgcaacctctgcttcccgggttcaagtgattctcctgcctcagcctcccaagtggctggaattacaagcatgcgccaccatgcccagctaattttatatttttagtagagatggggtttctccatgttgggcaggctggtctcaaactcccgacctcaggtgatctgcctgcctcggcctcccaaagtgctgggattacaggcatgagccactgcgccgggcttttttttttcgagatggagtctcactctgtcgtccaggctggagtgcagtggcatgatctcagctcactgcaacctctgccttctgggttcaaacaattttcctgcctcagcctcctgagtagctgggattacagccacctgccaccataccaggctaaattttgcatttttagtagagatggggtttcaccatgttggccaggctggttttgaattgacctcatgatctgcctgcctaggtctcccaaagtgctgggattacaggtgtgagccactgcacccggcccagctcttctttatacaataatggaaatgctaaaatgaatgactcttcctgctcacttaaacctgtgctcaaaatgacatatttgtcaggcaccctcttcatttaccttaaagaaggagagtttaatgtccatcttggttctgccctatgaatcatcttgtcaagaacaggtgttcttatgcagaaacaatgaaaaccttatactgaagtgtgaaccctggatttcttagtttcttctgagtcctagaagaagggttggaatagaataatacatttacaggatttaggttggttttctttctgtccagtctcatctgaatttcgtctgtctcttgtggtccagaagttccacagagcaacgcagctgcatgtggtgacaggtagagcagttaaagctgccaataggaactcgtccatattccacacacctggtatagtgttatgccctccatgggcacttacctgcaataagcagaagccactgccacattcccgtgtattgggaaaatggactactgtgtgcgaacaggccctttaccctaatggcagggaagatggattatctttggccagtggagctgccaatctagacatacacattcaactgaatacaattaaaagcagttctttaaatgcaaatataattactcatctttataatacaatagtattaactgcccatatgctcatagtatgatgagccctgtatagcacaaggtcaacaggtcctctccttgtccttacaatctaaagcagatgacactgacatggacaaacaagtgcacatgcatagttgcggcagttttagagaaatctagaaagctaggtagcaacactatgcataaatgttgtggtccaatgcattagtttgctttaacaaaaatctgggaggtattttttctctttattcaggaaggcttcatgaagcaggaagtggtcaaaggagggaaggttactggttaaattatgataggaagaactttccataactagttgcaaaattgagtgctgggtgggttgaggaatgggaaaaagggggagcaaggtgttttgtgtagatggaacaaagggcaaaggatagactgtaaggaaggccagataaagcttggagtagcatgagaacttgaggaatagtatgatatgggctgtgcagcaggcagagagaatcaccttagctgaaacatgggtgttaggagcagaccatgaggtggtagaaccatcatctatagtaaatcaggtactacgctataactattgataaggaaacagctgactgccactgaaagaataagcagttttaggggactagctcctatgggagataaaggtcagaaatcgtagtatctgatgaagatattttgatgagcaggtgagaagaaagataaacatggccagatggccaaggactgggataagtagccgtttcacattcaattagaattctgtggctggaataagatcagggagagcagtaggaagatatagtattctataattcatagcttgttgtgttagagattaattaggattctgctgttgaatcttagtacaaaaaaatctaatatttattaggaattaagggaagatggtacttctgttatgttgcctaagcagacaggaagctacaagaaacaccagtctgaagcagtgcctcaggatctcagatgatttaggaagtgtgctgtaatgtcaaaaaaaaaaaaaagtattgtctttagtatatctatgtatagtctcgtgggaaaagcattggttgtggtatcaacagatattctggttccagatgtcttgtaagttaacctgcctccatttccctttctgtaaagcaaaataatgtttacacctaatctgtctctcagggataccatattaataaaaatcatgtctataaagtg

SEQ ID NO: 2763 - DNA, 4128 bp, Homo sapiens
attaacccccgaaccgccgcgagctgtccctagcagtgccttagccagggacctgcttggccagcgacagatcctttgctgctctgtctgccggttcttgaggtgaatgtcggaatccattatctttcgggaaagctctctggggcagggagcgtcctggggagttggaattcagaaggaatctctcagacgcaaatctccatctcctccctgcctcacctgggcagccttttcagactgtctctgcccagaatgtcaggagaggccacagtcttggcctaccatgctccagaagaacaggaaggacttctagttgtcaaggttgaagaagaaaattatgttttggaccaggactttggccttcaggaaaacccctggagccaagaggtattccggcagaagttcaggcagtttagttactctgactccactggccctcgggaggctctgagccggctgcgagagctttgctgtcagtggttgaggccggaggtgcactccaaggagcagatcctggagctgctgatgttggagcagttcctggccatccttcctgaggagctgcaagcttggctgcgagagcatcggccagagaatggagaggaagctgtgactatgctggaggagctggaaaaagaactggaggagccaaggcaacaggacacaactcatggccaagaaatgttctggcaggaaatgacatccacaggagcactgaagtctctgtctctgaatagcccggtgcagcccttagagaaccagtgcaagactgagactcaggagtcccaggctttccaggagagagatggcaggatggtggctggcaaagtgttgatggcaaagcaagaaattgttgaatgtgtagcctcagcagctatgatatcgccgggaaaacttcctggagaaacacattcccaacggatagctgaagaagctttgggaggtctggacaactctaagaagcaaaagggaaatgctgcagggaacaaaatcagtcagcttccttcccaggacagacatttcagtctggcaaccttcaacagaagaatccccacagaacacagtgtccttgaatctcatgagagtgaaggaagtttcagtatgaattcaaatgatattacacaacagagcgttgacactagggaaaagctctatgagtgctttgactgtgggaaggccttttgccagagctcaaagctgattagacatcagagaattcatactggagagagaccttatgcatgtaaagaatgtggcaaagccttcagtttgagctcagaccttgttagacatcagagaattcatagtggtgaaaaaccctatgaatgttgtgaatgtggaaaagccttcaggggcagttcagagctcatcaggcatcggagaatccacactggagagaagccttatgaatgtggagaatgtgggaaggccttcagccggagctcagcccttattcagcataagaaaattcacactggagataaaagctatgaatgtattgcatgtggtaaggcttttggtaggagttctatccttattgaacatcaaagaattcacactggagagaaaccttatgaatgtaatgaatgtggaaaatccttcaatcagagctcagccctcacccagcaccagagaattcacactggagagaagccttatgaatgtagtgaatgtagaaaaacatttaggcataggtcaggccttatgcagcatcagagaacacacaccagagtttaactctgtgggtaagagttgtacaattgtgaaatgcaaggagttcactgtaggggtgagactccacagaaaagaaaagtttcctgagagcagaacttctgtccttccctcccagttcggtactataagaagacatgcacacaaagatgtttgttatgattattgaagtgttaaatggaagaaaaatgttacccaagtcttctccaaaaagaatggtagatatttccttgaaatgcctaacccatttctggatgagactcatcaatatccccttcactccactctctgccaactcagatataatttccattgggcaccttcacagtaatgccaggattggggcagagatcctgaaagagcttcttataagatggcaaatgtgcctggcaagagcatttgtattttgtcaggtggaggcatgtgctgagagttattcaactatctgaaatgttgaatttggaggttgtgaaaatattgaattatgctattagtttaataatatctgaggcagtaaaatagtacctgaggaatggtgcctcattctgcccccttgccagttgtctcctcaatcctgagcttcctgctgaggttaattcaagtctactagtttattgagcacctgctatgtgctaggcattgaggtagacctggtcattgccctcccagagttaagggctaataggatatgcatatatactaaacagtaattacagtaaagtgtggtaagtgctttggtaggaaaaatgcgggtttccatcaaagtacatggcagggatacctaaatctggtctatgagtcactaaagacttcctggatatgatggtatctcagacataaaggtgggtagaaggtagcaagggcaggggagaagagaacaggatctggagacactccatgaagactcttctctactgcagaaattgtcatagacctaatttttaaaaaaatgaatctgaaggagtaattcaacaaatatttattgccctcaagtataatagctcagggcctgcaagcctggtaaggaggggtgtgggcagggaatggggaatagcagagcctgggaaggcagatcaccgtgttcctttatacttcccactgcctgagtcccagagtcatgggacacaaacactccagtccccactgtctctctagcctctgatatgcattctttccctgtgtatatacatgccttttcccataaaatgcaccagtctctcaccacactaattctgagtacttcagagtctcacaggtcattctgggtctagaataggctccccaactcagtgattataagtaggaagaggaaaagcaacacatggggattctgagccaggctttatgacaactaattcctgctggagagaagagtcctgatgatgggctgtctccagatcctatcttatcttcatgccattgtatgggctataacctctgcctgtaactctctctgctaatttttattttggcagttttaattaacccacaattgctgagggcaattaatacctaaaagaaagtttgattcctcttctaagatatcctaggtagtgtcatttctaaagaagacttggtgatcactgcttgtattagtccattttcacagtgctatgaagatactacctgatactgggtaatttattaaaaaaaaaaaagaggtttaattgactgacagttctgcagggctggggaggcctcaggaaacttaaatcatggtggaaggcgaaggggaagcaagcaccttcttcacaaggtggcaagagagagtgcaggggaaatgctaggcacttatcaatcagccaaatctcatgagaattcactatcatgagaacaagggggaaatctgctcccatgatctaatcacctcccaccacgaccctccctcaacacctggggattactattggagatttgggtggggacacaagagccaaaccatatcactgctgttgtgggtaataggggaggtgaaattggggggacaattcggcctctttgtgtccagaggttgtgcagttatcgagtgaggtcgatcagaagtctaaagggatctttcaaatggatagtgagttgccttttcctataggtgacaatcagagatttaatgttttaagtatcatataataggtttttctcctgattgtgaattgtaagtgttggtaatacagaaaatgagaaagtataaaccacccccaatcccaatgcccatagaaacgttgttaacattttggagtactttctattagtgtttatttttcccaatcctagtatttttagtaaaactactgtttagtaaatgatttttggtaactaatttcaaaatttatacttcaaccgtttattattagaatgtaatgcaagatgtattgcaataaaacttgagttttaaaagtt

SEQ ID NO: 2764 - DNA, 1281 bp, Homo sapiens
caagaggtattccggcagaagttcaggcagtttagttactctgactccactggccctcgggaggctctgagccggctgcgagagctttgctgtcagtggttgaggccggaggtgcactccaaggagcagatcctggagctgctgatgttggagcagttcctggccatccttcctgaggagctgcaagcttggctgcgagagcatcggccagagaatggagaggaagctgtgactatgctggaggagctggaaaaagaactggaggagccaaggcaacaggtaagaagtaaacattttttttgtgttcctgctacaacagtttcttctgtcatgggaagtaaaatacttacactttctattcacatttttagatggcaggatggtggctggcaaagtgttgatggcaaagcaagaaattcctcagcagctatgatatcgccgggaaaacttcctggagaaacacattcccaacggatagctgaagaagctttgggaggtctggacaactctaagaagcaaaagggaaatgctgcagggaacaaaatcagtcagcttccttcccaggacagacatttcagtctggcaaccttcaacagaagaatccccacagaacacagtgtccttgaatctcatgagagtgaaggaagtttcagtatgaattcaaatgatattacacaacagagcgttgacactagggaaaagctctatgagtgctttgactgtgggaaggccttttgccagagctcaaagctgattagacatcagagaattcatactggagagagaccttatgcatgtaaagaatgtggcaaagccttcagtttgagctcagaccttgttagacatcagagaattcatagtggtgaaaaaccctatgaatgttgtgaatgtggaaaagccttcaggggcagttcagagctcatcaggcatcggagaatccacactggagagaagccttatgaatgtggagaatgtgggaaggccttcagccggagctcagcccttattcagcataagaaaattcacactggagataaaagctatgaatgtattgcatgtggtaaggcttttggtaggagttctatccttattgaacatcaaagaattcacactggagagaaaccttatgaatgtaatgaatgtggaaaatccttcaatcagagctcagccctcacccagcaccagagaattcacactggagagaagccttatgaatgtagtgaatgtagaaaaacatttaggcataggtcaggccttatgcagcatcagagaacacacacc

SEQ ID NO: 2765 - DNA, 1122 bp, Homo sapiens
attaacccccgaaccgccgcgagctgtccctagcagtgccttagccagggacctgcttggccagcgacagatcctttgctgctctgtctgccggttcttgaggtgaatgtcggaatccattatctttcgggaaagctctctggggcaggcgcgtcaaccgcttgtactctgcgatgcccccgccaggtctgagccggacccgcgcccctcctgcgagacacgacccgcgcctgccacagagctgcggtcctccgggctcctagaggggcactctcccacttccggcgcgcgtgcggccgggcattgttctcgctcccgggggtgggttcccgccgccgccggtagagcgaagggagcgtcctggggagttggaattcagaaggaatctctcagacgcaaatctccatctcctccctgcctcacctgggcagccttttcagactgtctctgcccagaatgtcaggagaggccacagtcttggcctaccatgctccagaagaacaggaaggacttctagttgtcaaggttgaagaagaaaattatgttttggaccaggactttggccttcaggaaaacccctggagccaagaggtattccggcagaagttcaggcagtttagttactctgactccactggccctcgggaggctctgagccggctgcgagagctttgctgtcagtggttgaggccggaggtgcactccaaggagcagatcctggagctgctgatgttggagcagttcctggccatccttcctgaggagctgcaagcttggctgcgagagcatcggccagagaatggagaggaagctgtgactatgctggaggagctggaaaaagaactggaggagccaaggcaacaggacacaactcatggccaagaaatgttctggcaggaaatgacatccacaggagcactgaagtctctgtctctgaatagcccggtgcagcccttagagaaccagtgcaagactgagactcaggagtcccaggctttccaggagagagatggggtctcactctatcacccaggttggagtgcagtggtgcaaccacagctcactgcagcagccttgaacccctgggttaaagtgatcctcctgcctcagcctccagagtag

SEQ ID NO: 2766 - DNA, 4332 bp, Homo sapiens
attaacccccgaaccgccgcgagctgtccctagcagtgccttagccagggacctgcttggccagcgacagatcctttgctgctctgtctgccggttcttgaggtgaatgtcggaatccattatctttcgggaaagctctctggggcaggcgcgtcaaccgcttgtactctgcgatgcccccgccaggtctgagccggacccgcgcccctcctgcgagacacgacccgcgcctgccacagagctgcggtcctccgggctcctagaggggcactctcccacttccggcgcgcgtgcggccgggcattgttctcgctcccgggggtgggttcccgccgccgccggtagagcgaagggagcgtcctggggagttggaattcagaaggaatctctcagacgcaaatctccatctcctccctgcctcacctgggcagccttttcagactgtctctgcccagaatgtcaggagaggccacagtcttggcctaccatgctccagaagaacaggaaggacttctagttgtcaaggttgaagaagaaaattatgttttggaccaggactttggccttcaggaaaacccctggagccaagaggtattccggcagaagttcaggcagtttagttactctgactccactggccctcgggaggctctgagccggctgcgagagctttgctgtcagtggttgaggccggaggtgcactccaaggagcagatcctggagctgctgatgttggagcagttcctggccatccttcctgaggagctgcaagcttggctgcgagagcatcggccagagaatggagaggaagctgtgactatgctggaggagctggaaaaagaactggaggagccaaggcaacaggacacaactcatggccaagaaatgttctggcaggaaatgacatccacaggagcactgaagtctctgtctctgaatagcccggtgcagcccttagagaaccagtgcaagactgagactcaggagtcccaggctttccaggagagagatggcaggatggtggctggcaaagtgttgatggcaaagcaagaaattgttgaatgtgtagcctcagcagctatgatatcgccgggaaaacttcctggagaaacacattcccaacggatagctgaagaagctttgggaggtctggacaactctaagaagcaaaagggaaatgctgcagggaacaaaatcagtcagcttccttcccaggacagacatttcagtctggcaaccttcaacagaagaatccccacagaacacagtgtccttgaatctcatgagagtgaaggaagtttcagtatgaattcaaatgatattacacaacagagcgttgacactagggaaaagctctatgagtgctttgactgtgggaaggccttttgccagagctcaaagctgattagacatcagagaattcatactggagagagaccttatgcatgtaaagaatgtggcaaagccttcagtttgagctcagaccttgttagacatcagagaattcatagtggtgaaaaaccctatgaatgttgtgaatgtggaaaagccttcaggggcagttcagagctcatcaggcatcggagaatccacactggagagaagccttatgaatgtggagaatgtgggaaggccttcagccggagctcagcccttattcagcataagaaaattcacactggagataaaagctatgaatgtattgcatgtggtaaggcttttggtaggagttctatccttattgaacatcaaagaattcacactggagagaaaccttatgaatgtaatgaatgtggaaaatccttcaatcagagctcagccctcacccagcaccagagaattcacactggagagaagccttatgaatgtagtgaatgtagaaaaacatttaggcataggtcaggccttatgcagcatcagagaacacacaccagagtttaactctgtgggtaagagttgtacaattgtgaaatgcaaggagttcactgtaggggtgagactccacagaaaagaaaagtttcctgagagcagaacttctgtccttccctcccagttcggtactataagaagacatgcacacaaagatgtttgttatgattattgaagtgttaaatggaagaaaaatgttacccaagtcttctccaaaaagaatggtagatatttccttgaaatgcctaacccatttctggatgagactcatcaatatccccttcactccactctctgccaactcagatataatttccattgggcaccttcacagtaatgccaggattggggcagagatcctgaaagagcttcttataagatggcaaatgtgcctggcaagagcatttgtattttgtcaggtggaggcatgtgctgagagttattcaactatctgaaatgttgaatttggaggttgtgaaaatattgaattatgctattagtttaataatatctgaggcagtaaaatagtacctgaggaatggtgcctcattctgcccccttgccagttgtctcctcaatcctgagcttcctgctgaggttaattcaagtctactagtttattgagcacctgctatgtgctaggcattgaggtagacctggtcattgccctcccagagttaagggctaataggatatgcatatatactaaacagtaattacagtaaagtgtggtaagtgctttggtaggaaaaatgcgggtttccatcaaagtacatggcagggatacctaaatctggtctatgagtcactaaagacttcctggatatgatggtatctcagacataaaggtgggtagaaggtagcaagggcaggggagaagagaacaggatctggagacactccatgaagactcttctctactgcagaaattgtcatagacctaatttttaaaaaaatgaatctgaaggagtaattcaacaaatatttattgccctcaagtataatagctcagggcctgcaagcctggtaaggaggggtgtgggcagggaatggggaatagcagagcctgggaaggcagatcaccgtgttcctttatacttcccactgcctgagtcccagagtcatgggacacaaacactccagtccccactgtctctctagcctctgatatgcattctttccctgtgtatatacatgccttttcccataaaatgcaccagtctctcaccacactaattctgagtacttcagagtctcacaggtcattctgggtctagaataggctccccaactcagtgattataagtaggaagaggaaaagcaacacatggggattctgagccaggctttatgacaactaattcctgctggagagaagagtcctgatgatgggctgtctccagatcctatcttatcttcatgccattgtatgggctataacctctgcctgtaactctctctgctaatttttattttggcagttttaattaacccacaattgctgagggcaattaatacctaaaagaaagtttgattcctcttctaagatatcctaggtagtgtcatttctaaagaagacttggtgatcactgcttgtattagtccattttcacagtgctatgaagatactacctgatactgggtaatttattaaaaaaaaaaaagaggtttaattgactgacagttctgcagggctggggaggcctcaggaaacttaaatcatggtggaaggcgaaggggaagcaagcaccttcttcacaaggtggcaagagagagtgcaggggaaatgctaggcacttatcaatcagccaaatctcatgagaattcactatcatgagaacaagggggaaatctgctcccatgatctaatcacctcccaccacgaccctccctcaacacctggggattactattggagatttgggtggggacacaagagccaaaccatatcactgctgttgtgggtaataggggaggtgaaattggggggacaattcggcctctttgtgtccagaggttgtgcagttatcgagtgaggtcgatcagaagtctaaagggatctttcaaatggatagtgagttgccttttcctataggtgacaatcagagatttaatgttttaagtatcatataataggtttttctcctgattgtgaattgtaagtgttggtaatacagaaaatgagaaagtataaaccacccccaatcccaatgcccatagaaacgttgttaacattttggagtactttctattagtgtttatttttcccaatcctagtatttttagtaaaactactgtttagtaaatgatttttggtaactaatttcaaaatttatacttcaaccgtttattattagaatgtaatgcaagatgtattgcaataaaacttgagttttaaaagtt

SEQ ID NO: 2767 - DNA, 1542 bp, Homo sapiens
attctagttcagccctctgagcaagggctgggagttgcgacccccgccccggatccggaagtggtcgccgaggcctcctagcagccaatgtgaatgcgacaagttcccgatccaggcgtcccgctctccccggccccactcgccaggtcctaccacgatgcctgactcgtttgcggctttgggaccggttgtaggtggcttgaccgtcactagtagacgtttctgagtgtgtcgcggtcaccatggggaggttccctgctcaagctctcttctcttgtctgctgccatgtgagacgtgcctttgaccttctgccatgattgtgaggcctccccagccacgtgaaacttctgtggtcaccttccacggaaaggaatatattgtgcaggactcagatatcgagatggctgaagccccctccagtgtcagagatgatctgaaagacgtgtccagccaacgggcctcctcggtgaaccagatgcgtccaggggaaggccaggcccaccgagagctgcagatcctgcccagggtccctgcattgtccaggaggcagggagaggactttctgctacacaagagtattgacgtaacaggtgacccaaagtctctgagacccaagcagaccttggagaaggatctgaaggaaaacagggaagagaacccaggactgacatccccagagcctcagcttccaaagagtcccacagatctggtgagagcaaaggaggggaaggaccccccaaaaatagcctctgtggaaaatgtggatgctgacacaccttctgcctgcgttgtggagagagaagcttcgactcacagcgggaacagaggagacgctctgaatctgagcagtcccaaaagaagcaaaccagatgcctcctccatttcccaagaagagcctcaaggagaagccacacctgtgggcaacagagaatccccgggacaagctgggatgaattcaattcattccccaggccctgcgagcccagtcagtcacccggatggccaagaagccaaggcactgccgccctttgcatgtgacgtgtgcgagaagaggtttacgtgtaattccaagctagtcatccacaagagatcacacacaggcgagagactctttcaatgtaatctctgtgggaagcgcttcatgcagcttattagcctccaatttcaccagcgaacccacactggcgagaggccctacacgtgtgacgtctgccagaagcagttcacccagaagtcctacttgaagtgtcacaagagaagccacacaggggagaagcccttcgaatgtaaagactgcaagaaagttttcacctacagggggagcctgaaggagcaccagcgcatccactccggagagaaaccctacaaatgttccaagtgtccaagagccttcagtcggctgaaattgttaagacgccaccagaaaacacatccagaagctacttctcagtgattgcataatccggtctatgccttctgcaccaagaagaagtgaatgatatttttcatcaatgttatcagatgacatttgacacatgcaa

SEQ ID NO: 2768 - DNA, 1920 bp, Homo sapiens
cccagaccgagaaggtcggaggcagaagccgggaaggagacttctgaatgaacagtgaatctattactgaggaaaaccagaggaagcctgtgtagataggtatcaattagataccagctactggaagagctttctcagagactgattaaaaaattctccactagatatggctgcaaattgcacatcctcatggagtctaggagaatcctgcaacagacctgggttggagctgccacggtctatggcatcctcagaaactcaacttggaaatcacgacgtggaccctgagatttctcacgtgaacttcaggatgttcagctgcccgaaggagtcggaccccatccaggctctgaggaaactcactgagctgtgccatctgtggctgaggcccgacctccacaccaaagagcagatcctggacatgctggtgatggagcagttcatgatctccatgccccaggagctccaggtcttagtcatgatgaacggtgtgcagagctgcaaagacctggaggacctgctacgaaataacagaagacccaagaaatggtctgtggtcaccttccacggaaaggaatatattgtgcaggactcagatatcgagatggctgaagccccctccagtgtcagagatgatctgaaagacgtgtccagccaacgggcctcctcggtgaaccagatgcgtccaggggaaggccaggcccaccgagagctgcagatcctgcccagggtccctgcattgtccaggaggcagggagaggactttctgctacacaagagtattgacgtaacaggtgacccaaagtctctgagacccaagcagaccttggagaaggatctgaaggaaaacagggaagagaacccaggactgacatccccagagcctcagcttccaaagagtcccacagatctggtgagagcaaaggaggggaaggaccccccaaaaatagcctctgtggaaaatgtggatgctgacacaccttctgcctgcgttgtggagagagaagcttcgactcacagcgggaacagaggagacgctctgaatctgagcagtcccaaaagaagcaaaccagatgcctcctccatttcccaagaagagcctcaaggagaagccacacctgtgggcaacagagaatccccgggacaagctgggatgaattcaattcattccccaggccctgcgagcccagtcagtcacccggatggccaagaagccaaggcactgccgccctttgcatgtgacgtgtgcgagaagaggtttacgtgtaattccaagctagtcatccacaagagatcacacacaggcgagagactctttcaatgtaatctctgtgggaagcgcttcatgcagcttattagcctccaatttcaccagcgaacccacactggcgagaggccctacacgtgtgacgtctgccagaagcagttcacccagaagtcctacttgaagtgtcacaagagaagccacacaggggagaagcccttcgaatgtaaagactgcaagaaagttttcacctacagggggagcctgaaggagcaccagcgcatccactccggagagaaaccctacaaatgttccaagtgtccaagagccttcagtcggctgaaattgttaagacgccaccagaaaacacatccagaagctacttctcagtgattgcataatccggtctatgccttctgcaccaagaagaagtgaatgatatttttcatcaatgttatcagatgacatttgacacatgcaagggcgtctgacacacagagggagtgccctagatatgaattgccaggatgtttgagtaaatatgtgtcctccccactgagctttgttttctgtttcattatgtccattgttttcttataggtttattttggtttgtgttgctgttcttccaataaacgatcatcttattagttttc

SEQ ID NO: 2769 - DNA, 3203 bp, Homo sapiens
aggactaccgtcgcggcctgatgacgtcgcacaatggccggcccccgcgggtagtggagcccgtttgttccgcccgtgtcgagcctggagccagaacctgtgaagagcggaagggccaagggacgtcttctccacgccgctccgactccaggggagccgtggcctcctctccgccctagcgctgagaaccgtgggtaccgatggatgtggccgagagccctgaacgggatcctcactctccagaggatgaagagcagccacagggactctcggacgatgacattctgagggacagcgggtccgatcaggatttggacggggcgggggtgagggcttctgatctggaggatgaggaaagtgcagccagggggccgagccaggaggaggaagataatcactccgacgaggaggaccgggcaagtgagcctaaatcccaagaccaggactcagaggtgaatgagctgagccggggcccgaccagctccccctgcgaggaggagggggacgaaggggaggaagaccggacaagcgaccttagggatgaggcctcctcagtcaccagggagctggatgagcatgagctagactacgatgaggaggttcctgaggagccagctcccgccgtccaggaggacgaggctgagaaagcgggggctgaggatgatgaggagaaaggcgaaggcactcccagggaggaggggaaggctggtgttcagagtgtgggagaaaaggaatccctggaggctgccaaggagaaaaagaaagaggacgatgatggagaaatcgatgatggggaaatagacgatgatgacctggaagaaggtgaagtgaaggaccccagtgacaggaaggtgaggcctcgtcccacctgccggttcttcatgaaagatgttgtgacaccattatccactcttcttccaccaatatccaattccataccattcagaggccaggttaaagggaactgtacctggggaatgaattgtaggtttatacaccctggagtgaacgacaaggggaactactccctaatcaccaaagccgaccccttcccgcctaatggtgccccgcctctcggacctcacccgctgatgcccgccaacccttggggtgggccggtagttgatgaaattttgcctccaccccctccagagcccccaacagagagtgcctgggaacgaggactccggcatgcaaaggaggttttaaaaaaagcaactattcgaaaagaacaggagcctgattttgaagagaaaaggtttacggtgaccattggcgaagacgaacgggaatttgacaaagaaaatgaagtttttcgagattggaattctcggatcccgagagatgtcagagacacagtactcgagccttacgcagacccttattatgactatgaaattgagcggttttggcgtggcggacagtatgagaatttcagggtgcagtatacagaaacagagccgtatcataattaccgagaaagggagcgggagcgagagagagagcgtgaccgcgaccgggagaaggagcgggagaaggagaaggggaagcccaagccccgctccccgcagccgccaagccgccaagctgagccaccaaagaaggaggctgccaccacggggccgcaggtgaagagagcagatgagtggaaggacccttggcgccgatccaagtctcccaagaagaaactcggggtgtcggtctccccgagccgggctcgaaggcgtcggaaaacatcagcctcgtcagcctctgcctctaattcctccaggtcgtcttcgcggtcatcgtcctactctggctccggctcctcccggtcgcgatcccggtcttcatcctacagctcctactccagccgctcttccagacacagctcgttctcaggaagccggtccaggtcccggtccttctcttcgtccccgtccccgtccccaacaccttccccacatagaccttccatcagaaccaagggagagccggccccgccgcccgggaaagcaggagagaagtcagtgaagaagccggccccgcctccagccccaccacaggccaccaaaaccactgctcctgtccccgagcccaccaagccaggagaccctcgggaagccaggaggaaggagcggccagccaggaccccccccaggaggcggctgataaaggaagcaggaagcgctatgaaccatcagacaaggacaggcagagccctcctccagccaagcggcccaacacatccccagaccgaggttctcgggaccggaagtcaggtgggagactgggctccccgaagccagagcggcagagaggccagaactccaaagcccctgcagccccggctgacaggaagcgccagctgtcaccccagtccaagagctccagcaaggtcacgagcgtgcccggcaaagcctcggatcccggcgccgccagcaccaaatcagggaaggccagcacgctgtctcggcgggaggagctgctgaaacagctgaaggccgtggaggatgctattgcacgcaagcgggccaagatccccgggaaagcataggccgtgccccgaccggactggacgcatttttatacatagggtaagcgcagccattttggattttgcagttaatgtcttattttggctgtgattctttttaaaaagtaaaaaagaaaaaaaagtttctcagctggaaaagaagccacacaggaaatgacaacgacgctgaatcccagcctccctccccagagcagaagtcccgcaggacagacagacacagacagcgctagtgaccagcacggttctcatgtaaattacaagccccagccgccagccccgccttctcttcctcctcctccgtcttcttccctggccctggtcaggcctgtggagccccagctctgggtccctagcccgggtccaggcagccaggctccctcctgagctgagaaacggaacctcgcgaaccactggtggcacatccttctcctcccccgcccctgatcacccgcccccggatcagaaatatatctatattctcgactaaagtctcatcaggaaatatttcctgtcttttattttaagcatcaaattgttttagttgatttaaaaaggaaaaaatacagaaaagaccaaaaaaaggccaagggtgttgttggggcgtctgtctaatgtggtgggtctttttttgaggggtctcctaaaataaaatattttgataagc

SEQ ID NO: 2770 - DNA, 3729 bp, Homo sapiens
aggactaccgtcgcggcctgatgacgtcgcacaatggccggcccccgcgggtagtggagcccgtttgttccgcccgtgtcgagcctggagccagaacctgtgaagagcggaagggccaagggacgtcttctccacgccgctccgactccaggggagccgtggcctcctctccgccctagcgctgagaaccgtgggtaccgatggatgtggccgagagccctgaacgggatcctcactctccagaggatgaagagcagccacagggactctcggacgatgacattctgagggacagcgggtccgatcaggatttggacggggcgggggtgagggcttctgatctggaggatgaggaaagtgcagccagggggccgagccaggaggaggaagataatcactccgacgaggaggaccgggcaagtgagcctaaatcccaagaccaggactcagaggtgaatgagctgagccggggcccgaccagctccccctgcgaggaggagggggacgaaggggaggaagaccggacaagcgaccttagggatgaggcctcctcagtcaccagggagctggatgagcatgagctagactacgatgaggaggttcctgaggagccagctcccgccgtccaggaggacgaggctgagaaagcgggggctgaggatgatgaggagaaaggcgaaggcactcccagggaggaggggaaggctggtgttcagagtgtgggagaaaaggaatccctggaggctgccaaggagaaaaagaaagaggacgatgatggagaaatcgatgatggggaaatagacgatgatgacctggaagaaggtgaagtgaaggaccccagtgacaggaaggtgaggcctcgtcccacctgccggttcttcatgaaagggaactgtacctggggaatgaattgtaggtttatacaccctggagtgaacgacaaggggaactactccctaatcaccaaagccgaccccttcccgcctaatggtgccccgcctctcggacctcacccgctgatgcccgccaacccttggggtgggccggtagttgatgaaattttgcctccaccccctccagagcccccaacagagagtgcctgggaacgaggactccggcatgcaaaggaggttttaaaaaaagcaactattcgaaaagaacaggagcctgattttgaagagaaaaggtttacggtgaccattggcgaagacgaacgggaatttgacaaagaaaatgaagtttttcgagattggaattctcggatcccgagagatgtcagagacacagtactcgagccttacgcagacccttattatgactatgaaattgagcggttttggcgtggcggacagtatgagaatttcagggtgcagtatacagaaacagagccgtatcataattaccgagaaagggagcgggagcgagagagagagaacagacagcgcgagcgcgagcgggagcgggagcgggaccgagagcgggagcgccggcagagggagcgcgagcgagagcgggagcgcgagcgcgacaaggagcggcagcggaggaaggaggagtgggagcgtgagcgagccaagcgggacgagaaggaccggcagcaccgtgaccgcgaccgggagaaggagcgggagaaggagaaggggaagcccaagccccgctccccgcagccgccaagccgccaagctgagccaccaaagaaggaggctgccaccacggggccgcaggtgaagagagcagatgagtggaaggacccttggcgccgatccaagtctcccaagaagaaactcggggtgtcggtctccccgagccgggctcgaaggcgtcggaaaacatcagcctcgtcagcctctgcctctaattcctccaggtcgtcttcgcggtcatcgtcctactctggctccggctcctcccggtcgcgatcccggtcttcatcctacagctcctactccagccgctcttccagacacagctcgttctcaggaagccggtccaggtcccggtccttctcttcgtccccgtccccgtccccaacaccttccccacatagaccttccatcagaaccaagggagagccggccccgccgcccgggaaagcaggagagaagtcagtgaagaagccggccccgcctccagccccaccacaggccaccaaaaccactgctcctgtccccgagcccaccaagccaggagaccctcgggaagccaggaggaaggagcggccagccaggaccccccccaggaggcggacgctaagcggcagcggcagtggcagtggtagcagctatagtggttccagctcccgatccaggtccctgagcgtgagcagcgtctcctcagtgtccagtgctacgtcgagcagcagctctgcacacagcgtggactcggaggacatgtacgcagacctggctagccccgtgtcctcagccagctctcggtccccggccccagcccagaccaggaaggagaaaggaaaatctaagaaagaagacggtgttaaagaggaaaagcggaaaagggattcgtccacacaaccacccaaatctgcaaaacctccagcaggggggaagtcctcccagcagccctcgacaccccagcaggcaccccccgggcagccccagcagggcacatttgtggcccacaaggagatcaagttgacactgttgaataaggcggctgataaaggaagcaggaagcgctatgaaccatcagacaaggacaggcagagccctcctccagccaagcggcccaacacatccccagaccgaggttctcgggaccggaagtcaggtgggagactgggctccccgaagccagagcggcagagaggccagaactccaaagcccctgcagccccggctgacaggaagcgccagctgtcaccccagtccaagagctccagcaaggtcacgagcgtgcccggcaaagcctcggatcccggcgccgccagcaccaaatcagggaaggccagcacgctgtctcggcgggaggagctgctgaaacagctgaaggccgtggaggatgctattgcacgcaagcgggccaagatccccgggaaagcataggccgtgccccgaccggactggacgcatttttatacatagggtaagcgcagccattttggattttgcagttaatgtcttattttggctgtgattctttttaaaaagtaaaaaagaaaaaaaagtttctcagctggaaaagaagccacacaggaaatgacaacgacgctgaatcccagcctccctccccagagcagaagtcccgcaggacagacagacacagacagcgctagtgaccagcacggttctcatgtaaattacaagccccagccgccagccccgccttctcttcctcctcctccgtcttcttccctggccctggtcaggcctgtggagccccagctctgggtccctagcccgggtccaggcagccaggctccctcctgagctgagaaacggaacctcgcgaaccactggtggcacatccttctcctcccccgcccctgatcacccgcccccggatcagaaatatatctatattctcgactaaagtctcatcaggaaatatttcctgtcttttattttaagcatcaaattgttttagttgatttaaaaaggaaaaaatacagaaaagaccaaaaaaaggccaagggtgttgttggggcgtctgtctaatgtggtgggtctttttttgaggggtctcctaaaataaaatattttgataagcagc

SEQ ID NO: 2771 - DNA, 3211 bp, Homo sapiens
gacgtcgcacaatggccggcccccgcgggtagtggagcccgtttgttccgcccgtgtcgagcctggagccagaacctgtgaagagcggaagggccaagggacgtcttctccacgccgctccgactccaggggagccgtggcctcctctccgccctagcgctgagaaccgtgggtaccgatggatgtggccgagagccctgaacgggatcctcactctccagaggatgaagagcagccacagggactctcggacgatgacattctgagggacagcgggtccgatcaggatttggacggggcgggggtgagggcttctgatctggaggatgaggaaagtgcagccagggggccgagccaggaggaggaagataatcactccgacgaggaggaccgggcaagtgagcctaaatcccaagaccaggactcagaggtgaatgagctgagccggggcccgaccagctccccctgcgaggaggagggggacgaaggggaggaagaccggacaagcgaccttagggatgaggcctcctcagtcaccagggagctggatgagcatgagctagactacgatgaggaggttcctgaggagccagctcccgccgtccaggaggacgaggctgagaaagcgggggctgaggatgatgaggagaaaggcgaaggcactcccagggaggaggggaaggctggtgttcagagtgtgggagaaaaggaatccctggaggctgccaaggagaaaaagaaagaggacgatgatggagaaatcgatgatggggaaatagacgatgatgacctggaagaaggtgaagtgaaggaccccagtgacaggaaggtgaggcctcgtcccacctgccggttcttcatgaaagatgttgtgacaccattatccactcttcttccaccaatatccaattccataccattcagaggccaggttaaagggaactgtacctggggaatgaattgtaggtttatacaccctggagtgaacgacaaggggaactactccctaatcaccaaagccgaccccttcccgcctaatggtgccccgcctctcggacctcacccgctgatgcccgccaacccttggggtgggccggtagttgatgaaattttgcctccaccccctccagagcccccaacagagagtgcctgggaacgaggactccggcatgcaaaggaggttttaaaaaaagcaactattcgaaaagaacaggagcctgattttgaagagaaaaggtttacggtgaccattggcgaagacgaacgggaatttgacaaagaaaatgaagtttttcgagattggaattctcggatcccgagagatgtcagagacacagtactcgagccttacgcagacccttattatgactatgaaattgagcggttttggcgtggcggacagtatgagaatttcagggtgcagtatacagaaacagagccgtatcataattaccgagaaagggagcgggagcgagagagagagaacagacagcgcgagcgcgagcgggagcgggagcgggaccgagagcgggagcgccggcagagggagcgcgagcgagagcgggagcgcgagcgcgacaaggagcggcagcggaggaaggaggagtgggagcgtgagcgagccaagcgggacgagaaggaccggcagcaccgtgaccgcgaccgggagaaggagcgggagaaggagaaggggaagcccaagccccgctccccgcagccgccaagccgccaagctgagccaccaaagaaggaggctgccaccacggggccgcaggtgaagagagcagatgagtggaaggacccttggcgccgatccaagtctcccaagaagaaactcggggtgtcggtctccccgagccgggctcgaaggcgtcggaaaacatcagcctcgtcagcctctgcctctaattcctccaggtcgtcttcgcggtcatcgtcctactctggctccggctcctcccggtcgcgatcccggtcttcatcctacagctcctactccagccgctcttccagacacagctcgttctcaggaagccggtccaggtcccggtccttctcttcgtccccgtccccgtccccaacaccttccccacatagaccttccatcagaaccaagggagagccggccccgccgcccgggaaagcaggagagaagtcagtgaagaagccggccccgcctccagccccaccacaggccaccaaaaccactgctcctgtccccgagcccaccaagccaggagaccctcgggaagccaggaggaaggagcggccagccaggaccccccccaggaggcggacgctaagcggcagcggcagtggcagtggtagcagctatagtggttccagctcccgatccaggtccctgagcgtgagcagcgtctcctcagtgtccagtgctacgtcgagcagcagctctgcacacagcgtggactcggaggacatgtacgcagacctggctagccccgtgtcctcagccagctctcggtccccggccccagcccagaccaggaaggagaaaggaaaatctaagaaagaagacggtgttaaagaggaaaagcggaaaagggattcgtccacacaaccacccaaatctgcaaaacctccagcaggggggaagtcctcccagcagccctcgacaccccagcaggcaccccccgggcagccccagcagggcacatttgtggcccacaaggagatcaagttgacactgttgaataaggcggctgataaaggaagcaggaagcgctatgaaccatcagacaaggacaggcagagccctcctccagccaagcggcccaacacatccccagaccgaggttctcgggaccggaagtcaggtgggagactgggctccccgaagccagagcggcagagaggccagaactccaaagcccctgcagccccggctgacaggaagcgccagctgtcaccccagtccaagagctccagcaaggtcacgagcgtgcccggcaaagcctcggatcccggcgccgccagcaccaaatcagggaaggccagcacgctgtctcggcgggaggagctgctgaaacagctgaaggccgtggaggatgctattgcacgcaagcgggccaagatccccgggaaagcataggccgtgccccgaccggactggacgcatttttatacatagggtaagcgcagccattttggattttgcagttaatgtcttattttggctgtgattcttttt

SEQ ID NO: 2772 - DNA, 2997 bp, Homo sapiens
atggatgtggccgagagccctgaacgggatcctcactctccagaggatgaagagcagccacagggactctcggacgatgacattctgagggacagcgggtccgatcaggatttggacggggcgggggtgagggcttctgatctggaggatgaggaaagtgcagccagggggccgagccaggaggaggaagataatcactccgacgaggaggaccgggcaagtgagcctaaatcccaagaccaggactcagaggatgatgacctggaagaaggtgaagtgaaggaccccagtgacaggaaggtgaggcctcgtcccacctgccggttcttcatgaaagggaactgtacctggggaatgaattgtaggtttatacaccctggagtgaacgacaaggggaactactccctaatcaccaaagccgaccccttcccgcctaatggtgccccgcctctcggacctcacccgctgatgcccgccaacccttggggtgggccggtagttgatgaaattttgcctccaccccctccagagcccccaacagagagtgcctgggaacgaggactccggcatgcaaaggaggttttaaaaaaagcaactattcgaaaagaacaggagcctgattttgaagagaaaaggtttacggtgaccattggcgaagacgaacgggaatttgacaaagaaaatgaagtttttcgagattggaattctcggatcccgagagatgtcagagacacagtactcgagccttacgcagacccttattatgactatgaaattgagcggttttggcgtggcggacagtatgagaatttcagggtgcagtatacagaaacagagccgtatcataattaccgagaaagggagcgggagcgagagagagagaacagacagcgcgagcgcgacaaggagcggcagcggaggaaggaggagtgggagcgtgagcgagccgccaagctgagccaccaaagaaggaggctgccaccacggggccgcaggtgaagagagcagatgagtggaaggacccttggcgccgatccaagtctcccaagaagaaactcggggtgtcggtctccccgagccgggctcgaaggcgtcggaaaacatcagcctcgtcagcctctgcctctaattcctccaggtcgtcttcgcggtcatcgtcctactctggctccggctcctcccggtcgcgatcccggtcttcatcctacagctcctactccagccgctcttccagacacagctcgttctcaggaagccggtccaggtcccggtccttctcttcgtccccgtccccgtccccaacaccttccccacatagaccttccatcagaaccaagggagagccggccccgccgcccgggaaagcaggagagaagtcagtgaagaagccggccccgcctccagccccaccacaggccaccaaaaccactgctcctgtccccgagcccaccaagccaggagaccctcgggaagccaggaggaaggagcggccagccaggaccccccccaggaggcggacgctaagcggcagcggcagtggcagtggtagcagctatagtggttccagctcccgatccaggtccctgagcgtgagcagcgtctcctcagtgtccagtgctacgtcgagcagcagctctgcacacagcgtggactcggaggacatgtacgcagacctggctagccccgtgtcctcagccagctctcggtccccggccccagcccagaccaggaaggagaaaggaaaatctaagaaagaagacggtgttaaagaggaaaagcggaaaagggattcgtccacacaaccacccaaatctgcaaaacctccagcaggggggaagtcctcccagcagccctcgacaccccagcaggcaccccccgggcagccccagcagggcacatttgtggcccacaaggagatcaagttgacactgttgaataaggcggctgataaaggaagcaggaagcgctatgaaccatcagacaaggacaggcagagccctcctccagccaagcggcccaacacatccccagaccgaggttctcgggaccggaagtcaggtgggagactgggctccccgaagccagagcggcagagaggccagaactccaaagcccctgcagccccggctgacaggaagcgccagctgtcaccccagtccaagagctccagcaaggtcacgagcgtgcccggcaaagcctcggatcccggcgccgccagcaccaaatcagggaaggccagcacgctgtctcggcgggaggagctgctgaaacagctgaaggccgtggaggatgctattgcacgcaagcgggccaagatccccgggaaagcataggccgtgccccgaccggactggacgcatttttatacatagggtaagcgcagccattttggattttgcagttaatgtcttattttggctgtgattctttttaaaaagtaaaaaagaaaaaaaagtttctcagctggaaaagaagccacacaggaaatgacaacgacgctgaatcccagcctccctccccagagcagaagtcccgcaggacagacagacacagacagcgctagtgaccagcacggttctcatgtaaattacaagccccagccgccagccccgccttctcttcctcctcctccgtcttcttccctggccctggtcaggcctgtggagccccagctctgggtccctagcccgggtccaggcagccaggctccctcctgagctgagaaacggaacctcgcgaaccactggtggcacatccttctcctcccccgcccctgatcacccgcccccggatcagaaatatatctatattctcgactaaagtctcatcaggaaatatttcctgtcttttattttaagcatcaaattgttttagttgatttaaaaaggaaaaaatacagaaaagaccaaaaaaaggccaagggtgttgttggggcgtctgtctaatgtggtgggtctttttttgaggggtctcctaaaataaaatattttgataagc

SEQ ID NO: 2773 - DNA, 3280 bp, Homo sapiens
gggggcctggccggccgtcgcggactcgggagatggaggaaaaggagatattacggcggcagatccgcctactgcagggtctgattgatgactacaaaaccctccacggcaatgccccggcccctggtaccccagcagcttctgggtggcagccacccacttaccacagtggcagagcctttagtgcccgctaccctcgtccaagccggaggggctactcttcccaccatgggccttcgtggcgcaagaaatactccctcgtgaatcggcccccgggaccctcagaccctcctgccgaccatgctgtgcggccgttgcacggggcccgggggggccagcctcctgtcccgcagcagcatgtccttgagagacaggtccagctcagtcagggtcagaacgtggtcatcaaagttaaaccgccatcaaagtctggctctgccagtgcctcaggggcccagcggggctctttggaagaatttgaggaaaccccctggagtgaccaaaggccccgggaaggtgaaggtgagccccctcggggacagctgcagccctcgaggccaacaagagccagggggacctgcagtgtggaagatcctcttctggtctgccagaaggagcctggtaagcccaggatggtgaagtcagtgggcagtgtgggcgacagcccccgggagccccgccggacagtcagtgagagtgtgattgccgtcaaggcgagcttcccatcctccgctctgcccccacgcactggcgtggccctgggccggaagctgggttctcattccgtggccagctgtgctccacagctccttggggacaggagagtagatgctggccacacagatcagccagttccgtctggctcagtggggggccccgccagaccggcctcaggacccaggcaggcccgggaggcctcgctggttgtgacctgtcgaactaacaagttccggaaaaacaactacaaatgggtggctgcctcctcgaagagtccccgggttgctcggagggccctcagtcccagagtggctgcagagaatgtgtgcaaggcctctgctggcatggcaaacaaggtggagaagccgcagctcatagctgacccagagcccaagcccaggaagccagccacgtcctccaagccagggtctgcccccagcaagtacaagtggaaggcctccagcccctctgcctcctcctcttcctccttccgttggcagtcggaggccagcagcaaggaccatgcctcccagctctccccagtcctgtctaggtccccgtcgggggacagaccagcagtaggacacagtggcttgaagcccctctctggggagaccccgctctcggcttacaaagtgaagagccgcaccaagatcatccggagacgcagcagcacaagccttcctggagacaagaaaagcggcacctcacctgccgccaccgccaagagccacctcagcctccggcggagacaggccctcagggggaagagcagccctgtcctgaagaagacccccaacaagggcctggtacaggtcaccacgcaccgactatgtcgcctgccaccgagccgggcccacctccccaccaaggaagcgtccagcctgcatgccgtgcggactgcacccaccagcaaggtgatcaagacccgctaccgcattgtcaagaagacgccggcctcgcctctcagcgccccgcccttccccctgtctctgccctcctggcgggcccggcggctctcactatccaggtccctggtgctgaaccgcctgcgtccagttgccagcgggggtgggaaagcccaaccgggctccccttggtggcggagcaaaggctaccgctgcatcggaggggtcctctacaaagtatctgccaacaagctctccaagacctccggccagcccagtgatgcgggcagcaggcccctcctgcgcacaggccggctggatcctgcaggcagctgtagccgttccctggccagccgggcagtgcagcgcagcctggccatcatccggcaggcgcggcagcgcagggagaagaggaaggagtactgcatgtactacaaccgcttcggcaggtgcaaccgtggcgagcgctgcccctacatccacgatcccgagaaggtggccgtgtgcaccaggtttgtccggggcacctgcaagaaaacggatgggacctgccccttctcccaccatgtgtccaaggagaagatgccggtgtgctcctacttcctgaagggcatctgcagcaacagcaactgtccctatagccacgtgtacgtgtcccgcaaggccgaggtctgcagcgacttcctcaaaggctactgccccctgggtgcaaagtgcaagaagaaacacacgctgctgtgccccgactttgcccgcaggggggcgtgtccccgcggcgcccagtgccagctgctccaccgtacccagaaacgccacagtcggcgggcagccacgtcccccgccccagggcccagcgacgcaaccgccaggagcagggtctcggccagccacgggcccaggaagccttcagcatcccagcgccccaccaggcagacgcccagctcggctgccctcactgcggctgccgtggctgcacctccccactgcccaggggggtcagcctctccctcatcctcgaaggcttcctcctcctcctcctcctcctcatcccctcccgcttccttggaccacgaggcaccatctctccaggaggctgccttagcagcagcgtgctccaacaggctctgcaagctgccttccttcatctccctgcagtcctcgccgagcccaggagcccagcccagggtccgggcccctagggcccccctcaccaaggactcagggaagcctctgcacatcaaaccacgtctgtgaggaccccagggaccggcctgcacctacctcagaccctcatccttggagaggaaagaggctctgtccaccactctaccccacaggagggccgcccgccaccaagcctcacctgggggccacagggacactgctctgcctgcctggccctcaaccttccatgaccagcgtgtgcgcagggcctggtcttcctcccccaagccaggcccctgtccccaccccaccaccttccagggtgccaggcagggctggcctccaggcctgtccccgactgccattggcaacagtggccctgcagcccccagccctccccacccaggttttcggcccagtgaagaggccactggccaggcctcccaggcaggtgttttatgttcagcaataaaggttctatccgtaactgg

SEQ ID NO: 2774 - DNA, 3801 bp, Homo sapiens
aaccgagggagagctgcgagcgagcacccaggccccgccgccgccgccgccaccgctgcccgcctgccgccgcccgcctccgcctgccttctgccgccggccggcgcgtcgtccccacagattgctcatttagaaagtggatgtgtgggataacatgtccaatgtgtccgaggagagaagaaaaaggcagcagaacattaaggaaggactgcagtttatacagtcaccgctgtcatatccaggaacacaggagcaatatgcggtatatttgcgtgctctcgtgagaaatctttttaatgaaggaaatgacgtttatcgggaacatgattggaacaactcgataagccagtacacggaagccttgaatatagctgattatgcaaaatctgaagaaattttaatccccaaagaaataattgaaaaactatatataaatcgtattgcctgctattctaatatgggtttccatgataaagttttggaggactgcaatatagtcctcagtttaaatgccagtaactgcaaagctctgtatcggaaatctaaggctttaagtgatttaggaagatacaaaaaggcttacgatgctgtagcaaagtgctccttagcagtgcctcaggatgagcatgtaataaaactaactcaagaactagctcagaaattgggatttaaaataagaaaagcgtatgtcagagctgagctctcattaaaatcagttcctggggatggggctaccaaggctttgaaccattctgtggaagatattgagccagatttattaactccaaggcaagaagcagttcctgttgtctctttaccggcacccagtttttctcatgaagttggaagtgagctggcctcagttcctgttatgcccttaacttctattttgccactacaagtggaagagagcgctctgccatctgcagtgctggcaaatggaggaaagatgcccttcactatgccagaagcttttctagatgatggagatatggtccttggagatgaactagatgacctgcttgattctgcacctgaaactaatgaaactgttatgccgtcagctttagtcagaggaccccttcagacagccagtgtctctcctagcatgcccttttcggcatcgctgttaggaaccttacccattggtgcgaggtatgctcctccaccctccttctcagaattttatccacctttgacttcatccttagaagatttttgttcttctttaaattcattttcaatgagtgaatccaaacgagatctgtccacctcaacttctagagagggaacaccgcttaacaacagtaattcttcccttttacttatgaatggaccaggtagtttgtttgcttcagagaatttcctgggaatttcaagtcagcctagaaatgactttggaaacttttttggaagtgcagttaccaaaccatcttcatcagtgactccaagacatcccctcgaaggaacccatgaattgagacaagcttgccagatctgttttgtaaaatcaggccctaagttaatggatttcacttaccatgctaacatagatcataagtgtaagaaagatattttaatcggtaggataaagaatgttgaagataaatcatggaaaaaaatacgtccaagaccaacaaaaacaaattatgaaggaccatattatatatgtaaagatgttgctgctgaggaggaatgtagatattcaggccactgcacgtttgcttattgccaagaggagatagatgtgtggacactggagcggaaaggagcattcagccgggaggctttctttggcggcaatggaaagattaaccttactgtgttcaaacttctccaggagcatcttggggaatttatattcctttgtgagaaatgttttgatcataagcctagaatgataagtaaaagaaataaagataattctactgcttgttctcacccggttacaaagcatgagtttgaagacaataagtgccttgtccacattttgcgagagacaacagtaaaatactccaaaatacgttcttttcatggtcagtgtcagcttgatttatgtcgacatgaagttcggtatggctgtttaagggaagatgagtgcttttatgcccatagtcttgtggaactgaaagtctggataatgcaaaatgaaacaggtatctcacatgatgctattgctcaagagtctaaacgatattggcagaatttggaagcaaatgtacctggagcgcaggtacttggtaatcaaataatgcctggatttcttaatatgaagataaagtttgtgtgcgcccagtgtctgagaaacggtcaagtcattgaaccagacaaaaacagaaaatattgtagtgcaaaagcaaggcattcgtggaccaaagaccggcgtgcgatgagagtgatgtctattgaacgtaagaagtggatgaacatccgtcctctccccacaaagaaacaaatgcctttacagtttgatctgtgcaaccatattgcttctgggaaaaaatgtcaatatgttggaaactgttcctttgctcatagtcctgaggaaagagaagtttggacttacatgaaggagaatgggatacaagatatggagcaattttacgaactatggctcaagagtcaaaaaaatgaaaaaagtgaagacatagccagtcagtcaaacaaggaaaatggaaaacaaattcacatgccaacagattatgctgaagttacagtggactttcactgctggatgtgtgggaaaaactgcaacagtgagaagcagtggcagggccacatctcctccgagaagcacaaagagaaggttttccacaccgaggacgaccagtactgctggcagcaccgcttcccaacaggctatttcagtatttgtgataggtatatgaatggcacctgcccagaaggaaacagctgtaaatttgcacatggaaatgccgaacttcatgaatgggaagaaagaagagatgccctaaagatgaagctcaacaaagcacgaaaagatcacttaattggcccaaatgataatgactttggaaaatatagttttttgtttaaagatttaaactaatatgctggcttttatgtatgatacctaatcagagcattgaccagaaaaattgaaagtgttctgaggcacatagcagaggagctgcagatttcctgcttgtattggcgtatatcgttcctcctgagcagcaacccacagtaggtaggaaaatgggctgtttcacaggcctggccacgctctcacggaaccactggcatcagatggtgaagtgactgctacccggttgccatctgttgaacagacttttggatgaagtgtgttggggaagaggataaggttatatctaggacaactctttgagttggtccttcatataagaatcgtgacggtaagagaataaacacttgtactgggatcagaatacatgatggatgaaattctttacatgttttagcagaatgaatttgtttaatataataaagtttgctacttatctgtatgtaggttgctaaaaaggattttcttaactcagattttaagccaaataaccatttaacactagtatttgttaaatggggtatttttctgtatttgtatgtttcactataataagggaattaaggataatgtgcattgagaatattttgaaaaataattgactcaaattttatttcttggtcttttgctgtttaaatgatgattttgaaagattaaacctgtactgttggtattgtgttagtgtatggaccaatactgcctgtaataaagattttatatatagatgcctttca

SEQ ID NO: 2775 - DNA, 3844 bp, Homo sapiens
aaagatgactcctgtacggtccctgccgtccaggaccctggagtcaagtcagaaatggatgtgtccacagctgattgtgtgacaaggtctggatttgtgggtgttttcattggagtccagggaccctggtaccttatgtgcttttttgccttgtttctttccagattgctcatttagaaagtggatgtgtgggataacatgtccaatgtgtccgaggagagaagaaaaaggcagcagaacattaaggaaggactgcagtttatacagtcaccgctgtcatatccaggaacacaggagcaatatgcggtatatttgcgtgctctcgtgagaaatctttttaatgaaggaaatgacgtttatcgggaacatgattggaacaactcgataagccagtacacggaagccttgaatatagctgattatgcaaaatctgaagaaattttaatccccaaagaaataattgaaaaactatatataaatcgtattgcctgctattctaatatgggtttccatgataaagttttggaggactgcaatatagtcctcagtttaaatgccagtaactgcaaagctctgtatcggaaatctaaggctttaagtgatttaggaagatacaaaaaggcttacgatgctgtagcaaagtgctccttagcagtgcctcaggatgagcatgtaataaaactaactcaagaactagctcagaaattgggatttaaaataagaaaagcgtatgtcagagctgagctctcattaaaatcagttcctggggatggggctaccaaggctttgaaccattctgtggaagatattgagccagatttattaactccaaggcaagaagcagttcctgttgtctctttaccggcacccagtttttctcatgaagttggaagtgagctggcctcagttcctgttatgcccttaacttctattttgccactacaagtggaagagagcgctctgccatctgcagtgctggcaaatggaggaaagatgcccttcactatgccagaagcttttctagatgatggagatatggtccttggagatgaactagatgacctgcttgattctgcacctgaaactaatgaaactgttatgccgtcagctttagtcagaggaccccttcagacagccagtgtctctcctagcatgcccttttcggcatcgctgttaggaaccttacccattggtgcgaggtatgctcctccaccctccttctcagaattttatccacctttgacttcatccttagaagatttttgttcttctttaaattcattttcaatgagtgaatccaaacgagatctgtccacctcaacttctagagagggaacaccgcttaacaacagtaattcttcccttttacttatgaatggaccaggtagtttgtttgcttcagagaatttcctgggaatttcaagtcagcctagaaatgactttggaaacttttttggaagtgcagttaccaaaccatcttcatcagtgactccaagacatcccctcgaaggaacccatgaattgagacaagcttgccagatctgttttgtaaaatcaggccctaagttaatggatttcacttaccatgctaacatagatcataagtgtaagaaagatattttaatcggtaggataaagaatgttgaagataaatcatggaaaaaaatacgtccaagaccaacaaaaacaaattatgaaggaccatattatatatgtaaagatgttgctgctgaggaggaatgtagatattcaggccactgcacgtttgcttattgccaagaggagatagatgtgtggacactggagcggaaaggagcattcagccgggaggctttctttggcggcaatggaaagattaaccttactgtgttcaaacttctccaggagcatcttggggaatttatattcctttgtgagaaatgttttgatcataagcctagaatgataagtaaaagaaataaagataattctactgcttgttctcacccggttacaaagcatgagtttgaagacaataagtgccttgtccacattttgcgagagacaacagtaaaatactccaaaatacgttcttttcatggtcagtgtcagcttgatttatgtcgacatgaagttcggtatggctgtttaagggaagatgagtgcttttatgcccatagtcttgtggaactgaaagtctggataatgcaaaatgaaacaggtatctcacatgatgctattgctcaagagtctaaacgatattggcagaatttggaagcaaatgtacctggagcgcaggtacttggtaatcaaataatgcctggatttcttaatatgaagataaagtttgtgtgcgcccagtgtctgagaaacggtcaagtcattgaaccagacaaaaacagaaaatattgtagtgcaaaagcaaggcattcgtggaccaaagaccggcgtgcgatgagagtgatgtctattgaacgtaagaagtggatgaacatccgtcctctccccacaaagaaacaaatgcctttacagtttgatctgtgcaaccatattgcttctgggaaaaaatgtcaatatgttggaaactgttcctttgctcatagtcctgaggaaagagaagtttggacttacatgaaggagaatgggatacaagatatggagcaattttacgaactatggctcaagagtcaaaaaaatgaaaaaagtgaagacatagccagtcagtcaaacaaggaaaatggaaaacaaattcacatgccaacagattatgctgaagttacagtggactttcactgctggatgtgtgggaaaaactgcaacagtgagaagcagtggcagggccacatctcctccgagaagcacaaagagaaggttttccacaccgaggacgaccagtactgctggcagcaccgcttcccaacaggctatttcagtatttgtgataggtatatgaatggcacctgcccagaaggaaacagctgtaaatttgcacatggaaatgccgaacttcatgaatgggaagaaagaagagatgccctaaagatgaagctcaacaaagcacgaaaagatcacttaattggcccaaatgataatgactttggaaaatatagttttttgtttaaagatttaaactaatatgctggcttttatgtatgatacctaatcagagcattgaccagaaaaattgaaagtgttctgaggcacatagcagaggagctgcagatttcctgcttgtattggcgtatatcgttcctcctgagcagcaacccacagtaggtaggaaaatgggctgtttcacaggcctggccacgctctcacggaaccactggcatcagatggtgaagtgactgctacccggttgccatctgttgaacagacttttggatgaagtgtgttggggaagaggataaggttatatctaggacaactctttgagttggtccttcatataagaatcgtgacggtaagagaataaacacttgtactgggatcagaatacatgatggatgaaattctttacatgttttagcagaatgaatttgtttaatataataaagtttgctacttatctgtatgtaggttgctaaaaaggattttcttaactcagattttaagccaaataaccatttaacactagtatttgttaaatggggtatttttctgtatttgtatgtttcactataataagggaattaaggataatgtgcattgagaatattttgaaaaataattgactcaaattttatttcttggtcttttgctgtttaaatgatgattttgaaagattaaacctgtactgttggtattgtgttagtgtatggaccaatactgcctgtaataaagattttatatatagatgcctttc

SEQ ID NO: 2776 - DNA, 5608 bp, Homo sapiens
atggagaggcagaaacggaaggcggacatcgagaaagggctgcagttcattcagtcgacactacccctaaagcaagaagaatatgaggcctttctgctcaagctggtgcagaatctgtttgctgagggcaatgatctgttccgggagaaggactataagcaggctctggtgcagtacatggaagggctgaacgtggccgactacgctgcctctgaccaggtggccctgccccgggagctgctgtgcaagctgcatgtcaatagggccgcctgctacttcaccatgggcctgtatgagaaggcgctggaggacagcgagaaggcgctgggcctggacagtgagagtatccgggcgttgttccgcaaggcacgcgctctcaatgaactgggacgccacaaggaggcctacgagtgcagcagccggtgttccctcgccctgccccacgatgaaagcgtgactcagcttggtcaggagctggcccagaaactggggctgcgagttcgcaaggcgtataagaggccccaggaattggaaaccttttctctgctcagtaacggcactgcggctggcgtggcagatcagggaacttctaatggattggggtccatagatgacatcgaaacagactgctacgtggaccctcgaggctccccagcccttctcccctccacgcccacgatgcccctgttccctcacgttctggacctgctggcccccctggacagcagcaggaccctccccagcaccgacagcctggatgacttctcagacggggatgtctttggcccagagctggacaccctcctggactcgctgtctctggtccagggtggcctgtctggcagcggcgtgcctagtgagttgccccagctgatacccgtgttccccggcgggaccccactgctaccacctgtggtgggtggctccatccctgtctccagcccactgccccccgcctccttcggcttggtcatggacccctccaagaagctggccgcctctgtgctggatgccctcgatcccccgggccccacgctggaccccctggacctgctgccgtactcggagacccggctggatgcactcgacagctttgggtcgacacgaggctccctggacaaacctgactccttcatggaggagaccaactcacaggaccaccgtccccctagcggtgctcagaaaccagccccctcgccagagccctgcatgcccaacactgccttgctcatcaagaaccccttggctgccacccacgagttcaagcaggcctgccagctctgctaccccaagacaggcccccgggctggcgactacacctaccgtgagggccttgagcacaagtgcaagcgggacatcctgctcggccggctccggagctcggaggaccagacctggaagcggatccggccccggcccactaagaccagcttcgtgggctcctactacctgtgcaaagacatgattaacaagcaggactgtaagtacggggataactgcaccttcgcctaccatcaggaggagatcgacgtgtggaccgaggagcggaagggcaccctcaaccgcgacctgctcttcgacccgctggggggtgttaagcgcggcagcctcaccatcgccaagctcctgaaggagcaccagggcatcttcaccttcctctgcgagatctgctttgacagtaaaccccggatcatcagcaaaggcaccaaggactctccgtctgtctgctccaacctggctgccaagcacagcttctacaacaacaagtgcctggtgcacatcgtccgctccacctccctcaagtactccaagatccgccagttccaggagcacttccagttcgacgtgtgccgccatgaggtgcgctacggctgcctgcgggaggacagctgccacttcgcccacagcttcatcgagctcaaggtctggctgctgcagcagtactcaggcatgacccacgaagacatcgttcaggagtctaagaagtactggcagcagatggaggcgcatgcggggaaggccagcagcagcatgggtgctccgaggacacatgggcccagcacctttgacctgcagatgaagtttgtatgtggccagtgctggagaaacgggcaggtggtggagcctgacaaggacctcaagtactgtagtgccaaggcccggcactgctggaccaaggagcggcgggtccttctggtgatgtccaaggccaagaggaaatgggtgtcagtgaggccactgccatccattcgtaacttcccacagcaatacgatctctgcatccatgcacagaacggccgcaagtgccaatatgtggggaactgctccttcgcacacagcccggaggagagggacatgtggaccttcatgaaggagaacaagatcctggacatgcagcagacctatgacatgtggctgaaaaaacacaacccaggaaagcctggagaagggacccccatcagttctcgggaaggggagaagcagatccagatgcccacggactacgcggacatcatgatgggctaccactgctggctctgcggcaagaacagcaacagcaagaagcagtggcagcagcacatccagtccgagaagcacaaggagaaggtcttcacgtccgacagtgacgccagcggctgggccttccgcttccccatgggcgagttccggctctgcgacaggctccagaagggcaaagcctgcccagatggggacaagtgccgctgcgcccatggacaggaggagctcaacgagtggctggaccggcgcgaggtgctgaagcagaagttggccaaggctcgcaaggacatgctgctgtgcccacgggacgacgactttggcaaatacaacttcctgctgcaagaggacggggaccttgccggtgccaccccagaagcccctgctgctgctgccaccgccaccactggggagtagggccaggtgttggccgtgggtgaagtcctggggtcagggggtggggtggggccagaaggcctgatagaagggtcagggcaggccaggggggtggggggccgccctcatcaggcagcccccagccccctgaggccctgtccatcttctccccaccaccgccccggtgtgcgtacccaggcgcacgtgctgcagcccccggaggccccgctgaaacctgggctgcccttcccccacccccacggctctcctggttgaggagggaggggcctggctgacccctccagcttcagcctccagctttaacttctgtctgctcctaatgggggcccaaagctcagggctggggagcctggggtccccacttgaatctccagcaggagggtccttctctccctggcccgtcctcctcccaccccctccccctgggggcaaatcaggacacaacagagggcagaggccccattagctttaaaatgtagccccaggttggagctgggaacactgtactggccacttaccctctggggcctcagctttccctccggaaggctgggaggaggtgggctagatgatctttggagcttaaggagtcccagccctttctctgatgccaccacctgaaccctgctccctcgtgggccagtgaaaatagactgtaggtcctcagagccttcagagatgatccagcccaaaccccattttgcagagaggaaaactgaggcctagaagggaggagtggtccacccacggtcccagcacaaggcagagctgggatgaaaacagggctgaaaagactcagggccaattattggctgagcccacggtcccctcagcagggatgcgatggtctctgaatcagtgtgcagctggggtcccaggcagcgctgcctgggggctggggaggggaggcccagaggagggctggccatgtgagcaccccatgaagggaccgccccctcccaaggatggtccctttgggtgcagcagcagaggtcacctcctgacatgcgctctgggaaaggtggcagagggcaggacaccatgagctcaggatctgtgtgaggtgtgggaggtgggaagggtgagggtctgggggaatgcggagaaaagggaggcttgaccccgggcaccatgggccactccaggatgggacacggcccctctttcttggggacccagtatgtcctctcctctagacccagacatacagttataaccgtctgtcctagcccctccctaatccctggccctcccagctgtctgggacttcagtggacccccagcccctgcccccactcaccaaggcctcgctcgtccctctcgtctgacatgtctgtgtgcacccccctcctctccaccctaccttccatcaaccagggcagatccaccgtgccctggttccccagacattccagaatgccccacatcattggcacaggagtggggcagccccggaaggaaccagggattaggctgtaggggggtgagaaggagagaagggaccaccccattcttctcaagcaaggattgccagcgcgcgctgacacagtgatgggctgcccagggctggaggggacgctgttcctcccgccgccactgcccaacctttcctgataatcgtggcatgcgccctttcctcttccctgccccaccccctggccgcagcaggccagcactgcagagtttgggtgctggtggtgtggctgtaggggaggggagaccacacccaaggtgggggctgtggccatgtgtggccgtgatgtcgatgatactcgttttccctgatccgtggtgttgcagtccgttgtcaccagccttgtttctagtgtgtatatatgtcgcccccgtgatgcatatatacacaggtattaaatatatcgctctatataatattatatatgtgtgtggtatccaaggaatcacttttatgagggctaaagataaagaatttggccagaaaatgcagccatccttgtgtgattaggagggtttcaggggccactggactatttgcaaggtgacagggactggagccatggctcagaggtgattcgggcagccagggacaggagccaccctccccaggcccaactctgctagcttcccagaccacccccatcgagtgcggagagagtgggagtgctcagggaaagaaggtgatttgtatttgtctccccgctgaaaagaacaggattcaagtccagagttttcatcttcagcctgtgatctgtccagggacccttgggatctggggcttcctggcctggccagagctggagcccccacagggtaaggaagagagagtgggaggcagagtgtgatggggaggagggacaggaagacccttttaatgatgagggtaactatttcagttgtgagccttctagggccccaggctgggaggctcagaggactgaatctgggacctgtgttccccccggcaggcagggacaagatggcatggcaagcatgggggcggggtgggtggggagggatgctgcatttctcagctgggcagtaatcaatttaatggtcctttaaaatgtctgtgtattaaaaatttaagaataccacactttaatattaaatattcataaggtctagtatcttgataataatgtagatgttttaataacaatttttgtccttcttaaaataaaatgaaagaaacttg

SEQ ID NO: 2777 - DNA, 5909 bp, Homo sapiens
agggagacagtgcctccagcgggtgctgccgcgagcggccagccgaggggctggaaatgaaagtaaagcgctccagagccacatggacggagctgccggggcggcggcgccgggagcaggatgcggccgcccgtaattaaatagcatttactcttattattactaataataataacgtaatcatacctctagtcatagcataccatttatcgggctcggcgcaggcccgcggggagcgcagcccggcggagagactgatggagaggcagaaacggaaggcggacatcgagaaagggctgcagttcattcagtcgacactacccctaaagcaagaagaatatgaggcctttctgctcaagctggtgcagaatctgtttgctgagggcaatgatctgttccgggagaaggactataagcaggctctggtgcagtacatggaagggctgaacgtggccgactacgctgcctctgaccaggtggccctgccccgggagctgctgtgcaagctgcatgtcaatagggccgcctgctacttcaccatgggcctgtatgagaaggcgctggaggacagcgagaaggcgctgggcctggacagtgagagtatccgggcgttgttccgcaaggcacgcgctctcaatgaactgggacgccacaaggaggcctacgagtgcagcagccggtgttccctcgccctgccccacgatgaaagcgtgactcagcttggtcaggagctggcccagaaactggggctgcgagttcgcaaggcgtataagaggccccaggaattggaaaccttttctctgctcagtaacggcactgcggctggcgtggcagatcagggaacttctaatggattggggtccatagatgacatcgaaacagactgctacgtggaccctcgaggctccccagcccttctcccctccacgcccacgatgcccctgttccctcacgttctggacctgctggcccccctggacagcagcaggaccctccccagcaccgacagcctggatgacttctcagacggggatgtctttggcccagagctggacaccctcctggactcgctgtctctggtccagggtggcctgtctggcagcggcgtgcctagtgagttgccccagctgatacccgtgttccccggcgggaccccactgctaccacctgtggtgggtggctccatccctgtctccagcccactgccccccgcctccttcggcttggtcatggacccctccaagaagctggccgcctctgtgctggatgccctcgatcccccgggccccacgctggaccccctggacctgctgccgtactcggagacccggctggatgcactcgacagctttgggtcgacacgaggctccctggacaaacctgactccttcatggaggagaccaactcacaggaccaccgtccccctagcggtgctcagaaaccagccccctcgccagagccctgcatgcccaacactgccttgctcatcaagaaccccttggctgccacccacgagttcaagcaggcctgccagctctgctaccccaagacaggcccccgggctggcgactacacctaccgtgagggccttgagcacaagtgcaagcgggacatcctgctcggccggctccggagctcggaggaccagacctggaagcggatccggccccggcccactaagaccagcttcgtgggctcctactacctgtgcaaagacatgattaacaagcaggactgtaagtacggggataactgcaccttcgcctaccatcaggaggagatcgacgtgtggaccgaggagcggaagggcaccctcaaccgcgacctgctcttcgacccgctggggggtgttaagcgcggcagcctcaccatcgccaagctcctgaaggagcaccagggcatcttcaccttcctctgcgagatctgctttgacagtaaaccccggatcatcagcaaaggcaccaaggactctccgtctgtctgctccaacctggctgccaagcacagcttctacaacaacaagtgcctggtgcacatcgtccgctccacctccctcaagtactccaagatccgccagttccaggagcacttccagttcgacgtgtgccgccatgaggtgcgctacggctgcctgcgggaggacagctgccacttcgcccacagcttcatcgagctcaaggtctggctgctgcagcagtactcaggcatgacccacgaagacatcgttcaggagtctaagaagtactggcagcagatggaggcgcatgcggggaaggccagcagcagcatgggtgctccgaggacacatgggcccagcacctttgacctgcagatgaagtttgtatgtggccagtgctggagaaacgggcaggtggtggagcctgacaaggacctcaagtactgtagtgccaaggcccggcactgctggaccaaggagcggcgggtccttctggtgatgtccaaggccaagaggaaatgggtgtcagtgaggccactgccatccattcgtaacttcccacagcaatacgatctctgcatccatgcacagaacggccgcaagtgccaatatgtggggaactgctccttcgcacacagcccggaggagagggacatgtggaccttcatgaaggagaacaagatcctggacatgcagcagacctatgacatgtggctgaaaaaacacaacccaggaaagcctggagaagggacccccatcagttctcgggaaggggagaagcagatccagatgcccacggactacgcggacatcatgatgggctaccactgctggctctgcggcaagaacagcaacagcaagaagcagtggcagcagcacatccagtccgagaagcacaaggagaaggtcttcacgtccgacagtgacgccagcggctgggccttccgcttccccatgggcgagttccggctctgcgacaggctccagaagggcaaagcctgcccagatggggacaagtgccgctgcgcccatggacaggaggagctcaacgagtggctggaccggcgcgaggtgctgaagcagaagttggccaaggctcgcaaggacatgctgctgtgcccacgggacgacgactttggcaaatacaacttcctgctgcaagaggacggggaccttgccggtgccaccccagaagcccctgctgctgctgccaccgccaccactggggagtagggccaggtgttggccgtgggtgaagtcctggggtcagggggtggggtggggccagaaggcctgatagaagggtcagggcaggccaggggggtggggggccgccctcatcaggcagcccccagccccctgaggccctgtccatcttctccccaccaccgccccggtgtgcgtacccaggcgcacgtgctgcagcccccggaggccccgctgaaacctgggctgcccttcccccacccccacggctctcctggttgaggagggaggggcctggctgacccctccagcttcagcctccagctttaacttctgtctgctcctaatgggggcccaaagctcagggctggggagcctggggtccccacttgaatctccagcaggagggtccttctctccctggcccgtcctcctcccaccccctccccctgggggcaaatcaggacacaacagagggcagaggccccattagctttaaaatgtagccccaggttggagctgggaacactgtactggccacttaccctctggggcctcagctttccctccggaaggctgggaggaggtgggctagatgatctttggagcttaaggagtcccagccctttctctgatgccaccacctgaaccctgctccctcgtgggccagtgaaaatagactgtaggtcctcagagccttcagagatgatccagcccaaaccccattttgcagagaggaaaactgaggcctagaagggaggagtggtccacccacggtcccagcacaaggcagagctgggatgaaaacagggctgaaaagactcagggccaattattggctgagcccacggtcccctcagcagggatgcgatggtctctgaatcagtgtgcagctggggtcccaggcagcgctgcctgggggctggggaggggaggcccagaggagggctggccatgtgagcaccccatgaagggaccgccccctcccaaggatggtccctttgggtgcagcagcagaggtcacctcctgacatgcgctctgggaaaggtggcagagggcaggacaccatgagctcaggatctgtgtgaggtgtgggaggtgggaagggtgagggtctgggggaatgcggagaaaagggaggcttgaccccgggcaccatgggccactccaggatgggacacggcccctctttcttggggacccagtatgtcctctcctctagacccagacatacagttataaccgtctgtcctagcccctccctaatccctggccctcccagctgtctgggacttcagtggacccccagcccctgcccccactcaccaaggcctcgctcgtccctctcgtctgacatgtctgtgtgcacccccctcctctccaccctaccttccatcaaccagggcagatccaccgtgccctggttccccagacattccagaatgccccacatcattggcacaggagtggggcagccccggaaggaaccagggattaggctgtaggggggtgagaaggagagaagggaccaccccattcttctcaagcaaggattgccagcgcgcgctgacacagtgatgggctgcccagggctggaggggacgctgttcctcccgccgccactgcccaacctttcctgataatcgtggcatgcgccctttcctcttccctgccccaccccctggccgcagcaggccagcactgcagagtttgggtgctggtggtgtggctgtaggggaggggagaccacacccaaggtgggggctgtggccatgtgtggccgtgatgtcgatgatactcgttttccctgatccgtggtgttgcagtccgttgtcaccagccttgtttctagtgtgtatatatgtcgcccccgtgatgcatatatacacaggtattaaatatatcgctctatataatattatatatgtgtgtggtatccaaggaatcacttttatgagggctaaagataaagaatttggccagaaaatgcagccatccttgtgtgattaggagggtttcaggggccactggactatttgcaaggtgacagggactggagccatggctcagaggtgattcgggcagccagggacaggagccaccctccccaggcccaactctgctagcttcccagaccacccccatcgagtgcggagagagtgggagtgctcagggaaagaaggtgatttgtatttgtctccccgctgaaaagaacaggattcaagtccagagttttcatcttcagcctgtgatctgtccagggacccttgggatctggggcttcctggcctggccagagctggagcccccacagggtaaggaagagagagtgggaggcagagtgtgatggggaggagggacaggaagacccttttaatgatgagggtaactatttcagttgtgagccttctagggccccaggctgggaggctcagaggactgaatctgggacctgtgttccccccggcaggcagggacaagatggcatggcaagcatgggggcggggtgggtggggagggatgctgcatttctcagctgggcagtaatcaatttaatggtcctttaaaatgtctgtgtattaaaaatttaagaataccacactttaatattaaatattcataaggtctagtatcttgataataatgtagatgttttaataacaatttttgtccttcttaaaataaaatgaaagaaacttgcttcccttagcctttgttctagaaaataaacttgtgcactttga

SEQ ID NO: 2778 - DNA, 1601 bp, Homo sapiens
ggccctggcgcggctctgggtccgtctcgtcgcgtccgggttgtcactctctcgggttgttactctgtagcttcccggctcgcgaaagggaggacctgtctgggtcatggattttgagaatcttttctcaaaaccccccaacccggccctcggcaaaacggccacggactctgacgaaagaatcgatgatgaaatagatacagaagttgaagaaacacaagaagagaaaattaaactggagtgcgagcaaattcccaaaaaatttagacactctgcaatatcaccaaaaagttcgctgcatagaaaatcaagaagtaaggactatgatgtatatagtgataatgatatctgcagtcaggaatcagaagataattttgccaaagagcttcaacagtacatacaagccagagaaatggcaaatgctgctcaacctgaagaatctacaaagaaagaaggagtaaaagataccccacaggctgctaaacaaaaaaataaaaatcttaaagctggtcacaagaatggcaaacagaagaaaatgaagcgaaaatggcctggccctggaaacaaaggatcaaatgctttgctgaggaacagcggctcacaggaagaggatggtaaacctaaagagaagcagcagcatttgagtcaggcattcatcaaccaacatacagtggaacgcaagggaaaacaaatttgtaaatattttcttgaaaggaaatgtattaagggagaccagtgtaaatttgatcatgatgcagagatagaaaagaaaaaggaaatgtgtaagttttatgtacaaggatattgtaccagaggtgaaaactgtctgtatttgcataatgaatatccttgtaagttttaccatacaggaacaaaatgttatcagggagaatactgcaagttttctcatgctccactgactcctgaaacacaagaattgttggctaaagttttggatactgaaaagaagtcatgtaaataaaatagacataaaaaggtagcaatgtacagataaagagtactttaacgcccatgcgtgttcaagactgttcaagactggtgatttggagtagtttacaagattcctcattcagagtgccctcttgtgtgactggggtgatgtgcagcttccataatggatgggacagagagctgggatctaatgtacaagtgaagggcttggtcttccctgagacattccagccattggaataggagaggagcatatatggcagaggtgatggctggtgggtaaatgtgatagtaaattgtagaaacctcttctgattgattggatttccttaataaaatcggaagcaaggttaggctgagtgagggtgagtaaagaggtagaggaggtttgaggagagagaactgctcggaagacattggtagatggaccataaaaacagagttagttctctttatgacattaaatagttttacaacatatttttaatggttcacaatttcattttagggcttaaaataaattatggttctatgatttttttaaaccagtttcctattgttagacatttgtttccagtttcttactattataaataaagtgaaacaatatctcttactataccatttct

SEQ ID NO: 2779 - DNA, 1813 bp, Homo sapiens
gaggctgcgcggggcggagcctgtggccctggcgcggctctgggtccgtctcgtcgcgtccgggttgtcactctctcgggttgttactctgtagcttcccggctcgcgaaagggaggacctgtctgggtcatggattttgagaatcttttctcaaaaccccccaacccggccctcggcaaaacggccacggactctgacgaaagaatcgatgatgaaatagatacagaagttgaagaaacacaagaagagaaaattaaactggagtgcgagcaaattcccaaaaaatttagacactctgcaatatcaccaaaaagttcgctgcatagaaaatcaagaagtaaggactatgatgtatatagtgataatgatatctgcagtcaggaatcagaagataattttgccaaagagcttcaacagtacatacaagccagagaaatggcaaatgctgctcaacctgaagaatctacaaagaaagaaggagtaaaagataccccacaggctgctaaacaaaaaaataaaaatcttaaagctggtcacaagaatggcaaacagaagaaaatgaagcgaaaatggcctggccctggaaacaaaggatcaaatgctttgctgaggaacagcggctcacaggaagaggatggtaaacctaaagagaagcagcagcatttgagtcaggcattcatcaaccaacatacagtggaacgcaagggaaaacaaatttgtaaatattttcttgaaaggaaatgtattaagggagaccagtgtaaatttgatcatgatgcagagatagaaaagaaaaaggaaatgtgtaagttttatgtacaaggatattgtaccagaggtgaaaactgtctgtatttgcataatgaatatccttgtaagttttaccatacaggaacaaaatgttatcagggagaatactgcaagttttctcatgctccactgactcctgaaacacaagaattgttggctaaagttttggatactgaaaagaagtcatgtaaataaaatagacataaaaaggtagcaatgtacagataaagagtactttaacgcccatgcgtgttcaagactgttcaagactggtgatttggagtagtttacaagattcctcattcagagtgccctcttgtgtgactggggtgatgtgcagcttccataatggatgggacagagagctgggatctaatgtacaagtgaagggcttggtcttccctgagacattccagccattggaataggagaggagcatatatggcagaggtgatggctggtgggtaaatgtgatagtaaattgtagaaacctcttctgattgattggatttccttaataaaatcggaagcaaggttaggctgagtgagggtgagtaaagaggtagaggaggtttgaggagagagaactgctcggaagacattggtagatggaccataaaaacagagttagttctctttatgacattaaatagttttacaacatatttttaatggttcacaatttcattttagggcttaaaataaattatggttctatgatttttttaaaccagtttcctattgttagacatttgtttccagtttcttactattataaataaagtgaaacaatatctcttactataccatttctaaatttagagttcgtaacttttctgttgttaaaatataagaatatttatctttctcattggtttataaactgtagtcagattatacacttgtgtgagttacaaactttaggagtgtgatggtatcattaacacaagattcaaatactaatgttccaagtacaaataataatgagattctaaatatgca

SEQ ID NO: 2780 - DNA, 2876 bp, Homo sapiens
aaagggccagcggggcacgtggctcgggacgcagttcgctgccgcccggcagtagctctcaggttaggcgggtcccgctccgcttccgccgtcgctgccgcgccgccccgggcccgacaggccgggtccagggactgcaacccagcgagggacgcgggcagccatggccgaagcggcgcctgcccgggaccccgagacagacaagcacacagaggaccagagtccttcgacacccttgccccagccagctgctgagaagaactcgtacctctactccacggaaatcacactgtggacggtggtggccgccattcaggccttggagaagaaggtggattcctgcctgacccgcttgctgactctggaggggcgcacggggacagccgagaagaagctggccgactgcgagaagacagctgtggagttcgggaaccagctggagggcaagtgggccgtgctggggaccttgctgcaggagtacgggctgctgcagaggcggctggagaatgtggagaacttgctgcgcaacaggaacttctggatcttgcggctgcccccgggcagcaagggggaggcccccaaggtgcccgtgaccttcgatgatgtggccgtgtatttctctgagctggagtggggcaagctggaggactggcagaaggagctctacaagcacgtgatgaggggcaactacgagacgctggtctccctggattatgcaatctccaaaccagacatcctcacccggatagagaggggagaggagccttgtcttgaccggtggggccaggagaaggggaatgaagtagaggtgggacgtccaaggatgatgggcactggcctccctccgtatccagagcacctcaccagcccacttagccctgcccaggaggagctgaaagaagggcaggcccccaagcagcagcaggactcagaggcgagagtggccccagccgggccagaagcaggactggcattgcggactgacctccagggagaggcccagatctgatctgcagagatctcccttccggctatcgtggctgctgttcaggtggtggagaagaagatggaaccccaggctgcctggctacagagcctggagggatgcatgtggacagccaagaagaagctggctgactgcgagaaggtggctgtggagttcgggaaccagctggaggccaggccaccaccaagccagatctggcaccagtggagaaaggagacaggcaggcaactgcagcctgcccagtgcggagaggggccagagcccgggcactgatttctccaggagagagctttgtttacccccaaggactgggcttcactcctaaaagctgcttctaaaccctttgcgtgcaggccccagacagtgtgggtgcatgactgctttatctgttggatgtttccacaggcaggctgttgctgccagaattctagaagcagtgtaaacgggctgctcattcattagggccctggttaatggtggagccagcctggtgtgtggcagccaggtcgggctggtgtcttcagagtggctgtgtcagaagggcctcgtgtatgacagaaacgcaggccagctggaacgtccccaggcgttctgtcctggatcaagcaagaggaaggggcaagtgggaggagccagcagggcccacaggagaccactgtggcacacctgtgctcaggcagcatggtgctgggcgctgcaggggctcattaatgcatgagacacagattccactcaggagagagaagacgaacacagacacagtacacggtgggaaggggcacttccatgtctgcagccagagagccctttcagaatctgacccaaaagatggccagtattctaagaaaaagcacatatgcttacgatgtgcaaacagctgaaggtgttctttcaactatagtaaaaggggtgtctcggtggccacaggcggcccagatgaagagacctgtctgggccgcagagaggagtctggaggccccccgagccaggctgagccagccgctaggggcacggagcagtgcccaccttgcgcccagtgtggccagagcttcggccagaaggagctcagtgcgccgcaccagcgcgtgcatcgtggcccccggcctttcgctggtgctcagtgtcccaagagcttcacgcagcggaccacccccgccagccaccgtcgggcgcacgtggccgagtgcacctacacccgcgcccaatgcggcaagaccttcctccagcagtcgacgctcacacccactactgcgcgcacatcagggagaagccctacgagtgcgccaagctctttggccgcctgtccacgctgctggagcaccggcacatgcacacgggtgagcggcccttccagtgcacgcaatgtggctgctgcttcagccgcctgtccacgctgctggagcaccggcacacacacatcagcgagaagcccttccagtgtgcgcagtgcgacaagcgtttcacgcgtctggccaacctgaccgtgcaccagagagtgcacttgggcgagcgctccttccagtgcgcccagtacagcaggagattcatgcagaagcccggcttcctgcgtcatctgtgtggccactcgcaggagaagcactatccttgcagcccttgtggttcccatgatcagtggtgaaatatagtgattttcacctgtgcttccattctgaagttctggaaagaagtactggatggactgaagtccaggacaacgtcccaaagaaaggcagagtccaggtaggcttggaggaccaagccctggatgagcactggagggcagaggcctcagtgtccagcactgtgccctgcacatggaaagcccctacgtttgtggaatgaatgaataataaaaatgttttcataagtg

SEQ ID NO: 2781 - DNA, 943 bp, Homo sapiens
gcgttttccgcgtgtcccgagccccggcggccccgcgagctcggtccgtgcggggaaagcagggctgacgccgtctgcggagaggactgcgcagccgggcttgtgtggggccgcgcgtaacggcagcggctactccctgcccaggccggccagcacagggccatggccgaggcggctgcgcctccggactggcattgcggactgacctccagggagaggcccagatctgatctgcagagatctcccttccggctatcgtggctgctgttcaggtggtggagaagaagatggaaccccaggctgcctggctacagagcctggagggatgcatgtggacagccaagaagaagctggctgactgcgagaaggtggctgtggagttcgggaaccagctggagggccctggttaatggtggagccagcctggtgtgtggcagccaggtcgggctggtgtcttcagagtggctgtgtcagaagggcctcgtgtatgacagaaacgcaggccagctggaacgtccccaggcgttctgtcctggatcaagcaagaggaaggggcaagtgggaggagccagcagggcccacaggagaccactgtggcacacctgtgctcaggtaaggcatgctgggccatgtctcctcaggcctgtatccctgggccttaggagacatggcgtcccctggggggcctcacagcgcctctagtggggccttctcctgggcgaggctcctgagggaaggcagtgcgcagccttggctgtgtctctgcagaatcttgtatgcttgctgcgtggtgtcctcccatgcagttgcacgaaatcattcttttattcctgatcctgtttcctgtttatttcatgaacttgtctgtaggcagcatggtgctgggcgctgcaggggctcattaatgcatgagacacagattccactcaggagagagaagacg

SEQ ID NO: 2782 - DNA, 4452 bp, Homo sapiens
aaagggccagcggggcacgtggctcgggacgcagttcgctgccgcccggcagtagctctcaggttaggcgggtcccgctccgcttccgccgtcgctgccgcgccgccccgggcccgacaggccgggtccagggactgcaacccagcgagggacgcgggcagccatggccgaagcggcgcctgcccgggaccccgagacagacaagcacacagaggaccagagtccttcgacacccttgccccagccagctgctgagaagaactcgtacctctactccacggaaatcacactgtggacggtggtggccgccattcaggccttggagaagaaggtggattcctgcctgacccgcttgctgactctggaggggcgcacggggacagccgagaagaagctggccgactgcgagaagacagctgtggagttcgggaaccagctggagggcaagtgggccgtgctggggaccttgctgcaggagtacgggctgctgcagaggcggctggagaatgtggagaacttgctgcgcaacaggaacttctggatcttgcggctgcccccgggcagcaagggggaggcccccaaggtgcccgtgaccttcgatgatgtggccgtgtatttctctgagctggagtggggcaagctggaggactggcagaaggagctctacaagcacgtgatgaggggcaactacgagacgctggtctccctggattatgcaatctccaaaccagacatcctcacccggatagagaggggagaggagccttgtcttgaccggtggggccaggagaaggggaatgaagtagaggtgggacgtccaaggatgatgggcactggcctccctccgtatccagagcacctcaccagcccacttagccctgcccaggaggagctgaaagaagggcaggcccccaagcagcagcaggactcagaggcgagagtggccccagccgggccagaagcaggtggtggtgtggccatcaagacagaggcacagtctgaagacgagatgacgcctgagcggctctttctgggggtgtcccgaggccagaccgagtgtagaatcccccgagggcccaggaacaggcctgggggccccagccgtcatcaggcccagggcatgcccagggtgcgggcaggggagccacggccaccgggggccagtggggagacgccccgagtcctctcccgcaggcggcagcgggcattcccctgccccgactgcgggcagagcttccgcctgaagatcaatctgacgattcatcagcggacccatgtggaggaggggcggcaggaggcccccggccgctcgcccaccagctgcggggacagccaggccatgctggagccgggggaggtggtggtacccggccctgtcatccgctggctccccgaggagcctgagggtcgccgctccgtggcagggggccgtgccttggtggggcggcggcctgcagccagcaagatgtaccactgcagcgagtgcctgcgcttcttccagcagcgcaagagcctgctgctgcaccagcgcctgcacaccggcaatggccagggctggcccgcctgcccctactgcggcaaggccttccgccggccctcggacctcttccggcaccagcgcatccacaccggtgagcggccctaccagtgcccccagtgtggccggaccttcaaccgcaaccaccacctggccgtgcacatgcagacccacgcccgaggccaggtgggcccacacttccctgccgcccccgcccgccacgggagcctgcccctgccctggcccagccggaaggaggagggctgacctggcaggagcccacagaggacccctggcggggtctctcccctgtgcctgacgcaggttcttccttttcctgggatggagagaggtttgttgtttttacccattcaaatgggaagctagctgcccttctggtgacattgtgtgtgaccgggtgctttctgtttcctgtttgcactcttcgctgccttttctgcattcctgacttctaaaagatgccttaaggcttaagggatgccatatttttgataaggcctctggtaggtaccacagccaagaggaccagagatcatggcccttccagtatgggggcgatagagacatcggggacctgggatttttgttttgtgcagagatctcctgcctgctgtcaccatgagaaacagtggagtggagtggatggatggcctgacttgaagaaagggccctggaaagttttctactttgctattttgaaatttttttcccttcttatagagactttgaaatacttttgtaaatgtgtgtagttgttaatggaactttgccttttgcaaagtcggaaagagtcggcttttccatgtgaggctcgcagagctgaaaggggagctacgtccaccagcctgtgggtcttttggttttttttttgttgttgttgttgtttttttaagatggagtttcactcttgttgcccaggctggagtgcaatggtacaatctccgctcactgcaacctccgcctctcgggttcaggtgattctcctgcctcagcctcctgagtagctgggattacaggcgcccaccaccactcccggctaatttttgtatttttagtagagacagggtttcatcatgttgtccagactggtctcgaactcctgatgttaggtgacccgcacacctcggcctcctgaagtgctgggattacaggcgtgagccaccactcttggcccagcctgtgggttttgatggggatgtcttggctgctgtcttggaggcacagtgtctccccatgtgtgtgtttcttggcccagagtgactcccagtattcctagtccttccccacaggatagtcacatccattatttacttttgttgtcagctgggaggggaaactgaagcctggacacgtctccccaagggctcagtgttcatgggtgtgtaagatccattgactggaccccagaaagcaccctgaggggcagtgcagagagagcccaggaagcccctccactagaggaggcccttggtctggctgaggaccacgtccaccctgggcctccaggcctgcttttcacattaaaggcggggcagtctcctctcaaaggagttctcccttgagcactttgggctctggggcagagttgggctaggagatctgggtgaatcctttagtcacagctagtctcatgttcctcttctgtcaaaggggtcatggccccagtgtgtcctacctcagagttgtcagggtcaaagtaacaggcactgggacaaatatgaagcctagctttgtgcttcctttcaaattcagggcctcctttctactccattccagcctttttttcctgtcagaatccctcaggaaggacctttatcttctggagtgagtggcagttccactgggttcagtgaaagagtcgcccatggggctctgttccccaggagtcctttgtattttggtgaacaaattcttaccaaagcatgagattcggactgtagaagttcagactgcctcagttcagactgcctcatggggcagtctggaggtcagctggcttctggtgtctctcatcacaccactgcggacgctgtctgtagagcagccttggtgtgggtgactctgaagctggagtgatgggaccccagctatccttgttttttaccgccttgtctggcactgtgaccacgcttcagggctgcttctgggggtcttggtccctggatgtgccatttccttgcccttctgaccctcacacttcttccaaagtcttgagcagagttgggggccaatggtagcattgctgtcatctctgggaggagagtgagtatacaagtcagtgacagttcagccaggctcccttgggtttgggaagaggcactgcccttctgtgctgtggatcctgcttgtctgctctggagtccccccacccttgccaggagcttcacaaaccagagacgggctgtcagcaagagctcagacaggatgtggtgcaagtgcaggtgcacgagtttaaccctcagctgcaggagctagtctcaggtgttctggggatgcctcaggctaagaattttgccgactttctgggcttggttggctaatgccaaatgcccctgcttaaatatcacaaggtgctgattctccttttttctttttttcataccaatgtgctcaaactttgagctaggtcttgtgagtttgcctagcactcagacctgtttaagtaacgttctttacattgaaacaagtcaaccgaagctttgtggtgcaggagctgagggtgccccagactcagtgggagccctggttgggccccaaactctcccagcagggtcctcggtttcctcatttgtgaaataaatgagtgggccacgacgttaataagcccaagagaactgtgaaggtggtagtcccttgccctaattggtgctcaataaagttgttggcataaacga

SEQ ID NO: 2783 - DNA, 2346 bp, Homo sapiens
cccggcagtagctctcaggttaggcgggtcccgctccgcttccgccgtcgctgccgcgccgccccgggcccgacaggccgggtccagggactgcaacccagcgagggacgcgggcagccatggccgaagcggcgcctgcccgggaccccgagacagacaagcacacagaggaccagagtccttcgacacccttgccccagccagctgctgagaagaactcgtacctctactccacggaaatcacactgtggacggtggtggccgccattcaggccttggagaagaaggtggattcctgcctgacccgcttgctgactctggaggggcgcacggggacagccgagaagaagctggccgactgcgagaagacagctgtggagttcgggaaccagctggagggcaagtgggccgtgctggggaccttgctgcaggagtacgggctgctgcagaggcggctggagaatgtggagaacttgctgcgcaacaggaacttctggatcttgcggctgcccccgggcagcaagggggaggcccccaaggtgcccgtgaccttcgatgatgtggccgtgtatttctctgagctggagtggggcaagctggaggactggcagaaggagctctacaagcacgtgatgaggggcaactacgagacgctggtctccctggattatgcaatctccaaaccagacatcctcacccggatagagaggggagaggagccttgtcttgaccggtggggccaggagaaggggaatgaagtagaggtgggacgtccaaggatgatgggcactggcctccctccgtatccagagcacctcaccagcccacttagccctgcccaggaggagctgaaagaagggcaggcccccaagcagcagcaggactcagaggcgagagtggccccagccgggccagaagcaggactggcattgcggactgacctccagggagaggcccagatctgatctgcagagatctcccttccggctatcgtggctgctgttcaggtggtggagaagaagatggaaccccaggctgcctggctacagagcctggagggatgcatgtggacagccaagaagaagctggctgactgcgagaaggtggctgtggagttcgggaaccagctggaggccaggccaccaccaagccagatctggcaccagtggagaaaggagacaggcaggcaactgcagcctgcccagtgcggagaggggccagagcccgggcactgggccctggttaatggtggagccagcctggtgtgtggcagccaggtcgggctggtgtcttcagagtggctgtgtcagaagggcctcgtgtatgacagaaacgcaggccagctggaacgtccccaggcgttctgtcctggatcaagcaagaggaaggggcaagtgggaggagccagcagggcccacaggagaccactgtggcacacctgtgctcaggcagcatggtgctgggcgctgcaggggctcattaatgcatgagacacagattccactcaggagagagaagacgaacacagacacagtacacgagacctgtctgggccgcagagaggagtctggaggtagggtccaagggccacgagccagtttgggctgctggaggggggcctggcaaggagggctctcggggaagcacctgtgggggtctgcttcctgaccccagggagctagaggcctccctccctccaggccccccgagccaggctgagccagccgctaggggcacggagcagtgcccaccttgcgcccagtgtggccagagcttcggccagaaggagctcagtgcgccgcaccagcgcgtgcatcgtggcccccggcctttcgctggtgctcagtgtcccaagagcttcacgcagcggaccacccccgccagccaccgtcgggcgcacgtggccgagtgcacctacacccgcgcccaatgcggcaagaccttcctccagcagtcgacgctcacacccactactgcgcgcacatcagggagaagccctacgagtgcgccaagctctttggccgcctgtccacgctgctggagcaccggcacatgcacacgggtgagcggcccttccagtgcacgcaatgtggctgctgcttcagccgcctgtccacgctgctggagcaccggcacacacacatcagcgagaagcccttccagtgtgcgcagtgcgacaagcgtttcacgcgtctggccaacctgaccgtgcaccagagagtgcacttgggcgagcgctccttccagtgcgcccagtacagcaggagattcatgcagaagcccggcttcctgcgtcatctgtgtggccactcgcaggagaagcactatccttgcagcccttgtggt

SEQ ID NO: 2784 - DNA, 5428 bp, Homo sapiens
ggagcgagcgagtgcccagggtgaatcaatggaaaccccctcacgaagccggggaaacacttcagccgcagccaaatagcattgattattttccttcacttccctcaccgccgtgaatttatttatttatttttttccgtctccgtccctgacgccccggagcgagcgctggagggagggaggaggaggggaaaaaagaggaatcaacacatcggagaagtcccttccaagagccgccccctcccctccccgcctcgcgctgctcggtggccgcggttcgactcccgtccctgcttccagctgaggtggtactggctgtcacgctgacatgagcccccagcactcctccgtctaccatggccacccttaactcagcctctaccactggtaccaccccctcccctgggcacaatgccccgtccctgccttcggacaccttctcctccagcaccccctctgatcctgtcaccaaagatccccctgctgcctcctccacctctgagaacatgaggtcctcagagccagggggacagctcctggagtcgggctgtggcctcgtcccaccaaaggagattggggagccccaggaagggcctgactgtggtcacttcccaccaaatgacccaggggtggaaaaggacaaggagcaggaggaggaagaagaagggctccctcccatggacctaagcaaccacttattcttcacagctggaggtgaggcctacctagtggccaagctgtccctgccaggtggcagtgaactcctgttaccaaagggcttcccctggggtgaggcgggcatcaaggaagagcccagtctgcccttccttgcctacccacccccctcacacctcactgcccttcacatccaacatggctttgacccaatccaaggctttagctcttctgaccaaattctgtcccatgatacctcagcaccatctccggctgcctgtgaggaaaggcatggagctttctggagctaccagctggctccaaatccacccggagatcccaaagatggccccatggggaacagcgggggcaaccacgtggcggtcttctggctctgccttctgtgccgcctgggtttcagcaagccccaggcctttatggatcacacacagtctcatggggtgaagctaacccctgcccaatatcagggcctgtcaggtagcccagctgtactccaggagggagatgaaggctgcaaggccctcataagctttctggagccaaaactccctgctcgcccctcttctgacataccccttgacaacagcagcacagtgaacatggaggcgaatgtggcccagacagaggatggcccccctgaggcagaagtccaggcccttatcctcctggatgaagaagttatggccctcagcccaccctctccacccacagccacctgggaccccagcccaacccaagccaaagaatcgccagtagcagcaggcgaggcagggccagattggttccctgaggggcaagaagaggatggagggctctgccccccactcaaccaaagctcacccacctccaaggaggggggcactctccctgccccagtgggctcccccgaagaccccagtgacccaccccagccctatcgcctagctgatgactacaccccagcccctgcagccttccagggcctcagcctgtccagccacatgtccctgctccactcacgcaactcctgcaagacactcaagtgtcccaagtgcaactggcactacaagtaccagcagaccctggatgtgcacatgcgagagaagcaccctgagagcaacagtcactgcagctactgcagtgctgggggcgcccacccccgccttgctcgtggagagagctacaactgtggctacaaaccctaccgctgtgacgtctgcaactactctacaaccaccaaaggcaacctcagcatccatatgcagtctgacaagcacctggccaacctacagggcttccaggcgggccctggtgggcagggaagtccaccagaggcatcactcccaccctccgcgggagacaaagagcctaagaccaaatcatcctggcagtgcaaggtgtgcagctacgagacaaacatctcccgtaacctgcgcatccatatgacctctgagaagcacatgcagaatgtcctaatgctgcaccaggggctgccgctgggcctgccacctggattgatggggccaggccctcctcccccaccaggggctacccccactagcccccctgaactcttccagtactttgggccccaggccctagggcagcctcagactcccttggctggcccggggctgaggccagacaagcccctggaagcccagctacttctcaatggtttccaccacgtaggagcacctgcccgcaagttccccacatccgcccctggaagcctatcccctgatgcccacctgcctccaagtcagctcctgggttcctcatctgacagcctgcccacctcaccacccccagacgacagcctgtccctgaaggtgttccgctgcctagtgtgccaggccttcagcacagacagcctggagctgctgctctaccactgcagcataggccggagcctcccggaagctgaatggaaggaggtggctggtgacacccaccgctgcaagctttgctgctatggcacccagctcaaggccaacttccaactccacctcaagactgacaaacatgctcagaagtaccagctggcagcccacctgcgggaggggggtggagccatgggcaccccttccccagcatccctgggagatggggctccttatgggtctgtctccccactacacctgcgctgcaacatctgtgactttgagtccaacagcaaggagaagatgcagctgcatgccaggggtgcagcccacgaagaaaacagccaaatctataagaggacaggaactggactcttaataaaatgatctcttaggccctaccagttctaatactgtaattttccctctatcttctgtgtgggtgtttctttttgttggcttttcatactctcctacctgctgattgagccatccattttctccttcattgactggctgcttgtcctgcttcctctgtcctatgtcctcccttccctgatgccacacctctttaagctgactctccccccatcctacacagggaaggctcctgtcacccccttagctgagccacccacccctgagaaagatgcccagaacaagacagaacaattgggtgagttttccctcccttccccccagtcctcctaccttctgagacgctcacgggaccttgcagtaatccaggagcccagcaatgtctgtgctcaaggagcaaaactgattaaagaaagggctcatcagggggaagggaggctgagccacgagaggctaggcacttccgccctctttgagaactcagacctgaccatcctactgacccggagtcagcccttgccaagcctcacctatctactgagtttcctgccctttctctagtgcccaactccctaccctggaagctctctgctacaaatcatcttgagggctgtcagggttccttaatctcctcttctttcatcctcagcttcagaagagacagaaaacaagactggcccttccagagacagtgccaaccagaccacggtcagaattggggtaactgggaagagctgaagtgggggcctggctttactgagatctgctcatattctaaaggcagacgtaattttgtcatgctttgacttatttcactcagaatagcacagttaagaaattccacccagatccagttccacatgttcagcactttcgggggcagagctggcccagcagggtcaagcacagagggagatgataggagggagacagcaggaacttgagggaaagatgaataaaggaattgtgctgagagtaggaaagagtgggggtacatgctggaaggaggggaggagaaaggcaaaagcaaacaaccagctactgcccagctctttatcccttagttaggagcagaaagacaagacaccggtgttcctaccctacaaaacgccctgagcctggatggaactgtcctggcatcctcttactaagggtaggggcaccaaccaaatgattcacactgacagcatgtgccacaaatctctaaatccccaggactcagacctaggcagcacccaggaatggcagctctgtgttctgaggggattcccagcctctggtttgagatgccatcctgtgcctcacagctctccaaactggactacaatatgtaacatttattgttattgcaatacgcagtgttactgcattactgcaagctgaagtaatgccttatgtcctcagcatcttttcttcctaactcctgctcccgccaacagacctcttccagatgtctgctccaggggctaggtgcgttaagatgagcatctggatccccttcctttacagtcatcccctccctgacacacaggcctgtgccactggtgccagcctggatgcaggctgggtaggtctggcagtcaggtgatggtggggcctctggcagcctcacccctctggaagtgtggctgagaatgtgctgagagggctgggccagaattttcctgggccactgggggagctgtggtgtttattcacattaggaaaaagaagaaggaaaaagaaagatggaaaataaggtgggagctgctgagcctgagggaggatgagctggcttctgagcagacaggtagggcccctttccaggtgatggttcacagaggcagagtgggcagggacaagggagcctctgggtccagaaaatgcccagaggaaatggaaccatttcacagagaagacacgacaggataggataggtaagagaagaaaactaaatccaaggtgggggcagtaggtacagagccatctgttagctggagagttgaggcaggcagcaaagactgggaaagacacaccaagaaaaggcagagaggccaggatggtggaagagggccagacaaagaaggagtgcaaggtagcggcctaagctaggcctttgtcccaatccaagggaaagtggggaggagccagctctcaggactgtggctggaggctgggtctgctataatgccttcctatctggctagttcctcttcaattaggagtgagaggccaagcgtggtggctcacgcctgtaatcccagcactttgggaagccaagatgagtagatcacctggcatcaggagttcaagaccaacctggccaatgtggcaaaaccctgtctccactaaaaaatacaaaaattagctgggcgtggttgcacacgcctgtaatcccagctgcttgggaggctgagggcaggagaattgcttgaacctggaaggcggaggttgcagtgagccgagatcacgtcactgcactccggcctgggtgacagagccagactccatct

SEQ ID NO: 2785 - DNA, 821 bp, Homo sapiens
acgcccgttgtggcggtgccgagagcaggccagggctcgagacacgcgctatgtaatgggaggccgcgacccccgcggtggccaggggagcgaggccgccccttgcattctgctcctcattgttggccccgcacggctcccgggggctggtacaggtctcatgcctgaggctgagccaggcaccccgaggcgcggatgcatgatgggagatgtagttccaaagggagactttgccatctcgccccgcccgtcgctatggcgacaggaaagctgcacttggtgcctgcggtactctacctaaagctgaactggggctacaaggcggcggggagagtcgggtgcaaggagctcaagccccagtcccgtctccaacaccccccgccgcacccccaacgcaggcagatgggcctggaatacaagccattcacaccgtccaacagatatctgctatagcagccagctaagcgcagggtactggctgtcacgctgacatgagcccccagcactcctccgtctaccatggccacccttaactcagcctctaccactggtaccaccccctcccctgggcacaatgccccgtccctgccttcggacaccttctcctccagcaccccctctgatcctgtcaccaaagatccccctgctgcctcctccacctctgagaacatgaggtcctcagagccagggggacagctcctggagtcgggctgtggcctcgtcccaccaaaggagattggggagccccaggaagggcctgactgtggtcacttcccaccaaatgacccaggggtggaaaaggacaaggagcaggaggagga

SEQ ID NO: 2786 - DNA, 8855 bp, Homo sapiens
gtggccgcggttcgactcccgtccctgcttccagctgaggtggtactggctgtcacgctgacatgagcccccagcactcctccgtctaccatggccacccttaactcagcctctaccactggtaccaccccctcccctgggcacaatgccccgtccctgccttcggacaccttctcctccagcaccccctctgatcctgtcaccaaagatccccctgctgcctcctccacctctgagaacatgaggtcctcagagccagggggacagctcctggagtcgggctgtggcctcgtcccaccaaaggagattggggagccccaggaagggcctgactgtggtcacttcccaccaaatgacccaggggtggaaaaggacaaggagcaggaggaggaagaagaagggctccctcccatggacctaagcaaccacttattcttcacagctggaggtgaggcctacctagtggccaagctgtccctgccaggtggcagtgaactcctgttaccaaagggcttcccctggggtgaggcgggcatcaaggaagagcccagtctgcccttccttgcctacccacccccctcacacctcactgcccttcacatccaacatggctttgacccaatccaaggctttagctcttctgaccaaattctgtcccatgatacctcagcaccatctccggctgcctgtgaggaaaggcatggagctttctggagctaccagctggctccaaatccacccggagatcccaaagatggccccatggggaacagcgggggcaaccacgtggcggtcttctggctctgccttctgtgccgcctgggtttcagcaagccccaggcctttatggatcacacacagtctcatggggtgaagctaacccctgcccaatatcagggcctgtcaggtagcccagctgtactccaggagggagatgaaggctgcaaggccctcataagctttctggagccaaaactccctgctcgcccctcttctgacataccccttgacaacagcagcacagtgaacatggaggcgaatgtggcccagacagaggatggcccccctgaggcagaagtccaggcccttatcctcctggatgaagaagttatggccctcagcccaccctctccacccacagccacctgggaccccagcccaacccaagccaaagaatcgccagtagcagcaggcgaggcagggccagattggttccctgaggggcaagaagaggatggagggctctgccccccactcaaccaaagctcacccacctccaaggaggggggcactctccctgccccagtgggctcccccgaagaccccagtgacccaccccagccctatcgcctagctgatgactacaccccagcccctgcagccttccagggcctcagcctgtccagccacatgtccctgctccactcacgcaactcctgcaagacactcaagtgtcccaagtgcaactggcactacaagtaccagcagaccctggatgtgcacatgcgagagaagcaccctgagagcaacagtcactgcagctactgcagtgctgggggcgcccacccccgccttgctcgtggagagagctacaactgtggctacaaaccctaccgctgtgacgtctgcaactactctacaaccaccaaaggcaacctcagcatccatatgcagtctgacaagcacctggccaacctacagggcttccaggcgggccctggtgggcagggaagtccaccagaggcatcactcccaccctccgcgggagacaaagagcctaagaccaaatcatcctggcagtgcaaggtgtgcagctacgagacaaacatctcccgtaacctgcgcatccatatgacctctgagaagcacatgcagaatgtcctaatgctgcaccaggggctgccgctgggcctgccacctggattgatggggccaggccctcctcccccaccaggggctacccccactagcccccctgaactcttccagtactttgggccccaggccctagggcagcctcagactcccttggctggcccggggctgaggccagacaagcccctggaagcccagctacttctcaatggtttccaccacgtaggagcacctgcccgcaagttccccacatccgcccctggaagcctatcccctgatgcccacctgcctccaagtcagctcctgggttcctcatctgacagcctgcccacctcaccacccccagacgacagcctgtccctgaaggtgttccgctgcctagtgtgccaggccttcagcacagacagcctggagctgctgctctaccactgcagcataggccggagcctcccggaagctgaatggaaggaggtggctggtgacacccaccgctgcaagctttgctgctatggcacccagctcaaggccaacttccaactccacctcaagactgacaaacatgctcagaagtaccagctggcagcccacctgcgggaggggggtggagccatgggcaccccttccccagcatccctgggagatggggctccttatgggtctgtctccccactacacctgcgctgcaacatctgtgactttgagtccaacagcaaggagaagatgcagctgcatgccaggggtgcagcccacgaagaaaacagccaaatctataagtttctgctggacatggagggagcggaggcaggggcagagctggggctataccactgcctgttgtgtgcgtgggagacaccctcccgcttggctgtgctgcaacacctgcgcacacctgcccaccgcgatgcccaggcccagaggcgtctgcagctgctacagaatggcccaaccactgaggaaggactcgcagctcttcagagcatcctgagcttcagccacgggcagctccggactcccgggaaggctcctgtcacccccttagctgagccacccacccctgagaaagatgcccagaacaagacagaacaattggcttcagaagagacagaaaacaagactggcccttccagagacagtgccaaccagaccacggtatactgctgtccatactgcagcttcctgagcccagagtccagccaggtgagggctcatacactctcccagcatgcagtgcagcccaagtacagatgcccactgtgccaggaacagctggtgggccggcctgccctgcacttccaccttagccaccttcacaacgtggtgcccgagtgcgttgagaagctgctgcttgtagctacaactgtagaaatgacatttacaaccaaagtgctgtctgcacccacattaagccctctggacaatggccaagaaccccccactcatgggccagagcctacaccgagcagagaccaggcagcagaaggccctaacctgaccccagaagccagtccagatcctcttcctgagcctcccctggcctcagttgaggtcccagacaaaccctcaggaagccctggccaacccccttctccagccccatctccagtccctgaacctgatgcccaagctgaagacgtagctcctccgcccaccatggctgaggaggaagaggggaccactggggagctccgctctgcagagccagctccagctgactctcgccaccctctgacctatcggaaaaccaccaactttgccctggacaagtttctcgaccctgcccggccctataagtgcactgtgtgtaaggagtccttcacccagaagaatattctgttggttcattataattctgtctcccaccttcacaagatgaagaaggctgccattgacccctctgcccctgcacggggagaggccggtgccccacccaccaccactgctgccacagacaagccctttaagtgcacagtctgcagagtctcctacaaccagagctccaccctggagatccacatgcggtcagttctgcatcagactcgctctcggggaaccaagactgattccaagattgaagggccagaacgcagccaagaagagcccaaggaaggcgagacagagggggaggtgggcactgagaagaagggccctgacaccagtggcttcatatctggattgcctttcctgtcccctcccccacctcccttggacctgcaccgattcccagcccctctcttcaccccaccagtcctgccccccttccctctggtgcccgaatcactgcttaagctccagcagcagcagctgctcctgcccttctacctccacgatctcaaggtggggcccaagctgacactagctgggcctgcacctgtgctgtccctgccagctgccacccctcctcctccaccccaacctcccaaggctgagctggctgagcgggagtgggagcggccccccatggccaaagagggtaatgaggcagggccttcctcaccccccgacccattgcccaacgaggctgcccgcactgcagccaaagcccttctagaaaactttggctttgagctggtgatccagtacaatgaagggaagcaagctgtgccccctccccctaccccacccccacctgaggccctcgggggtggggacaagctggcctgtggggcctgtgggaaactcttctccaatatgcttatcctcaagacacacgaggaacatgtccaccgccgctttctgccctttgaagccctgagccgttatgctgctcagtttcgaaagagctatgacagcctatacccgccccttgcagagcctcccaaacctcctgatgggtctctggattcacctgttccccatctgggcccacccttcctggtcccagagcctgaggcaggggggacccgtgcccctgaagagcgaagtcgagcagggggacactggcccatagaagaggaagaaagctccagagggaatcttcctcccctggtgcctgccggccgccggttctccagaaccaagttcacagagttccagacccaagccctgcagtctttctttgagactagcgcctaccccaaagacggagaggtggagcgactcgcaagtctgttgggtctggctagccgtgtggtggtggtgtggttccagaatgcccgccagaaagcacgcaaaaatgcctgtgagggtgggtccatgccaaccggaggaggcactgggggagcctccggctgcaggcgttgccacgccactttctcctgtgtttttgagttggtgcgccacctcaagaagtgctatgatgaccagacccttgaagaggaggaggaagaggcagagagaggggaagaggaggaagaggtggaagaagaagaagtagaggaggaacagggccttgaacctccagcagggcctgagggcccattaccagagcctccagatggggaggagctgagccaagcagaggcaacaaaggcaggaggcaaagagcctgaagagaaggctactccatcaccttccccagcccatacctgtgaccagtgtgccatttctttctccagccaggacctcctgaccagtcaccgccgactacatttcctgccatctctgcagcccagtgctcccccccaactcctagatctgcccttgctggtgtttggggagagaaaccccctggtggcagccacctcaccaatgccaggtccacctctcaaacggaagcatgaggacggcagcttgtctcccacaggcagtgaagcagggggaggaggggagggcgagccccccagggacaagcgcctgcgcaccaccatcttgcctgagcagctagagatcctgtaccgttggtacatgcaggattccaacccaacacgcaagatgctcgactgcatctccgaggaggtggggctcaaaaagcgagtggtacaggtctggttccagaataccagggcccgggagaggaaaggccagtttcgaagcacccctgggggggtgcctagtccagcagtgaaaccgcctgccacagccacccctgcatccttgcccaagttcaacctcttattaggcaaggtagatgatggcactgggagggaagccccaaagagggaagcacctgcttttccctaccccactgccacgcttgcttctgggccccagcctttcctaccacctgggaaagaggccaccaccccaacaccagagccacctctacctctcctacctccccctccacccagtgaggaagagggcccagaggaaccacctaaagcttctccagagagtgaggcttgcagtctctctgcaggagatctgagtgattcatctgcttccagcctagctgaaccagaatcccctggggctggagggaccagtgggggacctggaggtgggactggggttccagatggaatggggcagcggcgctacaggacccagatgagcagcctgcagctgaagatcatgaaagcctgctatgaagcttaccgcacccccaccatgcaggagtgtgaggtgctgggagaggagattgggctgcccaagagagtcatccaggtctggttccagaatgctcgtgccaaggaaaagaaggccaaactacaggggacagccgctgggagcactgggggcagcagtgagggcctcttagcagcccagcgcactgactgcccctattgtgatgtcaagtatgatttctatgtctcctgccgaggccatctcttttcccgtcagcacctggccaagctcaaggaggcggttcgagcccagctgaagagtgaaagcaagtgctacgacttggccccagcacctgaggctcccccagctctcaaggccccacctgccaccacacctgcctccatgcccctcggggctgccccaaccttgcctcgcctggcgccggtcctcttatctggcccagctctggctcagcccccgctgggcaacttagctcctttcaattcaggcccggcagcctcctcaggcctcctcggcctcgccacttcggtcctgcctaccaccacagtggtccagactgctggcccaggccgccccttacctcagagacccatgcccgaccaaaccaacacctccacagcaggcaccactgaccctgtcccaggccctcctactgagcccttgggggacaaggtctccagtgagcgaaagccagttgcaggccccaccagctcctccaatgatgccctcaagaacctcaaagcattgaagaccactgtcccagccctgttggggggccagttcctgccctttccattgccccctgctgggggaacagcaccgccagctgtctttggcccccagctacagggggcctacttccaacagctctatggcatgaagaaggggctatttcccatgaaccccatgatacctcagaccctcattgggctgctccccaatgccctcctccagccgccaccccagccccctgagcccacagccacagcacctccaaagcctcctgaactgcctgctccaggggagggggaagctggtgaggttgatgagctgctgacaggcagcactggcatctccaccgtggatgtaacccatcgctacctgtgccgccagtgcaagatggcatttgacggggaggccccggctactgcccaccagagatccttctgcttctttgggcggggctctgggggctccatgccacccccattgcgggtgcccatctgcacctaccactgcctggcatgtgaggtgctgctgagtgggcgtgaagccctagcctcccacctgcgctcctcggcccacaggcgcaaggcagccccacctcaagggggcccacccatctccatcaccaacgccgccactgctgcctcggctgctgtggcttttgccaaagaggaagcaagattacctcacacggactccaacccaaaaactacgactacctctacacttctagctttataaacagattaaccaagatggggagaggggagggcctcagggctccctcttttaccccaaggggtgttcggtgggagctcaaatccctcaccccaccccctggccccgcccacctcacaggaactgttcagttcccaccctcagtgggcaccacacaccccacttccagcagagtcctgcctcctcccaatccccacagacacacacattgatcctcctcctcagctccttgcagatgtagcccttgcccatcttcacagacacatacacccatcttggcaccctgattattcatacatgtctgcctaccacacacaaaatatatccttggttctatcttccttttcctcactgaattcccagctccccatccccataaatgcatacacatacatgcacacacacacgttatcccatgatgttccactgagaaaacaccaaaaaattttgaaaaagaagataaaaagaagaaacgaaaaagaaagcccaaggcaaagaagggggaaggaaaacaaacttcgccactctctcttctccttcctaaccctttgtctagagcaccacaccgctcacaaactctttccaaatgctcagttggctcccaaagttggagcctggcatgggcagggagcccacaaaactctaaccaaactggaggctggcatgggagaagtgcttctggttcactcttcctaccctctccctcctaaccctctccttgcctgacaggggagcccctgtggcctggactctaggggatgccgccaccagaaacccctctgccaatccctaccttgcaccctgggaactgcagtaacttattctcaaaggctttaaacacagagatcctctcagcggccgtgggcctgccccttgtcctagccctgccacgtgagggtccagcctccagggacaggcactgcccaccaacggcaaatccaaagttctttcaaaaaaaaaaactgaaacacaaccaaaaaagcaagagcgagagagagtacgtgcacacgcgcacaaaagagagaaacggacaccagaggaatgaacta

SEQ ID NO: 2787 - DNA, 1972 bp, Homo sapiens
tccttcacttccctcaccgccgtgaatttatttatttatttttttccgtctccgtccctgacgccccggagcgagcgctggagggagggaggaggaggggaaaaaagaggaatcaacacatcggagaagtcccttccaagagccgccccctcccctccccgcctcgcgctgctcggtggccgcggttcgactcccgtccctgcttccagctgaggtggtactggctgtcacgctgacatgagcccccagcactcctccgtctaccatggccacccttaactcagcctctaccactggtaccaccccctcccctgggcacaatgccccgtccctgccttcggacaccttctcctccagcaccccctctgatcctgtcaccaaagatccccctgctgcctcctccacctctgagaacatgaggtcctcagagccagggggacagctcctggagtcgggctgtggcctcgtcccaccaaaggagattggggagccccaggaagggcctgactgtggtcacttcccaccaaatgacccaggggtggaaaaggacaaggagcaggaggaggaagaagaagggctccctcccatggacctaagcaaccacttattcttcacagctggaggtgaggcctacctagtggccaagctgtccctgccaggtggcagtgaactcctgttaccaaagggcttcccctggggtgaggcgggcatcaaggaagagcccagtctgcccttccttgcctacccacccccctcacacctcactgcccttcacatccaacatggctttgacccaatccaaggctttagctcttctgaccaaattctgtcccatgatacctcagcaccatctccggctgcctgtgaggaaaggcatggagctttctggagctaccagctggctccaaatccacccggagatcccaaagatggccccatggggaacagcgggggcaaccacgtggcggtcttctggctctgccttctgtgccgcctgggtttcagcaagccccaggcctttatggatcacacacagtctcatggggtgaagctaacccctgcccaatatcagggcctgtcaggtagcccagctgtactccaggagggagatgaaggctgcaaggccctcataagctttctggagccaaaactccctgctcgcccctcttctgacataccccttgacaacagcagcacagtgaacatggaggcgaatgtggcccagacagaggatggcccccctgaggcagaagtccaggcccttatcctcctggatgaagaagttatggccctcagcccaccctctccacccacagccacctggggctataccactgcctgttgtgtgcgtgggagacaccctcccgcttggctgtgctgcaacacctgcgcacacctgcccaccgcgatgcccaggcccagaggcgtctgcagctgctacagaatggcccaaccactgaggaaggactcgcagctcttcagagcatcctgagcttcagccacgggcagctccggactcccgggaaggctcctgtcacccccttagctgagccacccacccctgagaaagatgcccagaacaagacagaacaattggcttcagaagagacagaaaacaagactggcccttccagagacagtgccaaccagaccacggtcagaattggggtaactgggaagagctgaagtgggggcctggctttactgagatctgctcatattctaaaggcagacgtaattttgtcatgctttgacttatttcactcagaatagcacagttaagaaattccacccagatccagttccacatgttcagcactttcgggggcagagctggcccagcagggtcaagcacagagggagatgataggagggagacagcaggaacttgagggaaagatgaataaaggaattgtgctgagagtaggaaagagtgggggtacatgctggaaggaggggaggagaaaggcaa

SEQ ID NO: 2788 - DNA, 949 bp, Homo sapiens
atacaggaatcacttgctgctttgccggggtgctgtatcacctacgggccagggcctgggtcgaattggaaatagatgtttttgagagaggatctgggagttactgtaggatttggggcttaggtctgcctagccctactctgagctgtgatcgagcgtgggtactggctgtcacgctgacatgagcccccagcactcctccgtctaccatggccacccttaactcagcctctaccactggtaccaccccctcccctgggcacaatgccccgtccctgccttcggacaccttctcctccagcaccccctctgatcctgtcaccaaagatccccctgctgcctcctccacctctgagaacatgaggtcctcagagccagggggacagctcctggagtcgggctgtggcctcgtcccaccaaaggagattggggagccccaggaagggcctgactgtggtcacttcccaccaaatgacccaggggtggaaaaggacaaggagcaggaggaggaagaagaagggctccctcccatggacctaagcaaccacttattcttcacagctggaggtgaggcctacctagtggccaagctgtccctgccaggtggcagtgaactcctgttaccaaagggcttcccctggggtgaggcgggcatcaaggaagagcccagtctgcccttccttgcctacccacccccctcacacctcactgcccttcacatccaacatggctttgacccaatccaaggctttagctcttctgaccaaattctgtcccatgatacctcagcaccatctccggctgcctgtgaggaaaggcatggagctttctggagctaccagctggctccaaatccacccggagatcccaaagatggccccatggggaacagcgggggcaaccacgtggcggtcttctggctctgccttctgtgccgcctgggtttcag

SEQ ID NO: 2789 - DNA, 2090 bp, Homo sapiens
ggtgcagaagtctgggcagctgcgggaggagaggtttgggaggcgcgggagatgtccaccctgggctggtggcgccgccgggcgccgggcgccatgagggtgcgctaggcggctgttcgtgcccgaggctgcgcagcactgagctttgccttcttgatcttccgtccttcttggagacgactggcgagaggaagagggactaggtccaaacgctaggtggctgggtccagccggagacccgcaccaaggaggagatcatcgagctcttggtccttgagcagtacctgaccatcatccctgaaaagctcaagccttgggtgcgagcaaaaaagccggagaactgtgagaagctcgtcactctgctggagaattacaaggagatgtaccaaccagaagacgacaacaacagtgacgtgaccagcgacgacgacatgacccggaacagaagagagtcctcaccacctcactcagtccattctttcagtggtgaccgggactgggaccggaggggcagaagcagagacatggagccacgagaccgctggtcccacaccaggaacccaagaagcaggatgcctccgcgggatctttcccttcctgtggtggcgaaaacaagctttgaaatggacagagaggacgacagggactccagggcttatgagtcccgatctcaggatgctgaatcataccaaaatgtggtggacctcgctgaggacaggaaacctcacaacacaatccaggacaacatggaaaactacaggaagctgctctccctcggtttccttgctcaggactctgtccctgcagaaaagaggaacacagagatgttagacaatctgccatctgctgggtcccagttcccggacttcaaacacttaggaacatttctggtgtttgaggagttggtgaccttcgaggatgtgcttgtggacttcagcccagaggaacttagttcccttagtgctgctcagagaaacctctacagggaggtgatgctggagaattaccggaacctggtctccctggggcaccagttctctaaacctgacattatctcacgcctggaagaggaggaatcatatgcaatggagacagacagcagacatacagtgatttgtcaaggagagtctcatgatgatccattggaaccacaccagggcaaccaagagaaacttttgactcctataacaatgaatgaccccaagaccctcactccggaaagaagctatggcagtgatgaatttgagagaagctctaatcttagtaaacaatcaaaggatcctctaggaaaggatccccaggaaggcactgctcctggaatatgtacgagtccccagtcagcatcccaagagaacaaacacaacagatgtgaattttgcaaacgaacctttagtacgcaagtagcccttaggagacacgaacggatccatactgggaagaaaccctatgaatgtaaacagtgtgctgaagccttctatctcatgccacacctcaacagacatcagaagacccattctggtaggaagacttctggctgcaatgaaggtagaaagccttccgtccagtgtgcgaatctctgtgaacgtgtaagaattcacagtcaggaggactactttgaatgttttcagtgcggcaaagcttttctccagaatgtgcatcttcttcaacatctcaaagcccatgaggcagcaagagtccttcctcctgggttgtcccacagcaagacatacttaattcgttatcagcggaaacatgactacgttggagagagagcctgccagtgttgtgactgtggcagagtcttcagtcggaattcatatctcattcagcattatagaactcacactcaagagaggccttaccagtgtcagctatgtgggaaatgtttcggccgaccctcatacctcactcaacattatcaactccattctcaagagaaaactgttgagtgcgatcactgttgagaaacctttagtcacagcacacacttttctcaacattattggcttcctcctagagtgttgtgagtgtgagaaggcctttcactagccccaccttgttaacaacttgaacattcatcaaagtgtggt

SEQ ID NO: 2790 - DNA, 2253 bp, Homo sapiens
ggtgcagaagtctgggcagctgcgggaggagaggtttgggaggcgcgggagatgtccaccctgggctggtggcgccgccgggcgccgggcgccatgagggtgcgctaggcggctgttcgtgcccgaggctgcgcagcactgagctttgccttcttgatcttccgtccttcttggagacgactggcgagaggaagagggactaggtccaaacgctaggtggctgggtccagatacctgtgttttgactctgttcctgtggatagctgcttggtctgaagttccagaaaggatcctgttcccagacagaggtttcggaacctaatctatgtggaatttgttgggcctcggaagaccctgatcaaactccgaaacctctgcctcgattggttgcagccggagacccgcaccaaggaggagatcatcgagctcttggtccttgagcagtacctgaccatcatccctgaaaagctcaagccttgggtgcgagcaaaaaagccggagaactgtgagaagctcgtcactctgctggagaattacaaggagatgtaccaaccagaagacgacaacaacagtgacgtgaccagcgacgacgacatgacccggaacagaagagagtcctcaccacctcactcagtccattctttcagtggtgaccgggactgggaccggaggggcagaagcagagacatggagccacgagaccgctggtcccacaccaggaacccaagaagcaggatgcctccgcgggatctttcccttcctgtggtggcgaaaacaagctttgaaatggacagagaggacgacagggactccagggcttatgagtcccgatctcaggatgctgaatcataccaaaatgtggtggacctcgctgaggacaggaaacctcacaacacaatccaggacaacatggaaaactacaggaagctgctctccctcggtttccttgctcaggactctgtccctgcagaaaagaggaacacagagatgttagacaatctgccatctgctgggtcccagttcccggacttcaaacacttaggaacatttctggtgtttgaggagttggtgaccttcgaggatgtgcttgtggacttcagcccagaggaacttagttcccttagtgctgctcagagaaacctctacagggaggtgatgctggagaattaccggaacctggtctccctggggcaccagttctctaaacctgacattatctcacgcctggaagaggaggaatcatatgcaatggagacagacagcagacatacagtgatttgtcaaggagagtctcatgatgatccattggaaccacaccagggcaaccaagagaaacttttgactcctataacaatgaatgaccccaagaccctcactccggaaagaagctatggcagtgatgaatttgagagaagctctaatcttagtaaacaatcaaaggatcctctaggaaaggatccccaggaaggcactgctcctggaatatgtacgagtccccagtcagcatcccaagagaacaaacacaacagatgtgaattttgcaaacgaacctttagtacgcaagtagcccttaggagacacgaacggatccatactgggaagaaaccctatgaatgtaaacagtgtgctgaagccttctatctcatgccacacctcaacagacatcagaagacccattctggtaggaagacttctggctgcaatgaaggtagaaagccttccgtccagtgtgcgaatctctgtgaacgtgtaagaattcacagtcaggaggactactttgaatgttttcagtgcggcaaagcttttctccagaatgtgcatcttcttcaacatctcaaagcccatgaggcagcaagagtccttcctcctgggttgtcccacagcaagacatacttaattcgttatcagcggaaacatgactacgttggagagagagcctgccagtgttgtgactgtggcagagtcttcagtcggaattcatatctcattcagcattatagaactcacactcaagagaggccttaccagtgtcagctatgtgggaaatgtttcggccgaccctcatacctcactcaacattatcaactccattctcaagagaaaactgttgagtgcgatcactgttgagaaacctttagtcacagcacacacttttctcaacattattggcttcctcctagagtgttgtgagtgtgagaaggcctttcactagccccaccttgttaacaacttgaacattcatcaaagtgtggt

SEQ ID NO: 2791 - DNA, 2049 bp, Homo sapiens
ggagacgactggcgagaggaagagggactaggtccaaacgctaggtggctgggtccagatacctgtgttttgactctgttcctgtggatagctgcttggtctgaagttccagaaaggatcctgttcccagacagaggtttcggaacctaatctatgtggaatttgttgggcctcggaagaccctgatcaaactccgaaacctctgcctcgattggttgcagccggagacccgcaccaaggaggagatcatcgagctcttggtccttgagcagtacctgaccatcatccctgaaaagctcaagccttgggtgcgagcaaaaaagccggagaactgtgagaagctcgtcactctgctggagaattacaaggagatgtaccaaccagaagacgacaacaacagtgacgtgaccagcgacgacgacatgacccggaacagaagagagtcctcaccacctcactcagtccattctttcagtggtgaccgggactgggaccggaggggcagaagcagagacatggagccacgagaccgctggtcccacaccaggaacccaagaagcaggatgcctccgcgggatctttcccttcctgtggtggcgaaaacaagctttgaaatggacagagaggacgacagggactccagggcttatgagtcccgatctcaggatgctgaatcataccaaaatgtggtggacctcgctgaggacaggaaacctcacaacacaatccaggacaacatggaaaactacaggaagctgctctccctcggtttccttgctcaggactctgtccctgcagaaaagaggaacacagagatgttagacaatctgccatctgctgggtcccagttcccggacttcaaacacttaggaacatttctggtgtttgaggagttggtgaccttcgaggatgtgcttgtggacttcagcccagaggaacttagttcccttagtgctgctcagagaaacctctacagggaggtgatgctggagaattaccggaacctggtctccctggggcaccagttctctaaacctgacattatctcacgcctggaagaggaggaatcatatgcaatggagacagacagcagacatacagtgatttgtcaaggagagtctcatgatgatccattggaaccacaccagggcaaccaagagaaacttttgactcctataacaatgaatgaccccaagaccctcactccggaaagaagctatggcagtgatgaatttgagagaagctctaatcttagtaaacaatcaaaggatcctctaggaaaggatccccaggaaggcactgctcctggaatatgtacgagtccccagtcagcatcccaagagaacaaacacaacagatgtgaattttgcaaacgaacctttagtacgcaagtagcccttaggagacacgaacggatccatactgggaagaaaccctatgaatgtaaacagtgtgctgaagccttctatctcatgccacacctcaacagacatcagaagacccattctggtaggaagacttctggctgcaatgaaggtagaaagccttccgtccagtgtgcgaatctctgtgaacgtgtaagaattcacagtcaggaggactactttgaatgttttcagtgcggcaaagcttttctccagaatgtgcatcttcttcaacatctcaaagcccatgaggcagcaagagtccttcctcctgggttgtcccacagcaagacatacttaattcgttatcagcggaaacatgactacgttggagagagagcctgccagtgttgtgactgtggcagagtcttcagtcggaattcatatctcattcagcattatagaactcacactcaagagaggccttaccagtgtcagctatgtgggaaatgtttcggccgaccctcatacctcactcaacattatcaactccattctcaagagaaaactgttgagtgcgatcactgttgagaaacctttagtcacagcacacacttttctcaacattattggcttcctcctagagtgttgtgagtgtgagaaggcctttcactagccccacctt

SEQ ID NO: 2792 - DNA, 2083 bp, Homo sapiens
cgggaggagaggtttgggaggcgcgggagatgtccaccctgggctggtggcgccgccgggcgccgggcgccatgagggtgcgctaggcggctgttcgtgcccgaggctgcgcagcactgaggtgagctttgccttcttgatcttccgtccttcttggagacgactggcgagaggaagagggactaggtccaaacgctaggtggctgggtccagccggagacccgcaccaaggaggagatcatcgagctcttggtccttgagcagtacctgaccatcatccctgaaaagctcaagccttgggtgcgagcaaaaaagccggagaactgtgagaagctcgtcactctgctggagaattacaaggagatgtaccaaccagaagacgacaacaacagtgacgtgaccagcgacgacgacatgacccggaacagaagagagtcctcaccacctcactcagtccattctttcagtggtgaccgggactgggaccggaggggcagaagcagagacatggagccacgagaccgctggtcccacaccaggaacccaagaagcaggatgcctccgcgggatctttcccttcctgtggtggcgaaaacaagctttgaaatggacagagaggacgacagggactccagggcttatgagtcccgatctcaggatgctgaatcataccaaaatgtggtggacctcgctgaggacaggaaacctcacaacacaatccaggacaacatggaaaactacaggaagctgctctccctcggtttccttgctcaggactctgtccctgcagaaaagaggaacacagagatgttagacaatctgccatctgctgggtcccagttcccggacttcaaacacttaggaacatttctggtgtttgaggagttggtgaccttcgaggatgtgcttgtggacttcagcccagaggaacttagttcccttagtgctgctcagagaaacctctacagggaggtgatgctggagaattaccggaacctggtctccctggggcaccagttctctaaacctgacattatctcacgcctggaagaggaggaatcatatgcaatggagacagacagcagacatacagtgatttgtcaaggagagtctcatgatgatccattggaaccacaccagggcaaccaagagaaacttttgactcctataacaatgaatgaccccaagaccctcactccggaaagaagctatggcagtgatgaatttgagagaagctctaatcttagtaaacaatcaaaggatcctctaggaaaggatccccaggaaggcactgctcctggaatatgtacgagtccccagtcagcatcccaagagaacaaacacaacagatgtgaattttgcaaacgaacctttagtacgcaagtagcccttaggagacacgaacggatccatactgggaagaaaccctatgaatgtaaacagtgtgctgaagccttctatctcatgccacacctcaacagacatcagaagacccattctggtaggaagacttctggctgcaatgaaggtagaaagccttccgtccagtgtgcgaatctctgtgaacgtgtaagaattcacagtcaggaggactactttgaatgttttcagtgcggcaaagcttttctccagaatgtgcatcttcttcaacatctcaaagcccatgaggcagcaagagtccttcctcctgggttgtcccacagcaagacatacttaattcgttatcagcggaaacatgactacgttggagagagagcctgccagtgttgtgactgtggcagagtcttcagtcggaattcatatctcattcagcattatagaactcacactcaagagaggccttaccagtgtcagctatgtgggaaatgtttcggccgaccctcatacctcactcaacattatcaactccattctcaagagaaaactgttgagtgcgatcactgttgagaaacctttagtcacagcacacacttttctcaacattattggcttcctcctagagtgttgtgagtgtgagaaggcctttcactagccccaccttgttaacaacttgaacattcatcaaagtgtggtaaaaaaaaaa

SEQ ID NO: 2793 - DNA, 1965 bp, Homo sapiens
cttggagacgactggcgagaggaagagggactaggtccaaacgctaggtggctgggtccagatacctgtgttttgactctgttcctgtggatagctgcttggtctgaagttccagaaaggatcctgttcccagacagccggagacccgcaccaaggaggagatcatcgagctcttggtccttgagcagtacctgaccatcatccctgaaaagctcaagccttgggtgcgagcaaaaaagccggagaactgtgagaagctcgtcactctgctggagaattacaaggagatgtaccaaccagaagacgacaacaacagtgacgtgaccagcgacgacgacatgacccggaacagaagagagtcctcaccacctcactcagtccattctttcagtggtgaccgggactgggaccggaggggcagaagcagagacatggagccacgagaccgctggtcccacaccaggaacccaagaagcaggatgcctccgcgggatctttcccttcctgtggtggcgaaaacaagctttgaaatggacagagaggacgacagggactccagggcttatgagtcccgatctcaggatgctgaatcataccaaaatgtggtggacctcgctgaggacaggaaacctcacaacacaatccaggacaacatggaaaactacaggaagctgctctccctcggtttccttgctcaggactctgtccctgcagaaaagaggaacacagagatgttagacaatctgccatctgctgggtcccagttcccggacttcaaacacttaggaacatttctggtgtttgaggagttggtgaccttcgaggatgtgcttgtggacttcagcccagaggaacttagttcccttagtgctgctcagagaaacctctacagggaggtgatgctggagaattaccggaacctggtctccctggggcaccagttctctaaacctgacattatctcacgcctggaagaggaggaatcatatgcaatggagacagacagcagacatacagtgatttgtcaaggagagtctcatgatgatccattggaaccacaccagggcaaccaagagaaacttttgactcctataacaatgaatgaccccaagaccctcactccggaaagaagctatggcagtgatgaatttgagagaagctctaatcttagtaaacaatcaaaggatcctctaggaaaggatccccaggaaggcactgctcctggaatatgtacgagtccccagtcagcatcccaagagaacaaacacaacagatgtgaattttgcaaacgaacctttagtacgcaagtagcccttaggagacacgaacggatccatactgggaagaaaccctatgaatgtaaacagtgtgctgaagccttctatctcatgccacacctcaacagacatcagaagacccattctggtaggaagacttctggctgcaatgaaggtagaaagccttccgtccagtgtgcgaatctctgtgaacgtgtaagaattcacagtcaggaggactactttgaatgttttcagtgcggcaaagcttttctccagaatgtgcatcttcttcaacatctcaaagcccatgaggcagcaagagtccttcctcctgggttgtcccacagcaagacatacttaattcgttatcagcggaaacatgactacgttggagagagagcctgccagtgttgtgactgtggcagagtcttcagtcggaattcatatctcattcagcattatagaactcacactcaagagaggccttaccagtgtcagctatgtgggaaatgtttcggccgaccctcatacctcactcaacattatcaactccattctcaagagaaaactgttgagtgcgatcactgttgagaaacctttagtcacagcacacacttttctcaacattattggcttcctcctagagtgttgtgagtgtgagaaggcctttcactagccccacctt

SEQ ID NO: 2794 - DNA, 1707 bp, Homo sapiens
atggcacgtttaacaaaaagacgacaggcggatacaaaagctatccagcatctttgggcagccattgagattatacggaaccagaagcagattgccaacattgaccgtattacaaagtatatgtctcgagtccacggtatgcaccctaaagagaccacccgtcagctgagcttagctgtgaaagatggtcttattgtcgaaactctaacagtgggctgcaaaggttcaaaagctggtattgaacaagaaggatattggttgccaggagatgagattgactgggaaacagaaaatcatgactggtattgttttgaatgccatttgcctggagaggtgttgatatgtgacctgtgttttcgtgtgtatcattccaagtgtttgtctgatgagttcaggcttagagacagcagtagtccctggcagtgcccagtttgcaggagcattaagaagaagaatacaaacaaacaggagatgggcacatacctcagattcattgtctcccgcatgaaggagagggctatagatcttaataaaaaggggaaggacaataaacacccgatgtacaggaggctggtgcactcagctgtggacgttcccaccattcaagagaaagtgaatgaagggaaataccgaagttatgaagagttcaaagctgatgcccaattgcttctccacaataccgtgattttctatggagcagacagtgagcaagctgacattgcgaggatgctatataaagacacatgtcatgagctggatgaactgcagctttgcaagaattgcttttacttgtcaaatgctcgtcctgacaactggttctgttatccttgtatacctaatcatgagctggtttgggctaaaatgaaaggttttgggttttggccagccaaagtcatgcagaaagaagacaatcaagtcgacgttcgcttctttggccaccaccaccagagggcctggattccttctgaaaacattcaagatatcacagtcaacattcatcggctgcacgtgaagcgcagtatgggttggaaaaaggcctgtgatgagctggagctgcatcagcgtttcctacgagaagggagattttggaaatctaagaatgaggaccgaggtgaggaagaggcagaatccagtatctcctccaccagtaatgagcagctaaaggtcactcaagaaccaagagcaaagaaaggacgacgtaatcaaagtgtggagcccaaaaaggaagaaccagagcctgaaacagaagcagtaagttctagccaggaaatacccacgatgcctcagcccatcgaaaaagtctccgtgtcaactcagacaaagaagttaagtgcctcttcaccaagaatgctgcatcggagcacccagaccacaaacgacggcgtgtgtcagagcatgtgccatgacaaatacaccaagatcttcaatgacttcaaagaccggatgaagtcggaccacaagcgggagacagagcgtgttgtccgagaagctctggagaagctgcgttctgaaatggaagaagaaaagagacaagctgtaaataaagctgtagccaacatgcagggtgagatggacagaaaatgtaagcaagtaaaggaaaagtgtaaggaagaatttgtagaagaaatcaagaagctggcaacacagcacaagcaactgatttctcagaccaagaagaagcagtgggtaaataccagtcttttttag

SEQ ID NO: 2795 - DNA, 3285 bp, Homo sapiens
cgcccttcccccaccaccagcggcgagtgggtgacagagcccccgtctccgcgcgtcttcgccgccctgcgccgtgacccgctgtggcactgggccacgagtggaggctgcgcccctccagttctgccttcatagttctctgcctttgcccaaaactgcagaaaatgaacaaatcccagggatcagtttcattcacggatgtgactgtggactttacccaggaggaatgggaacaactggacccctctcagaggatcctatacatggatgtgatgctggagaattatagcaacttactttcagtggaagtgtggaaggctgatgaccagatggagagagaccacagaaacccagacgagcaggcgaggcaatttttaattcttaagaaccaaaccccaattgaggaaagaggcgatctctttggaaaagcacttaatctgaacacagactttgtttctttaagacaagtaccttataaatatgacttatatgaaaaaactttgaaatataattcagacttgcttaatagtaatagaagctatgcaggaaagcagactgatgagtgtaatgaatttggaaaagcacttctctacctgaagcaagagaaaacccacagtggagtagaatattctgaatacaataaaagtggaaaagccctcagccataaagcagccatttttaaacatcagaaaataaaaaacttggttcaacctttcatttgtacttactgtgacaaggctttctcctttaagtcactcctcattagtcataagagaatacatactggagaaaagccatatgaatgcaatgtatgtaagaaaaccttctcccataaggccaacctcatcaaacatcagagaattcacactggggagaaacctttcgagtgtccggaatgtggaaaagctttcacccaccagtcaaacctcattgtacaccagagagcacatatggagaagaagccctatgagtgcagtgaatgtggaaagacatttgcccaaaagtttgaactcaccacacaccagagaattcatacaggagagcgaccctatgagtgtaacgaatgtgcaaaaaccttctttaagaagtcaaaccttatcatacatcagaagattcacacgggggagaaacgctatgagtgcagtgaatgtggaaaatcctttatccagaactcacagctcatcatacacatgagaactcatacaggagagaaaccctatgaatgtactgagtgcggcaaaactttcagccagaggtcaactcttagattacacttgcgaatccacacaggagagaaaccatatgagtgttccgaatgtgggaaggcctttagcaggaagtcccgactcagtgtccatcagagagttcacatcggggagaaaccctgaaactccagccaggtcttactgtggaaaactcctgccagaactcttcaagcgggtgaaaaacctcatgacagtattgagggaacatgggaattcatactgagatgcaatctctcaactcaaaaatgtattaaaaataggatcccatgagaacattatactggaagttacatgtgatacccagctaaagaatacatatcagaatatatccagttgtaaatagccatacccagttgtactacaatgagctttttaaaatcttgaatgaattgagtattctagacagcagcataagaaatatacaaacagtatcctatgaatttagtggttttatgtggatatgccacaaaacacaagtggtatgctttagatctgcacatgtgaatttagcataatcactgggaatttgaaattcttgtcctctgtgataattaggacataacaagattttccatactaaacatcacatgtgtttttcagtatctctgcaatccagtatgcattccaaatgaaatgtgtaacatttaaagtagcatggaacctacgtctttccctactgcttgctggcatatatcagttggtatgaacattgttcttgagctgcctcttaggaaacagaagacagtgttgaagttttccctgcttctggtttgctgaagattttctagaagcactatttacacaaatatgcaaatgtgaaataaccgatctataacgtgaaggaggcagacatgagctgtactactcagtatgcaccacagaataagagtttgccgtgtaaagacaatatccccattcgtcatgctcttattttcccgtgggatatttgcatacaaatgcatgtctgttaccaaaatattgtgtaacacagacagaaaccacctgtttttgtctttccttgtttcccttaatatttcatgaattgtctagcaaaaatggtaggatgcttctgtagttcacaaatgttacatttcagagactttagaggaaaaattattttaaataactgtcaactgtttcattgctttttaaatttttcacgtgcataaccccctttagaagtaaatttttacactattttgttgtttaaaggaggcatttctacttccttgagttttgctgttgccaacctaaaacatttccctttggaacatgagttataagttattacttttcctttacatgtttacacttttataaaaatcagatttttcagtggtctctccagatattaacaagaattgttgtgtaactcaaagatttgcttttatagacttgatttcaaattcttaagttcagcctttccctatcaatcacaaatcatgtattggaaattataaatggcaaccaaaaactggcttttaaaaaatatttttggatatcattgatgtgctgtcacactatatattgagtgactttctgaacaaatttatccagaacatccatagcccaataagcttttgtctaagttgtcatcttacttactcacaaaggaggggaaaacgttattttcatagctgcttttagaaatgtaaattgtaacagcctccttggacaacattgtgagtctgttttaacattaatatactcttacaacctaggaatctcctgggaatctatccctaaggaataaaaagcgccagcacttaagattatatgtttactaatgtatattgtattttttggtaaggaccaaaaaaacaaacaaaaaaaagaccatcagtaagggaatggatgaataaattgtggtaaaaacataccatggctgaatggtatttccttgaaaagaatgtgtgggaacaaactccaaacttctctaggtcaaatgaggaaagcaagaggggagagagagagtgtatgtgtgtgtgtagcagtttttataaaataaagataaaccctt

SEQ ID NO: 2796 - DNA, 3230 bp, Homo sapiens
cgccgccctgcgccgtgacccgctgtggcactgggccacgagtggaggctgcgcccctccaggtacgagaggggcttccagttctgccttcatagttctctgcctttgcccaaaactgcagaaaatgaacaaatcccagggatcagtttcattcacggatgtgactgtggactttacccaggaggaatgggaacaactggacccctctcagaggatcctatacatggatgtgatgctggagaattatagcaacttactttcagtggaagtgtggaaggctgatgaccagatggagagagaccacagaaacccagacgagcaggcgaggcaatttttaattcttaagaaccaaaccccaattgaggaaagaggcgatctctttggaaaagcacttaatctgaacacagactttgtttctttaagacaagtaccttataaatatgacttatatgaaaaaactttgaaatataattcagacttgcttaatagtaatagaagctatgcaggaaagcagactgatgagtgtaatgaatttggaaaagcacttctctacctgaagcaagagaaaacccacagtggagtagaatattctgaatacaataaaagtggaaaagccctcagccataaagcagccatttttaaacatcagaaaataaaaaacttggttcaacctttcatttgtacttactgtgacaaggctttctcctttaagtcactcctcattagtcataagagaatacatactggagaaaagccatatgaatgcaatgtatgtaagaaaaccttctcccataaggccaacctcatcaaacatcagagaattcacactggggagaaacctttcgagtgtccggaatgtggaaaagctttcacccaccagtcaaacctcattgtacaccagagagcacatatggagaagaagccctatgagtgcagtgaatgtggaaagacatttgcccaaaagtttgaactcaccacacaccagagaattcatacaggagagcgaccctatgagtgtaacgaatgtgcaaaaaccttctttaagaagtcaaaccttatcatacatcagaagattcacacgggggagaaacgctatgagtgcagtgaatgtggaaaatcctttatccagaactcacagctcatcatacacatgagaactcatacaggagagaaaccctatgaatgtactgagtgcggcaaaactttcagccagaggtcaactcttagattacacttgcgaatccacacaggagagaaaccatatgagtgttccgaatgtgggaaggcctttagcaggaagtcccgactcagtgtccatcagagagttcacatcggggagaaaccctgaaactccagccaggtcttactgtggaaaactcctgccagaactcttcaagcgggtgaaaaacctcatgacagtattgagggaacatgggaattcatactgagatgcaatctctcaactcaaaaatgtattaaaaataggatcccatgagaacattatactggaagttacatgtgatacccagctaaagaatacatatcagaatatatccagttgtaaatagccatacccagttgtactacaatgagctttttaaaatcttgaatgaattgagtattctagacagcagcataagaaatatacaaacagtatcctatgaatttagtggttttatgtggatatgccacaaaacacaagtggtatgctttagatctgcacatgtgaatttagcataatcactgggaatttgaaattcttgtcctctgtgataattaggacataacaagattttccatactaaacatcacatgtgtttttcagtatctctgcaatccagtatgcattccaaatgaaatgtgtaacatttaaagtagcatggaacctacgtctttccctactgcttgctggcatatatcagttggtatgaacattgttcttgagctgcctcttaggaaacagaagacagtgttgaagttttccctgcttctggtttgctgaagattttctagaagcactatttacacaaatatgcaaatgtgaaataaccgatctataacgtgaaggaggcagacatgagctgtactactcagtatgcaccacagaataagagtttgccgtgtaaagacaatatccccattcgtcatgctcttattttcccgtgggatatttgcatacaaatgcatgtctgttaccaaaatattgtgtaacacagacagaaaccacctgtttttgtctttccttgtttcccttaatatttcatgaattgtctagcaaaaatggtaggatgcttctgtagttcacaaatgttacatttcagagactttagaggaaaaattattttaaataactgtcaactgtttcattgctttttaaatttttcacgtgcataaccccctttagaagtaaatttttacactattttgttgtttaaaggaggcatttctacttccttgagttttgctgttgccaacctaaaacatttccctttggaacatgagttataagttattacttttcctttacatgtttacacttttataaaaatcagatttttcagtggtctctccagatattaacaagaattgttgtgtaactcaaagatttgcttttatagacttgatttcaaattcttaagttcagcctttccctatcaatcacaaatcatgtattggaaattataaatggcaaccaaaaactggcttttaaaaaatatttttggatatcattgatgtgctgtcacactatatattgagtgactttctgaacaaatttatccagaacatccatagcccaataagcttttgtctaagttgtcatcttacttactcacaaaggaggggaaaacgttattttcatagctgcttttagaaatgtaaattgtaacagcctccttggacaacattgtgagtctgttttaacattaatatactcttacaacctaggaatctcctgggaatctatccctaaggaataaaaagcgccagcacttaagattatatgtttactaatgtatattgtattttttggtaaggaccaaaaaaacaaacaaaaaaaagaccatcagtaagggaatggatgaataaattgtggtaaaaacataccatggctgaatggtatttccttgaaaagaatgtgtgggaacaaactccaaacttctctaggtcaaatgaggaaagcaagaggggagagagagagtgtatgtgtgtgtgtagcagtttttataaaa

SEQ ID NO: 2797 - DNA, 5659 bp, Homo sapiens
gtcggctccgagagctctggcttatcaggactccatagttctccaacagagaaatcttgaaaaggactgaccagtttttgcagttctaaaaccatggcccatggttcagtgacattcagggatgtggccatagacttctcacaggaagaatgggaattcctggatcctgctcagagggacttatatagggatgtaatgtgggagaactacagcaacttcatttcactaggaccttccatttctaaaccagatgtgattaccttattggatgaagaaaggaaggaacctgggatggttgtgagggaagggacaagaagatactgccctgatttggagtccagatacaggaccaatactttatctccagaaaaggacatttatgaaatatattcatttcagtgggatataatggaaagaattaaaagctatagccttcagggttccatttttaggaatgattgggaatgcaaaagcaagattgagggggaaaaggaacaacaagagggatattttgggcaagtgaaaattacctctgaaaaaatgaccacttacaaaaggcacaattttcttactgagtatcagatcgttcataatggagaaaaggtgtatgagtgtaaggagtgtaggaagacctttattcgtcgctcaacacttagtcaacacctgagaattcatactggtgagaaaccttataagtgtaaggaatgtgggcaggcctttagacagcgtgcacatcttattcgacatcacaaacttcacaccggtgagaaaccctatgaatgtaaggagtgtgggaaggcctttacagtgctccaagaacttactcaacatcagagacttcatacgggtgaaaaaccctatgaatgtaaggaatgtggaaaggcctttagagtacatcagcaactggctcgacatcagagaattcacactggtgagaaaccctatgaatgtaaggactgtggaaagacctttagacagtgtacacaccttacacgccatcagagacttcatactgctgaaaagctctatgaatgtaaggaatgtgggaaagccttcgtatgtggtccagaccttagagtacatcagaaaattcattttggtgagaaaccctatgaatgtaaggagtgtggaaaggcttttagaatatgccaacaacttactgttcatcagagtattcatactggtgagaaaccctacgaatgtaaggaatgtgggaagacttttagattaagacaacaactagttcgccatcagagaatacatactcgtgagaaaccctatgaatgtatggaatgttggaagacctttagtagttactcacagcttatttcacaccagagcattcatattggtgagagaccctatgaatgtgaagagtgtggaaaggcctttagactgctctcacaacttactcagcatcaaagtattcacactggtgagaaaccttatgaatgtaaggaatgtagaaaaccttttagactgctctcacaacttacccaacatcagagtattcacactggtgagaaaccttatgaatgtaaggaatgtggtaaggcttttagactttattcatttcttactcaacaccagagaattcatactggtgagaagccctacaagtgtaaggagtgtaagaaggcctttagacagcattcacaccttactcagcatcagaagattcataatggaatttaatagaagaaagccttcaaatgtatatgatgttacagaacatcagaaaattcatttttgagaaaatgtgtttcatgctcaattccaagcataataaattttatattagagaaagaatatgttgatttaaaagccttccaacaccatttaaacatggtttatcttcagcaaattcctatgagagaataatgtaatgaatgtaggaaaatctttagccttatctgtcattatctccctttctccacttgattaccagtttgatttattggacaagatactaagcttctgtgcctcattttgctgacttgtaaaatggtaataatagtacttatatgtattagttatttattgctgcgtaataaattaccacagacttagtagcataaaataacatataattatatcttataatttggatcaggagtataggcatgacttagttgggtcctctgcttcagggtctcttgcaaggctacagatttcagccagggctgaggtctcatctgaaggctcaactggggaaggatccacatccagactaacatagttgttacccaatgtatttccgtgaggcctgttgcattgagattctcagtttctagctggctgttggctgaacgctgactgcagctcctggccacaatagcctcatcaacatggctgcttgcttcatcaaggcatgcaagccaaaagggaggacagtctgctagcaagatggaagttaccatcttgtgtaatctaatcatggaagtaacattccctcaccttctactggtagaagtaagttactaggatagtccacactcaagagaacgggatgatacaagagtgtgaataagtcctggagacaggaccactggggggcctgtttagagtcagcctgccacactgtggaataggattgttgcaaggagtaagtagttaatacttggaggaatcacagtcatatagcatgtattctgtaaatattatctgtaattgttattattgtcattagtattagtgaattcacgtaaaaggaagatctgtagacataataaatgtagaaatgcctcctgtcacctctcagaaattattaaacataatttattctaggtaaaatttagattgtagtgaatgtaggaagttcttcagcacttgagctgcattagaaatttcatgccaaaaatgaatttcatgaatgtgaggtcactagtaatacagctgttgaagaattagagggaaataggaaatgattttcccataattccagaaagcaaaaggcttacaatccctgttgtctgaccacagtttaaaattaattagaaactatcaaaaatgtggcttaaaagaaattaaccacctaggaatttaatattgttgtgtatatttatgtgtgtgtataaaactcctgtgggaaagaaacaaaacatcattctataagtcagtatacttttggatgctcaaaatgccatatcttcaaccagtaggagttgtttcaagttgagtttttgatgtgatcccaccaataatttgatagtttacttgattgtggctgcataatttggtaacctatgaaagatgctagagcaccaatgtataatttttttgagacagggtgtcactttgtcccccaggctggagtgcagtggtacaagcacagttcactgtaccctgttcctcctgggctcaagtgattcttccacctaaattttttttttttttttagagaaagggtctcactatgttgcccaggctggtcttgaacttctgggctcaagtgatcctccctccttggcctccaaaggtgctggggttacaggtatgagccaccacacccagcccaactcattattcttgaaatcaataaatcagaggaaaaattgtcatttagtttccttttcccatgtgaaccaaatttcagggtcaccagaagttcatcaaattcaaatgaatttggcctggcacaggggtcacacctgtaatcccagcactttgggaggacaaggtgggtggatcacttgaggccaggagtttgagaccaacctggttaacatggtgaaaccctgtctgtactaaaaatacaaaatttagccaggcatggtggcacacacctgtagtcccaggctgaggtgggaggatcacttgaacccaagaggcagagtttgcagtgagctgagatcgtgccactgcactccagcctgggtgacagagtgagaccctgtctcaaaaaaaaaatttgttttttgaatgggtttttcttttttgaagaagtctaataaatctagaaggaattagaggattagaaaaatcaccattttctagaccttaatggaataatgggtccagaaaacatgatcttcaatgggtactacaactaataggtgaaatattttatagcgagatttttatggtggatctatcaaactggccacctctgaaccctttgatctgttttaaccttaataaaaatgggtctatcagacaacacacttcctgacgtaatgcaataggaagtccacaccaccatctacaaagccttattgctggaataatgaactgaaagcagacagggactagatgaacagtatatggtcatcccttggtatccatggggaattggttccaggatcctccactgatggtaaaatctgaggatgctcaagtcccttgtataaaatggcatagtatgtatttgcatattacctactcacatcttcctgtatactttaaattatctttagatcacttatacctatcacaatgtaaatactatgtaaatagttgttatactgtatttttcaatttgcattatttttattgtattttatttttattgtttttttttgagtattttctatttgagattggttgaatctgcacatatggagggctggctataaagggcaccacaaggaagaagccaaacagatccagaatgtgtgaaattctacagagcaaattacctgatttcttcaactaacaggtagcatgaaaatacaaggggaagggcaaccattaacagattaaaagagacttaaagagacatatcaactaaattcagtatgttggcattacttggacctggtttgaacaaaacataaaaagccattttggagacagtgagggaagtgtggacatggactaaatattaaatgatatttacatatattaatttggttagggattatgtcagtgtgattataaaaaataaaagatcgtatgatatgagatacatactatgaaatgaagatagacacatttggattaaaatattctagcaaaagaaataattggcaaagagagctggaaactaaattggcaacatgttgataatttaagtggagtgttttgttcatggagacttattgttctaatatttctacttttgtatgtgtttgaaatttcaataataaaatgtttaaaatcaaaaccaaaattatagactatgtagaaatgaatgacagtgagatgcctgcacatctaaccttgtcagatataatcaaagttctgttcagtgacaaattaatgccctgtaatgtggtaaggaaatcttatttgtggatacagtcttcatcttcttcacttacccacagcagcaacaccaggcctgtcacacagatgaatgtgttgagggaatgaataagtatttccgtcaagaaaaaggaaacaacaaaataaaaccaacccaagtaaagaacagccaagtggccaggtgcggtggctcatgcctgtaatcccagcactttgggaggccatggcaggtggatcacctgaggtcgggattttgagaccagcctgaccaacactgagaaaccccatctctattaaagatacaaaattagccaggcatggtggtgcatgcctgtaatcccagctacttgggaggctaaggcaggagaatcacttgaatccaggaggcggagtttgtggtgagttgagatcgcgccactgcactccagcctgggtaacagagcaagagtctgtc

SEQ ID NO: 2798 - DNA, 5566 bp, Homo sapiens
gtagcacatggttcagtgacattcagggatgtggccatagacttctcacaggaagaatgggaattcctggatcctgctcagagggacttatatagggatgtaatgtgggagaactacagcaacttcatttcactaggaccttccatttctaaaccagatgtgattaccttattggatgaagaaaggaaggaacctgggatggttgtgagggaagggacaagaagatactgccctgatttggagtccagatacaggaccaatactttatctccagaaaaggacatttatgaaatatattcatttcagtgggatataatggaaagaattaaaagctatagccttcagggttccatttttaggaatgattgggaatgcaaaagcaagattgagggggaaaaggaacaacaagagggatattttgggcaagtgaaaattacctctgaaaaaatgaccacttacaaaaggcacaattttcttactgagtatcagatcgttcataatggagaaaaggtgtatgagtgtaaggagtgtaggaagacctttattcgtcgctcaacacttagtcaacacctgagaattcatactggtgagaaaccttataagtgtaaggaatgtgggcaggcctttagacagcgtgcacatcttattcgacatcacaaacttcacaccggtgagaaaccctatgaatgtaaggagtgtgggaaggcctttacagtgctccaagaacttactcaacatcagagacttcatacgggtgaaaaaccctatgaatgtaaggaatgtggaaaggcctttagagtacatcagcaactggctcgacatcagagaattcacactggtgagaaaccctatgaatgtaaggactgtggaaagacctttagacagtgtacacaccttacacgccatcagagacttcatactgctgaaaagctctatgaatgtaaggaatgtgggaaagccttcgtatgtggtccagaccttagagtacatcagaaaattcattttggtgagaaaccctatgaatgtaaggagtgtggaaaggcttttagaatatgccaacaacttactgttcatcagagtattcatactggtgagaaaccctacgaatgtaaggaatgtgggaagacttttagattaagacaacaactagttcgccatcagagaatacatactcgtgagaaaccctatgaatgtatggaatgttggaagacctttagtagttactcacagcttatttcacaccagagcattcatattggtgagagaccctatgaatgtgaagagtgtggaaaggcctttagactgctctcacaacttactcagcatcaaagtattcacactggtgagaaaccttatgaatgtaaggaatgtagaaaaccttttagactgctctcacaacttacccaacatcagagtattcacactggtgagaaaccttatgaatgtaaggaatgtggtaaggcttttagactttattcatttcttactcaacaccagagaattcatactggtgagaagccctacaagtgtaaggagtgtaagaaggcctttagacagcattcacaccttactcagcatcagaagattcataatggaatttaatagaagaaagccttcaaatgtatatgatgttacagaacatcagaaaattcatttttgagaaaatgtgtttcatgctcaattccaagcataataaattttatattagagaaagaatatgttgatttaaaagccttccaacaccatttaaacatggtttatcttcagcaaattcctatgagagaataatgtaatgaatgtaggaaaatctttagccttatctgtcattatctccctttctccacttgattaccagtttgatttattggacaagatactaagcttctgtgcctcattttgctgacttgtaaaatggtaataatagtacttatatgtattagttatttattgctgcgtaataaattaccacagacttagtagcataaaataacatataattatatcttataatttggatcaggagtataggcatgacttagttgggtcctctgcttcagggtctcttgcaaggctacagatttcagccagggctgaggtctcatctgaaggctcaactggggaaggatccacatccagactaacatagttgttacccaatgtatttccgtgaggcctgttgcattgagattctcagtttctagctggctgttggctgaacgctgactgcagctcctggccacaatagcctcatcaacatggctgcttgcttcatcaaggcatgcaagccaaaagggaggacagtctgctagcaagatggaagttaccatcttgtgtaatctaatcatggaagtaacattccctcaccttctactggtagaagtaagttactaggatagtccacactcaagagaacgggatgatacaagagtgtgaataagtcctggagacaggaccactggggggcctgtttagagtcagcctgccacactgtggaataggattgttgcaaggagtaagtagttaatacttggaggaatcacagtcatatagcatgtattctgtaaatattatctgtaattgttattattgtcattagtattagtgaattcacgtaaaaggaagatctgtagacataataaatgtagaaatgcctcctgtcacctctcagaaattattaaacataatttattctaggtaaaatttagattgtagtgaatgtaggaagttcttcagcacttgagctgcattagaaatttcatgccaaaaatgaatttcatgaatgtgaggtcactagtaatacagctgttgaagaattagagggaaataggaaatgattttcccataattccagaaagcaaaaggcttacaatccctgttgtctgaccacagtttaaaattaattagaaactatcaaaaatgtggcttaaaagaaattaaccacctaggaatttaatattgttgtgtatatttatgtgtgtgtataaaactcctgtgggaaagaaacaaaacatcattctataagtcagtatacttttggatgctcaaaatgccatatcttcaaccagtaggagttgtttcaagttgagtttttgatgtgatcccaccaataatttgatagtttacttgattgtggctgcataatttggtaacctatgaaagatgctagagcaccaatgtataatttttttgagacagggtgtcactttgtcccccaggctggagtgcagtggtacaagcacagttcactgtaccctgttcctcctgggctcaagtgattcttccacctaaattttttttttttttttagagaaagggtctcactatgttgcccaggctggtcttgaacttctgggctcaagtgatcctccctccttggcctccaaaggtgctggggttacaggtatgagccaccacacccagcccaactcattattcttgaaatcaataaatcagaggaaaaattgtcatttagtttccttttcccatgtgaaccaaatttcagggtcaccagaagttcatcaaattcaaatgaatttggcctggcacaggggtcacacctgtaatcccagcactttgggaggacaaggtgggtggatcacttgaggccaggagtttgagaccaacctggttaacatggtgaaaccctgtctgtactaaaaatacaaaatttagccaggcatggtggcacacacctgtagtcccaggctgaggtgggaggatcacttgaacccaagaggcagagtttgcagtgagctgagatcgtgccactgcactccagcctgggtgacagagtgagaccctgtctcaaaaaaaaaatttgttttttgaatgggtttttcttttttgaagaagtctaataaatctagaaggaattagaggattagaaaaatcaccattttctagaccttaatggaataatgggtccagaaaacatgatcttcaatgggtactacaactaataggtgaaatattttatagcgagatttttatggtggatctatcaaactggccacctctgaaccctttgatctgttttaaccttaataaaaatgggtctatcagacaacacacttcctgacgtaatgcaataggaagtccacaccaccatctacaaagccttattgctggaataatgaactgaaagcagacagggactagatgaacagtatatggtcatcccttggtatccatggggaattggttccaggatcctccactgatggtaaaatctgaggatgctcaagtcccttgtataaaatggcatagtatgtatttgcatattacctactcacatcttcctgtatactttaaattatctttagatcacttatacctatcacaatgtaaatactatgtaaatagttgttatactgtatttttcaatttgcattatttttattgtattttatttttattgtttttttttgagtattttctatttgagattggttgaatctgcacatatggagggctggctataaagggcaccacaaggaagaagccaaacagatccagaatgtgtgaaattctacagagcaaattacctgatttcttcaactaacaggtagcatgaaaatacaaggggaagggcaaccattaacagattaaaagagacttaaagagacatatcaactaaattcagtatgttggcattacttggacctggtttgaacaaaacataaaaagccattttggagacagtgagggaagtgtggacatggactaaatattaaatgatatttacatatattaatttggttagggattatgtcagtgtgattataaaaaataaaagatcgtatgatatgagatacatactatgaaatgaagatagacacatttggattaaaatattctagcaaaagaaataattggcaaagagagctggaaactaaattggcaacatgttgataatttaagtggagtgttttgttcatggagacttattgttctaatatttctacttttgtatgtgtttgaaatttcaataataaaatgtttaaaatcaaaaccaaaattatagactatgtagaaatgaatgacagtgagatgcctgcacatctaaccttgtcagatataatcaaagttctgttcagtgacaaattaatgccctgtaatgtggtaaggaaatcttatttgtggatacagtcttcatcttcttcacttacccacagcagcaacaccaggcctgtcacacagatgaatgtgttgagggaatgaataagtatttccgtcaagaaaaaggaaacaacaaaataaaaccaacccaagtaaagaacagccaagtggccaggtgcggtggctcatgcctgtaatcccagcactttgggaggccatggcaggtggatcacctgaggtcgggattttgagaccagcctgaccaacactgagaaaccccatctctattaaagatacaaaattagccaggcatggtggtgcatgcctgtaatcccagctacttgggaggctaaggcaggagaatcacttgaatccaggaggcggagtttgtggtgagttgagatcgcgccactgcactccagcctgggtaacagagcaagagtctgtc

SEQ ID NO: 2799 - DNA, 3477 bp, Homo sapiens
attgtttttggtctaacgggcagtagagtgtccggcttcggtgccgagtgccaccgcgagtgggccgagacgcggagggaggcgcggccggagctcgggtcgccgacgctggccaggaccgcgcttcttcccggcggcaggcggcgcggtccccgtgactctcagaagccgcccgatgtagagccgcttctttgtctcatacccctgaccattcgtgcgtggcacggagccgggtatctgcgggtacagcgatgaacagggcagacgtggccaggtgagcggcgctgctgaagcctggtttaacacgaaaggccacactaccatcacccctttctccaaccctgaaaaacagttcctgagacctgaactattgaccatcattttaatcggaccaactgcagctgtaacaagcttctctttggggtcacaatgaccactgcaggcaggggaaatttaggcctcatccccaggagcactgctttccagaagcaagaggggcgcctgactgtgaagcaggagccagcaaaccagacctgggggcagggcagcagtctccagaagaactatcctcctgtctgcgaaatcttccggctacacttcaggcaattgtgttaccacgagatgtctgggccgcaggaagcattgagccggcttcgggagctctgccgctggtggctcatgccagaggtgcacaccaaggagcagatcctggagctgctggtgcttgagcagttcctgagcatcctccctggggagctccggacctgggtgcagctgcatcaccctgagagtggtgaggaggctgtggctgtggtggaggatttccagagacacctcagtggatcagaggaggtttcagccccagcacagaaacaggaaatgcattttgaggagacaacagctctgggtacaacaaaggaatctcctcctacctcacccctcagtgggggctcagcccctggagcccacctggagcctccttatgacccagggacacaccacctccccagtggggacttcgctcaatgtacttctccagttcctacccttcctcaagtggggaactcaggagaccaagcaggggcaactgtacttcggatggtcaggccccaggatactgtggcatatgaggacctatctgtagactacactcagaagaaatggaaaagtctcacactcagtcagagagccctgcagtggaacatgatgccagaaaatcaccatagcatggcctccttggcaggtgagaacatgatgaagggttcagagttgactccaaagcaggaattttttaaaggatcagagtcatctaacaggacatcagggggactctttggggtggttcctggggcagcagagactggagatgtttgtgaagatactttcaaggagttagaaggacaaacctcagatgaagaagggagcagactagaaaatgatttcttggaaataacagatgaagataagaaaaaatccacaaaagacagatatgacaaatataaggaagttggggaacatccacctctgtcttccagtcctgttgaacatgaaggagttttaaagggacagaaatcctatcgatgtgatgaatgtggcaaagctttcaatcggagttctcaccttattggccatcagagaatccacactggagagaaaccctatgagtgtaatgagtgtgggaagaccttcaggcaaacctcccagctcattgttcatctcagaacccacacaggggaaaaaccctatgaatgcagtgagtgtggaaaggcctataggcacagctcccatctcattcaacaccagagactccataatggggagaaaccctataaatgtaatgaatgtgcaaaagcctttactcagagttcccgactcactgaccaccagagaacccatactggggagaaaccttatgaatgcaatgagtgtggagaggcattcattcgaagcaaaagtcttgctcgacatcaggtcctgcacactggtaagaaaccttacaaatgcaatgagtgtgggagagcattctgttccaatagaaatctcattgaccatcagagaatccacactggggagaagccttatgagtgtagtgaatgtggcaaagccttcagtcggagtaaatgtcttattcgacatcagagcctccatactggggaaaagccatacaaatgtagtgaatgtgggaaagccttcaatcagaactctcaactcattgagcatgagcgaattcatactggagaaaaaccttttgaatgtagcgagtgtggtaaggcatttggtctgagtaaatgtcttattcggcaccagagacttcacacgggtgaaaagccctataaatgcaatgagtgtggaaaatccttcaatcaaaactcacaccttattatacaccagagaattcacactggtgagaaaccctatgaatgtaatgagtgtgggaaggtattcagttatagctccagccttatggtacatcagagaacccatactggggaaaaaccctataaatgcaatgattgtgggaaagcttttagtgacagctcacagcttattgtacaccagagagtccacaccggagagaaaccttatgaatgtagtgaatgtgggaaagcctttagtcagcgttccacttttaatcaccaccagcgaactcacactggagagaagtcctcaggtctggcttggtcagtttcttaaggtatggttctctgagacagagagcaacgacctttgagttaagctgtctttataagcaggatgctcatagtggtttcccggagccagtagtcacggtggaccattccctacttgcttttccttggatcactaaggtgggagagtaggagtaacttattccagttcttacccattattaggaaggtaaggactacacatgtcattgaattgtaggtttcctttttttttctttacttttaaattttaacttttaaaatctatttcatttcttagttatgcatctcataatcagactccatgctttttaaagacagagataatatcttctctattctattctacttcctccatttcaccatttatacaaagtcattcaaaaaggctgattcatgccttcctgcctcttggctatggccctccccatctactctttaaactttaatctataacttttcatcagttttgttccctatctagaaaacattttcttctgtttgctaatctttgtccctcacaatttttgaaatccatctcatcactgaaatactttcttcttcaagtacttttttatttttcttcaacttctcttgatttgacctcagtgctttgaattcactggtgctacaatatgtaactgtggttaattgccttgtaaattttgcgtgtctgtatacttttataccaacttattgtaggctctttgaggtcaggtatgtatttctttcccatatagatagtattttgtacataccagttgttaaataaataatttttaaaatctca

SEQ ID NO: 2800 - DNA, 612 bp, Homo sapiens
agtaaatgtcttattcgacatcagagcctccatactggggaaaagccatacaaatgtagtgaatgtgggaaagccttcaatcagaactctcaactcattgagcatgagcgaattcatactggagaaaaaccttttgaatgtagcgagtgtggtaaggcatttggtctgagtaaatgtcttattcggcaccagagacttcacacgggtgaaaagccctataaatgcaatgagtgtggaaaatccttcaatcaaaactcacaccttattatacaccagagaattcacactggtgagaaaccctatgaatgtaatgagtgtgggaaggtattcagttatagctccagccttatggtacatcagagaacccatactggggaaaaaccctataaatgcaatgattgtgggaaagcttttagtgacagctcacagcttattgtacaccagagagtccacaccggagagaaaccttatgaatgtagtgaatgtgggaaagcctttagtcagcgttccacttttaatcaccaccagcgaactcacactggagaggtcctcaggtctggcttggtcagtttcttaaggtatggttctgagacagagagcaacgacctttga

SEQ ID NO: 2801 - DNA, 1757 bp, Homo sapiens
cggccattgtttttggtctaacgggcagtagagtgtccggcttcggtgccgagtgccaccgcgagtgggccgagacgcggagggaggcgcggccggagctcgggtcgccgacgctggccaggaccgcgcttcttcccggcggcaggcggcgcggtccccgtgactctcagaagccgcccgatgtagagccgcttctttgtctcatacccctgaccattcgtgcgtggcacggagccgggtatctgcgggtacagcgatgaacagggcagacgtggccaggtgagcggcgctgctgaagcctggtttaacacgaaaggccacactaccatcacccctttctccaaccctgaaaaacagttcctgagacctgaactattgaccatcattttaatcggaccaactgcagctgtaacaagcttctctttggggtcacaatgaccactgcaggcaggggaaatttaggcctcatccccaggagcactgctttccagaagcaagaggggcgcctgactgtgaagcaggagccagcaaaccagacctgggggcagggcagcagtctccagaagaactatcctcctgtctgcgaaatcttccggctacacttcaggcaattgtgttaccacgagatgtctgggccgcaggaagcattgagccggcttcgggagctctgccgctggtggctcatgccagaggtgcacaccaaggagcagatcctggagctgctggtgcttgagcagttcctgagcatcctccctggggagctccggacctgggtgcagctgcatcaccctgagagtggtgaggaggctgtggctgtggtggaggatttccagagacacctcagtggatcagaggaggtttcagccccagcacagaaacaggaaatgcattttgaggagacaacagctctgggtacaacaaaggaatctcctcctacctcacccctcagtgggggctcagcccctggagcccacctggagcctccttatgacccagggacacaccacctccccagtggggacttcgctcaatgtacttctccagttcctacccttcctcaagtggggaactcaggagaccaagcaggggcaactgtacttcggatggtcaggccccaggatactgtggcatatgaggacctatctgtagactacactcagaagaaatggaaaagtctcacactcagtcagagagccctgcagtggaacatgatgccagaaaatcaccatagcatggcctccttgggctggagtacaatggcgtgatcttggctcacttcaatctccagctcccgagttcaagcgattctcctgcctcagactcctgagtagctgggattacaggcgcctgccaccatgcccagctaatttttgtaatatttagtagagacggggtttcaccatgttggccaggctggtttcgaactcctgacctcaggtgatccacccgcctcagcctcccaaagtggtgggattacaggcgtgagccaccacacccagcctattctttttaagtttcttgatgtagtggcagtagtcttgtgctcttcaggagagtgtcccgagttctacgtcccacatcaactgagggtgtgaacttgtggaggacttttgtctgaatctctttttcaatctctatacaatgtggcggagttgtgccacctacatgagccaatggagaagaaagctcctggtatactttaagtactcaacaatattaaatactgaatatttgtcaattgacgaagtacttcaaaa

SEQ ID NO: 2802 - DNA, 2791 bp, Homo sapiens
gcttccggctcggccattgtttttggtctaacgggcagtagagtgtccggcttcggtgccgagtgccaccgcgagtgggccgagacgcggagggaggcgcggccggagctcgggtcgccgacgctggccaggaccgcgcttcttcccggcggcaggcggcgcggtccccgtgactctcagaagccgcccgatgtagagccgcttctttgtctcatacccctgaccattcgtgcgtggcacggagccgggtatctgcgggtacagcgatgaacagggcagacgtggccaggccacactaccatcacccctttctccaaccctgaaaaacagttcctgagacctgaactattgaccatcattttaatcggaccaactgcagctgtaacaagcttctctttggggtcacaatgaccactgcaggcaggggaaatttaggcctcatccccaggagcactgctttccagaagcaagaggggcgcctgactgtgaagcaggagccagcaaaccagacctgggggcagggcagcagtctccagaagaactatcctcctgtctgcgaaatcttccggctacacttcaggcaattgtgttaccacgagatgtctgggccgcaggaagcattgagccggcttcgggagctctgccgctggtggctcatgccagaggtgcacaccaaggagcagatcctggagctgctggtgcttgagcagttcctgagcatcctccctggggagctccggacctgggtgcagctgcatcaccctgagagtggtgaggaggctgtggctgtggtggaggatttccagagacacctcagtggatcagaggaggtttcagccccagcacagaaacaggaaatgcattttgaggagacaacagctctgggtacaacaaaggaatctcctcctacctcacccctcagtgggggctcagcccctggagcccacctggagcctccttatgacccagggacacaccacctccccagtggggacttcgctcaatgtacttctccagttcctacccttcctcaagtggggaactcaggagaccaagcaggggcaactgtacttcggatggtcaggccccaggatactgtggcatatgaggacctatctgtagactacactcagaagaaatggaaaagtctcacactcagtcagagagccctgcagtggaacatgatgccagaaaatcaccatagcatggcctccttggcaggtgagaacatgatgaagggttcagagttgactccaaagcaggaattttttaaaggatcagagtcatctaacaggacatcagggggactctttggggtggttcctggggcagcagagactggagatgtttgtgaagatactttcaaggagttagaaggacaaacctcagatgaagaagggagcagactagaaaatgatttcttggaaataacagatgaagataagaaaaaatccacaaaagacagatatgacaaatataaggaagttggggaacatccacctctgtcttccagtcctgttgaacatgaaggagttttaaagggacagaaatcctatcgatgtgatgaatgtggcaaagctttcaatcggagttctcaccttattggccatcagagaatccacactggagagaaaccctatgagtgtaatgagtgtgggaagaccttcaggcaaacctcccagctcattgttcatctcagaacccacacaggggaaaaaccctatgaatgcagtgagtgtggaaaggcctataggcacagctcccatctcattcaacaccagagactccataatggggagaaaccctataaatgtaatgaatgtgcaaaagcctttactcagagttcccgactcactgaccaccagagaacccatactggggagaaaccttatgaatgcaatgagtgtggagaggcattcattcgaagcaaaagtcttgctcgacatcaggtcctgcacactggtaagaaaccttacaaatgcaatgagtgtgggagagcattctgttccaatagaaatctcattgaccatcagagaatccacactggggagaagccttatgagtgtagtgaatgtggcaaagccttcagtcggagtaaatgtcttattcgacatcagagcctccatactggggaaaagccatacaaatgtagtgaatgtgggaaagccttcaatcagaactctcaactcattgagcatgagcgaattcatactggagaaaaaccttttgaatgtagcgagtgtggtaaggcatttggtctgagtaaatgtcttattcggcaccagagacttcacacgggtgaaaagccctataaatgcaatgagtgtggaaaatccttcaatcaaaactcacaccttattatacaccagagaattcacactggtgagaaaccctatgaatgtaatgagtgtgggaaggtattcagttatagctccagccttatggtacatcagagaacccatactggggaaaaaccctataaatgcaatgattgtgggaaagcttttagtgacagctcacagcttattgtacaccagagagtccacaccggagagaaaccttatgaatgtagtgaatgtgggaaagcctttagtcagcgttccacttttaatcaccaccagcgaactcacactggagagaagtcctcaggtctggcttggtcagtttcttaaggtatggttctctgagacagagagcaacgacctttgagttaagctgtctttataagcaggatgctcatagtggtttcccggagccagtagtcacggtggaccattccctacttgctttt

SEQ ID NO: 2803 - DNA, 1692 bp, Homo sapiens
gcttccggctcggccattgtttttggtctaacgggcagtagagtgtccggcttcggtgccgagtgccaccgcgagtgggccgagacgcggagggaggcgcggccggagctcgggtcgccgacgctggccaggaccgcgcttcttcccggcggcaggcggcgcggtccccgtgactctcagaagccgcccgatgtagagccgcttctttgtctcatacccctgaccattcgtgcgtggcacggagccgggtatctgcgggtacagcgatgaacagggcagacgtggccaggccacactaccatcacccctttctccaaccctgaaaaacagttcctgagacctgaactattgaccatcattttaatcggaccaactgcagctgtaacaagcttctctttggggtcacaatgaccactgcaggcaggggaaatttaggcctcatccccaggagcactgctttccagaagcaagaggggcgcctgactgtgaagcaggagccagcaaaccagacctgggggcagggcagcagtctccagaagaactatcctcctgtctgcgaaatcttccggctacacttcaggcaattgtgttaccacgagatgtctgggccgcaggaagcattgagccggcttcgggagctctgccgctggtggctcatgccagaggtgcacaccaaggagcagatcctggagctgctggtgcttgagcagttcctgagcatcctccctggggagctccggacctgggtgcagctgcatcaccctgagagtggtgaggaggctgtggctgtggtggaggatttccagagacacctcagtggatcagaggaggtttcagccccagcacagaaacaggaaatgcattttgaggagacaacagctctgggtacaacaaaggaatctcctcctacctcacccctcagtgggggctcagcccctggagcccacctggagcctccttatgacccagggacacaccacctccccagtggggacttcgctcaatgtacttctccagttcctacccttcctcaagtggggaactcaggagaccaagcaggggcaactgtacttcggatggtcaggccccaggatactgtggcatatgaggacctatctgtagactacactcagaagaaatggaaaagtctcacactcagtcagagagccctgcagtggaacatgatgccagaaaatcaccatagcatggcctccttgggctggagtacaatggcgtgatcttggctcacttcaatctccagctcccgagttcaagcgattctcctgcctcagactcctgagtagctgggattacaggcgcctgccaccatgcccagctaatttttgtaatatttagtagagacggggtttcaccatgttggccaggctggtttcgaactcctgacctcaggtgatccacccgcctcagcctcccaaagtggtgggattacaggcgtgagccaccacacccagcctattctttttaagtttcttgatgtagtggcagtagtcttgtgctcttcaggagagtgtcccgagttctacgtcccacatcaactgagggtgtgaacttgtggaggacttttgtctgaatctctttttcaatctctatacaatgtggcggagttgtgccacctacatgagccaatggagaagaaagctcctggtatactttaagtactcaacaatatta

SEQ ID NO: 2804 - DNA, 2678 bp, Homo sapiens
gcaacgcctcctggggttgtcaatatggctgcgttgggatctgttcaccttcaggctgagtcgagactgaggtgaaaaagcggaaaaacgcgagaaaaggtttccccgttgtacagaggctagagtgaggctcggttgaatcggttgcaggcgttggtgcctctgtcagcgtccaggtcactgccgctcccgccccgctcttccctggctgtgctggcggaggctgcgccgatgaacctgactgaggattatatggtttttgaggacgtggccatacatttctcccaggaggagtggggaattcttaatgacgttcagagacacctgcacagcgatgtgatgctggagaactttgcacttttgtcctcagtaggttgttggcatggagccaaggatgaggaggcaccttccaagcaatgtgtttctgtaggagtgtcacaggtcacaactttaaagccagctttgtccacccagaaggcccagccctgtgagacatgtagctcacttctgaaggacattctacacctggctgagcatgacggaacacaccccaagcgtacagccaagctttacctgcaccaaaaggagcatcttagagagaagctcaccagaagtgatgaagggaggccttcgtttgtgaatgacagtgttcacctggcaaagaggaacctcacatgcatgcagggtggcaaggattttactggtgattcagatcttcaacaacaggctcttcacagtgggtggaagccacacagggacactcatggtgtggaggcctttcaaagtggacagaataattacagctgcacccaatgtgggaaagacttttgccaccaacatacactgtttgagcaccagaaaatccacacagaggaaaggccttatgagtgcagtgaatgtggcaaattgtttaggtacaactccgaccttattaaacatcagcgaaatcatactggagaaaggccttataagtgtagtgaatgtggaaaagccttcagcctcaaatacaatgttgttcaacaccagaaaattcacactggagaaaggccttatgagtgcagtgaatgtgggaaagcttttcttagaaagtctcacctacttcagcaccagaggattcacaccaggccaaggccttatgtgtgtagtgaatgtgggaaggccttccttacacaggctcaccttgttggtcaccagaaaattcatactggagaacggccttatggatgcaatgaatgtgggaaatactttatgtacagttcagcactcattagacatcagaaagttcacactggagaaaggcctttttattgctgtgaatgtgggaaattctttatggacagctgcacactcattattcaccagagagttcatactggagaaaaaccttatgaatgcaacgaatgtgggaaattctttagataccgttccacactcattagacatcagaaagttcacactggagaaaagccttatgagtgtagtgaatgtgggaagttctttatggacacttccacactcattattcatcagagagttcatactggagaaaagccttatgaatgcaacaaatgtgggaaattctttaggtattgcttcacactgaatagacatcagagagttcactctggagagaggccttatgaatgcagtgaatgtggcaaattctttgtggacagctgtacactgaagagtcatcagagagttcacactggagaaagaccttttgaatgcagcatttgtgggaaatcctttagatgtcgctccacacttgatacacatcagagaattcacactggtgaaaggccttatgagtgtagtgaatgtgggaaattctttaggcacaactcaaatcatattagacatcggagaaatcactttggagaaaggtcttttgagtgcactgagtgtgggagagtttttagccaaaattcccacctcattcggcaccaaaaagttcacactagggaaagaacttacaaatgcagcaaatgtgggaaattttttatggacagctccacactcattagtcatgagagagttcatactggagaaaagccttatgagtgcagtgaatgtgggaaagtctttagatacaactccagcctcattaaacatcggagaattcacactggagagagaccttatcagtgcagtgaatgtggaagagtctttaaccaaaattctcatctcattcagcaccagaaagttcacaccagataaagaatgtatatataaagcagatggggaaagacttcacacagaaatctactctgatttagcactgggacctacgttttaaaaaaagtattcttgtagaatacagataacataaaatctaacatcttaaccatgttaaagtgtatagttcagtactgttaagtcattcacattgtgcaatgaatatctagaagtcttttcaacttatgaaactaagtctataccttttaaaaccttattcctcactccatccagcctcttgacaagcaccgctctgtatgaattttactagtccgggtacctcatataagaaaacttaagttttggtcttcttgtggtttattttgtggcttattttgcttaacgttatatttttaaggtttcatgttctaatccattagaatttccatcctttttaaaggctgaataaaattctgttagtcatgtgttgcttaacagtg

SEQ ID NO: 2805 - DNA, 2524 bp, Homo sapiens
gtcaatatggctgcgttgggatctgttcaccttcaggctgagtcgagactgaggtgaaaaagcggaaaaacgcgagaaaaggtttccccgttgtacagaggctagagtgaggctcggttgaatcggttgcaggcgttggtgcctctgtcagcgtccaggtcactgccgctcccgccccgctcttccctggctgtgctggcggaggctgcgccgatgaacctgactgaggattatatggtttttgaggacgtggccatacatttctcccaggaggagtggggaattcttaatgacgttcagagacacctgcacagcgatgtgatgctggagaactttgcacttttgtcctcagtaggttgttggcatggagccaaggatgaggaggcaccttccaagcaatgtgtttctgtaggagtgtcacaggtcacaactttaaagccagctttgtccacccagaaggcccagccctgtgagacatgtagctcacttctgaaggacattctacacctggctgagcatgacggaacacaccccaagcgtacagccaagctttacctgcaccaaaaggagcatcttagagagaagctcaccagaagtgatgaagggaggccttcgtttgtgaatgacagtgttcacctggcaaagaggaacctcacatgcatgcagggtggcaaggattttactggtgattcagatcttcaacaacaggctcttcacagtgggtggaagccacacagggacactcatggtgtggaggcctttcaaagtggacagaataattacagctgcacccaatgtgggaaagacttttgccaccaacatacactgtttgagcaccagaaaatccacacagaggaaaggccttatgagtgcagtgaatgtggcaaattgtttaggtacaactccgaccttattaaacatcagcgaaatcatactggagaaaggccttataagtgtagtgaatgtggaaaagccttcagcctcaaatacaatgttgttcaacaccagaaaattcacactggagaaaggccttatgagtgcagtgaatgtgggaaagcttttcttagaaagtctcacctacttcagcaccagaggattcacaccaggccaaggccttatgtgtgtagtgaatgtgggaaggccttccttacacaggctcaccttgttggtcaccagaaaattcatactggagaacggccttatggatgcaatgaatgtgggaaatactttatgtacagttcagcactcattagacatcagaaagttcacactggagaaaggcctttttattgctgtgaatgtgggaaattctttatggacagctgcacactcattattcaccagagagttcatactggagaaaaaccttatgaatgcaacgaatgtgggaaattctttagataccgttccacactcattagacatcagaaagttcacactggagaaaagccttatgagtgtagtgaatgtgggaagttctttatggacacttccacactcattattcatcagagagttcatactggagaaaagccttatgaatgcaacaaatgtgggaaattctttaggtattgcttcacactgaatagacatcagagagttcactctggagagaggccttatgaatgcagtgaatgtggcaaattctttgtggacagctgtacactgaagagtcatcagagagttcacactggagaaagaccttttgaatgcagcatttgtgggaaatcctttagatgtcgctccacacttgatacacatcagagaattcacactggtgaaaggccttatgagtgtagtgaatgtgggaaattctttaggcacaactcaaatcatattagacatcggagaaatcactttggagaaaggtcttttgagtgcactgagtgtgggagagtttttagccaaaattcccacctcattcggcaccaaaaagttcacactagggaaagaacttacaaatgcagcaaatgtgggaaattttttatggacagctccacactcattagtcatgagagagttcatactggagaaaagccttatgagtgcagtgaatgtgggaaagtctttagatacaactccagcctcattaaacatcggagaattcacactggagagagaccttatcagtgcagtgaatgtggaagagtctttaaccaaaattctcatctcattcagcaccagaaagttcacaccagataaagaatgtatatataaagcagatggggaaagacttcacacagaaatctactctgatttagcactgggacctacgttttaaaaaaagtattcttgtagaatacagataacataaaatctaacatcttaaccatgttaaagtgtatagttcagtactgttaagtcattcacattgtgcaatgaatatctagaagtcttttcaacttatgaaactaagtctataccttttaaaaccttattcctcactccatccagcctcttgacaagcaccgctctgtatgaattttactagtccgggtacctcatataagaaaacttaagtttt

SEQ ID NO: 2806 - DNA, 3275 bp, Homo sapiens
attctgtgcctcggctgccggaagggctcgttcctgtgtcatctcctagcggcctggcgccgaggcggcggtacgcaaggctggagccgcagcgggagcccccgatgatactctccaagctgtaaggaagaagtcaaggattaaggagacctggactggagaggagcctttttcaaaaaacaacaatgacaagagaaaatgtagcccacaatgctctgagacaagagggccttgtgaaggggaaggatgatacctggaaatggggaaccagcttccaaggaagtagctcctctgtttgggagacctcccacctacactttagacaattacgttaccatgagacatctggaccccaggaagccctgagccggctcagggaactctgtcgccggtggctgagaccagaagcacgcaccaaggcacagatcctggagctgctggtgctggagcagtttctgagcatcctgcctggggagattcggacctgggtacagctccatcaccctggaagtggcgaggaggctgtggccctggtagaggagctgcagaaagaccttgatggaccagcaatacaagttccagtccttgtcaaggatcaggacactctccagaaggtggtgagtgccccaggaacaacacttcctcctgtacttcctggcagccacatagcagctgaaatttgcccgcatcctcctactgacctagtggcattcaacctccaggatcctcagcatgattctcctgcccctgaagcttctgccctttcccaggaagagaacccaagaaatcaattaatggcacttatgctcctaacagcccagccccaggagttggtgatgttcgaggaggtgtcagtatgcttcacttcagaggaatgggcatgtctgggcccaatccagagggccttgtactgggatgtgatgctggagaattatggaaatgtgacctccctagaatgggagaccatgaccgagaatgaggaggtgacatcaaagccaagtagttctcaaagagcagactctcataaaggaacatcaaaaagacttcaaggaagtgttccccaggtccttgattttgaagaagagtgtgaatggcaagttttggcaagtcagtggggaaatgaaacagatgaaagggcagatacagtgaagaaagtttccctttgtgaacgagacaagaagaaaaggactccaccagagaaacaaggccaaaagtggaaggaattaggagacagcttgactttcggttcagctatttctgaaagtttaataggtactgaaggaaagaagttttataaatgtgatatgtgttgtaaacattttaataaaatctcccatcttataaaccatcggagaatccacactggtgagaaacctcataaatgtaaggaatgtggaaaaggctttattcagcgttcgagccttctaatgcatttacggaaccattcaggggagaaaccttataaatgtaatgaatgtgggaaagcattttctcaaagtgcttaccttctaaaccatcagaggatccacactggggagaaaccttataagtgtaaggagtgtggaaagggcttctataggcactcaggcctaattatacatctaaggcgccattcaggggagagaccttataagtgtaatgaatgtgggaaagtcttctctcagaatgcttacctcattgaccatcagaggctccacaaaggggaagaaccttataaatgtaataagtgtcagaaagctttcattctgaagaagagcctcattctgcaccagagaatccactctggggaaaaaccctataaatgtgatgaatgtggaaagacctttgctcagaccacttatcttattgaccatcagcgactccacagtgcagagaacccttacaagtgtaaagaatgtggaaaagttttcattcgaagcaaaagcctcctcttacatcagagagtccacacagaaaagaaaacctttggttgtaaaaagtgtgggaagattttcagttctaagtcaaacttcattgaccataagaggatgcacagcagagagaaaccttacaaatgcactgaatgtgggaaagcctttactcaaagtgcttacctttttgaccaccagagactccacaatggggagaagccctatgaatgtaatgaatgtgggaaagtttttattctgaagaagagcctcattttacatcaaaggttccacactggagagaatctctatgaatgtaaagattgtggtaaggtcttcggttcaaacagaaacctcattgaccatgagagactccacaatggggagaagccatatgaatgtcgagagtgtgggaaaacctttattatgagcaaaagttttatggtccatcagaaactccatacacaagagaaagcctacaaatgtgaggattgtgggaaggctttcagttacaattcaagcctgcttgtacatcggagaatccacaccggagaaaaaccctttgaatgcagtgagtgtggaagagctttcagttcaaacagaaacctcattgagcataagagaatccacagtggtgagaaaccctatgagtgtgatgagtgtggcaaatgcttcattctgaagaaaagcctcattggacatcagagaattcacacgagggaaaaatcttataaatgcaatgactgtgggaaggtcttcagttaccgctcaaaccttatagcccatcagaggatccatactggtgagaagccctatgcgtgtagtgagtgtggaaaaggttttacgtacaacagaaacctgattgaacatcaaagaattcacagtggagaaaaaacctacgaatgtcatgtatgtaggaaagtccttacctctagtagaaatcttatggtacatcaaagaatccatactggagagaaaccttataaatgtaatgagtgtggaaaagactttagtcagaataaaaaccttgttgtacatcagagaatgcacactggggaaaaaccttatgagtgtgacaagtgtaggaaatcctttacttctaagaggaatttagttggccaccagagaattcacacaggggagaaaccctatgggtgtaatgattgtagtaaagtttttaggcaaagaaaaaaccttactgtacatcagaaaatccacacagatgaaaaaccttgtgaatgtgatgtgtctgaaaaagaattctctcagacttccaaccttcatcttcaacagaaaatccataccattgaggaattctcttggctacaaaacaccaatgagtccaagattgagattcagaaaatctag

SEQ ID NO: 2807 - DNA, 1989 bp, Homo sapiens
agtattctcggctcggccattattctgtgcctcggctgccggaagggctcgttcctgtgtcatctcctagcggcctggcgccgaggcggcggtacgcaaggctggagccgcagcgggagcccccgatgatactctccaagctgtaaggaagaagtcaaggattaaggagacctggactggagaggagcctttttcaaaaaacaacaatgacaagagaaaatgtagcccacaatgctctgagacaagagggccttgtgaaggggaaggatgatacctggaaatggggaaccagcttccaaggaagtagctcctctgtttgggagacctcccacctacactttagacaattacgttaccatgagacatctggaccccaggaagccctgagccggctcagggaactctgtcgccggtggctgagaccagaagcacgcaccaaggcacagatcctggagctgctggtgctggagcagtttctgagcatcctgcctggggagattcggacctgggtacagctccatcaccctggaagtggcgaggaggctgtggccctggtagaggagctgcagaaagaccttgatggaccagcaatacaagttccagtccttgtcaaggatcaggacactctccagaaggtggtgagtgccccaggaacaacacttcctcctgtacttcctggcagccacatagcagctgaaatttgcccgcatcctcctactgacctagtggcattcaacctccaggatcctcagcatgattctcctgcccctgaagcttctgccctttcccaggaagagaacccaagaaatcaattaatggcacttatgctcctaacagcccagccccaggagttggtgatgttcgaggaggtgtcagtatgcttcacttcagaggaatgggcatgtctgggcccaatccagagggccttgtactgggatgtgatgctggagaattatggaaatgtgacctccctaggttacaggaaatacaggaggcagaggaacaaataaaagacaccacgagaaacagacacatccagaacgtggaatattgcataagaaagctgccctggattcttcaaaatattattatgatgaaaaagagaggggagtgaaaattgttcaagctgtcttgagtctgctgtgagtttattataccattctctgcttttgtgtatgtatgaaaatttcgatatgaaaggtataaaacatggatgaggaggcttgtttttaaaagataatactagagagccgttaggtactaagaaccagaaatagactcacataaatggccaattgatttttgacaggggcaaaagcaattcaatggaggagggatcgccttttcagcaaatactgttggagtaattggatatccataggcagtaaaccaacaacttcaggacctaggactgagctaagaaggctcagatgactcaaaagcatgctccttagaaggaaaaaaaatgttaaattggacttcatcaaaattaagataatttaccctgtaagagacctttttacaaagatgatattacaggttgggaaaaaatatttgcaaatcatatccaacaagggatttgtatgtaaactacataaagaactttccaaatttaacagtaataagtaaatacaattagaaaataagcaaaagacagacatttcactgaagtatagatagcaaataagcaaatgaaaagatgttcaacatcattaggcatgagggaaatgcagagtaaaatcgtgagatatcacctatcagaatagcttaactttttttttttaatggtggtaactgctggcaaggatgaagagaaacaggatctcatacattgctgggaatgtaaaatggtacagccactctggaatataatttggcagtttcttgtaaaaccacacatgtatatgtcatgcttcaggaattgcacttctgagcatttatcccagagaaatgaaaacttgcgttcacacaaaaacctgtatacgaatg

SEQ ID NO: 2808 - DNA, 2935 bp, Homo sapiens
ctcggctgccggaagggctcgttcctgtgtcatctcctagcggcctggcgccgaggcggcggtacgcaaggctggagccgcagcgggagcccccggtcttgtagatgatactctccaagctgtaaggaagaagtcaaggattaaggagacctggactggagaggagcctttttcaaaaaacaacaatgacaagagaaaatgtagcccacaatgctctgagacaagagggccttgtgaaggggaaggatgatacctggaaatggggaaccagcttccaaggaagtagctcctctgtttgggagacctcccacctacactttagacaattacgttaccatgagacatctggaccccaggaagccctgagccggctcagggaactctgtcgccggtggctgagaccagaagcacgcaccaaggcacagatcctggagctgctggtgctggagcagtttctgagcatcctgcctggggagattcggacctgggtacagctccatcaccctggaagtggcgaggaggctgtggccctggtagaggagctgcagaaagaccttgatggaccagcaatacaagttccagtccttgtcaaggatcaggacactctccagaaggtggtgagtgccccaggaacaacacttcctcctgtacttcctggcagccacatagcagctgaaatttgcccgcatcctcctactgacctagtggcattcaacctccaggatcctcagcatgattctcctgcccctgaagcttctgccctttcccaggaagagaacccaagaaatcaattaatggcacttatgctcctaacagcccagccccaggagttggtgatgttcgaggaggtgtcagtatgcttcacttcagaggaatgggcatgtctgggcccaatccagagggccttgtactgggatgtgatgctggagaattatggaaatgtgacctccctaggttacaggaaatacaggaggcagaggaacaaataaaagacaccacgagaaacagacacatccagaacgtggaatattgcataagaaagctgccctggattcttcaaaatattattatgatgaaaaagagaggggagtgaaaattgttcaagctgtcttgagtctgctgtgagtttattataccattctctgcttttgtgtatgtatgaaaatttcgatatgaaaggtataaaacatggatgaggaggcttgtttttaaaagataatactagagagccgttaggtactaagaaccagaaatagactcacataaatggccaattgatttttgacaggggcaaaagcaattcaatggaggagggatcgccttttcagcaaatactgttggagtaattggatatccataggcagtaaaccaacaacttcaggacctaggactgagctaagaaggctcagatgactcaaaagcatgctccttagaaggaaaaaaaatgttaaattggacttcatcaaaattaagataatttaccctgtaagagacctttttacaaagatgatattacaggttgggaaaaaatatttgcaaatcatatccaacaagggatttgtatgtaaactacataaagaactttccaaatttaacagtaataagtaaatacaattagaaaataagcaaaagacagacatttcactgaagtatagatagcaaataagcaaatgaaaagatgttcaacatcattaggcatgagggaaatgcagagtaaaatcgtgagatatcacctatcagaatagcttaactttttttttttaatggtggtaactgctggcaaggatgaagagaaacaggatctcatacattgctgggaatgtaaaatggtacagccactctggaatataatttggcagtttcttgtaaaaccacacatgtatatgtcatgcttcaggaattgcacttctgagcatttatcccagagaaatgaaaacttgcgttcacacaaaaacctgtatacgaatgttcatagcagctttatttgtaatggtcgaaacctgtaggcaacccatatatccttccttaggtggttaaaacaaattgtggtttatgtattaccatggaatacttgttactctgcaataaaattgacttattgatatccataacaactcaaataaatttcaagggaattaatgctgagtgaaaataatcacaaaaggccatattctgtatgaaaatattcatataacattctcaaaatgataaaactatagagatgaaaaatggattaatggttgccaaaggttagggatggtgggaggaaaaatggggagagggttggatggaactattaaaaggtagcaccagaaaggtctttgtggtgatggaacacttgtgtatcttgattgcagtggtggttacacaaatctataggtgctatacctatacacacatactgtaccaatgttgatttcctttttcattttatgtaagatgtaaccatgaggggaaagtgggtgaagggtgctatctttgcaacttcctgtgattctatcatttcaaaataaaaagtaaaaaccaacaatggcaacgaaaacccaaaactaaagagctgtaaccaactaaagtgtgtgaaactgatttgaaaaaaagttataaaatacatgttttaggacagttgggaaatttgaatatgactggttattagatggtattagggaatttttgttgattttcttacctgtgacggtggtggtagtttgaagaatattcttaatcttaagggatgcatgttgaagtatttggaatgaagtgttctgatgtttacaactttcaaaaaaatgattttaaatatgtattgagagatcaggcaaacatagcaaaatgttcattgttgagtccacatggaaaatacgggtattcaatgtgccatactttcaactcttctgtactctgatattttcaaaataaaacatttgaggggaaatta

SEQ ID NO: 2809 - DNA, 4299 bp, Homo sapiens
ggagctgactgggagctgactggggcctggaaagctcagttgtttctctgggctaactttaacaatgatttcttgaggtcttgtagatgatactctccaagctgtaaggaagaagtcaaggattaaggagacctggactggagaggagcctttttcaaaaaacaacaatgacaagagaaaatgtagcccacaatgctctgagacaagagggccttgtgaaggggaaggatgatacctggaaatggggaaccagcttccaaggaagtagctcctctgtttgggagacctcccacctacactttagacaattacgttaccatgagacatctggaccccaggaagccctgagccggctcagggaactctgtcgccggtggctgagaccagaagcacgcaccaaggcacagatcctggagctgctggtgctggagcagtttctgagcatcctgcctggggagattcggacctgggtacagctccatcaccctggaagtggcgaggaggctgtggccctggtagaggagctgcagaaagaccttgatggaccagcaatacaagttccagtccttgtcaaggatcaggacactctccagaaggtggtgagtgccccaggaacaacacttcctcctgtacttcctggcagccacatagcagctgaaatttgcccgcatcctcctactgacctagtggcattcaacctccaggatcctcagcatgattctcctgcccctgaagcttctgccctttcccaggaagagaacccaagaaatcaattaatggcacttatgctcctaacagcccagccccaggagttggtgatgttcgaggaggtgtcagtatgcttcacttcagaggaatgggcatgtctgggcccaatccagagggccttgtactgggatgtgatgctggagaattatggaaatgtgacctccctagaatgggagaccatgaccgagaatgaggaggtgacatcaaagccaagtagttctcaaagagcagactctcataaaggaacatcaaaaagacttcaaggaagtgttccccaggtccttgattttgaagaagagtgtgaatggcaagttttggcaagtcagtggggaaatgaaacagatgaaagggcagatacagtgaagaaagtttccctttgtgaacgagacaagaagaaaaggactccaccagagaaacaaggccaaaagtggaaggaattaggagacagcttgactttcggttcagctatttctgaaagtttaataggtactgaaggaaagaagttttataaatgtgatatgtgttgtaaacattttaataaaatctcccatcttataaaccatcggagaatccacactggtgagaaacctcataaatgtaaggaatgtggaaaaggctttattcagcgttcgagccttctaatgcatttacggaaccattcaggggagaaaccttataaatgtaatgaatgtgggaaagcattttctcaaagtgcttaccttctaaaccatcagaggatccacactggggagaaaccttataagtgtaaggagtgtggaaagggcttctataggcactcaggcctaattatacatctaaggcgccattcaggggagagaccttataagtgtaatgaatgtgggaaagtcttctctcagaatgcttacctcattgaccatcagaggctccacaaaggggaagaaccttataaatgtaataagtgtcagaaagctttcattctgaagaagagcctcattctgcaccagagaatccactctggggaaaaaccctataaatgtgatgaatgtggaaagacctttgctcagaccacttatcttattgaccatcagcgactccacagtgcagagaacccttacaagtgtaaagaatgtggaaaagttttcattcgaagcaaaagcctcctcttacatcagagagtccacacagaaaagaaaacctttggttgtaaaaagtgtgggaagattttcagttctaagtcaaacttcattgaccataagaggatgcacagcagagagaaaccttacaaatgcactgaatgtgggaaagcctttactcaaagtgcttacctttttgaccaccagagactccacaatggggagaagccctatgaatgtaatgaatgtgggaaagtttttattctgaagaagagcctcattttacatcaaaggttccacactggagagaatctctatgaatgtaaagattgtggtaaggtcttcggttcaaacagaaacctcattgaccatgagagactccacaatggggagaagccatatgaatgtcgagagtgtgggaaaacctttattatgagcaaaagttttatggtccatcagaaactccatacacaagagaaagcctacaaatgtgaggattgtgggaaggctttcagttacaattcaagcctgcttgtacatcggagaatccacaccggagaaaaaccctttgaatgcagtgagtgtggaagagctttcagttcaaacagaaacctcattgagcataagagaatccacagtggtgagaaaccctatgagtgtgatgagtgtggcaaatgcttcattctgaagaaaagcctcattggacatcagagaattcacacgagggaaaaatcttataaatgcaatgactgtgggaaggtcttcagttaccgctcaaaccttatagcccatcagaggatccatactggtgagaagccctatgcgtgtagtgagtgtggaaaaggttttacgtacaacagaaacctgattgaacatcaaagaattcacagtggagaaaaaacctacgaatgtcatgtatgtaggaaagtccttacctctagtagaaatcttatggtacatcaaagaatccatactggagagaaaccttataaatgtaatgagtgtggaaaagactttagtcagaataaaaaccttgttgtacatcagagaatgcacactggggaaaaaccttatgagtgtgacaagtgtaggaaatcctttacttctaagaggaatttagttggccaccagagaattcacacaggggagaaaccctatgggtgtaatgattgtagtaaagtttttaggcaaagaaaaaaccttactgtacatcagaaaatccacacagatgaaaaaccttgtgaatgtgatgtgtctgaaaaagaattctctcagacttccaaccttcatcttcaacagaaaatccataccattgaggaattctcttggctacaaaacaccaatgagtccaagattgagattcagaaaatctagtgtcatatgtaaaatggaatagaatccctgcctacttaagtaactgttggacaaatgatatatatttcttctaaggaaaaagtttattatttactctttactagacaaatgagtagcatatagaagaaagttaataggccgggcttggtggctcatgcctgtaatcccagcactttgagaggccgaagcgagtggatcacctgaggtcaggattttgagaccagcctgaccaacatggtgaaaccccatctctactaaaatacaaaaattatccgggcatgggggcacacaccggtaatcccagctactcaggaggctgagacaggagagtcgcttgaacctgggagggcggaggttgcagtgagccaggatcgcgccattgcactccagcctgggcaacaagagcgaaactcttgtctgaaaaaataaagttcatcccaactttcaagtctacaaaaacataatccaaatctaataacatagttgtaaatgagagcaacaataaaaagtagacatgggctgggtgcagtggctcactcctgtagtcccaggactttgggaggccgaggtgggaagatcccttgagcccaggagttcgagacaagcctgggtaacacggggagacccgtctttagtaaataaaaataaatttattaataaaactaaaaatttaataataaaaagtggacattgttttttaaaatgtgtatagtatgcattttaaagatagtgtcactgctgtggaaaacctgaacagacagtatgatccagaatgtcaggtgtggagttgggcggacaagagtctgctgatgaggacaacctaaaagagcactggatttggaatcagaagacctacctttgattcctggctttcccttaatggccatgtgatgttattaagtcagcctctaaagctttagtttcctgtcagtcaaatgttgacatgatacctacctcacagggttgttgtgagggttaagtgaaaggatctttgtgaaagtactttttgaaatcattcagttgtcaataaagttggataaaa

SEQ ID NO: 2810 - DNA, 546 bp, Homo sapiens
acagagatgtggaaacctcacgaagcctagaagggccggagggacaggctgggagttagctgggagttgctgacgcagttccttctgcgctttgttcaagatgtgggtctggcgctttcgtgactcaagaccctcttaggaacttcttcactgaactcaaggaggagatcaggcaagatctgtgctgtgcagatcctttggattgaggctgctgtgcacaggaatatggatgatactctccaagctgtaaggaagaagtcaaggattaaggagacctggactggagaggagcctttttcaaaaaacaacaatgacaagagaaaatgtagcccacaatgctctgagacaagagggccttgtgaaggggaaggatgatacctggaaatggggaaccagcttccaaggaagtagctcctctgtttgggagacctcccacctacactttagacaattacgttaccatgagacatctggaccccaggaagccctgagccggctcagggaactctgtcgccggtggctgagaccagaagcacgcaccaaggc

SEQ ID NO: 2811 - DNA, 1253 bp, Homo sapiens
agtattctcggctcggccattattctgtgcctcggctgccggaagggctcgttcctgtgtcatctcctagcggcctggcgccgaggcggcggtacgcaaggctggagccgcagcgggagcccccggtcttgtagatgatactctccaagctgtaaggaagaagtcaaggattaaggagacctggactggagaggagcctttttcaaaaaacaacaatgacaagagaaaatgtagcccacaatgctctgagacaagagggccttgtgaaggggaaggatgatacctggaaatggggaaccagcttccaaggaagtagctcctctgtttgggagacctcccacctacactttagacaattacgttaccatgagacatctggaccccaggaagccctgagccggctcagggaactctgtcgccggtggctgagaccagaagcacgcaccaaggcacagatcctggagctgctggtgctggagcagtttctgagcatcctgcctggggagattcggacctgggtacagctccatcaccctggaagtggcgaggaggctgtggccctggtagaggagctgcagaaagaccttgatggaccagcaatacaagttccagtccttgtcaaggatcaggacactctccagaaggtggtgagtgccccaggaacaacacttcctcctgtacttcctggcagccacatagcagctgaaatttgcccgcatcctcctactgacctagtggcattcaacctccaggatcctcagcatgattctcctgcccctgaagcttctgccctttcccaggaagagaacccaagaaatcaattaatggcacttatgctcctaacagcccagccccaggagttggtgatgttcgaggaggtgtcagtatgcttcacttcagaggaatgggcatgtctgggcccaatccagagggccttgtactgggatgtgatgctggagaattatggaaatgtgacctccctagaatgggagaccatgaccgagaatgaggaggtgacatcaaagccaagtagttctcaaagagcagactctcataaaggaacatcaaaaagacttcaaggaagtgttccccaggtccttgattttgaagaagagtgtgaatggcaagttttggcaagtcagtggggaaatgaaacagatgaaagggcagatacagtgaagaaagtttccctttgtgaacgagacaagaagggactccaccagagaaacaaggccaaaagtggaaggaattag

SEQ ID NO: 2812 - DNA, 2429 bp, Homo sapiens
aaatgtagtctggcgctccgggctgtaagcgccggtcgcggctgtgtcggtcgccgctgctcccgctcctgctgggagaggtttcaggagtcagtgaccttcaaggatgtgtccatagatttctcttgggaagagtggattcaagcagattctgctcagaggatgaccgtgtatggggaggtgatgctggagaactacaggaacccggtctcactgggaaatcacctttccaaacccaatgggacttcccagctggaacgagaactgagtctgatgcaaaaagaaccgcctgagggtggctttcgagattttcttggatattgctgtcagattaatctgacatttagtcctctcattatcctgtcccagtcaaggggagaaagtattgactgagtgctgtgctcagctcttccacagccagcatctcacttacttgacacaaaacatctatagactgggagacaagacttgaaaccaaagagccaactccgaagccgggtattactgaagatttatgccatggggtaacaatggaaagggaaggtatctggcattctactctaggggaaacctgggaacctaataattggttagagggacaacaggatagtcatctgagccaagtgggagttacccataaggaaaccttcactgagatgagagtatgtggaggtaatgaatttgaaagatgttccagtcaggattcaatccttgatacacagcaaagcattcctatggtaaaaaggccccataactgtaattcacatggagaagatgccacacaaaattctgagttaattaaaactcaaagaatgtttgtaggaaagaagatctatgaatgtaatcagtgcagcaaaaccttcagtcagagctcatcccttcttaagcaccagaggattcatactggggagaaaccctataagtgtaatgtatgtgggaaacacttcattgaacgatcctcccttactgtacatcaaagaattcatactggagagaaaccctataaatgtaatgaatgtgggaaagcctttagtcagagcatgaatcttactgtccatcaacgaactcacaccggagagaaaccctatcagtgtaaagagtgtggcaaagccttccataagaattcatctcttattcagcatgaaaggattcatactggagagaaaccctacaaatgtaatgaatgtggtaaagcttttacccaaagcatgaatttgacagttcatcagagaactcatacaggagaaaaaccctatgaatgtaatgaatgtggaaaagccttcagtcaaagcatgcatcttattgtacatcagagaagccatactggagaaaaaccctatgagtgtagtcaatgtggaaaagcctttagtaagagctcaactcttaccctacatcagcgaaatcacactggagaaaaaccttacaaatgtaacaaatgcgggaaatcctttagccaaagtacatatcttatagaacatcagagacttcattctggagtaaaaccttttgaatgtaacgagtgtggaaaagctttcagtaagaattcatctctaactcaacatcggagaattcacactggagagaaaccttatgagtgtatggtgtgtggaaaacatttcactggacgatcatcccttaccgtgcatcaggtcattcacactggagagaaaccttatgagtgcaatgaatgtggaaaggcattcagccagagtgcttaccttattgaacatcaaagaattcatactggtgagaaaccctatgaatgtgatcagtgtggaaaagccttcattaagaattcatcccttacagtgcatcagagaactcatacaggagagaaaccctatcagtgtaatgaatgcggaaaagccttcagccggagtacaaaccttacacgacatcaaagaactcatacgtgaggaatgttttcactggcccttacctcatgattaactcttcagtaataatcatatgagacatacaatgtagaaacctaataaatgtaatgattgtgggaatctttcagttgaagtacaatatgtcatatcagataataccactgcagagaatccatctaaaagtagagaaatcttgattcagaatgtataatttcctttatatcagaaggtttaaatagctaatataaacaatgaagagtcatgctgaagataagttctgttatatcataccgcacattctcctttggctatcagagactttacactggagagaaaaatgtgagagtgtttaactggacagcccagagacctggtatgtagtcctaatctgccactgccttggacaacttgcctacttccaccaggttatggttctttatttggtaaatgaatgattttggagttagaaatcttgtaggagctctgttagctctaaaatgctacaactctataaatataatgaatgctgggaaa

SEQ ID NO: 2813 - DNA, 2043 bp, Homo sapiens
cccggtctcactgggaaatcacctttccaaacccaatgggacttcccagctggaacgagaactgagtctgatgcaaaaagaaccgcctgagggtggctttcgagatggagtctcgctgtgtcgcccaggctggagtgcagtggcacgatctcgactcactgcaagctccgcctcccaggttcacgccattctcctgcctcagcctcctgagtagctgggactacagactgggagacaagacttgaaaccaaagagccaactccgaagccgggtattactgaagatttatgccatggggtaacaatggaaagggaaggtatctggcattctactctaggggaaacctgggaacctaataattggttagagggacaacaggatagtcatctgagccaagtgggagttacccataaggaaaccttcactgagatgagagtatgtggaggtaatgaatttgaaagatgttccagtcaggattcaatccttgatacacagcaaagcattcctatggtaaaaaggccccataactgtaattcacatggagaagatgccacacaaaattctgagttaattaaaactcaaagaatgtttgtaggaaagaagatctatgaatgtaatcagtgcagcaaaaccttcagtcagagctcatcccttcttaagcaccagaggattcatactggggagaaaccctataagtgtaatgtatgtgggaaacacttcattgaacgatcctcccttactgtacatcaaagaattcatactggagagaaaccctataaatgtaatgaatgtgggaaagcctttagtcagagcatgaatcttactgtccatcaacgaactcacaccggagagaaaccctatcagtgtaaagagtgtggcaaagccttccataagaattcatctcttattcagcatgaaaggattcatactggagagaaaccctacaaatgtaatgaatgtggtaaagcttttacccaaagcatgaatttgacagttcatcagagaactcatacaggagaaaaaccctatgaatgtaatgaatgtggaaaagccttcagtcaaagcatgcatcttattgtacatcagagaagccatactggagaaaaaccctatgagtgtagtcaatgtggaaaagcctttagtaagagctcaactcttaccctacatcagcgaaatcacactggagaaaaaccttacaaatgtaacaaatgcgggaaatcctttagccaaagtacatatcttatagaacatcagagacttcattctggagtaaaaccttttgaatgtaacgagtgtggaaaagctttcagtaagaattcatctctaactcaacatcggagaattcacactggagagaaaccttatgagtgtatggtgtgtggaaaacatttcactggacgatcatcccttaccgtgcatcaggtcattcacactggagagaaaccttatgagtgcaatgaatgtggaaaggcattcagccagagtgcttaccttattgaacatcaaagaattcatactggtgagaaaccctatgaatgtgatcagtgtggaaaagccttcattaagaattcatcccttacagtgcatcagagaactcatacaggagagaaaccctatcagtgtaatgaatgcggaaaagccttcagccggagtacaaaccttacacgacatcaaagaactcatacgtgaggaatgttttcactggcccttacctcatgattaactcttcagtaataatcatatgagacatacaatgtagaaacctaataaatgtaatgattgtgggaatctttcagttgaagtacaatatgtcatatcagataataccactgcagagaatccatctaaaagtagagaaatcttgattcagaatgtataatttcctttatatcagaaggtttaaatagctaatataaacaatgaagagtcatgctgaagataagttctgttatatcataccgcacattctcctttggctatcagagactttacactggagagaaaaatgtgagagtgtttaactggacagcccagagacctggt

SEQ ID NO: 2814 - DNA, 2043 bp, Homo sapiens
cccggtctcactgggaaatcacctttccaaacccaatgggacttcccagctggaacgagaactgagtctgatgcaaaaagaaccgcctgagggtggctttcgagatggagtctcgctgtgtcacccaggctggagtgcagtggcacaatctcagctcactgcaagctccgcctcccgggttcacaccattctcctgcctcagcctccggagtagctgggactacagactgggagacaagacttgaaaccaaagagccaactccgaagccgggtattactgaagatttatgccatggggtaacaatggaaagggaaggtatctggcattctactctaggggaaacctgggaacctaataattggttagagggacaacaggatagtcatctgagccaagtgggagttacccataaggaaaccttcactgagatgagagtatgtggaggtaatgaatttgaaagatgttccagtcaggattcaatccttgatacacagcaaagcattcctatggtaaaaaggccccataactgtaattcacatggagaagatgccacacaaaattctgagttaattaaaactcaaagaatgtttgtaggaaagaagatctatgaatgtaatcagtgcagcaaaaccttcagtcagagctcatcccttcttaagcaccagaggattcatactggggagaaaccctataagtgtaatgtatgtgggaaacacttcattgaacgatcctcccttactgtacatcaaagaattcatactggagagaaaccctataaatgtaatgaatgtgggaaagcctttagtcagagcatgaatcttactgtccatcaacgaactcacaccggagagaaaccctatcagtgtaaagagtgtggcaaagccttccataagaattcatctcttattcagcatgaaaggattcatactggagagaaaccctacaaatgtaatgaatgtggtaaagcttttacccaaagcatgaatttgacagttcatcagagaactcatacaggagaaaaaccctatgaatgtaatgaatgtggaaaagccttcagtcaaagcatgcatcttattgtacatcagagaagccatactggagaaaaaccctatgagtgtagtcaatgtggaaaagcctttagtaagagctcaactcttaccctacatcagcgaaatcacactggagaaaaaccttacaaatgtaacaaatgcgggaaatcctttagccaaagtacatatcttatagaacatcagagacttcattctggagtaaaaccttttgaatgtaacgagtgtggaaaagctttcagtaagaattcatctctaactcaacatcggagaattcacactggagagaaaccttatgagtgtatggtgtgtggaaaacatttcactggacgatcatcccttaccgtgcatcaggtcattcacactggagagaaaccttatgagtgcaatgaatgtggaaaggcattcagccagagtgcttaccttattgaacatcaaagaattcatactggtgagaaaccctatgaatgtgatcagtgtggaaaagccttcattaagaattcatcccttacagtgcatcagagaactcatacaggagagaaaccctatcagtgtaatgaatgcggaaaagccttcagccggagtacaaaccttacacgacatcaaagaactcatacgtgaggaatgttttcactggcccttacctcatgattaactcttcagtaataatcatatgagacatacaatgtagaaacctaataaatgtaatgattgtgggaatctttcagttgaagtacaatatgtcatatcagataataccactgcagagaatccatctaaaagtagagaaatcttgattcagaatgtataatttcctttatatcagaaggtttaaatagctaatataaacaatgaagagtcatgctgaagataagttctgttatatcataccgcacattctcctttggctatcagagactttacactggagagaaaaatgtgagagtgtttaactggacagcccagagacctggt

SEQ ID NO: 2815 - DNA, 598 bp, Homo sapiens
gtagtctggcgctccgggctgtaagcgccggtcgcggctgtgtcggtcgccgctgctcccgctcctgctgggagaggtttcaggagtcagtgaccttcaaggatgtgtccatagatttctcttgggaagagtggattcaagcagattctgctcagaggatgaccgtgtatggggaggtgatgctggagaactacaggaacccggtctcactggcaggaaatcacctttccaaacccaatgggacttcccagctggaacgagaactgagtctgatgcaaaaagaaccgcctgagggtggctttcgagattttcttggatattgctgtcagattaatctgacatttagtcctctcattatcctgtcccagtcaaggggagaaagtattgactgagtgctgtgctcagctcttccacagccagcatctcacttacttgacacaaaacatctatagactgggagacaagacttgaaaccaaagagccaactccgaagccgggtattactgaagatttatgccatggggtaacaatggaaagggaaggtatctggcattctactctaggggaaacctgggaacctaataattggttagaggga

SEQ ID NO: 2816 - DNA, 532 bp, Homo sapiens
gctgtaagcgccggtcgcggctgtgtcggtcgccgctgctcccgctcctgctgggagagggagtcagtgaccttcaaggatgtgtccatagatttctcttgggaagagtggattcaagcagattctgctcagaggatgaccgtgtatggggaggtgatgctggagaactacaggaacccggtctcactggcaggaaatcacctttccaaacccaatgggacttcccagctggaacgagaactgagtctgatgcaaaaagaaccgcctgagggtggctttcgagattttcttggatattgctgtcagattaatctgacatttagtcctctcattatcctgtcccagtcaaggggagaaagtattgactgagtgctgtgctcagctcttccacagccagcatctcacttacttgacacaaaacatctatagactgggagacaagacttgaaaccaaagagccaactccgaagccgggtattactgaagatttatgccatggggtaacaatggaaagggaaggtatctggcattc

SEQ ID NO: 2817 - DNA, 2154 bp, Homo sapiens
cccggtctcactgggaaatcacctttccaaacccaatgggacttcccagctggaacgagaactgagtctgatgcaaaaagaaccgcctgagggtggctttcgagccgggcatggttgcgtgcacctgtaatcccagctactcgggaggctgaggtgcaagaatcacttcaacccgggaggctgaggttgcgattttcttggatattgctgtcagattaatctgacatttagtcctctcattatcctgtcccagtcaaggggagaaagtattgactgagtgctgtgctcagctcttccacagccagcatctcacttacttgacacaaaacatctatagactgggagacaagacttgaaaccaaagagccaactccgaagccgggtattactgaagatttatgccatggggtaacaatggaaagggaaggtatctggcattctactctaggggaaacctgggaacctaataattggttagagggacaacaggatagtcatctgagccaagtgggagttacccataaggaaaccttcactgagatgagagtatgtggaggtaatgaatttgaaagatgttccagtcaggattcaatccttgatacacagcaaagcattcctatggtaaaaaggccccataactgtaattcacatggagaagatgccacacaaaattctgagttaattaaaactcaaagaatgtttgtaggaaagaagatctatgaatgtaatcagtgcagcaaaaccttcagtcagagctcatcccttcttaagcaccagaggattcatactggggagaaaccctataagtgtaatgtatgtgggaaacacttcattgaacgatcctcccttactgtacatcaaagaattcatactggagagaaaccctataaatgtaatgaatgtgggaaagcctttagtcagagcatgaatcttactgtccatcaacgaactcacaccggagagaaaccctatcagtgtaaagagtgtggcaaagccttccataagaattcatctcttattcagcatgaaaggattcatactggagagaaaccctacaaatgtaatgaatgtggtaaagcttttacccaaagcatgaatttgacagttcatcagagaactcatacaggagaaaaaccctatgaatgtaatgaatgtggaaaagccttcagtcaaagcatgcatcttattgtacatcagagaagccatactggagaaaaaccctatgagtgtagtcaatgtggaaaagcctttagtaagagctcaactcttaccctacatcagcgaaatcacactggagaaaaaccttacaaatgtaacaaatgcgggaaatcctttagccaaagtacatatcttatagaacatcagagacttcattctggagtaaaaccttttgaatgtaacgagtgtggaaaagctttcagtaagaattcatctctaactcaacatcggagaattcacactggagagaaaccttatgagtgtatggtgtgtggaaaacatttcactggacgatcatcccttaccgtgcatcaggtcattcacactggagagaaaccttatgagtgcaatgaatgtggaaaggcattcagccagagtgcttaccttattgaacatcaaagaattcatactggtgagaaaccctatgaatgtgatcagtgtggaaaagccttcattaagaattcatcccttacagtgcatcagagaactcatacaggagagaaaccctatcagtgtaatgaatgcggaaaagccttcagccggagtacaaaccttacacgacatcaaagaactcatacgtgaggaatgttttcactggcccttacctcatgattaactcttcagtaataatcatatgagacatacaatgtagaaacctaataaatgtaatgattgtgggaatctttcagttgaagtacaatatgtcatatcagataataccactgcagagaatccatctaaaagtagagaaatcttgattcagaatgtataatttcctttatatcagaaggtttaaatagctaatataaacaatgaagagtcatgctgaagataagttctgttatatcataccgcacattctcctttggctatcagagactttacactggagagaaaaatgtgagagtgtttaactggacagcccagagacctggt

SEQ ID NO: 2818 - DNA, 2440 bp, Homo sapiens
ctgtctgtcagccgctttggtacgctgcatcgggatcgaagtgacggaccgtgaaggcgcgagagtcaggtctgagggtcgggggcagagccgcccgcgaggccggcctggggatagcgatgctcgggttccccccgggtcgcccgcagctcccggtccagctccgcccacagactcggatggcgaccgcactgagggacccggcttcggttcccatagctacagaggtgcttttcaaacttacacagggaagtgtgacctttgaagatgtggccgtgtacttctcctgggaggaatgggatctccttgatgaggctcagaaacacctgtacttcgatgtgatgctggagaactttgcacttacgtcctccctgggttgttggtgtggagtggaacatgaggaaacaccttctgaacagagaatttctggagaaagagtgccacagttcaggacttccaaagaaggttcatcttcccagaatgccgactcctgtgaaatatgttgcctggtcttgagagatattttgcacttggctgaacaccaaggaacaaactgcgggcagaaactacacacatgtggaaaacaattctacatcagtgcaaatcttcaacagcaccagaggcagcacattacagaggcacctttcagaagttatgtggacactgcctcgtttacacagagttgcatagtccatgtgtcggagaaaccctttacctgcagggagatcaggaaagacttcctggccaacatgaggtttctccatcaagacgccactcaaacaggggagaagccaaataacagtaacaagtgtgcggtggccttttacagtggaaaaagtcatcacaactggggaaaatgcagtaaagcctttagccacatagacacacttgttcaggaccagagaatcctcactagagaaggactttttgagtgcagtaaatgtgggaaagcatgtacgcgaagatgtaacctcattcagcaccagaaagtccacagtgaagaaaggccttatgaatgcaatgaatgtggaaaattctttacctactactccagtttcattatacatcagagagttcatactggagaaaggccttatgcgtgccctgaatgtgggaaatcgtttagtcagatatacagcctcaatagccataggaaagttcacactggagaaaggccttatgaatgtggggaatgtgggaaatcttttagccaaaggtccaacctcatgcagcatcgcagagttcacactggagaaaggccttatgaatgcagcgaatgtgggaaatcttttagccaaaactttagcctgatctaccaccagagagttcacactggagaaagacctcatgagtgcaatgaatgtggaaaatcctttagccgaagctccagcctcattcaccaccggagacttcacactggagaaagaccctatgagtgcagtaaatgtgggaagtcatttaagcaaagctccagcttcagttcacatcggaaagtccacacaggggaaaggccttatgtgtgtggggaatgtgggaaatcctttagccatagctccaaccttaagaaccaccagagagttcacactggagaaagacctgttgagtgcagtgaatgtagcaaatcctttagctgtaaatctaacctcattaaacacctgagagttcacactggagaaaggccttatgagtgcagtgaatgtgggaaatcctttagccaaagttctagcctcattcaacaccgcagagttcacacgggaaaaaggccttatcagtgcagtcaatgtgggaaatcctttggctgcaaatctgtcctcattcaacaccagagagttcacattggagaaaagccttagctgtactgagaatatgcaatttccttttagtgtaattatactgaaggagtacacctgtgagagagacaagtacctgatttggaagccccaacatctaaggatatacagtgggcggattccccttaagttccaggtatgtgttacactttctaacatgccatttagaaagtgttagactttctcacctgccatttatggctcttgccgtttatgtcactgacagtttctgaggcagaagccgtatcatgtctaccacctgtgaggtccacacagtgtgtatcatttacctcctgaacctgctcaaggaagcagacctctgcttctccccatttgctagaagaaatcatgaatagtctgagtcttcctctctgacaagttagggcatggacttgacccagctttgtgccagagaacccaatatgagtgttgttggcagcttgccaagaaggactgtctttttcaagacatactggtttcatgtgacacctccatggatttttttccagcctctaagtcaccaacttgggaactgcttgtctcacgttgctttgttttttacaataataaaagcattattatttaagcta

SEQ ID NO: 2819 - DNA, 1959 bp, Homo sapiens
tcttcgcagcggtcattttggctgccctcccggaggtccgttctgtctgtcagccgctttggttcccatagctacagaggtgcttttcaaacttacacagggaagtgtgacctttgaagatgtggccgtgtacttctcctgggaggaatgggatctccttgatgaggctcagaaacacctgtacttcgatgtgatgctggagaactttgcacttacgtcctccctgggacttatatcatcctggtctcatgtagttgctcaactagggctaggggaagtgccctctgttcttcacaggatgttcatgactccagcctcagcaagatgggatcagagagggcctggcctacatgaatggcacttgggaaaaggcatgtcatcaggttgttggtgtggagtggaacatgaggaaacaccttctgaacagagaatttctggagaaagagtgccacagttcaggacttccaaagaaggttcatcttcccagaatgccgactcctgtgaaatatgttgcctggtcttgagagatattttgcacttggctgaacaccaaggaacaaactgcgggcagaaactacacacatgtggaaaacaattctacatcagtgcaaatcttcaacagcaccagaggcagcacattacagaggcacctttcagaagttatgtggacactgcctcgtttacacagagttgcatagtccatgtgtcggagaaaccctttacctgcagggagatcaggaaagacttcctggccaacatgaggtttctccatcaagacgccactcaaacaggggagaagccaaataacagtaacaagtgtgcggtggccttttacagtggaaaaagtcatcacaactggggaaaatgcagtaaagcctttagccacatagacacacttgttcaggaccagagaatcctcactagagaaggactttttgagtgcagtaaatgtgggaaagcatgtacgcgaagatgtaacctcattcagcaccagaaagtccacagtgaagaaaggccttatgaatgcaatgaatgtggaaaattctttacctactactccagtttcattatacatcagagagttcatactggagaaaggccttatgcgtgccctgaatgtgggaaatcgtttagtcagatatacagcctcaatagccataggaaagttcacactggagaaaggccttatgaatgtggggaatgtgggaaatcttttagccaaaggtccaacctcatgcagcatcgcagagttcacactggagaaaggccttatgaatgcagcgaatgtgggaaatcttttagccaaaactttagcctgatctaccaccagagagttcacactggagaaagacctcatgagtgcaatgaatgtggaaaatcctttagccgaagctccagcctcattcaccaccggagacttcacactggagaaagaccctatgagtgcagtaaatgtgggaagtcatttaagcaaagctccagcttcagttcacatcggaaagtccacacaggggaaaggccttatgtgtgtggggaatgtgggaaatcctttagccatagctccaaccttaagaaccaccagagagttcacactggagaaagacctgttgagtgcagtgaatgtagcaaatcctttagctgtaaatctaacctcattaaacacctgagagttcacactggagaaaggccttatgagtgcagtgaatgtgggaaatcctttagccaaagttctagcctcattcaacaccgcagagttcacacgggaaaaaggccttatcagtgcagtcaatgtgggaaatcctttggctgcaaatctgtcctcattcaacaccagagagttcacattggagaaaagccttagctgtactgagaatatgcaatttccttttagtgtaattatactgaaggagtacacctgtgagagagacaagtacctgatttggaagccccaacatctaa

SEQ ID NO: 2820 - DNA, 2472 bp, Homo sapiens
agggcgggacttgtggcgtcttcgcagcggtcattttggctgccctcccggaggtccgttctgtctgtcagccgctttggtacgctgcatcgggatcgaagtgacggaccgtgaaggcgcgagagtcaggtctgagggtcgggggcagagccgcccgcgaggccggcctggggatagcgatgctcgggttccccccgggtcgcccgcagctcccggtccagctccgcccacagactcggatggcgaccgcactgagggacccggcttcgggaagtgtgacctttgaagatgtggccgtgtacttctcctgggaggaatgggatctccttgatgaggctcagaaacacctgtacttcgatgtgatgctggagaactttgcacttacgtcctccctgggttgttggtgtggagtggaacatgaggaaacaccttctgaacagagaatttctggagaaagagtgccacagttcaggacttccaaagaaggttcatcttcccagaatgccgactcctgtgaaatatgttgcctggtcttgagagatattttgcacttggctgaacaccaaggaacaaactgcgggcagaaactacacacatgtggaaaacaattctacatcagtgcaaatcttcaacagcaccagaggcagcacattacagaggcacctttcagaagttatgtggacactgcctcgtttacacagagttgcatagtccatgtgtcggagaaaccctttacctgcagggagatcaggaaagacttcctggccaacatgaggtttctccatcaagacgccactcaaacaggggagaagccaaataacagtaacaagtgtgcggtggccttttacagtggaaaaagtcatcacaactggggaaaatgcagtaaagcctttagccacatagacacacttgttcaggaccagagaatcctcactagagaaggactttttgagtgcagtaaatgtgggaaagcatgtacgcgaagatgtaacctcattcagcaccagaaagtccacagtgaagaaaggccttatgaatgcaatgaatgtggaaaattctttacctactactccagtttcattatacatcagagagttcatactggagaaaggccttatgcgtgccctgaatgtgggaaatcgtttagtcagatatacagcctcaatagccataggaaagttcacactggagaaaggccttatgaatgtggggaatgtgggaaatcttttagccaaaggtccaacctcatgcagcatcgcagagttcacactggagaaaggccttatgaatgcagcgaatgtgggaaatcttttagccaaaactttagcctgatctaccaccagagagttcacactggagaaagacctcatgagtgcaatgaatgtggaaaatcctttagccgaagctccagcctcattcaccaccggagacttcacactggagaaagaccctatgagtgcagtaaatgtgggaagtcatttaagcaaagctccagcttcagttcacatcggaaagtccacacaggggaaaggccttatgtgtgtggggaatgtgggaaatcctttagccatagctccaaccttaagaaccaccagagagttcacactggagaaagacctgttgagtgcagtgaatgtagcaaatcctttagctgtaaatctaacctcattaaacacctgagagttcacactggagaaaggccttatgagtgcagtgaatgtgggaaatcctttagccaaagttctagcctcattcaacaccgcagagttcacacgggaaaaaggccttatcagtgcagtcaatgtgggaaatcctttggctgcaaatctgtcctcattcaacaccagagagttcacattggagaaaagccttagctgtactgagaatatgcaatttccttttagtgtaattatactgaaggagtacacctgtgagagagacaagtacctgatttggaagccccaacatctaaggatatacagtgggcggattccccttaagttccaggtatgtgttacactttctaacatgccatttagaaagtgttagactttctcacctgccatttatggctcttgccgtttatgtcactgacagtttctgaggcagaagccgtatcatgtctaccacctgtgaggtccacacagtgtgtatcatttacctcctgaacctgctcaaggaagcagacctctgcttctccccatttgctagaagaaatcatgaatagtctgagtcttcctctctgacaagttagggcatggacttgacccagctttgtgccagagaacccaatatgagtgttgttggcagcttgccaagaaggactgtctttttcaagacatactggtttcatgtgacacctccatggatttttttccagcctctaagtcaccaacttgggaactgcttgtctcacgttgctttgttttttacaataataaaagcattattatttaagctacctttatcttg

SEQ ID NO: 2821 - DNA, 2239 bp, Homo sapiens
cattttggctgccctcccggaggtccgttctgtctgtcagccgctttgggaagtgtgacctttgaagatgtggccgtgtacttctcctgggaggaatgggatctccttgatgaggctcagaaacacctgtacttcgatgtgatgctggagaactttgcacttacgtcctccctgggttgttggtgtggagtggaacatgaggaaacaccttctgaacagagaatttctggagaaagagtgccacagttcaggacttccaaagaaggttcatcttcccagaatgccgactcctgtgaaatatgttgcctggtcttgagagatattttgcacttggctgaacaccaaggaacaaactgcgggcagaaactacacacatgtggaaaacaattctacatcagtgcaaatcttcaacagcaccagaggcagcacattacagaggcacctttcagaagttatgtggacactgcctcgtttacacagagttgcatagtccatgtgtcggagaaaccctttacctgcagggagatcaggaaagacttcctggccaacatgaggtttctccatcaagacgccactcaaacaggggagaagccaaataacagtaacaagtgtgcggtggccttttacagtggaaaaagtcatcacaactggggaaaatgcagtaaagcctttagccacatagacacacttgttcaggaccagagaatcctcactagagaaggactttttgagtgcagtaaatgtgggaaagcatgtacgcgaagatgtaacctcattcagcaccagaaagtccacagtgaagaaaggccttatgaatgcaatgaatgtggaaaattctttacctactactccagtttcattatacatcagagagttcatactggagaaaggccttatgcgtgccctgaatgtgggaaatcgtttagtcagatatacagcctcaatagccataggaaagttcacactggagaaaggccttatgaatgtggggaatgtgggaaatcttttagccaaaggtccaacctcatgcagcatcgcagagttcacactggagaaaggccttatgaatgcagcgaatgtgggaaatcttttagccaaaactttagcctgatctaccaccagagagttcacactggagaaagacctcatgagtgcaatgaatgtggaaaatcctttagccgaagctccagcctcattcaccaccggagacttcacactggagaaagaccctatgagtgcagtaaatgtgggaagtcatttaagcaaagctccagcttcagttcacatcggaaagtccacacaggggaaaggccttatgtgtgtggggaatgtgggaaatcctttagccatagctccaaccttaagaaccaccagagagttcacactggagaaagacctgttgagtgcagtgaatgtagcaaatcctttagctgtaaatctaacctcattaaacacctgagagttcacactggagaaaggccttatgagtgcagtgaatgtgggaaatcctttagccaaagttctagcctcattcaacaccgcagagttcacacgggaaaaaggccttatcagtgcagtcaatgtgggaaatcctttggctgcaaatctgtcctcattcaacaccagagagttcacattggagaaaagccttagctgtactgagaatatgcaatttccttttagtgtaattatactgaaggagtacacctgtgagagagacaagtacctgatttggaagccccaacatctaaggatatacagtgggcggattccccttaagttccaggtatgtgttacactttctaacatgccatttagaaagtgttagactttctcacctgccatttatggctcttgccgtttatgtcactgacagtttctgaggcagaagccgtatcatgtctaccacctgtgaggtccacacagtgtgtatcatttacctcctgaacctgctcaaggaagcagacctctgcttctccccatttgctagaagaaatcatgaatagtctgagtcttcctctctgacaagttagggcatggacttgacccagctttgtgccagagaacccaatatgagtgttgttggcagcttgccaagaaggactgtctttttcaagacatactggtttcatgtgacacctccatggatttttttccagcctctaagtcaccaacttgggaactgcttgtctcacgttgctttgttttttacaataataaaagcattattatttaagct

SEQ ID NO: 2822 - DNA, 1707 bp, Homo sapiens
atgatctcggcttactgcaacctccacctcctgggttcaagcgattctcctgcctcagcctcccaagtagctgggactacaggcatgcgccaccacgcccagggaagtgtgacctttgaagatgtggccgtgtacttctcctgggaggaatgggatctccttgatgaggctcagaaacacctgtacttcgatgtgatgctggagaactttgcacttacgtcctccctgggttgttggtgtggagtggaacatgaggaaacaccttctgaacagagaatttctggagaaagagtgccacagttcaggacttccaaagaaggttcatcttcccagaatgccgactcctgtgaaatatgttgcctggtcttgagagatattttgcacttggctgaacaccaaggaacaaactgcgggcagaaactacacacatgtggaaaacaattctacatcagtgcaaatcttcaacagcaccagaggcagcacattacagaggcacctttcagaagttatgtggacactgcctcgtttacacagagttgcatagtccatgtgtcggagaaaccctttacctgcagggagatcaggaaagacttcctggccaacatgaggtttctccatcaagacgccactcaaacaggggagaagccaaataacagtaacaagtgtgcggtggccttttacagtggaaaaagtcatcacaactggggaaaatgcagtaaagcctttagccacatagacacacttgttcaggaccagagaatcctcactagagaaggactttttgagtgcagtaaatgtgggaaagcatgtacgcgaagatgtaacctcattcagcaccagaaagtccacagtgaagaaaggccttatgaatgcaatgaatgtggaaaattctttacctactactccagtttcattatacatcagagagttcatactggagaaaggccttatgcgtgccctgaatgtgggaaatcgtttagtcagatatacagcctcaatagccataggaaagttcacactggagaaaggccttatgaatgtggggaatgtgggaaatcttttagccaaaggtccaacctcatgcagcatcgcagagttcacactggagaaaggccttatgaatgcagcgaatgtgggaaatcttttagccaaaactttagcctgatctaccaccagagagttcacactggagaaagacctcatgagtgcaatgaatgtggaaaatcctttagccgaagctccagcctcattcaccaccggagacttcacactggagaaagaccctatgagtgcagtaaatgtgggaagtcatttaagcaaagctccagcttcagttcacatcggaaagtccacacaggggaaaggccttatgtgtgtggggaatgtgggaaatcctttagccatagctccaaccttaagaaccaccagagagttcacactggagaaagacctgttgagtgcagtgaatgtagcaaatcctttagctgtaaatctaacctcattaaacacctgagagttcacactggagaaaggccttatgagtgcagtgaatgtgggaaatcctttagccaaagttctagcctcattcaacaccgcagagttcacacgggaaaaaggccttatcagtgcagtcaatgtgggaaatcctttggctgcaaatctgtcctcattcaacaccagagagttcacattggagaaaagccttag

SEQ ID NO: 2823 - DNA, 2395 bp, Homo sapiens
cattttggctgccctcccggaggtccgttctgtctgtcagccgctttgggaagtgtgacctttgaagatgtggccgtgtacttctcctgggaggaatgggatctccttgatgaggctcagaaacacctgtacttcgatgtgatgctggagaactttgcacttacgtcctccctgggacttatatcatcctggtctcatgtagttgctcaactagggctaggggaagtgccctctgttcttcacaggatgttcatgactccagcctcagcaagatgggatcagagagggcctggcctacatgaatggcacttgggaaaaggcatgtcatcaggttgttggtgtggagtggaacatgaggaaacaccttctgaacagagaatttctggagaaagagtgccacagttcaggacttccaaagaaggttcatcttcccagaatgccgactcctgtgaaatatgttgcctggtcttgagagatattttgcacttggctgaacaccaaggaacaaactgcgggcagaaactacacacatgtggaaaacaattctacatcagtgcaaatcttcaacagcaccagaggcagcacattacagaggcacctttcagaagttatgtggacactgcctcgtttacacagagttgcatagtccatgtgtcggagaaaccctttacctgcagggagatcaggaaagacttcctggccaacatgaggtttctccatcaagacgccactcaaacaggggagaagccaaataacagtaacaagtgtgcggtggccttttacagtggaaaaagtcatcacaactggggaaaatgcagtaaagcctttagccacatagacacacttgttcaggaccagagaatcctcactagagaaggactttttgagtgcagtaaatgtgggaaagcatgtacgcgaagatgtaacctcattcagcaccagaaagtccacagtgaagaaaggccttatgaatgcaatgaatgtggaaaattctttacctactactccagtttcattatacatcagagagttcatactggagaaaggccttatgcgtgccctgaatgtgggaaatcgtttagtcagatatacagcctcaatagccataggaaagttcacactggagaaaggccttatgaatgtggggaatgtgggaaatcttttagccaaaggtccaacctcatgcagcatcgcagagttcacactggagaaaggccttatgaatgcagcgaatgtgggaaatcttttagccaaaactttagcctgatctaccaccagagagttcacactggagaaagacctcatgagtgcaatgaatgtggaaaatcctttagccgaagctccagcctcattcaccaccggagacttcacactggagaaagaccctatgagtgcagtaaatgtgggaagtcatttaagcaaagctccagcttcagttcacatcggaaagtccacacaggggaaaggccttatgtgtgtggggaatgtgggaaatcctttagccatagctccaaccttaagaaccaccagagagttcacactggagaaagacctgttgagtgcagtgaatgtagcaaatcctttagctgtaaatctaacctcattaaacacctgagagttcacactggagaaaggccttatgagtgcagtgaatgtgggaaatcctttagccaaagttctagcctcattcaacaccgcagagttcacacgggaaaaaggccttatcagtgcagtcaatgtgggaaatcctttggctgcaaatctgtcctcattcaacaccagagagttcacattggagaaaagccttagctgtactgagaatatgcaatttccttttagtgtaattatactgaaggagtacacctgtgagagagacaagtacctgatttggaagccccaacatctaaggatatacagtgggcggattccccttaagttccaggtatgtgttacactttctaacatgccatttagaaagtgttagactttctcacctgccatttatggctcttgccgtttatgtcactgacagtttctgaggcagaagccgtatcatgtctaccacctgtgaggtccacacagtgtgtatcatttacctcctgaacctgctcaaggaagcagacctctgcttctccccatttgctagaagaaatcatgaatagtctgagtcttcctctctgacaagttagggcatggacttgacccagctttgtgccagagaacccaatatgagtgttgttggcagcttgccaagaaggactgtctttttcaagacatactggtttcatgtgacacctccatggatttttttccagcctctaagtcaccaacttgggaactgcttgtctcacgttgctttgttttttacaataataaaagcattattatttaagct

SEQ ID NO: 2824 - DNA, 2639 bp, Homo sapiens
cggaggtccgttctgtctgtcagccgctttggtacgctgcatcgggatcgaagtgacggaccgtgaaggcgcgagagtcaggtctgagggtcgggggcagagccgcccgcgaggccggcctggggatagcgatgctcgggttccccccgggtcgcccgcagctcccggtccagctccgcccacagactcggatggcgaccgcactgagggacccggcttcgggccgtgggagccatagagagcttgcgcaaacgagagacaccatctgagttaaatttgaaaaatcctctgcaggctgttcagtggaagaaaagactttagagatggatgaggacgttgaggcagagggaggttgaatatttttccaaggccacacaactggtgagaggcagcactaaggaccgaggcgcacaggttcccatagctacagaggtgcttttcaaacttacacagggaagtgtgacctttgaagatgtggccgtgtacttctcctgggaggaatgggatctccttgatgaggctcagaaacacctgtacttcgatgtgatgctggagaactttgcacttacgtcctccctgggttgttggtgtggagtggaacatgaggaaacaccttctgaacagagaatttctggagaaagagtgccacagttcaggacttccaaagaaggttcatcttcccagaatgccgactcctgtgaaatatgttgcctggtcttgagagatattttgcacttggctgaacaccaaggaacaaactgcgggcagaaactacacacatgtggaaaacaattctacatcagtgcaaatcttcaacagcaccagaggcagcacattacagaggcacctttcagaagttatgtggacactgcctcgtttacacagagttgcatagtccatgtgtcggagaaaccctttacctgcagggagatcaggaaagacttcctggccaacatgaggtttctccatcaagacgccactcaaacaggggagaagccaaataacagtaacaagtgtgcggtggccttttacagtggaaaaagtcatcacaactggggaaaatgcagtaaagcctttagccacatagacacacttgttcaggaccagagaatcctcactagagaaggactttttgagtgcagtaaatgtgggaaagcatgtacgcgaagatgtaacctcattcagcaccagaaagtccacagtgaagaaaggccttatgaatgcaatgaatgtggaaaattctttacctactactccagtttcattatacatcagagagttcatactggagaaaggccttatgcgtgccctgaatgtgggaaatcgtttagtcagatatacagcctcaatagccataggaaagttcacactggagaaaggccttatgaatgtggggaatgtgggaaatcttttagccaaaggtccaacctcatgcagcatcgcagagttcacactggagaaaggccttatgaatgcagcgaatgtgggaaatcttttagccaaaactttagcctgatctaccaccagagagttcacactggagaaagacctcatgagtgcaatgaatgtggaaaatcctttagccgaagctccagcctcattcaccaccggagacttcacactggagaaagaccctatgagtgcagtaaatgtgggaagtcatttaagcaaagctccagcttcagttcacatcggaaagtccacacaggggaaaggccttatgtgtgtggggaatgtgggaaatcctttagccatagctccaaccttaagaaccaccagagagttcacactggagaaagacctgttgagtgcagtgaatgtagcaaatcctttagctgtaaatctaacctcattaaacacctgagagttcacactggagaaaggccttatgagtgcagtgaatgtgggaaatcctttagccaaagttctagcctcattcaacaccgcagagttcacacgggaaaaaggccttatcagtgcagtcaatgtgggaaatcctttggctgcaaatctgtcctcattcaacaccagagagttcacattggagaaaagccttagctgtactgagaatatgcaatttccttttagtgtaattatactgaaggagtacacctgtgagagagacaagtacctgatttggaagccccaacatctaaggatatacagtgggcggattccccttaagttccaggtatgtgttacactttctaacatgccatttagaaagtgttagactttctcacctgccatttatggctcttgccgtttatgtcactgacagtttctgaggcagaagccgtatcatgtctaccacctgtgaggtccacacagtgtgtatcatttacctcctgaacctgctcaaggaagcagacctctgcttctccccatttgctagaagaaatcatgaatagtctgagtcttcctctctgacaagttagggcatggacttgacccagctttgtgccagagaacccaatatgagtgttgttggcagcttgccaagaaggactgtctttttcaagacatactggtttcatgtgacacctccatggatttttttccagcctctaagtcaccaacttgggaactgcttgtctcacgttgctttgttttttacaataataaaagcattattattt

SEQ ID NO: 2825 - DNA, 2577 bp, Homo sapiens
cggaggtccgttctgtctgtcagccgctttggtacgctgcatcgggatcgaagtgacggaccgtgaaggcgcgagagtcaggtctgagggtcgggggcagagccgcccgcgaggccggcctggggatagcgatgctcgggttccccccgggtcgcccgcagctcccggtccagctccgcccacagactcggatggcgaccgcactgagggacccggcttcggttcccatagctacagaggtgcttttcaaacttacacagggaagtgtgacctttgaagatgtggccgtgtacttctcctgggaggaatgggatctccttgatgaggctcagaaacacctgtacttcgatgtgatgctggagaactttgcacttacgtcctccctgggacttatatcatcctggtctcatgtagttgctcaactagggctaggggaagtgccctctgttcttcacaggatgttcatgactccagcctcagcaagatgggatcagagagggcctggcctacatgaatggcacttgggaaaaggcatgtcatcaggttgttggtgtggagtggaacatgaggaaacaccttctgaacagagaatttctggagaaagagtgccacagttcaggacttccaaagaaggttcatcttcccagaatgccgactcctgtgaaatatgttgcctggtcttgagagatattttgcacttggctgaacaccaaggaacaaactgcgggcagaaactacacacatgtggaaaacaattctacatcagtgcaaatcttcaacagcaccagaggcagcacattacagaggcacctttcagaagttatgtggacactgcctcgtttacacagagttgcatagtccatgtgtcggagaaaccctttacctgcagggagatcaggaaagacttcctggccaacatgaggtttctccatcaagacgccactcaaacaggggagaagccaaataacagtaacaagtgtgcggtggccttttacagtggaaaaagtcatcacaactggggaaaatgcagtaaagcctttagccacatagacacacttgttcaggaccagagaatcctcactagagaaggactttttgagtgcagtaaatgtgggaaagcatgtacgcgaagatgtaacctcattcagcaccagaaagtccacagtgaagaaaggccttatgaatgcaatgaatgtggaaaattctttacctactactccagtttcattatacatcagagagttcatactggagaaaggccttatgcgtgccctgaatgtgggaaatcgtttagtcagatatacagcctcaatagccataggaaagttcacactggagaaaggccttatgaatgtggggaatgtgggaaatcttttagccaaaggtccaacctcatgcagcatcgcagagttcacactggagaaaggccttatgaatgcagcgaatgtgggaaatcttttagccaaaactttagcctgatctaccaccagagagttcacactggagaaagacctcatgagtgcaatgaatgtggaaaatcctttagccgaagctccagcctcattcaccaccggagacttcacactggagaaagaccctatgagtgcagtaaatgtgggaagtcatttaagcaaagctccagcttcagttcacatcggaaagtccacacaggggaaaggccttatgtgtgtggggaatgtgggaaatcctttagccatagctccaaccttaagaaccaccagagagttcacactggagaaagacctgttgagtgcagtgaatgtagcaaatcctttagctgtaaatctaacctcattaaacacctgagagttcacactggagaaaggccttatgagtgcagtgaatgtgggaaatcctttagccaaagttctagcctcattcaacaccgcagagttcacacgggaaaaaggccttatcagtgcagtcaatgtgggaaatcctttggctgcaaatctgtcctcattcaacaccagagagttcacattggagaaaagccttagctgtactgagaatatgcaatttccttttagtgtaattatactgaaggagtacacctgtgagagagacaagtacctgatttggaagccccaacatctaaggatatacagtgggcggattccccttaagttccaggtatgtgttacactttctaacatgccatttagaaagtgttagactttctcacctgccatttatggctcttgccgtttatgtcactgacagtttctgaggcagaagccgtatcatgtctaccacctgtgaggtccacacagtgtgtatcatttacctcctgaacctgctcaaggaagcagacctctgcttctccccatttgctagaagaaatcatgaatagtctgagtcttcctctctgacaagttagggcatggacttgacccagctttgtgccagagaacccaatatgagtgttgttggcagcttgccaagaaggactgtctttttcaagacatactggtttcatgtgacacctccatggatttttttccagcctctaagtcaccaacttgggaactgcttgtctcacgttgctttgttttt

SEQ ID NO: 2826 - DNA, 2759 bp, Homo sapiens
tggcgtcttcgcagcggtcattttggctgccctcccggaggtccgttctgtctgtcagccgctttggtacgctgcatcgggatcgaagtgacggaccgtgaaggcgcgagagtcaggtctgagggtcgggggcagagccgcccgcgaggccggcctggggatagcgatgctcgggttccccccgggtcgcccgcagctcccggtccagctccgcccacagactcggatggcgaccgcactgagggacccggcttcggctgttcagtggaagaaaagactttagagatggatgaggacgttgaggcagagggaggttgaatatttttccaaggccacacaactggtgagaggcagcactaaggaccgaggcgcacaggttcccatagctacagaggtgcttttcaaacttacacagggaagtgtgacctttgaagatgtggccgtgtacttctcctgggaggaatgggatctccttgatgaggctcagaaacacctgtacttcgatgtgatgctggagaactttgcacttacgtcctccctgggacttatatcatcctggtctcatgtagttgctcaactagggctaggggaagtgccctctgttcttcacaggatgttcatgactccagcctcagcaagatgggatcagagagggcctggcctacatgaatggcacttgggaaaaggcatgtcatcaggttgttggtgtggagtggaacatgaggaaacaccttctgaacagagaatttctggagaaagagtgccacagttcaggacttccaaagaaggttcatcttcccagaatgccgactcctgtgaaatatgttgcctggtcttgagagatattttgcacttggctgaacaccaaggaacaaactgcgggcagaaactacacacatgtggaaaacaattctacatcagtgcaaatcttcaacagcaccagaggcagcacattacagaggcacctttcagaagttatgtggacactgcctcgtttacacagagttgcatagtccatgtgtcggagaaaccctttacctgcagggagatcaggaaagacttcctggccaacatgaggtttctccatcaagacgccactcaaacaggggagaagccaaataacagtaacaagtgtgcggtggccttttacagtggaaaaagtcatcacaactggggaaaatgcagtaaagcctttagccacatagacacacttgttcaggaccagagaatcctcactagagaaggactttttgagtgcagtaaatgtgggaaagcatgtacgcgaagatgtaacctcattcagcaccagaaagtccacagtgaagaaaggccttatgaatgcaatgaatgtggaaaattctttacctactactccagtttcattatacatcagagagttcatactggagaaaggccttatgcgtgccctgaatgtgggaaatcgtttagtcagatatacagcctcaatagccataggaaagttcacactggagaaaggccttatgaatgtggggaatgtgggaaatcttttagccaaaggtccaacctcatgcagcatcgcagagttcacactggagaaaggccttatgaatgcagcgaatgtgggaaatcttttagccaaaactttagcctgatctaccaccagagagttcacactggagaaagacctcatgagtgcaatgaatgtggaaaatcctttagccgaagctccagcctcattcaccaccggagacttcacactggagaaagaccctatgagtgcagtaaatgtgggaagtcatttaagcaaagctccagcttcagttcacatcggaaagtccacacaggggaaaggccttatgtgtgtggggaatgtgggaaatcctttagccatagctccaaccttaagaaccaccagagagttcacactggagaaagacctgttgagtgcagtgaatgtagcaaatcctttagctgtaaatctaacctcattaaacacctgagagttcacactggagaaaggccttatgagtgcagtgaatgtgggaaatcctttagccaaagttctagcctcattcaacaccgcagagttcacacgggaaaaaggccttatcagtgcagtcaatgtgggaaatcctttggctgcaaatctgtcctcattcaacaccagagagttcacattggagaaaagccttagctgtactgagaatatgcaatttccttttagtgtaattatactgaaggagtacacctgtgagagagacaagtacctgatttggaagccccaacatctaaggatatacagtgggcggattccccttaagttccaggtatgtgttacactttctaacatgccatttagaaagtgttagactttctcacctgccatttatggctcttgccgtttatgtcactgacagtttctgaggcagaagccgtatcatgtctaccacctgtgaggtccacacagtgtgtatcatttacctcctgaacctgctcaaggaagcagacctctgcttctccccatttgctagaagaaatcatgaatagtctgagtcttcctctctgacaagttagggcatggacttgacccagctttgtgccagagaacccaatatgagtgttgttggcagcttgccaagaaggactgtctttttcaagacatactggtttcatgtgacacctccatggatttttttccagcctctaagtcaccaacttgggaactgcttgtctcacgttgctttgttttttacaataataaaagcattattatttaa

SEQ ID NO: 2827 - DNA, 2426 bp, Homo sapiens
gcgggagctacggctgcgggagttaccctttattctgtgatattttgagctgttctgcgtctcgcaggcccttctgaatttcctggacctactctcggaaccctcaacgagctagcgatagatttagaggaaaggaagcaccgtcggaaagcaaagggatttctggaagcttgaacttaagagtgataacttagggtacctggcaaaagaaatttctgagcagcaaagcattcaagaagtggcctggctgcctcactgcttcaaacagcctacaattatatatgggagcaaaaaaatgacttaaagttggaatttatatttaaaaggcatgatttcaccttcacttgaactgcttcattcaggactctgcaaattccctgaagtagaaggaaaaatgaccacattcaaagaggcagtgacattcaaggatgtggctgtggtcttcactgaggaggagctggggctgctggaccctgcccagaggaagctgtaccgagatgtgatgctagagaacttcaggaacctgctctcagtagggaatcaaccattccaccaagatactttccacttcttagggaaggaaaagttttggaagatgaagacaacaagccaaagagaagggaattcaggaggcaagatccaaattgagatggagactgttccagaagcaggaccacatgaagagtggtcctgtcagcaaatatgggaacaaattgcaagtgacctaaccaggtctcaaaactccataaggaacagctctcagttcttcaaagaaggtgatgtcccctgccagattgaggcaagactatctataagtcacgtgcaacagaaaccttaccgttgtaatgaatgtaaacagtccttcagtgatgtttctgtctttgatcttcatcaacaatcacactcaggagagaaatctcatacatgtggtgagtgtggaaaaagcttctgttacagcccagcccttcatattcatcagagagtccatatgggagaaaaatgctataagtgtgatgtgtgtggtaaggaatttaatcagagctcacatctgcaaactcatcagagagtccatactggagagaaaccattcaaatgtgggcaatgtgggaaaggcttccatagtagatcagcacttaatgttcattgcaaattgcacacaggagagaaaccttataattgtgaggaatgtgggaaagccttcattcatgattcacagcttcaagaacatcagagaatccatactggggagaagccattcaaatgtgatatatgtggtaagagcttccgtgttagatcaagacttaataggcattccatggttcacacaggagaaaaagcattcagatgtgatacatgtggcaagaactttcgtcagagatcagcacttaatagtcattccatggtccacatagaagagaagccatacaaatgtgagcaatgtggaaaaggcttcatttgtaggcgagatttttgtaagcatcagatggtccacacaggagagaaaccatataattgtaaagaatgtgggaagaccttcagatggtcctcatgtcttttgaaccatcagcaagtccacagtggacaaaaatccttcaaatgtgaagaatgtgggaagggattttatacaaattcacgacgatcttcccatcagagatcccacaatggagaaaagccatataactgtgaggagtgtggtaaggactataaaaggaggttggatcttgagtttcaccagagggtccacacgggtgagagaccctataattgtaaggaatgtggcaagagctttggctgggcctcctgtcttttgaaacatcagagactccacagtggggaaaaacctttcaaatgtgaagagtgtggaaagagatttactcagagttcacaacttcattcccatcagacatgccatactggagaaaagctatacaaatgtgagcagtgtgagaaggggtacaacagtaaatttaatcttgacatgcaccagagggtccacgggggagagcgaccctataattgtaaggaatgtggaaagagctttggctgggcttcatgtcttttgaaacatcagagactccacagtggagaaaagccattgaaatctggagtgtgggaagagatctactcagaattcacagcttcatttacatcagtaagtctatgtgggagaaaagccatataaatgtgagaagtgtgggaagggctttggctgggcctcaactcatctgacccatcaattctccacagcagagaaaaaccattcaaatatgagaactgtgggaagagctttgtacatagatcatatcttttttttttttttttgagacagagtctcactctttcacccaggcctgactgcagtggcgctatctcagctcactgcaagctccgcctcccaggttcacgccattctcctgcctcagcct

SEQ ID NO: 2828 - DNA, 582 bp, Homo sapiens
agacgctctgtggagtcgcgggagctacggctgcgggagttaccctttattctgtgatattttgagctgttctgcgtctcgcaggcccttctgaatttcctggacctactctcggaaccctcaacgagctagcgatagatttagaggaaaggaagcaccgtcggaaagcaaaggcatgatttcaccttcacttgaactgcttcattcaggactctgcaaattccctgaagtagaaggaaaaatgaccacattcaaagaggcagtgacattcaaggatgtggctgtggtcttcactgaggaggagctggggctgctggaccctgcccagaggaagctgtaccgagatgtgatgctagagaacttcaggaacctgctctcagtagggaatcaaccattccaccaagatactttccacttcttagggaaggaaaagttttggaagatgaagacaacaagccaaagagaagggaattcaggaggcaagatccaaattgagatggagactgttccagaagcaggaccacatgaagagtggtcctgtcagcaaatatgggaacaaattgcaagtgacctaaccaggtc

SEQ ID NO: 2829 - DNA, 1616 bp, Homo sapiens
gttgctatttcatttaccacagtagtttgagtcatttccacatcttgcgagtccttccgaacgagtctcctttccttggggctcgcaaccacccaatgatcgattcaggagaaaagaagcctgggcggagagcagagcccgacctttctaaaagagctgcaggaagggacttcttggctactgatggcaaagctctacgaggcagtgaccttcaaggatgtggctgtgatcttcactgaggaggagctggggctgctggaccctgcccagaggaagctgtaccgagatgtgatgcttgagaacttcaggaacctgctctcagtgggaggcaagatccaaactgagatggagactgttccagaagcaggaacacatgaagaattttcctgcaagcaaatttgggaacaaattgcaagtgacttaaccaggtctcaagataccaccataagtaactctcagttatttgaacaagatgacaacccctcccagattaaagcaagactatctacagttcacacaagagaaaaacctttccagggtgaaaattgtaaacagttcttcagtgatgtttccttctttgatcttcctcagcagttatattcaggagagaagtctcatacctgtgatgagtgtggaaaaagcttctgttacatctcagcccttcatattcatcagagggtccacatgggagtgaaatgctataagtgtgatgtgtgtggtaaggaatttagtcagagctcacgtctgcaaactcatcaaagagtccacactggagagaaaccattcaaatgtgagcagtgtgggaaaggcttcagatgtagatcagcacttaaagttcattgcaaattacacatgagagagaaaccttataattgtgagaaatgtgggaaggctttcatgcacaatttccagcttcagaaacatcacagaattcatactggggagaagccattcaaatgtgaaatatgtggtaagagcttctgtcttaggtcaagtcttaataggcattgcatggtccacacagcagagaaactgtacaaatctgaaaagtatggaagaggtttcattgataggctagatttgcataagcatcagatgattcatatgggacagaaaccatataattgtaaagaatgtgggaagagcttcaaatggtcctcatatcttttggtccatcaacgagtccacactggagaaaagccatacaaatgtgaggagtgtgggaagggctacattagtaagtcaggtcttgacttccaccatagaacccacacgggagagagatcttataactgtgataactgcgggaagagctttagacatgcttctagtattttgaatcataagaaactccactgccaaagaaagccattgaaatgtgaagactgtggaaagaggcttgtatgccggtcatactgtaaagaccaacaaagagaccacagtggagaaaacccatccaaatgtgaggactgtgggaagcgctacaagaggcgcttgaatctggatataattttatcattatttttaaatgacatataagttatacatatttatggagtgtgaaatttgatacatgtatataatgtgtgctgattaaatcagtttaatttcacctg

SEQ ID NO: 2830 - DNA, 1808 bp, Homo sapiens
atttaccacagtagtttgagtcatttccacatcttgcgagtccttccgaacgagtctcctttccttggggctcgcaaccacccaatgatcgattcaggagaaaagaagcctgggcggagagcagagcccgacctttctaaaagagctgcaggaagggacttcttggctactgatggcaaagctctacgaggcagtgaccttcaaggatgtggctgtgatcttcactgaggaggagctggggctgctggaccctgcccagaggaagctgtaccgagatgtgatgcttgagaacttcaggaacctgctctcagtggggcatcaaccattccatggagatactttccacttcctaagggaagaaaagttttgggtgatggggacaacaagccaaagagaagggaatttggagttacccaggttttaccctcaagcaaagagactctcctcaggcatgacacttcaagatcctagagattacctctcagatgctgacgacaacgtcctgacctctttcaaggaggcaagatccaaactgagatggagactgttccagaagcaggaacacatgaagaattttcctgcaagcaaatttgggaacaaattgcaagtgacttaaccaggtctcaagataccaccataagtaactctcagttatttgaacaagatgacaacccctcccagattaaagcaagactatctacagttcacacaagagaaaaacctttccagggtgaaaattgtaaacagttcttcagtgatgtttccttctttgatcttcctcagcagttatattcaggagagaagtctcatacctgtgatgagtgtggaaaaagcttctgttacatctcagcccttcatattcatcagagggtccacatgggagtgaaatgctataagtgtgatgtgtgtggtaaggaatttagtcagagctcacgtctgcaaactcatcaaagagtccacactggagagaaaccattcaaatgtgagcagtgtgggaaaggcttcagatgtagatcagcacttaaagttcattgcaaattacacatgagagagaaaccttataattgtgagaaatgtgggaaggctttcatgcacaatttccagcttcagaaacatcacagaattcatactggggagaagccattcaaatgtgaaatatgtggtaagagcttctgtcttaggtcaagtcttaataggcattgcatggtccacacagcagagaaactgtacaaatctgaaaagtatggaagaggtttcattgataggctagatttgcataagcatcagatgattcatatgggacagaaaccatataattgtaaagaatgtgggaagagcttcaaatggtcctcatatcttttggtccatcaacgagtccacactggagaaaagccatacaaatgtgaggagtgtgggaagggctacattagtaagtcaggtcttgacttccaccatagaacccacacgggagagagatcttataactgtgataactgcgggaagagctttagacatgcttctagtattttgaatcataagaaactccactgccaaagaaagccattgaaatgtgaagactgtggaaagaggcttgtatgccggtcatactgtaaagaccaacaaagagaccacagtggagaaaacccatccaaatgtgaggactgtgggaagcgctacaagaggcgcttgaatctggatataattttatcattatttttaaatgacatataagttatacatatttatggagtgtgaaatttgatacatgtatataatgtgtgctgattaaatcagtttaatttcacctg

SEQ ID NO: 2831 - DNA, 1648 bp, Homo sapiens
gttgctatttcatttaccacagtagtttgagtcatttccacatcttgcgagtccttccgaacgagtctcctttccttggggctcgcaaccacccaatgatcgattcaggagaaaagaagcctgggcggagagcagaggaggcagtgaccttcaaggatgtggctgtgatcttcactgaggaggagctggggctgctggaccctgcccagaggaagctgtaccgagatgtgatgcttgagaacttcaggaacctgctctcagtggggcatcaaccattccatggagatactttccacttcctaagggaagaaaagttttgggtgatggggacaacaagccaaagagaagggaatttgggaggcaagatccaaactgagatggagactgttccagaagcaggaacacatgaagaattttcctgcaagcaaatttgggaacaaattgcaagtgacttaaccaggtctcaagataccaccataagtaactctcagttatttgaacaagatgacaacccctcccagattaaagcaagactatctacagttcacacaagagaaaaacctttccagggtgaaaattgtaaacagttcttcagtgatgtttccttctttgatcttcctcagcagttatattcaggagagaagtctcatacctgtgatgagtgtggaaaaagcttctgttacatctcagcccttcatattcatcagagggtccacatgggagtgaaatgctataagtgtgatgtgtgtggtaaggaatttagtcagagctcacgtctgcaaactcatcaaagagtccacactggagagaaaccattcaaatgtgagcagtgtgggaaaggcttcagatgtagatcagcacttaaagttcattgcaaattacacatgagagagaaaccttataattgtgagaaatgtgggaaggctttcatgcacaatttccagcttcagaaacatcacagaattcatactggggagaagccattcaaatgtgaaatatgtggtaagagcttctgtcttaggtcaagtcttaataggcattgcatggtccacacagcagagaaactgtacaaatctgaaaagtatggaagaggtttcattgataggctagatttgcataagcatcagatgattcatatgggacagaaaccatataattgtaaagaatgtgggaagagcttcaaatggtcctcatatcttttggtccatcaacgagtccacactggagaaaagccatacaaatgtgaggagtgtgggaagggctacattagtaagtcaggtcttgacttccaccatagaacccacacgggagagagatcttataactgtgataactgcgggaagagctttagacatgcttctagtattttgaatcataagaaactccactgccaaagaaagccattgaaatgtgaagactgtggaaagaggcttgtatgccggtcatactgtaaagaccaacaaagagaccacagtggagaaaacccatccaaatgtgaggactgtgggaagcgctacaagaggcgcttgaatctggatataattttatcattatttttaaatgacatataagttatacatatttatggagtgtgaaatttgatacatgtatataatgtgtgctgattaaatcagtttaatttcacctg

SEQ ID NO: 2832 - DNA, 2414 bp, Homo sapiens
gcagagaggacacttccggtctcctagtctgaggttcctgctttaatgaccggggtagtttgagccatttctgcgtcttgcaggacattttgaacgaaccccctttgcttgaggctcgcaaccacccgatgatcgatgatcgtctcaggggaaaagaagccttggcgaagagcagaggtttagaggcacaattctgctttccctggaactgtgtcattcaggactctgcaaattccctaaagtaggaggaaaaatgaccatgtccaaggaggcagtgaccttcaaggatgtggcagtggtcttcactgaggaggagctggggctgctggaccttgcccagaggaagctgtatcgagatgtgatgctggagaacttcaggaacctgctgtcagtggggcatcaaccattccaccgagatactttccactttctaagggaggaaaagttttggatgatggatatagcaacccaaagggaagggaattcaggaggcaagatccaacctgagatgaagacttttccagaagcaggaccacatgaagggtggtcctgccagcagatctgggaagaaattgcaagtgatttaaccaggcctcaagactctaccataaagagctctcagttctttgaacagggtgatgcccactcccaggttgaggaaggactatctataatgcacacaggacagaaaccttccaattgtgggaagtgtaaacaatccttcagtgatatgtccatctttgatcttcctcagcaaatacgctcagcagagaagtctcattcctgtgatgagtgtggaaaaagcttctgttacatctcagcgcttcatattcatcagagagtccacctgggagagaaactctttaagtgtgacgtgtgtggtaaggaattcagtcagagtttacatctgcaaactcatcagagagtccatactggagagaaacctttcaaatgtgaacaatgtgggagaggcttcagatgtagatcagcacttacagttcattgcaaattacacatgggagagaaacattataattgtgaggcatgtgggagggccttcattcatgatttccagcttcagaaacatcagagaattcacacaggggagaagccattcaaatgtgagatatgtagtgtgagcttccgtcttaggtcaagtcttaataggcattgtgtggtccacacaggaaagaaaccaaacagcactggggaatatggaaaaggcttcattcgtaggctggatttgtgtaagcatcagacgatccacacaggagagaaaccatataattgtaaagaatgtgggaagagcttcagacggtcctcctatcttttgatccatcagcgagtccacactggagaaaagccatacaaatgtgacaagtgtgggaagagctacattactaagtcaggtcttgacttgcaccatagagcccacacaggagagagaccttataactgtgatgactgtgggaagagctttagacaggcctcaagtattttgaatcataagagactccattgccgaaaaaaaccattcaaatgtgaggattgtggaaagaagcttgtataccggtcataccgtaaagaccaacaaaaaaaccacagtggagaaaatccatccaaatgtgaagactgtgggaagcgctacaagaggcgcttgaatcttgatataattttatcattatttttaaatgacacgtaagtgttgtacatatttatggggtacagtgtgatatttaaatatatgtatatgatgtataatgatcaaatcagtgtaattagcacatttatcacctcaattatctcttttttgtgttgagaaaattaaaaattcattgttccagcagtttgaaaataaattgttgtcgatgatagtcacctttagtgctgcagaacagcagaacttcttcctcttatctacctgtacttttgcatccattagccaacctttggccatcccacctatcccttacccttccctgcctctagagccactgttctcactacttctaagaaatcagctttttaagcttccccatgtgattgaggacagtttgaagttagtgtttcagccatagctcagcataccccagtggtcgtgggactgtcagagcagagaatgctgcagggtttctaacagaagtttgacaattagttattattcaggagacaggtcttagtataagagtttgttcacacactttcaaaacactaatgatgaacatgtcaaaattgatgaccactagaatgtcagccacatgtgtctttgtatttttgctgcatccttacattgcttgagtctggaagattgaggctgcactgacctatggtagtgctactgcactccagccagggcaacagagtgagaccctgtctccaaaaaaaaaaattaaataaatacctttctttgtttc

SEQ ID NO: 2833 - DNA, 2731 bp, Homo sapiens
actcagtggagtagcgggccacttccgctccgttactgtgaggttgctgcagttttgtccctggtagtttgggtcagttccgcgagacccttctgaatttcctggacctacgcattggatccttaacgaactggtgatcgaattaggggaaaagaaacctcgtcggagagcagaggcaggattctgctttcccttggactgtatcactcaggactctgaatattccctgaaataggaggaaaaatgaccacgttgaaggaggcagtgaccttcaaggacgtggctgtggtcttcactgaggaagagctgaggctgctggaccttgcccagaggaaactgtaccgagaagtgatgctggagaacttcaggaacctgctctcagtggggcatcaatcactccacagagatactttccacttcctaaaggaagaaaagttttggatgatggagacagcaacccaaagagaagggaatttaggaggcaagatccaaatggagatggagactgtttcagaatcaggaacacatgaaggcttgttcagtcatcaaacctgggaacaaatttcaagtgacttaaccaggtttcaagactccatggtaaacagctttcagttctccaaacaagatgatatgccctgccaggttgatgcaggactatctataattcacgtaagacagaaaccttctgagggtaggacgtgtaaaaagtcctttagtgatgtctccgtccttgatcttcatcaacaactacagtcaagagagaagtctcatacatgtgatgaatgtggaaagagtttctgttatagctcagctcttcgtattcatcagagagttcacatgggggagaaactctataattgtgatgtgtgtggtaaggaattcaatcagagctcacatctgcaaattcatcagagaatccacactggagagaaaccattcaaatgtgagcagtgtgggaaaggctttagtcgtagatcaggactttatgttcatcgtaaattacacacaggagtgaaacctcatatttgtgagaaatgtgggaaggccttcattcatgattcccagcttcaggaacatcaaagaatccatactggggagaagccattcaaatgtgatatatgttgtaagagcttccgtagtagagcaaatcttaataggcattccatggttcacatgcgagagaaaccattcagatgtgatacatgtggtaagagctttggtctgaaatcagcacttaatagtcatcgcatggtccacacaggagagaaacggtacaaatgtgaggaatgtggaaaacgcttcatttataggcaagatctttataagcatcagatagaccacacaggggagaagccatataattgtaaagaatgtggaaagagcttcagatgggcctcaggtctttcaagacatgtgcgagtccacagtggagagacaacattcaaatgtgaagaatgtgggaagggattttatacaaattcacaacgttattctcaccagagagcgcacagtggagaaaagccatatagatgtgaggagtgtgggaagggctacaaaaggaggttggatcttgactttcatcagagggtccacagaggagagaaaccctataattgtaaggaatgtgggaagagctttggctgggcctcgtgtcttttgaatcatcagagaatccacagtggagaaaaaccatttaaatgtgaagaatgtgggaaaagatttactcagaattcacaactttatacccatcgtagagtccacagtggagaaaaaccattcaaatgtgaagagtgtgggaaaagatttactcagaattcacaactttattctcatcgcagagtccacactggagtaaagccatacaaatgtgaagagtgtgggaagggcttcaacagtaagtttaatcttgacatgcaccagagggtccacaccggagagagaccttataattgtaaagaatgtgggaagagctttagccgggcctcaagtattttgaatcataagagactccatggtgatgaaaagccattcaaatgtgaagagtgtgggaagagatttactgagaattcacagcttcattcccatcagagggttcacactggggaaaagccatacaaatgtgagaagtgtggaaagagcttcagatgggcctcaactcatctaacccatcagagactccacagtagagaaaaactacttcaatgtgaggactgtgggaagagcattgtgcacagttcatgccttaaagaccaacaaagagaccaaagtggagagaaaacatctaaatgtgaggactgtgggaagcgctacaagaggcgcttgaatcttgatacgcttttgtcattatttttaaatgacacataactgttgtactcatttatggggtacagtgtgatagttaatgcaagtatacaatgtgtaatgatcaaatcagtgtaattaacatacctatcacctcaaacatttatcatttatttatgttgggaacccttaaaattcactgtcctagctatttgaaaataatacgttgttaattactgtcaccctgtagtggtgtaaaacactagaacttattcctcctacctgcctgtatttctgtattcattaaccaacctttggctaccaccctgcctcctcacctctaagaactactattctactctctacttctatgaagttaactttttgagcttccacatatgtgtgagaacatgtggtatgtatctttctg

SEQ ID NO: 2834 - DNA, 2291 bp, Homo sapiens
gtgaggttgctgcagttttgtccctggtagtttgggtcagttccgcgagacccttctgaatttcctggaccttgcccagaggaaactgtaccgagaagtgatgctggagaacttcaggaacctgctctcagtggggcatcaatcactccacagagatactttccacttcctaaaggaagaaaagttttggatgatggagacagcaacccaaagagaagggaatttaggaggcaagatccaaatggagatggagactgtttcagaatcaggaacacatgaaggcttgttcagtcatcaaacctgggaacaaatttcaagtgacttaaccaggtttcaagactccatggtaaacagctttcagttctccaaacaagatgatatgccctgccaggttgatgcaggactatctataattcacgtaagacagaaaccttctgagggtaggacgtgtaaaaagtcctttagtgatgtctccgtccttgatcttcatcaacaactacagtcaagagagaagtctcatacatgtgatgaatgtggaaagagtttctgttatagctcagctcttcgtattcatcagagagttcacatgggggagaaactctataattgtgatgtgtgtggtaaggaattcaatcagagctcacatctgcaaattcatcagagaatccacactggagagaaaccattcaaatgtgagcagtgtgggaaaggctttagtcgtagatcaggactttatgttcatcgtaaattacacacaggagtgaaacctcatatttgtgagaaatgtgggaaggccttcattcatgattcccagcttcaggaacatcaaagaatccatactggggagaagccattcaaatgtgatatatgttgtaagagcttccgtagtagagcaaatcttaataggcattccatggttcacatgcgagagaaaccattcagatgtgatacatgtggtaagagctttggtctgaaatcagcacttaatagtcatcgcatggtccacacaggagagaaacggtacaaatgtgaggaatgtggaaaacgcttcatttataggcaagatctttataagcatcagatagaccacacaggggagaagccatataattgtaaagaatgtggaaagagcttcagatgggcctcaggtctttcaagacatgtgcgagtccacagtggagagacaacattcaaatgtgaagaatgtgggaagggattttatacaaattcacaacgttattctcaccagagagcgcacagtggagaaaagccatatagatgtgaggagtgtgggaagggctacaaaaggaggttggatcttgactttcatcagagggtccacagaggagagaaaccctataattgtaaggaatgtgggaagagctttggctgggcctcgtgtcttttgaatcatcagagaatccacagtggagaaaaaccatttaaatgtgaagaatgtgggaaaagatttactcagaattcacaactttatacccatcgtagagtccacagtggagaaaaaccattcaaatgtgaagagtgtgggaaaagatttactcagaattcacaactttattctcatcgcagagtccacactggagtaaagccatacaaatgtgaagagtgtgggaagggcttcaacagtaagtttaatcttgacatgcaccagagggtccacaccggagagagaccttataattgtaaagaatgtgggaagagctttagccgggcctcaagtattttgaatcataagagactccatggtgatgaaaagccattcaaatgtgaagagtgtgggaagagatttactgagaattcacagcttcattcccatcagagggttcacactggggaaaagccatacaaatgtgagaagtgtggaaagagcttcagatgggcctcaactcatctaacccatcagagactccacagtagagaaaaactacttcaatgtgaggactgtgggaagagcattgtgcacagttcatgccttaaagaccaacaaagagaccaaagtggagagaaaacatctaaatgtgaggactgtgggaagcgctacaagaggcgcttgaatcttgatacgcttttgtcattatttttaaatgacacataactgttgtactcatttatggggtacagtgtgatagttaatgcaagtatacaatgtgtaatgatcaaatcagtgtaattaacatacctatcacctcaaacatttatcatttatttatgttgggaacccttaaaattcactgtcctagctatttgaaaataatacgttgttaattactgtc

SEQ ID NO: 2835 - DNA, 885 bp, Homo sapiens
caggtcctcctgatactcgcaggcacttccgcccaggaagacgacgtagcagccatcttttccctggctttggtgattcagaaactcccgttctgtggcgaaattctccctgacttctcaaaaagcactgcacagaggaggaggcagcagaaccccatttcagcttcttaggactctgcacttccccagaaggaagaattaaaaatgaatatgttcaaggaagcagtgaccttcaaggacgtggctgtggccttcacggaggaggaattggggctgctgggccctgcccagaggaagctgtaccgagatgtgatggtggagaactttaggaacctgctgtcagtggggcatccacccttcaaacaagatgtatcacctatagaaagaaatgagcagctttggataatgacgacagcaacccgaagacagggaaatttagataccttacttgtaaaagctcttttgctctatgacctggctcaaacttaaacttggatttgaagttagaagaaatgttggaagtcatttatatatgaagaaatgttggaaggactcatatatgcatacattccttgagtgactatgaatgactgccgggcagtaacttctgggctgtggttgtaaactgtgagcactacaaaatgtttttccttattgataccatattatggtaggaaagacatggaataaaaaatttagatagtatgtcagtagttgtgtttttaaatgggtttcattagtgcttagcaattgggagcttggtggaccatctcttggttttggaccatctcttggtttctgtcagtatgtaaaccagaaacttcaaatgtgtcacaaaagatgagcagaactatcccgaggttcattaaagtcttttactctgtc

SEQ ID NO: 2836 - DNA, 2565 bp, Homo sapiens
aggaagacgacgtagcagccatcttttccctggctttggtgattcagccctgacttctcaaaaagcactgcacagaggaggaggcagcagaaccccatttcagcttcttaggactctgcacttccccagaaggaagaattaaaaatgaatatgttcaaggaagcagtgaccttcaaggacgtggctgtggccttcacggaggaggaattggggctgctgggccctgcccagaggaagctgtaccgagatgtgatggtggagaactttaggaacctgctgtcagtggggcatccacccttcaaacaagatgtatcacctatagaaagaaatgagcagctttggataatgacgacagcaacccgaagacagggaaatttaggagagaaaaatcaaagtaagttaattactgttcaagacagagaatcagaagaagagctttcttgttggcaaatctggcaacaaattgcaaatgacttaaccaggtgtcaagactccatgatcaataattctcagtgtcacaaacaaggtgatttcccttaccaggtagggacagaactgtctattcaaatttctgaagatgagaactatatagtaaataaagcagatggtcccaataatactgggaatccagagtttcctatcttgagaacccaggattcttggaggaaaacattcctgactgagtcacagagattgaacagagatcagcaaatttccataaaaaataaattatgtcaatgtaagaagggtgttgatcccatcggttggatttcacatcatgatggtcatagagtacacaaaagtgaaaaatcttatagacccaatgattatgaaaaagacaacatgaagattttgacatttgatcacaatagcatgattcacacaggacagaaatcgtaccagtgtaatgagtgtaaaaaacccttcagtgatctctccagctttgatcttcatcagcagttacaatcaggagagaagtctcttacatgtgttgagcgtggaaaaggcttctgttacagcccagttcttcctgttcatcagaaagtacatgtgggagaaaaacttaagtgtgatgagtgtggtaaggaattcagtcagggcgctcatctacagacccatcagaaagtccacgtgatagagaaaccatacaaatgtaagcaatgtgggaaaggtttcagtcgtagatcagcacttaatgttcattgcaaggtccacacggcagagaaaccttataattgtgaggagtgtgggagggccttcagtcaggcctctcatcttcaggaccatcagagactccacactggggagaagccattcaaatgtgatgcatgtggtaagagcttcagtcggaattcacatcttcaatcccatcaaagagttcatacaggagagaaaccatacaaatgtgaggagtgtggtaagggcttcatttgtagctcaaatctttacattcatcagagagtccacacaggagaaaaaccctataaatgtgaggaatgtggtaaaggctttagtcggccttcaagtcttcaggcccatcagggagttcacactggagagaagtcatacatatgtactgtatgtgggaaaggctttactctgagttcaaatcttcaagcccatcagagagtccacactggagagaagccatacaaatgcaatgagtgtgggaagagcttcaggaggaattcccattatcaagttcatctagtggtccacacaggagagaaaccctataaatgtgagatatgtgggaagggcttcagtcaaagttcgtatcttcaaatccatcagaaggcccacagtatagagaaaccttttaagtgtgaggagtgtgggcagggtttcaatcagagctcacgacttcagattcaccagctgatccatacgggtgagaaaccatacaaatgtgaagagtgtggcaagggatttagtcgtagagcagatcttaaaattcactgtaggatccacacaggagagaaaccatataattgtgaggagtgtgggaaggtcttcaggcaggcctcaaatcttttggcccatcagagagtccacagtggagaaaaaccattcaaatgtgaagaatgtgggaagagtttcggtcggagtgcacatcttcaagcccatcaaaaagtccacactggagataagccatacaaatgtgatgagtgtgggaagggcttcaagtggagcttgaaccttgacatgcatcagagggtgcacacaggagaaaaaccatataaatgtggggagtgtggtaagtacttcagtcaggcctcaagtcttcaacttcatcagagtgtccacacaggagagaaaccatacaaatgtgatgtgtgtggtaaagtcttcagtcggtcttcacaactacagtctcatcagcgagttcacactggggagaaaccttataaatgtgagatatgtggtaagagcttcagttggcgatcaaatcttacagttcatcacagaatccatgttggtgataaatcctataaaagtaataggggtggtaagaacatcagagaatccacacaggaaaaaaaatctataaaatgattctttgtg

SEQ ID NO: 2837 - DNA, 994 bp, Homo sapiens
aggaagacgacgtagcagccatcttttccctggctttggtgattcagaaactcccgttctgtggcgaaattctgtgagtccatgaagctggattgtccctgacctcttttgaggaaggagagggttgcttctaactggtcctgggagatgccactgtgatgtatccgggatgaagacacaatcctggttacttcatagcctgtttttcttccccagccctgacttctcaaaaagcactgcacagaggaggaggcagcagaaccccatttcagcttcttaggactctgcacttccccagaaggaagaattaaaaatgaatatgttcaaggaagcagtgaccttcaaggacgtggctgtggccttcacggaggaggaattggggctgctgggccctgcccagaggaagctgtaccgagatgtgatggtggagaactttaggaacctgctgtcagtggggcatccacccttcaaacaagatgtatcacctatagaaagaaatgagcagctttggataatgacgacagcaacccgaagacagggaaatttagataccttacttgtaaaagctcttttgctctatgacctggctcaaacttaaacttggatttgaagttagaagaaatgttggaagtcatttatatatgaagaaatgttggaaggactcatatatgcatacattccttgagtgactatgaatgactgccgggcagtaacttctgggctgtggttgtaaactgtgagcactacaaaatgtttttccttattgataccatattatggtaggaaagacatggaataaaaaatttagatagtatgtcagtagttgtgtttttaaatgggtttcattagtgcttagcaattgggagcttggtggaccatctcttggttttggaccatctcttggtttctgtcagtatgtaaaccagaaacttcaaatgtgtcacaaaagatgagcagaactatcccgaggttcattaaagtcttttactctgtc

SEQ ID NO: 2838 - DNA, 4600 bp, Homo sapiens
ggagtcgcgggcacttccgctccagggaagagggggcgattgtcacggcacattccacggtagtttcttccagttccgcgactcgcgggcccctcctaatgtcagggacttaagattggggctcgctgggacctggtggtccggttatgggaaaagaagcctcgtgggagagcagagcctgaaaaaggactgcgcggactgacttcttggctactgaaagcaaagctccactgttccaggcacgattctgccttctctcaaatggcataactcaggactctgcaaattcccagaaacaggaggaaaaatgaccacattcaaggagggactgaccttcaaggatgtggctgtggtcttcactgaggaggagctggggctgctggaccctgtccagaggaatctgtaccaagatgtgatgctggagaacttcaggaacctgctgtcagtggggcatcaccccttcaaacatgatgtattccttttagaaaaggaaaaaaagcttgatataatgaagacagcaactcaaagaaaagggaaatcagcagacaagatccaaagtgaggtggagactgttccagaagcaggacgacatgaagagctttactgggggcaaatctggaaacagattgcaagtgatttaatcaagtatgaagactctatgataagtatttctcggttccccagacaaggtgatttgtcctgccaggttagggcaggactatatacaactcacacaggacagaaattttaccaatgtgatgagtacaaaaaatccttcactgatgtcttcaactttgatcttcatcaacagttacactcaggagagaagtctcatacatgtgatgagtgtggaaaaagcttctgttacatctcagcccttcatattcatcaaagagtccacatgggagagaaatgctataagtgtgacgtgtgtggtaaggaatttagtcagagctcacatcttcaaactcatcagagagtccacactgtagagaaaccattcaaatgtgtggaatgtgggaaaggcttcagtcgtagatcaacacttactgtacattgcaaattacactcaggagagaaaccttacaattgtgaggaatgtggaagggccttcatacatgcttcccatcttcaggaacatcagagaattcatactggggagaaaccattcaaatgtgatacatgtggtaagaacttccgtcgtagatcagcacttaataatcattgcatggtccacacaggagagaaaccatacaaatgtgaggactgtggtaagtgtttcacttgtagctcaaaccttcgtatccatcaaagggtccacacaggagagaaaccttacaagtgtgaagaatgtggtaagtgctttattcagccttcacaatttcaggcccatcggagaatccacactggagagaaaccatacgtatgtaaagtgtgtggtaagggtttcatttacagttcaagttttcaggcccatcagggagtccacactggagagaagccatacaaatgcaatgagtgtgggaagagcttcagaatgaaaattcattatcaagtgcatctggtagtccacacaggggaaaaaccctataaatgtgaagtatgtggtaaagccttccgtcagagttcatatcttaaaatccatctgaaagcacatagtgtacagaaaccttttaagtgtgaagagtgtgggcagggcttcaatcagagctcacgacttcagattcaccagctgatccataccggtgagaaaccatacaaatgtgaagagtgcggaaagggatttagtcgtagagcagatcttaaaattcattgtaggatccacacaggggagaaaccatataattgtgaggagtgtgggaaggtcttcagtcaggcctcgcatcttctaacccatcagagagttcacagtggggaaaaaccatttaaatgtgaagagtgtgggaagagcttcagtcggagtgcacaccttcaagcccatcaaaaagtccacactggagaaaagccatacaaatgtggggagtgtggaaagggcttcaagtggagcttgaaccttgacatgcatcagagggtgcacacaggagaaaaaccctatacatgtggggagtgtgggaagcacttcagtcaggcctcaagtctccaacttcatcagagtgtccacacaggagagaaaccatacaaatgtgatgtatgtggtaaagtcttcagtcggtcttcacaattacagtatcataggcgagttcacactggggaaaaaccttacaaatgtgagatatgtggtaagaggttcagctggcgatcaaatcttgtaagtcatcacaaaattcatgctgctggtacattttatgaaaatgatgagaatagtaagaacatcagagagttgtcagagggaggaagttctacaaggtgattaaaaaaaaaaaaacagaactcatgtacaacctgaatgcttgtaattagatttcataggagggaaaaattttctttatcaacctctttgaatttatttgatttgtaacgctccacatttccacctagacttttttttgttttttattttttgttttgaaacagaatctcgctctgttgcccatgctggatgcagtggtgctatctcagctcactgtaacctccacttcccgggttcaagtgattctcctgcctcagtggattacaggtgcacaccaccacgcctggctaatttttgtatttttagtagagatggagtttcaccatactggccaggctggtctcaaactcctgacctcatgtgatccacccacctcggcctcccaaagtgctgggattacaggcatgagccaccgcccctggcctccatctagactttgaaatgattgccttctaattacagtagcattctcttatttaaaatatttgttttatttaagtcagtgtttaagcaatagctcagcatatcccagtggtccagtgaccacacagctgagaacccttgttaagtggtacagtaaagcattctgtcaaaactttgacatttatgacatgttacctaggaaataggacttagaaaatgagtttgacctgggctttaaaaaagtatactgatgaaggtgccagaattgatgtccattagactgtaagctccatgggggcaggaactttgctaccgaatctatacaaccttaacattgactagtgcttgtaggtgtgctcaatacttgtttgttaactgaatcaaaaggagtaaatgcacaatatttgaacattgtatccaaaggaagaaacctgcgaaataaaattatttgcagaaatgaacatttgttgaaatgcagaaaaccactggatactgcagcctacaatattaatatgatattactcttttacagttgacacctgtcctctctgtagtctcttctctcaaatttggttcttattgagagcctgtctagtttcccaaaggttttataaaacataagttgaagtacctttatttttaattttatttttgagacaggacctcgctctgtcaccgaggctggagtgcagtggcataatcatggctcactgcagcctcgtcctcccaggctccatccatctgcccatctctccctctgagtagctgggaccacgggcacgtgccaccacacccagctaatttttgtatgtttggtagagaaagggtttcaccacattgcccaggctggtcttgaacacctgagctcaagcaatccaacctccttggcctcccagtgttaaattacaggcgtaagccaccacacccggccaagttgaagtatattttgtgatttttctgacagtgcagactgaaaaaaatttaattaacctgacaagagtttactgaatatcacacaattgagtttttaatccattaatgttaaggcaggggtttactctaacacttttaaagtgtcagaagtagttgccaatgccaaatttttatcagcccccttgaatttatttgatttctgactttccacatttccatccagactttgacatgattgccgtctaataactgtagcattctcttattaaaacttctggctgggtgtggtggctcatgcctgtaaccccagcactttaggaggccaaggcaggtgaatcacctgaggtcaggacttagagaccagcctgaccaacatggtgaaaccccatctctactaaatacaaaaattagctgggcatggtggcaggcgcctgtaatcccagctactcaggaggctgaggcaggaggattgcttgaacccgggaggcggaagttgcagtgagccgagactgcgccattgcactccagcttgggtgacagagcaagactccgtctcaaaaaaaaaaaaaaaaacttctgaggtaggggctgtaccatatttttgccccacacccattaagcgaataccaaaaacaacttgtggaaatttgataattttatcaaatttattatttgggcaggattggcatttaccatgcttttccctattgctggcagtaaaacatgggtttaaggaagagtgtttttcagaatttacactgtatatctctgatttggaagttatataattggaatttatgattatgagattaaaataccaaaaagactaagtaa

SEQ ID NO: 2839 - DNA, 2601 bp, Homo sapiens
caaacttccccgaaatgcacttgtggtcagcagctagcggtcttttgtttggggaaaaaaaggagtagcggctaagagcggagccctgacttctcaaaaagcactgcacagaggaggaggcagcagaaccccatttcagcttcttaggactctgcacttccccagaaggaagaattaaaaatgaatatgttcaaggaagcagtgaccttcaaggacgtggctgtggccttcacggaggaggaattggggctgctgggccctgcccagaggaagctgtaccgagatgtgatggtggagaactttaggaacctgctgtcagtggggcatccacccttcaaacaagatgtatcacctatagaaagaaatgagcagctttggataatgacgacagcaacccgaagacagggaaatttaggagagaaaaatcaaagtaagttaattactgttcaagacagagaatcagaagaagagctttcttgttggcaaatctggcaacaaattgcaaatgacttaaccaggtgtcaagactccatgatcaataattctcagtgtcacaaacaaggtgatttcccttaccaggtagggacagaactgtctattcaaatttctgaagatgagaactatatagtaaataaagcagatggtcccaataatactgggaatccagagtttcctatcttgagaacccaggattcttggaggaaaacattcctgactgagtcacagagattgaacagagatcagcaaatttccataaaaaataaattatgtcaatgtaagaagggtgttgatcccatcggttggatttcacatcatgatggtcatagagtacacaaaagtgaaaaatcttatagacccaatgattatgaaaaagacaacatgaagattttgacatttgatcacaatagcatgattcacacaggacagaaatcgtaccagtgtaatgagtgtaaaaaacccttcagtgatctctccagctttgatcttcatcagcagttacaatcaggagagaagtctcttacatgtgttgagcgtggaaaaggcttctgttacagcccagttcttcctgttcatcagaaagtacatgtgggagaaaaacttaagtgtgatgagtgtggtaaggaattcagtcagggcgctcatctacagacccatcagaaagtccacgtgatagagaaaccatacaaatgtaagcaatgtgggaaaggtttcagtcgtagatcagcacttaatgttcattgcaaggtccacacggcagagaaaccttataattgtgaggagtgtgggagggccttcagtcaggcctctcatcttcaggaccatcagagactccacactggggagaagccattcaaatgtgatgcatgtggtaagagcttcagtcggaattcacatcttcaatcccatcaaagagttcatacaggagagaaaccatacaaatgtgaggagtgtggtaagggcttcatttgtagctcaaatctttacattcatcagagagtccacacaggagaaaaaccctataaatgtgaggaatgtggtaaaggctttagtcggccttcaagtcttcaggcccatcagggagttcacactggagagaagtcatacatatgtactgtatgtgggaaaggctttactctgagttcaaatcttcaagcccatcagagagtccacactggagagaagccatacaaatgcaatgagtgtgggaagagcttcaggaggaattcccattatcaagttcatctagtggtccacacaggagagaaaccctataaatgtgagatatgtgggaagggcttcagtcaaagttcgtatcttcaaatccatcagaaggcccacagtatagagaaaccttttaagtgtgaggagtgtgggcagggtttcaatcagagctcacgacttcagattcaccagctgatccatacgggtgagaaaccatacaaatgtgaagagtgtggcaagggatttagtcgtagagcagatcttaaaattcactgtaggatccacacaggagagaaaccatataattgtgaggagtgtgggaaggtcttcaggcaggcctcaaatcttttggcccatcagagagtccacagtggagaaaaaccattcaaatgtgaagaatgtgggaagagtttcggtcggagtgcacatcttcaagcccatcaaaaagtccacactggagataagccatacaaatgtgatgagtgtgggaagggcttcaagtggagcttgaaccttgacatgcatcagagggtgcacacaggagaaaaaccatataaatgtggggagtgtggtaagtacttcagtcaggcctcaagtcttcaacttcatcagagtgtccacacaggagagaaaccatacaaatgtgatgtgtgtggtaaagtcttcagtcggtcttcacaactacagtctcatcagcgagttcacactggggagaaaccttataaatgtgagatatgtggtaagagcttcagttggcgatcaaatcttacagttcatcacagaatccatgttggtgataaatcctataaaagtaataggggtggtaagaacatcagagaatccacacaggaaaaaaaatctataaaatgattctttgtg

SEQ ID NO: 2840 - DNA, 204 bp, Homo sapiens
ctcaagtctccaacttcatcagagttacatgtgggagaaaaacttaagtgtgatgagtgtggtaaggaattcagtcagggcgctcatctacagacccatcagaaagtccacgtgatagagaaaccatacaaatgtaagcaatgtgggaaaggtttcagtcgtagatcagcacttaatgttcattgcaaggtccacacggcagag

SEQ ID NO: 2841 - DNA, 216 bp, Homo sapiens
catcaacagttacactcaggagagaagtctcatacatgtgatgagtgtaaagcttctgttacatctcagcccttcatacatcaaagagtccacatgggagagaaatgctataagtgtgacgtgtgtggtaaggaatttagtcagagctcacatcttcaaactcatcagagagtccacactgtagagaaaccattcaaatgtgtggaatgtgggaaa

SEQ ID NO: 2842 - DNA, 3042 bp, Homo sapiens
acttccgccccggaaagcgaggccgccaccatcttttgggtccgggaggattgagtcatcgggctccaatgcgtggggatgtttaccgccgtttatccgggatagagactccatcgtgctgacagcatccttttattcaccgcctccgaatttgcaaagaggaggaaggagggacttcttggcttctcccagcatagccccagttatgccatctcagaactatgaccttccccagaagaagcaggagaaaatgaccaagtttcaggaggctgtgacattcaaggatgtggctgtggtcttctccagggaggaactgcgactgctcgatcttacccagaggaagctgtaccgagatgtcatggtggagaacttcaagaacctggttgcagtggggcatcttcccttccaaccagatatggtatcccaattggaagcagaagaaaagctttggatgatggaaacagaaacccaaagaagcagcaagcatcaaaataagatggaaacactccaaaaatttgcattaaaatacctttcaaatcaagagctgtcctgctggcaaatctggaaacaggttgcaagtgaattaaccaggtgtcttcaggggaagagttcccagttattacaaggtgactctattcaggtttctgaaaatgagaacaatataatgaaccctaaaggagatagctctatttatattgaaaatcaagagtttccattttggagaacccagcattcttgcgggaatacatatctgagtgagtcacagattcagagtagaggtaagcaaattgatgtgaaaaataacctgcaaatacatgaagacttcatgaagaaatcaccatttcatgagcatattaaaactgacacagaaccaaaaccctgcaaaggtaatgaatatggcaaaatcattagtgatggctccaatcagaaattacccttaggagagaaaccccatccatgtggtgagtgtggaaggggcttcagttatagcccaaggcttccccttcatccgaatgttcatacaggagaaaaatgcttcagtcaaagctcacatctgcgaactcatcagagaattcacccaggagagaaactcaatagatgtcatgaatctggtgattgcttcaataagagctcttttcattcttatcaatctaatcatacaggagagaagtcttatagatgcgacagttgcggcaagggattcagtagcagcacgggtcttatcattcattacagaactcatactggagagaaaccctataaatgcgaggaatgtggtaaatgctttagtcaaagttcaaattttcagtgccatcagagagtccacactgaagaaaaaccatacaaatgcgaagagtgtggtaagggcttcggttggagtgttaatctccgtgttcaccagagggtccacaggggtgagaagccctataaatgtgaggaatgtggtaagggcttcactcaggctgcacattttcacatccatcagagagtccacactggagagaaaccctacaagtgtgatgtgtgtggtaagggcttcagccacaattcaccattaatatgccatcggagagtccacacaggagagaagccatacaagtgtgaggcgtgtgggaaaggctttacccgtaatacagatctgcatattcatttcagagttcacacgggagagaaaccctataaatgtaaggagtgtggtaagggcttcagtcaggcttcaaatcttcaagtccatcagaatgtccacactggggagaaacgattcaagtgtgaaacgtgtgggaagggcttcagtcagtcctcaaagcttcaaacccatcagcgagtccacactggagagaaaccatatagatgtgatgtgtgtggtaaggacttcagttatagttcaaatcttaaactacaccaagtaattcacactggagaaaaaccatataaatgtgaggaatgtgggaagggcttcagttggagatcaaatcttcatgcacatcaaagagttcactcaggagaaaaaccctataaatgtgagcagtgtgataagagcttcagtcaggccatagattttcgggtacatcagagagtccatactggagagaagccatacaaatgtggtgtctgtggtaagggcttcagtcagtcctctggtcttcaatcccatcagagagtccacacgggggaaaagccatacaaatgtgatgtgtgtggaaagggctttagatacagttcgcagtttatataccatcagagaggccacactggagaaaaaccttacaaatgtgaagagtgtgggaaaggctttggtaggagcttgaatcttcgccatcatcagagggtccacacgggagagaaaccccatatatgtgaggagtgtggtaaggccttcagtctcccctcaaatcttcgagtccacctgggtgttcacaccagggaaaaactctttaaatgtgaagagtgtggtaaaggcttcagtcagagtgcacgtcttgaagcccatcagagagtccacactggagaaaaaccatacaaatgtgacatatgtgataaggacttccgtcaccgttcacgtcttacatatcatcagaaagtccatactggtaaaaagctttagaaatgagaaatgtgttaccaacttttgtctgaatgcacatcttcaagtttttggctagtccatgctggtggtaaaccctgtaaaactactgagagtggaagggggtttgttcacacttggaatctttctaacaaatccatcaagatgataacacagaaccatgaacaggaatagaactcgtatttaggggagaaatagggctggtggctctcttggtaagatctagttaatataaatgatcacctttcattgtgaatatatgcctgaagataatgtgtggaaggatatttgccatatgctaactggttttttggccagggagagttttgggttattatcccttttctttaattttcattttatacttacagtgatcattattttcataaaagctgtaaagctatgaaaaatgaataaaattactaaaaattttctgt

SEQ ID NO: 2843 - DNA, 2958 bp, Homo sapiens
acttccgccccggaaagcgaggccgccaccatcttttgggtccgggaggattgagtcatcgggctccaatgcgtggggatgtttaccgccgtttatccgggatagagactccatcgtgctgacagcatccttttattcaccgcctccgaatttgcaaagaggaggaaggagggacttcttggcttctcccagcatagccccagttatgccatctcagaactatgaccttccccagaagaagcaggagaaaatgaccaagtttcaggaggctgtgacattcaaggatgtggctgtggtcttctccagggaggaactgcgactgctcgatcttacccagaggaagctgtaccgagatgtcatggtggagaacttcaagaacctggttgcagtgggcagcaagcatcaaaataagatggaaacactccaaaaatttgcattaaaatacctttcaaatcaagagctgtcctgctggcaaatctggaaacaggttgcaagtgaattaaccaggtgtcttcaggggaagagttcccagttattacaaggtgactctattcaggtttctgaaaatgagaacaatataatgaaccctaaaggagatagctctatttatattgaaaatcaagagtttccattttggagaacccagcattcttgcgggaatacatatctgagtgagtcacagattcagagtagaggtaagcaaattgatgtgaaaaataacctgcaaatacatgaagacttcatgaagaaatcaccatttcatgagcatattaaaactgacacagaaccaaaaccctgcaaaggtaatgaatatggcaaaatcattagtgatggctccaatcagaaattacccttaggagagaaaccccatccatgtggtgagtgtggaaggggcttcagttatagcccaaggcttccccttcatccgaatgttcatacaggagaaaaatgcttcagtcaaagctcacatctgcgaactcatcagagaattcacccaggagagaaactcaatagatgtcatgaatctggtgattgcttcaataagagctcttttcattcttatcaatctaatcatacaggagagaagtcttatagatgcgacagttgcggcaagggattcagtagcagcacgggtcttatcattcattacagaactcatactggagagaaaccctataaatgcgaggaatgtggtaaatgctttagtcaaagttcaaattttcagtgccatcagagagtccacactgaagaaaaaccatacaaatgcgaagagtgtggtaagggcttcggttggagtgttaatctccgtgttcaccagagggtccacaggggtgagaagccctataaatgtgaggaatgtggtaagggcttcactcaggctgcacattttcacatccatcagagagtccacactggagagaaaccctacaagtgtgatgtgtgtggtaagggcttcagccacaattcaccattaatatgccatcggagagtccacacaggagagaagccatacaagtgtgaggcgtgtgggaaaggctttacccgtaatacagatctgcatattcatttcagagttcacacgggagagaaaccctataaatgtaaggagtgtggtaagggcttcagtcaggcttcaaatcttcaagtccatcagaatgtccacactggggagaaacgattcaagtgtgaaacgtgtgggaagggcttcagtcagtcctcaaagcttcaaacccatcagcgagtccacactggagagaaaccatatagatgtgatgtgtgtggtaaggacttcagttatagttcaaatcttaaactacaccaagtaattcacactggagaaaaaccatataaatgtgaggaatgtgggaagggcttcagttggagatcaaatcttcatgcacatcaaagagttcactcaggagaaaaaccctataaatgtgagcagtgtgataagagcttcagtcaggccatagattttcgggtacatcagagagtccatactggagagaagccatacaaatgtggtgtctgtggtaagggcttcagtcagtcctctggtcttcaatcccatcagagagtccacacgggggaaaagccatacaaatgtgatgtgtgtggaaagggctttagatacagttcgcagtttatataccatcagagaggccacactggagaaaaaccttacaaatgtgaagagtgtgggaaaggctttggtaggagcttgaatcttcgccatcatcagagggtccacacgggagagaaaccccatatatgtgaggagtgtggtaaggccttcagtctcccctcaaatcttcgagtccacctgggtgttcacaccagggaaaaactctttaaatgtgaagagtgtggtaaaggcttcagtcagagtgcacgtcttgaagcccatcagagagtccacactggagaaaaaccatacaaatgtgacatatgtgataaggacttccgtcaccgttcacgtcttacatatcatcagaaagtccatactggtaaaaagctttagaaatgagaaatgtgttaccaacttttgtctgaatgcacatcttcaagtttttggctagtccatgctggtggtaaaccctgtaaaactactgagagtggaagggggtttgttcacacttggaatctttctaacaaatccatcaagatgataacacagaaccatgaacaggaatagaactcgtatttaggggagaaatagggctggtggctctcttggtaagatctagttaatataaatgatcacctttcattgtgaatatatgcctgaagataatgtgtggaaggatatttgccatatgctaactggttttttggccagggagagttttgggttattatcccttttctttaattttcattttatacttacagtgatcattattttcataaaagctgtaaagctatgaaaaatgaataaaattactaaaaattttctgt

SEQ ID NO: 2844 - DNA, 1635 bp, Homo sapiens
gtcatgaatctggtgattgcttcaataagagctcttttcattcttatcaatctaatcatacaggagagaagtcttatagatgcgacagttgcggcaagggattcagtagcagcacgggtcttatcattcattacagaactcatactggagagaaaccctataaatgcgaggaatgtggtaaatgctttagtcaaagttcaaattttcagtgccatcagagagtccacactgaagaaaaaccatacaaatgcgaagagtgtggtaagggcttcggttggagtgttaatctccgtgttcaccagagggtccacaggggtgagaagccctataaatgtgaggaatgtggtaagggcttcactcaggctgcacattttcacatccatcagagagtccacactggagagaaaccctacaagtgtgatgtgtgtggtaagggcttcagccacaattcaccattaatatgccatcggagagtccacacaggagagaagccatacaagtgtgaggcgtgtgggaaaggctttacccgtaatacagatctgcatattcatttcagagttcacacgggagagaaaccctataaatgtaaggagtgtggtaagggcttcagtcaggcttcaaatcttcaagtccatcagaatgtccacactggggagaaacgattcaagtgtgaaacgtgtgggaagggcttcagtcagtcctcaaagcttcaaacccgagaaaaaccctataaatgtgagcagtgtgataagagcttcagtcaggccatagattttcgggtacatcagagagtccatactggagagaagccatacaaatgtggtgtctgtggtaagggcttcagtcagtcctctggtcttcaatcccatcagagagtccacacgggggaaaagccatacaaatgtgatgtgtgtggaaagggctttagatacagttcgcagtttatataccatcagagaggccacactggagaaaaaccttacaaatgtgaagagtgtgggaaaggctttggtaggagcttgaatcttcgccatcatcagagggtccacacgggagagaaaccccatatatgtgaggagtgtggtaaggccttcagtctcccctcaaatcttcgagtccacctgggtgttcacaccagggaaaaactctttaaatgtgaagagtgtggtaaaggcttcagtcagagtgcacgtcttgaagcccatcagagagtccacactggagaaaaaccatacaaatgtgacatatgtgataaggacttccgtcaccgttcacgtcttacatatcatcagaaagtccatactggtaaaaagctttagaaatgagaaatgtgttaccaacttttgtctgaatgcacatcttcaagtttttggctagtccatgctggtggtaaaccctgtaaaactactgagagtggaagggggtttgttcacacttggaatctttctaacaaatccatcaagatgataacacagaaccatgaacaggaatagaactcgtatttaggggagaaatagggctggtggctctcttggtaagatctagttaatataaatgatcacctttcattgtgaatatatgcctgaagataatgtgtggaaggatatttgccatatgctaactggttttttggcc

SEQ ID NO: 2845 - DNA, 2936 bp, Homo sapiens
gaaggattgagtcatcgggctccaatgcgtggggatgtttaccgccgtttatccgggatagagactccatcgtgctgacagcatccttttattcaccgcctccgaatttgcaaagaggaggaaggagggacttcttggcttctcccagcatagccccaggaggctgtgacattcaaggatgtggctgtggtcttctccagggaggaactgcgactgctcgatcttacccagaggaagctgtaccgagatgtcatggtggagaacttcaagaacctggttgcagtggggcatcttcccttccaaccagatatggtatcccaattggaagcagaagaaaagctttggatgatggaaacagaaacccaaagaagcagcaagcatcaaaataagatggaaacactccaaaaatttgcattaaaatacctttcaaatcaagagctgtcctgctggcaaatctggaaacaggttgcaagtgaattaaccaggtgtcttcaggggaagagttcccagttattacaaggtgactctattcaggtttctgaaaatgagaacaatataatgaaccctaaaggagatagctctatttatattgaaaatcaagagtttccattttggagaacccagcattcttgcgggaatacatatctgagtgagtcacagattcagagtagaggtaagcaaattgatgtgaaaaataacctgcaaatacatgaagacttcatgaagaaatcaccatttcatgagcatattaaaactgacacagaaccaaaaccctgcaaaggtaatgaatatggcaaaatcattagtgatggctccaatcagaaattacccttaggagagaaaccccatccatgtggtgagtgtggaaggggcttcagttatagcccaaggcttccccttcatccgaatgttcatacaggagaaaaatgcttcagtcaaagctcacatctgcgaactcatcagagaattcacccaggagagaaactcaatagatgtcatgaatctggtgattgcttcaataagagctcttttcattcttatcaatctaatcatacaggagagaagtcttatagatgcgacagttgcggcaagggattcagtagcagcacgggtcttatcattcattacagaactcatactggagagaaaccctataaatgcgaggaatgtggtaaatgctttagtcaaagttcaaattttcagtgccatcagagagtccacactgaagaaaaaccatacaaatgcgaagagtgtggtaagggcttcggttggagtgttaatctccgtgttcaccagagggtccacaggggtgagaagccctataaatgtgaggaatgtggtaagggcttcactcaggctgcacattttcacatccatcagagagtccacactggagagaaaccctacaagtgtgatgtgtgtggtaagggcttcagccacaattcaccattaatatgccatcggagagtccacacaggagagaagccatacaagtgtgaggcgtgtgggaaaggctttacccgtaatacagatctgcatattcatttcagagttcacacgggagagaaaccctataaatgtaaggagtgtggtaagggcttcagtcaggcttcaaatcttcaagtccatcagaatgtccacactggggagaaacgattcaagtgtgaaacgtgtgggaagggcttcagtcagtcctcaaagcttcaaacccatcagcgagtccacactggagagaaaccatatagatgtgatgtgtgtggtaaggacttcagttatagttcaaatcttaaactacaccaagtaattcacactggagaaaaaccatataaatgtgaggaatgtgggaagggcttcagttggagatcaaatcttcatgcacatcaaagagttcactcaggagaaaaaccctataaatgtgagcagtgtgataagagcttcagtcaggccatagattttcgggtacatcagagagtccatactggagagaagccatacaaatgtggtgtctgtggtaagggcttcagtcagtcctctggtcttcaatcccatcagagagtccacacgggggaaaagccatacaaatgtgatgtgtgtggaaagggctttagatacagttcgcagtttatataccatcagagaggccacactggagaaaaaccttacaaatgtgaagagtgtgggaaaggctttggtaggagcttgaatcttcgccatcatcagagggtccacacgggagagaaaccccatatatgtgaggagtgtggtaaggccttcagtctcccctcaaatcttcgagtccacctgggtgttcacaccagggaaaaactctttaaatgtgaagagtgtggtaaaggcttcagtcagagtgcacgtcttgaagcccatcagagagtccacactggagaaaaaccatacaaatgtgacatatgtgataaggacttccgtcaccgttcacgtcttacatatcatcagaaagtccatactggtaaaaagctttagaaatgagaaatgtgttaccaacttttgtctgaatgcacatcttcaagtttttggctagtccatgctggtggtaaaccctgtaaaactactgagagtggaagggggtttgttcacacttggaatctttctaacaaatccatcaagatgataacacagaaccatgaacaggaatagaactcgtatttaggggagaaatagggctggtggctctcttggtaagatctagttaatataaatgatcacctttcattgtgaatatatgcctgaagataatgtgtggaaggatatttgccatatgctaactggttttttggccagggagagttttgggttattatcccttttctttaattttcattttatacttacagtgatcattattttcataaaagctgtaaagctatgaaaaatgaataaaattactaaaaattttctgt

SEQ ID NO: 2846 - DNA, 2774 bp, Homo sapiens
aaggttacacagctgcaagaggctgtgacattcaaggatgtggctgtggtcttctccagggaggaactgcgactgctcgatcttacccagaggaagctgtaccgagatgtcatggtggagaacttcaagaacctggttgcagtggatatggtatcccaattggaagcagaagaaaagctttggatgatggaaacagaaacccaaagaagcagcaagcatcaaaataagatggaaacactccaaaaatttgcattaaaatacctttcaaatcaagagctgtcctgctggcaaatctggaaacaggttgcaagtgaattaaccaggtgtcttcaggggaagagttcccagttattacaaggtgactctattcaggtttctgaaaatgagaacaatataatgaaccctaaaggagatagctctatttatattgaaaatcaagagtttccattttggagaacccagcattcttgcgggaatacatatctgagtgagtcacagattcagagtagaggtaagcaaattgatgtgaaaaataacctgcaaatacatgaagacttcatgaagaaatcaccatttcatgagcatattaaaactgacacagaaccaaaaccctgcaaaggtaatgaatatggcaaaatcattagtgatggctccaatcagaaattacccttaggagagaaaccccatccatgtggtgagtgtggaaggggcttcagttatagcccaaggcttccccttcatccgaatgttcatacaggagaaaaatgcttcagtcaaagctcacatctgcgaactcatcagagaattcacccaggagagaaactcaatagatgtcatgaatctggtgattgcttcaataagagctcttttcattcttatcaatctaatcatacaggagagaagtcttatagatgcgacagttgcggcaagggattcagtagcagcacgggtcttatcattcattacagaactcatactggagagaaaccctataaatgcgaggaatgtggtaaatgctttagtcaaagttcaaattttcagtgccatcagagagtccacactgaagaaaaaccatacaaatgcgaagagtgtggtaagggcttcggttggagtgttaatctccgtgttcaccagagggtccacaggggtgagaagccctataaatgtgaggaatgtggtaagggcttcactcaggctgcacattttcacatccatcagagagtccacactggagagaaaccctacaagtgtgatgtgtgtggtaagggcttcagccacaattcaccattaatatgccatcggagagtccacacaggagagaagccatacaagtgtgaggcgtgtgggaaaggctttacccgtaatacagatctgcatattcatttcagagttcacacgggagagaaaccctataaatgtaaggagtgtggtaagggcttcagtcaggcttcaaatcttcaagtccatcagaatgtccacactggggagaaacgattcaagtgtgaaacgtgtgggaagggcttcagtcagtcctcaaagcttcaaacccatcagcgagtccacactggagagaaaccatatagatgtgatgtgtgtggtaaggacttcagttatagttcaaatcttaaactacaccaagtaattcacactggagaaaaaccatataaatgtgaggaatgtgggaagggcttcagttggagatcaaatcttcatgcacatcaaagagttcactcaggagaaaaaccctataaatgtgagcagtgtgataagagcttcagtcaggccatagattttcgggtacatcagagagtccatactggagagaagccatacaaatgtggtgtctgtggtaagggcttcagtcagtcctctggtcttcaatcccatcagagagtccacacgggggaaaagccatacaaatgtgatgtgtgtggaaagggctttagatacagttcgcagtttatataccatcagagaggccacactggagaaaaaccttacaaatgtgaagagtgtgggaaaggctttggtaggagcttgaatcttcgccatcatcagagggtccacacgggagagaaaccccatatatgtgaggagtgtggtaaggccttcagtctcccctcaaatcttcgagtccacctgggtgttcacaccagggaaaaactctttaaatgtgaagagtgtggtaaaggcttcagtcagagtgcacgtcttgaagcccatcagagagtccacactggagaaaaaccatacaaatgtgacatatgtgataaggacttccgtcaccgttcacgtcttacatatcatcagaaagtccatactggtaaaaagctttagaaatgagaaatgtgttaccaacttttgtctgaatgcacatcttcaagtttttggctagtccatgctggtggtaaaccctgtaaaactactgagagtggaagggggtttgttcacacttggaatctttctaacaaatccatcaagatgataacacagaaccatgaacaggaatagaactcgtatttaggggagaaatagggctggtggctctcttggtaagatctagttaatataaatgatcacctttcattgtgaatatatgcctgaagataatgtgtggaaggatatttgccatatgctaactggttttttggccagggagagttttgggttattatcccttttctttaattttcattttatacttacagtgatcattattttcataaaagctgtaaagctatgaaaaatgaataaaattactaaaaattttctgt

SEQ ID NO: 2847 - DNA, 4964 bp, Homo sapiens
gcgtcaccttgattgcttcttaggcagtggtgaggcgtcttagagacgtgcatctccatgcggttgtactgtcaggccatgggaattaggatcggctctataggaccagtgtgaagggacaacgtgcggcggagggtcgaagcccacggatttccatgagctcggcctggcttccttcttggaattgttcgtttctcggagataattgtataaaagaaggagaaataaccccacatctcttgacactagagctccaggtcccctgaccatgggaagcagtcacgctctggacagtaaaggtggagacaggaacttgtcagagcttggagagtttccggaatgaaaaaggcctggatcttctgcgtctccagcttaggaaaaccagagaataaatacagttgctgctgctcgcagaaaacctagcagaagagaccatggagactttgacctcaaggcatgagaaaagagctcttcattctcaagcctcagccatttcccaagatagggaggagaagatcatgtctcaggagccattgagcttcaaggacgtggctgtggtcttcactgaggaggagctagagctgctggactctacccagaggcagctgtaccaagatgtgatgcaggagaatttcaggaacctactctcagtgggtgagaggaatcctctgggagacaagaatggaaaggatacggagtatattcaagatgaagaattaaggttcttttcacacaaagagctctcctcatgcaaaatctgggaagaggtggcaggtgaattacctgggagccaagactgtagagtaaatctgcaaggaaaagacttccagttctcagaagatgctgctccccatcaagggtgggaaggagcatctacgccgtgttttccaattgagaattccctggacagtctacaaggggatgggcttatcggtctagaaaatcaacagtttccagcctggagagctataagaccaatccccattcaaggatcttgggcaaaagcgtttgtgaaccagttaggggatgttcaagaaagatgtaaaaatctcgacacagaagacacagtatataaatgtaactgggatgatgacagcttttgctggatatcttgtcatgttgatcacagattccctgaaatagacaagccgtgtggttgcaataaatgcagaaaagactgcattaaaaactctgtacttcatcgcattaaccctggagagaatggcttgaaaagtaacgaatacagaaatggcttcagggacgatgcagaccttcccccgcatccaagagtacctttgaaagagaaactctgtcaatatgatgagtttagtgagggcttgaggcacagtgcccatcttaacagacatcaaagagttcccacaggagagaaatctgttaagagtcttgagcgtggtcggggcgtcagacagaacacgcacatacgtaaccaccccagagcccctgtgggagacatgccctatagatgtgatgtctgtggaaaggggttcaggtataaatcggttcttcttattcatcaaggggtgcacacaggaaggagaccctataaatgtgaggagtgtgggaaggcatttggtcgaagttcaaacctgcttgtccatcagagggtccacactggagagaaaccatataaatgcagcgagtgtgggaagggcttcagttacagctcagtgcttcaagtccatcagaggctgcacacaggggagaagccctacacctgcagcgagtgtggcaaaggcttctgtgccaagtctgcactgcacaaacaccagcacattcaccctggagaaaagccctacagctgtggcgagtgtggaaagggattcagctgcagctcccacctcagcagtcatcagaagacacacaccggcgagaggccctaccagtgtgacaagtgtggcaaaggtttcagtcacaactcgtaccttcaagctcaccagagagttcacatggggcagcatctgtacaaatgtaacgtgtgtggtaagagtttcagttacagctcagggcttctcatgcatcagagactgcacacaggagagaaaccctacaaatgcgagtgcgggaagagctttggccggagctccgacctccacatccatcagagggtccacacaggagagaaaccctataaatgcagtgagtgtgggaagggcttccggcggaattcagaccttcacagccaccagagggtccacacgggagagaggccctacgtgtgtgacgtgtgtgggaagggtttcatctacagctccgacctccttatccatcagagggtccacactggagagaaaccctataaatgtgctgagtgtggcaaaggcttcagttacagctcagggcttctcattcaccagagagtccacacaggcgagaaaccttacagatgccaagagtgcggaaagggctttaggtgcacatcaagccttcacaaacatcagcgagtccacacgggaaaaaagccctatacgtgtgatcagtgtggcaagggattcagttatggctctaatcttcgcacccaccagaggttgcacacaggagagaaaccctacacttgttgtgaatgtgggaagggtttcagatatggctcaggtctccttagtcataagagagtgcacactggcgagaagccatacagatgccacgtgtgtgggaagggctatagtcagagctcacatcttcaaggtcatcagagggtccacactggtgagaaaccctataaatgtgaggagtgtgggaagggctttggccgcaactcctgtcttcatgttcatcagagagtccacactggagagaagccctatacgtgtggtgtgtgtgggaaaggcttcagttatacctcaggtctgcggaaccaccaaagagtgcatttaggcgagaacccttataagtagatgtacatagaggattccatctgggactcagagctttctatccatctgagagccaacacaggagaaaaaccataggaaagtgacatgtaggagggctataggagaaactgatgattttacattttctagtctgcataggaagggaacacctggacgtgtgataaataggttagcacttcagttacaaacttcagtctttaagagtctgttgtgcagcggagtaggctttaaagaaacagtgcagcagtggtttcagtaataatcctcacttccatcagaatctgcctgggagggagcttttacaatgtacaagtggtgagaatgtttccaaggtgctaattatggacatagattctttgtgtgggttgatagctaccaatgggacagtgtagaaacaagtttccacctttctaaaaccagtttggtacatatctttttaaagatcgctttataaaaacaaaaagataacattaacatttattgaaacaagtcactctgagaagaccaggaacaaagttctcttggcagatctgggtaatgtgtgtgtctcacatttttatcatgtttttatgactgttttatcttgcaggtaagctttacagctttcagaggagttgtagtacactacagaaatatgtcttctttccaggttcaaaaagcaaaatctgattggcattgcattgaattattaattaaataaatttattaattggcattgcattgaatttataggttaattttgaaagaatgtggcgtctttgaaatgctgattttttttcactttaaaaaaatgacttttttttttttaccactgatagtatttcatatggtccctcagtaatatttcttagagatggttaaaaataggttctgagtcatcttaagcatatttctaggaatttgttttattgctgtcatgaatataatggttttgctccagttcatttcatggtttaacatatcaaatattaggtatcttaaaaatcacaaatgctatttcaccctgcaggttagcagtattaaaatagaaacatcaaatcccccatcagtgggggcgggggggggggttgtagaaacagtctgatatggtttggctctgttccccacccaaatcccatctcaattttaatccccatgtgtcagaggagggccttggtgggagatgactggatcacgagggcagatttctcccttgctgttctcatgatagtgagttctcatgagagctgatggttttaaggtgtagcccttcctcgctgtctctctcctgtccccttgtgaagaaggtccttatttctcttttgcgttctgccatgactaagttttcggaggcctccccagccatgtggaactgtgtgtgagttaaacctctttcctttgcaaattacctagtctcaggtagttctttatagcagtgcaaaaatggacgtaataagtcttatgtacttattggtgagagagaaaatccgtgcattgttttcaaaagaattcattaacgtatcaattcaatttctataacctttgaagtggcagtaaatatgtagtaattgatacttgggagatagttgcccacttgggcaaaaacgcatgcagaaggcggagtttttaaatttaaaacatttttaaaatagcaaatgttaatattccagtttccattggtaggaaattttttaggtaagttcaggcatatgtatgcaatggaaagccactagaaatcttcaggcacacagataatgacaatgcaggttgctcatgaagtatttagtgaaccaggagagttttagaacaacaattatagcatgaccccattttgttagtatgtttttctgtgtgtatgtttagagcaacagagaaaaaaagatgtgggagaggacatataactacttatctctagtggtgggattctgaatgtataatacatatgttgtacttttatgtatttcactttgtaacaaagtatctttcagttttataataacagtagagctattttttataaattagcctgatggaacaatcccttatgattaaagattcatgttgtaacctcta

SEQ ID NO: 2848 - DNA, 4510 bp, Homo sapiens
gcgtcaccttgattgcttcttaggcagtggtgaggcgtcttagagacgtgcatctccatgcggttgtactgtcaggccatgggaattaggatcggctctataggaccagtgtgaagggacaacgtgcggcggagggtcgaagcccacggatttccatgagctcggcctggcttccttcttggaattgttcgtttctcggagataattgtataaaagaaggagaaataaccccacatctcttgacactagagctccaggtcccctgaccatgggaagcagtcacgctctggacagtaaaggtggagacaggaacttgtcagagcttggagagtttccggaatgaaaaaggcctggatcttctgcgtctccagcttaggaaaaccagagaataaatacagttgctgctgctcgcagaaaacctagcagaagagaccatggagactttgacctcaaggcatgagaaaagagctcttcattctcaagcctcagccatttcccaagatagggaggagaagatcatgtctcaggagccattgagcttcaaggacgtggctgtggtcttcactgaggaggagctagagctgctggactctacccagaggcagctgtaccaagatgtgatgcaggagaatttcaggaacctactctcagtgggtgagaggaatcctctgggagacaagaatggaaaggatacggagtatattcaagatgaagaattaaggttcttttcacacaaagagctctcctcatgcaaaatctgggaagaggtggcaggtgaattacctgggagccaagactgtagagtaaatctgcaaggaaaagacttccagttctcagaagatgctgctccccatcaagggtgggaaggagcatctacgccgtgttttccaattgagaattccctggacagtctacaaggggatgggcttatcggtctagaaaatcaacagtttccagcctggagagctataagaccaatccccattcaaggatcttgggcaaaagcgtttgtgaaccagttaggggatgttcaagaaagatgtaaaaatctcgacacagaagacacagtatataaatgtaactgggatgatgacagcttttgctggatatcttgtcatgttgatcacagattccctgaaatagacaagccgtgtggttgcaataaatgcagaaaagactgcattaaaaactctgtacttcatcgcattaaccctggagagaatggcttgaaaagtaacgaatacagaaatggcttcagggacgatgcagaccttcccccgcatccaagagtacctttgaaagagaaactctgtcaatatgatgagtttagtgagggcttgaggcacagtgcccatcttaacagacatcaaagagttcccacaggagagaaatctgttaagagtcttgagcgtggtcggggcgtcagacagaacacgcacatacgtaaccaccccagagcccctgtgggagacatgccctatagatgtgatgtctgtggaaaggggttcaggtataaatcggttcttcttattcatcaaggggtgcacacaggaaggagaccctataaatgtgaggagtgtgggaaggcatttggtcgaagttcaaacctgcttgtccatcagagggtccacactggagagaaaccatataaatgcagcgagtgtgggaagggcttcagttacagctcagtgcttcaagtccatcagaggctgcacacaggggagaagccctacacctgcagcgagtgtggcaaaggcttctgtgccaagtctgcactgcacaaacaccagcacattcaccctggagaaaagccctacagctgtggcgagtgtggaaagggattcagctgcagctcccacctcagcagtcatcagaagacacacaccggcgagaggccctaccagtgtgacaagtgtggcaaaggtttcagtcacaactcgtaccttcaagctcaccagagagttcacatggggcagcatctgtacaaatgtaacgtgtgtggtaagagtttcagttacagctcagggcttctcatgcatcagagactgcacacaggagagaaaccctacaaatgcgagtgcgggaagagctttggccggagctccgacctccacatccatcagagggtccacacaggagagaaaccctataaatgcagtgagtgtgggaagggcttccggcggaattcagaccttcacagccaccagagggtccacacgggagagaggccctacgtgtgtgacgtgtgtgggaagggtttcatctacagctccgacctccttatccatcagagggtccacactggagagaaaccctataaatgtgctgagtgtggcaaaggcttcagttacagctcagggcttctcattcaccagagagtccacacaggcgagaaaccttacagatgccaagagtgcggaaagggctttaggtgcacatcaagccttcacaaacatcagcgagtccacacgggaaaaaagccctatacgtgtgatcagtgtggcaagggattcagttatggctctaatcttcgcacccaccagaggttgcacacaggagagaaaccctacacttgttgtgaatgtgggaagggtttcagatatggctcaggtctccttagtcataagagagtgcacactggcgagaagccatacagatgccacgtgtgtgggaagggctatagtcagagctcacatcttcaaggtcatcagagggtccacactggtgagaaaccctataaatgtgaggagtgtgggaagggctttggccgcaactcctgtcttcatgttcatcagagagtccacactggagagaagccctatacgtgtggtgtgtgtgggaaaggcttcagttatacctcaggtctgcggaaccaccaaagagtgcatttaggcgagaacccttataagtagatgtacatagaggattccatctgggactcagagctttctatccatctgagagccaacacaggagaaaaaccataggaaagtgacatgtaggagggctataggagaaactgatgattttacattttctagtctgcataggaagggaacacctggacgtgtgataaataggttagcacttcagttacaaacttcagtctttaagagtctgttgtgcagcggagtaggctttaaagaaacagtgcagcagtggtttcagtaataatcctcacttccatcagaatctgcctgggagggagcttttacaatgtacaagtggtgagaatgtttccaaggtgctaattatggacatagattctttgtgtgggttgatagctaccaatgggacagtgtagaaacaagtttccacctttctaaaaccagtttggtacatatctttttaaagatcgctttataaaaacaaaaagataacattaacatttattgaaacaagtcactctgagaagaccaggaacaaagttctcttggcagatctgggtaatgtgtgtgtctcacatttttatcatgtttttatgactgttttatcttgcaggtaagctttacagctttcagaggagttgtagtacactacagaaatatgtcttctttccaggttcaaaaagcaaaatctgattggcattgcattgaattattaattaaataaatttattaattggcattgcattgaatttataggttaattttgaaagaatgtggcgtctttgaaatgctgattttttttcactttaaaaaaatgacttttttttttttaccactgatagtatttcatatggtccctcagtaatatttcttagagatggttaaaaataggttctgagtcatcttaagcatatttctaggaatttgttttattgctgtcatgaatataatggttttgctccagttcatttcatggtttaacatatcaaatattaggtatcttaaaaatcacaaatgctatttcaccctgcaggttagcagtattaaaatagaaacatcaaatcccccatcagtgggggcgggggggggggttgtagaaacagtctgatatggtttggctctgttccccacccaaatcccatctcaattttaatccccatgtgtcagaggagggccttggtgggagatgactggatcacgagggcagatttctcccttgctgttctcatgatagtgagttctcatgagagctgatggttttaaggtgtagcccttcctcgctgtctctctcctgtccccttgtgaagaaggtccttatttctcttttgcgttctgccatgactaagttttcggaggcctccccagccatgtggaactgtgtgtgagttaaacctctttcctttgcaaattacctagtctcaggtagttctttatagcagtgcaaaaatggacgtaataagtcttatgtacttattggtgagagagaaaatccgtgcattgttttcaaaagaattcattaacgtatcaattcaatttctataacctttgaagtggcagtaaatatgtagtaattgatacttgggagatagttgcccacttgggcaaaaacgcatgcagaaggc

SEQ ID NO: 2849 - DNA, 4132 bp, Homo sapiens
agacgctctgtggagacgcgagcacttccggtgtgtgagcctgcggttgctacataaccgcgtagtttgagccatttctgcgtctggcgggtccttctgaacttgtcaccttcgcttggggtcgcaacgacccgatgatcgatgatccaagcaagggaaaagaagccttggcggagagcggaggcacaattccaccttcctttgtgctccattactcaagacactgaagactccaaaaagtagtaggaaaaatgaccacattcaaggaggcagtgaccttcaaggatgtggctgtgttcttcactgaggaggaactggggctactggaccctgcccagaggaagctgtaccaagacgtgatgcttgagaacttcacgaacctgctgtcagtggggcatcaaccattccaccctttccacttcctaagggaagaaaagttttggatgatggagacagcaacccaaagagaaggaaattcaggcggcaagactattgcggaagcaggaccacatgaagactgcccttgccagcaaatctgggaacaaactgcaagtgacttaacccagtctcaagactccatcataaataattctcacttctttgaacaaggtgatgtcccctcccaggttgaggcaggactatctataattcatacaggacagaaaccttcacagaatgggaagtgtaaacagtccttcagtgatgttgccatctttgatcctcctcagcagttccactcaggagagaagtctcatacatgcaatgagtgtggaaaaagcttctgttacatctcagctcttcgtattcaccagagagttcacttgagagagaaactctctaagtgtgacatgcgtggtaaggaattcagtcagagctcatgtctgcaaactcgtgagagagtccacactggagagaaaccattcaaatgtgagcaatgtgggaaaggcttcagatgtagagcgatacttcaagttcactgcaaattacacacaggagagaaaccttatatttgtgagaaatgtgggagggccttcattcacgatttccagcttcagaaacatcagataattcatactggggagaagccgttcaaatgtgaaatatgtggtaagagcttctgccttaggtcaagtcttaataggcattgcatggtccacacagcagagaaactgtacaaatctgaggagtgtggaaaaggcttcactgatagcctagatttgcataagcatcagataattcacacaggacagaaaccgtacaattgtaaagaatgtgggaagagcttcagatggtcctcatatcttttgatccatcagcgaatccacagtggagaaaaaccatacagatgtgaggagtgtgggaagggctacattagtaagtcaggtcttaacttgcaccagagggtccatactggagagagaccttataattgtaaggaatgtgggaagagctttagccgggcttcaagtattttgaatcataagaaactccactgccggaaaaaacccttcaaatgtgaggattgtggaaagaggcttgtacaccggtctttctgtaaagaccaacaaggagaccacaatggagaaaactcatccaaatgtgaggactgtgggaagcgctacaagaggcgcttgaatctggatataattttatcattatttttaaatgatatgtaagttgtacatatatatgggatatggtatgaaattttaatatgtgtatataatacgtaatgatcaaattgatgtaattagtgtattaccttaaacaattaacatttctttgttttgggaaaattcaaaatccattgttctagcgatttgaaaagaaacaataaattattgttgattatagtcacctttggtgctttagaacactagaatgtatttctcctatctagcagtacttatgtatcttgttacccaatctttggctatctcacctaacccctacacttccctgcttctagaaccactgttttactcactaattctatgaaatcaacttttttagcttccatatgtgtgtgaggacagttagtatttatcttaccttgcttagcttatattgtttaacatgtcctccaaagctcatctatgttgccacaaatgacacaattttgttttctttttatgcccaaagagtattctattgtgtatatatgccaccttttcttcatttatctattgatggacacataggtgggttccatatcttaactattgtgaagaatagtgctccaatgaacatggtagtgtagatatctgatccacatactgatttcctttgctttggatatactcaatagtgggattgctagatcactcgaatcttatgcctcagaggcttgacacaagagcaaaactatggaagtgtggctagggtgatatggcttcataccacctcaggcctcaagtcctcaactgcaccagagtgtccacgttggacagaatccttagtaatgaggtgtgtgataaagtctctgctcagttgtctataatctcatttgagagttcacaaaggggcaaaacattaaaaagaggcatatggtaagcacttcagtgtgtgtttatatcataatttatcacagtccatactgataatatatttcatccaggcttgtaggacagaaaacatttgtttaagttaaattcagtgtttcaccatagctcagcattctcccatcatcctaggaccatcgtagtagagaactcttgtaaattgtgcagtagggttgcaaacagaacttacgcttgtcattcaggagacaggccttagaataagagtttgttcacacatttacaaaaccctaatgatgaacatgtcaaaagtggtgaccactagaatgtcaactacaggtaccttgttttctgcatcctcaggaccttaacactgattagcacttacatgtttagtatgtgttaaatgactcaaaaggagaaaatatgatattttaaaattgcatctaggagagaaaatctacaaaaaataattcagggacacgagttaaaatgcagaatacactcagttctgcaatccaaagcattattttgggtaatcttaccctgttgcacttggctgctggcttcccctcatcctctgttctgaagtttactactagtggctttgtctaatgctccattggttgcatacaatataaattcaacaatcatttgtaactcttctcacactacaggctgaaaatggtttgttaacttgtcaataacagtccactgcatatatcacaattacatttttttcaacagtgttaaggcaaaatttatagtaatactttttacgtggcagatgtagttacgttggaaaaaacttccttagttctgaattctcatgattgcttctgtatttccatgcaggccttgatataatggccttctaattgtggtagcatttattttatcaaacaactcaggtagaagctatgccaatttgacaatttttggaaacctaacctaatattctcttcctatctctatgaaataccaagagaaacctatcggagtttggtaatttcatgaaatgtatccatgattggggtaggagtgacatttacatgctcttctttattgttggcagtaaaaataagtcttttgtaagcagtgtatatcagaatgtataaggtacaagtgttttacctggaaatgatgggataggaaattatgattatgatgttaaaactgtgaaaagtagaaaaccacatggatgatatcaccccattttaaaatggaataagtattcaacaagaatttgtgtgaaatgcatttattcctataacataagaccaataaaatgagggaaccagacatacagtaaaaggagaaaaacataatgtgagctttgtgaaatctgactgtaaccttcataacataatcaaatatctttgtgtgtttctgggactttttaatgtgtatatacgtaatttgtgaacaactattctttcctctggcaatgaatatttgctggtatttttccattttataattttatgcattttttctcagtgaacatcagttttatcaaagcagtaaatttagtgcaataaatttgcaaacttattaacgttaatcacttacctaccaggactcagaatctcagaataaaattgctctatatt

SEQ ID NO: 2850 - DNA, 2179 bp, Homo sapiens
cgacgacaaggatggggcccatctcttcggagcctaaggatccagcccaggtccagccctgcgcagccgcccaccaagctgccagaagacgagccggacgcccaaggctacgagaggacgattgcagaattgtacaggctagtggttggggaatattttttcgtggaagggaccgtcttccttagctgtggccctctcatcaggtctgggaagaggtaattggaaaatagaactcatggagaagtgttaccacaggccatggacaaggccagaatttccctgacatctgtccgccagcaccgcccttcaggtacaattccacaagagaccccccaaacttgatgaagtcacccgcttacaagggctcactctccacctgcgcaaggactgcaattcccaggggcctccagggcacccggccgctccagtccagtcgtgcaggcggcgcgctctttctcgctccgctcaagtccaggaaccggttcccgggctcccagcctctcggcagcgcccacgcgcctgggccaaagtccgcgaacggaagccggcggcgaggaggattctgggagttggaggccgaggctgcgacctgcgcaggcgcaaacctgcccctggggtgagggctgtaagtggcgcgattcgcggcagcgccccgatggaacctcctggtcctgtgagggggcccttgcaagattccagctggtatgagccttctgcagagctagtgcagactaggatggctgtatcactaacagcagctgaaactctggcccttcagggtacacagggacaagagaagatgatgatgatgggaccaaaggaagaggaacagtcttgtgagtatgagaccaggctacctgggaaccactctaccagtcaagagatcttccgccaacgcttcaggcatctccgctaccaggagactcctggtccccgggaggccttgagccaactacgagtactctgctgtgagtggctgaggccagagaaacacacgaaggagcagatcctggagttcctggtgctggaacaattcttgaccatcctgcctgaggagctccaatcctgggtgcggggacatcaccctaagagtggagaggaggctgtgactgtgctggaggatttagagaaaggacttgaaccagagccgcaggtcccaggccctgcacatggacctgcacaggaagagccatgggagaagaaggaatctctgggagcagcccaggaagcactgagcatccagctccagcctaaggagacccagcctttcccaaagagtgaacaggtatatttacattttctgtcagttgttacagaagatggcccagagcccaaggacaaaggatcattgccacaaccacccattactgaagtggaatcacaggtgttctcagaaaaacttgctactgacacctctacatttgaagctacctctgagggtaccttagaactgcagcagagaaatcccaaagcggagagactgaggtggtcccctgcccaggaggaaagtttcaggcagatggttgtcatccataaggaaattcccacagggaagaaagaccatgaatgtagtgaatgtggtaaaaccttcatttataactcacatcttgttgtccaccagagagttcattctggagagaaaccctataagtgtagtgactgtgggaaaactttcaaacagagctcaaacctcggtcagcatcagagaattcatacaggagagaaacccttcgaatgtaatgaatgtgggaaggccttcagatggggtgctcatcttgttcagcatcagaggattcactcaggagagaagccctatgagtgtaatgagtgtgggaaggcctttagtcaaagctcatatctaagtcagcatcggagaattcacagtggagagaaaccttttatatgtaaagaatgtgggaaagcttatggatggtgctcagagctcattagacatcggagagttcatgccagaaaagagccttcccattgaattgaaggggagaacgtctccagacagaattctacatcggtctaatctactttaggactggatcccataaaagttataagttccttaagatttttcctgtgtctttcttgattttggaaaaactgtttacttagttctgcctgtagatcatcccttcatgtcctctgatgaagatactgatattaatta

SEQ ID NO: 2851 - DNA, 1769 bp, Homo sapiens
aaacctgcccctggggtgagggctgtaagtggcgcgattcgcggcagcgccccgatggaacctcctggtcctgtgagctgcaagatagaaagcaacatatgcccccaggtggcctccctcaccctggcaatggaaacgaacagccgagcttcaccggacaagactagaaatcgttcctccacccacccagagacaaagcatatttgacttcttcctctactggggcccttgcaagattccagctggtatgagccttctgcagagctagtgcagactaggatggctgtatcactaacagcagctgaaactctggcccttcagggtacacagggacaagagaagatgatgatgatgggaccaaaggaagaggaacagtcttgtgagtatgagaccaggctacctgggaaccactctaccagtcaagagatcttccgccaacgcttcaggcatctccgctaccaggagactcctggtccccgggaggccttgagccaactacgagtactctgctgtgagtggctgaggccagagaaacacacgaaggagcagatcctggagttcctggtgctggaacaattcttgaccatcctgcctgaggagctccaatcctgggtgcggggacatcaccctaagagtggagaggaggctgtgactgtgctggaggatttagagaaaggacttgaaccagagccgcaggtgggaagggggatttggtctgttatgggagccagattgatgaccttcaggctggaccgaggggcagctgtagggggaggtgccaagttcaaacctctcttgggccaggtagagcagttagtatgtgtttctgtgtctgtcttttctgccctcgagccctgaatgagaaagagactctagctcctcttcttcccttgtgctgactctgaggaggctctctaaagtctccttggaagctttggtccaaggagggtcacatctgcaagtgtccaggcaggggacagaaaccacactagtaatttgaagaaaatttaaactgagtggtgcctgatcacctccaggtcccaggccctgcacatggacctgcacaggaagagccatgggagaagaaggaatctctgggagcagcccaggaagcactgagcatccagctccagcctaaggagacccagcctttcccaaagagtgaacaggtatatttacattttctgtcagttgttacagaagatggcccagagcccaaggacaaaggatcattgccacaaccacccattactgaagtggaatcacaggtgttctcagaaaaacttgctactgacacctctacatttgaagctacctctgagggtaccttagaactgcagcagagaaatcccaaagcggagagactgaggtggtcccctgcccaggaggaaagtttcaggcagatggttgtcatccataaggaaattcccacagggaagaaagaccatgaatgtagtgaatgtggtaaaaccttcatttataactcacatcttgttgtccaccagagagttcattctggagagaaaccctataagtgtagtgactgtgggaaaactttcaaacagagctcaaacctcggtcagcatcagagaattcatacaggagagaaacccttcgaatgtaatgaatgtgggaaggccttcagatggggtgctcatcttgttcagcatcagaggattcactcaggagagaagccctatgagtgtaatgagtgtgggaaggcctttagtcaaagctcatatctaagtcagcatcggagaattcacagt

SEQ ID NO: 2852 - DNA, 1701 bp, Homo sapiens
ggacacaagaatcaaaatgagatagatacccttcaagaagtaagattaagattcctttcatatgaagaccttatatgctggcaaatatgggaacaatttacaagtaaattaaccagtaatcaagacctaataataaatcttcaaggcaagaggtccaagttgctaaaacaaggtgattccccctgtcaggtgtggacaggagaatctagtcaggtctctgaagatgagaactatgtaataaagctacaaggggagagttcaaatagcataaaaaatcaagagcttccattgaggaccacctgggatttctggaggaaaatgtatctgagagaaccacagaattatcagagtaggtgtcagcaaattgatgtaaaaaataagctctgtaaatgtgatcattgtgttaggcaaagaattgctcatcaacatgatgatcatggagtacacaaaagagagaaagcttttagccacaataattgtggaaaagactgtgtgaaggaatcatcccagcatagcataatccaatcaggagagcaaacctctgatgaaaatggaaaaggcttaagtgttggctctaatcttgaacttcaccagcaactacacttaagagacaagcctcatgtaaatgttgagtacgggaagggcataggttacagctcagggcttcccaggcatcagtgtttccacataggagagaaatgctataggaatggtgacagtggtgagggcttcagtcagggctcacatctgcaacctcatcagagagtcagcacaggagagaacctctacagatgtcaggtatatgcccggagctccaaccagaactcctgtcttccctctcatgagcttactcacccaggagagaagttgtgtacatgtggcaggtgtgggaagggcttccatcatagcttagattttgacattcactgtgtagacagtgctggagagagagcctgtaaatgtgatgtatatgataaaggcttcagtcagacatcacaacttcaagcccatcagagagttcacactggagagaaaccatataaatgtgaggtatgtgataagggcttcagtaaggcctcaaatcttcaagcccatcagagaatccacactggagagaaaccctacaaatgtgatgtgtgtgataagaacttcagccgtaattcccaccttcaggcccatcagagagtccatacaggagagaaaccctacaaatgtgacacatgtgggaaggacttcagtcagatctctcatcttcaggcccatcagagagttcacaaaggagagaagccatacaaatgtgagacatgtgggaagggctttagtcagagttcgcatctccaagaccatcagcaagtccatactggagagaatccctacaaatgtgatgtgtgtgggaaaggcttcagttggagttcacatcttcaagcccatcagagagtccacacaggagagaaaccatacaaatgtgaagaatgtaggaaaggcttcatctggaactcatatcttcatgttcatcagaggatccacacgggagagaaaccctataaatgtggcatgtgtggtaagagcttcagtcagacttcacatcttcaagcccatcagagagtccatactggagagaaaccatacaaatgttttgtgtgtggtaagggctttagtaagagttcgcttcagattcatcagagagtccatgatggtgat

SEQ ID NO: 2853 - DNA, 1959 bp, Homo sapiens
atggtaaagagatcaatgcaacaagaagagctaactatcctaaatatatatgcacccaatacaggagcacctagattcataagggcggtagcctgtttccgctcgggcattctgggaagtgtagtgcagaagccgttgcaaccttgtgtacttccgctgcaggagggcgaagcagccgtcatctatcccctctgggaggtgagtcagcgcggaacctctgcatctacggcgagctttcctggcctgggcgttggactcgcagttctgccttcccaggaccctgcccttccccagaaggagcaggagaaaatgaccaagtttcagttattggccataagattgagattacatctgcttgatgttgtaggagatggtgacattcaaggatgtggctgtggtcttcaccagggaggagctggggttgctggaccttgcccagagaaagctgtaccaagatgtgatgctggagaacttcaggaacctgctgtcagtgggctatcaacccttcaaactagatgtgatattacagttgggaaaagaagacaagcttcggatgatggagacagaaatccaaggagatgggtgttcaggcaaagaattgctcatcaacatgatgatcatggagtacacaaaagagagaaagcttttagccacaataattgtggaaaagactgtgtgaaggaatcatcccagcatagcataatccaatcaggagagcaaacctctgatgaaaatggaaaaggcttaagtgttggctctaatcttgaacttcaccagcaactacacttaagagacaagcctcatgtaaatgttgagtacgggaagggcataggttacagctcagggcttcccaggcatcagtgtttccacataggagagaaatgctataggaatggtgacagtggtgagggcttcagtcagggctcacatctgcaacctcatcagagagtcagcacaggagagaacctctacagatgtcaggtatatgcccggagctccaaccagaactcctgtcttccctctcatgagcttactcacccaggagagaagttgtgtacatgtggcaggtgtgggaagggcttccatcatagcttagattttgacattcactgtgtagacagtgctggagagagagcctgtaaatgtgatgtatatgataaaggcttcagtcagacatcacaacttcaagcccatcagagaggtcactctagagacaagacatacaaatgggaagtaagtgacaggatatttaataggaattctggtcttcaccagagagttcacactggagagaaaccatataaatgtgaggtatgtgataagggcttcagtaaggcctcaaatcttcaagcccatcagagaatccacactggagagaaaccctacaaatgtgatgtgtgtgataagaacttcagccgtaattcccaccttcaggcccatcagagagtccatacaggagagaaaccctacaaatgtgacacatgtgggaaggacttcagtcagatctctcatcttcaggcccatcagagagttcacaaaggagagaagccatacaaatgtgagacatgtgggaagggctttagtcagagttcgcatctccaagaccatcagcaagtccatactggagagaatccctacaaatgtgatgtgtgtgggaaaggcttcagttggagttcacatcttcaagcccatcagagagtccacacaggagagaaaccatacaaatgtgaagaatgtaggaaaggcttcatctggaactcatatcttcatgttcatcagaggatccacacgggagagaaaccctataaatgtggcatgtgtggtaagagcttcagtcagacttcacatcttcaagcccatcagagagtccatactggagagaaaccatacaaatgttttgtgtgtggtaagggctttagtaagagttcgttgtcttcagattcatcagagagtccatga

SEQ ID NO: 2854 - DNA, 2782 bp, Homo sapiens
ctatcccctctgggaggtgagtcagcgcggaacctctgcatctacggcgagctttcctggcctgggcgttggactcgcagttctgccttcccaggaccctgcccttccccagaaggagcaggagaaaatgaccaagtttcaggagatggtgacattcaaggatgtggctgtggtcttcaccagggaggagctggggttgctggaccttgcccagagaaagctgtaccaagatgtgatgctggagaacttcaggaacctgctgtcagtgggctatcaacccttcaaactagatgtgatattacagttgggaaaagaagacaagcttcggatgatggagacagaaatccaaggagatgggtgttcaggacacaagaatcaaaatgagatagatacccttcaagaagtaagattaagattcctttcatatgaagaccttatatgctggcaaatatgggaacaatttacaagtaaattaaccagtaatcaagacctaataataaatcttcaaggcaagaggtccaagttgctaaaacaaggtgattccccctgtcaggtgtggacaggagaatctagtcaggtctctgaagatgagaactatgtaataaagctacaaggggagagttcaaatagcataaaaaatcaagagcttccattgaggaccacctgggatttctggaggaaaatgtatctgagagaaccacagaattatcagagtaggtgtcagcaaattgatgtaaaaaataagctctgtaaatgtgatcattgtgttaggcaaagaattgctcatcaacatgatgatcatggagtacacaaaagagagaaagcttttagccacaataattgtggaaaagactgtgtgaaggaatcatcccagcatagcataatccaatcaggagagcaaacctctgatgaaaatggaaaaggcttaagtgttggctctaatcttgaacttcaccagcaactacacttaagagacaagcctcatgtaaatgttgagtacgggaagggcataggttacagctcagggcttcccaggcatcagtgtttccacataggagagaaatgctataggaatggtgacagtggtgagggcttcagtcagggctcacatctgcaacctcatcagagagtcagcacaggagagaacctctacagatgtcaggtatatgcccggagctccaaccagaactcctgtcttccctctcatgagcttactcacccaggagagaagttgtgtacatgtggcaggtgtgggaagggcttccatcatagcttagattttgacattcactgtgtagacagtgctggagagagagcctgtaaatgtgatgtatatgataaaggcttcagtcagacatcacaacttcaagcccatcagagaggtcactctagagacaagacatacaaatgggaagtaagtgacaggatatttaataggaattctggtcttcaccagagagttcacactggagagaaaccatataaatgtgaggtatgtgataagggcttcagtaaggcctcaaatcttcaagcccatcagagaatccacactggagagaaaccctacaaatgtgatgtgtgtgataagaacttcagccgtaattcccaccttcaggcccatcagagagtccatacaggagagaaaccctacaaatgtgacacatgtgggaaggacttcagtcagatctctcatcttcaggcccatcagagagttcacaaaggagagaagccatacaaatgtgagacatgtgggaagggctttagtcagagttcgcatctccaagaccatcagcaagtccatactggagagaatccctacaaatgtgatgtgtgtgggaaaggcttcagttggagttcacatcttcaagcccatcagagagtccacacaggagagaaaccatacaaatgtgaagaatgtaggaaaggcttcatctggaactcatatcttcatgttcatcagaggatccacacgggagagaaaccctataaatgtggcatgtgtggtaagagcttcagtcagacttcacatcttcaagcccatcagagagtccatactggagagaaaccatacaaatgttttgtgtgtggtaagggctttagtaagagttcgttgtcttcagattcatcagagagtccatgatggtgatgaatctattaatcatgatgagtgtgataggggtgctcttcaagacttagacttcccattttcctcagaaaatccacacagcacagaatatttataaaatgtcatgttttaagaattcatgagctgagtttttatagttatctgaattccattgaagaaaacctatttttgtatgaatatgaccagtttcaagcagagcccaaaatgtcacagttgtcaagagaacacacaacagagaaaccctataaagaatgatacaatatgtttcaatcagaaccttcacatccaataagcaatatgcaggagtgaagccttcaaaatgataagtaaggtcagaatttagcaaaagtataatgagggacatgacaaaatctgtgtccactagaatctaagctccatgcaggaacattgtttactgctgcatgatcgtgaccttgaacaagtacctaagaaatagtggcttccctggaattgtttaacttgataggaaaaatctatcatatataggacatatatttgaatattttagtgagctcagccccaattcgtcattataattgtactgggaaaaggattcttgcaagaagccttaaaatgaattcaaggaaatgacatttaattaaaacacataaaacc

SEQ ID NO: 2855 - DNA, 318 bp, Homo sapiens
ggacacaagaatcaaaatgagatagatacccttcaagaagtaagattaagattcctttcatatgaagaccttatatgctggcaaatatgggaacaatttacaagtaaattaaccagtaatcaagacctaataataaatcttcaaggcaagaggtccaagttgctaaaacaaggtgattccccctgtcaggtgtggacaggagaatctagtcaggtctctgaagatgagaactatgtaataaagctacaaggggagagttcaaatagcataaaaaatcaagagcttccatctcaaaaaaaaaaaaaaaaaaaaaaaaaa

SEQ ID NO: 2856 - DNA, 3190 bp, Homo sapiens
ggaggcacttccgctccaggaaggcgaggtcggatctgagatatctcccagggaggttcacttccccggaactctgccttttcccagaaggaggaggggaaaaatgaccaagttccaggaggcagtgacattcaaggatgtggctgtggccttcactgaggaggagctggggctgctggactctgcccagaggaagctgtaccgagatgtgatgctggagaactttaggaacctggtttcagtgggacatcagtccttcaaaccagatatgatatcccagttggagagggaagaaaagctttggatgaaggagcttcaaacccaaagaggtaagcattcaggagacaggaatcaaaatgagatggcaactcttcacaaagcaggattaaggtgcttttcactgggagagctttcatgctggcaaatcaagagacacattgcgagcaaattagccagaagtcaagactccatgataaatattgaaggaaagagctctcagttccccaagcaccatgattccccctgtcaagtgggagcaggagaatctattcaagcttctgtggatgacaactgtctagtgaatcacataggggatcattccagtatcattgaaaatcaagaatttccaactgggaaagttccgaattcttggagtaaaatatatctgaatgagacacagaattatcagagaagttgtaagcagactcagatgaaaaacaaactatgtatatttgctccatatgttgacattttcagttgtatttcacaccaccatgatgataatatagtgcacaaaagagataaagttcatagcaatagtgattgtggtaaagataccctaaaggtatcacctcttacccagcgtagtattcacacaggacagaaaacctaccagggtaatgaatgtgaagaagccttcaatgatagctccagtcttgaacttcataaacaggtacacttgggaaagaagtctccagcgtgtagtacacatgagaaggacaccagttatagctcaggtattcctgttcaacaaagtgttcgtactgggaaaaaacgctattggtgtcatgaatgtggtaaaggtttcagtcagagctcaaatctgcaaactcatcagagagtccacacaggggagaaaccctatacatgccacgagtgtggtaagagctttaatcagagctcacatctttatgctcatttgcctattcacacaggagagaagccctatagatgtgacagttgtgggaagggcttcagtcgtagcacagatcttaacattcattgcagagttcacactggagagaaaccttataaatgtgaggtgtgtgggaagggcttcactcagagatcacatcttcaggcccatgaaagaattcacactggagagaaaccatataaatgtggggattgtggtaaacgctttagttgtagctcaaatcttcatacccatcagagagtccacactgaagaaaaaccatacaaatgtgatgagtgtggtaagtgctttagtttgagctttaatcttcatagtcatcaacgagtccacacaggagaaaaaccatataaatgtgaagagtgtggtaagggttttagttcagcctcaagtttccagagccatcagagggtccatacaggagagaaaccatttcgatgcaacgtgtgtgggaaaggcttcagtcagagttcatactttcaagcacatcagagagtccacactggagaaaaaccatacaaatgtgaagtgtgtgggaagcgcttcaattggagcttgaatcttcacaatcatcagagagtccacaccggagagaaaccctacaaatgtgaagagtgtggtaagggtttcagtcaggcttcaaatcttcaagcccatcagagcgtccacactggggaaaaaccattcaagtgtgatgcatgtcagaagcgattcagtcaggcctcacaccttcaagcccatcagagagtccacaccggagagaaaccatataaatgtgacacttgtggtaaggccttcagccagaggtcaaatcttcaagtccatcagataattcacactggagagaaaccatttaaatgtgaggaatgtgggaaagaattcagttggagtgctggtctcagtgcccatcagagggtccacacaggagagaaaccctatacgtgtcagcagtgtgggaagggcttcagtcaggcctcacattttcacacacaccagagagtccacactggagagaggccttacatatgtgatgtctgttgtaagggcttcagtcagaggtcacatctcatctaccatcagagagtccacactggagggaatctgtagaaatgagaggtgtggttcagccttcagttagagctcacatctttgtctccgttgggaagtccatgctgatgattgtgaaaagttcctttaaaactagaagcttcaaagaatcttgacaggaaagaagtctctcaaatgctgtgttttagacttggttaggacatgaattctttacaaacgtcatatttcacagatgcgagaaaactttgttctgtaaatatgatcagtgtttatatcagagtaccaggtgtcccggttctcaagatgtaacacagcagaaaagtcttgtcggagtctgcacaggagagaggccttcctttaacaaaagtatgattgacagaaaaaatggatgtcaactaaaatgtaacctctatgtaaggaggtgtttttcaccactctatctctaccatgtagaattgtgcttggctcataatagggcccagcaattactgaagaaagtgaagaaaatacctataattaggacaaatacttgaaaattctagtctgttttctactctaaatttatattaatttatattcaaaaggaatcctgcaagtagccttaataacgttagtttcagtaagtactgaaaagtatataatactgccatccatactaacacaaatttggaaaaaagacatgaatggctcccatccttcagccttagttctttgtacagtgtatcatcagttgtgtacagtatgatttttagtgtcagtttatagactgaacaatactgtttttatctaatgtgaccctgcaatttacatgattagaatttttggacactaagctgtactgtaactctgaaagtgttaaaagtagttactgatgacaaaaagtttcttagtaaacttgaattgttaata

SEQ ID NO: 2857 - DNA, 1764 bp, Homo sapiens
tcaggagacaggaatcaaaatgagatggcaactcttcacaaagcaggattaaggtgcttttcactgggagagctttcatgctggcaaatcaagagacacattgcgagcaaattagccagaagtcaagactccatgataaatattgaaggaaagagctctcagttccccaagcaccatgattccccctgtcaagtgggagcaggagaatctattcaagcttctgtggatgacaactgtctagtgaatcacataggggatcattccagtatcattgaaaatcaagaatttccaactgggaaagttccgaattcttggagtaaaatatatctgaatgagacacagaattatcagagaagttgtaagcagactcagatgaaaaacaaactatgtatatttgctccatatgttgacattttcagttgtatttcacaccaccatgatgataatatagtgcacaaaagagataaagttcatagcaatagtgattgtggtaaagataccctaaaggtatcacctcttacccagcgtagtattcacacaggacagaaaacctaccagggtaatgaatgtgaagaagccttcaatgatagctccagtcttgaacttcataaacaggtacacttgggaaagaagtctccagcgtgtagtacacatgagaaggacaccagttatagctcaggtattcctgttcaacaaagtgttcgtactgggaaaaaacgctattggtgtcatgaatgtggtaaaggtttcagtcagagctcaaatctgcaaactcatcagagagtccacacaggggagaaaccctatacatgccacgagtgtggtaagagctttaatcagagctcacatctttatgctcatttgcctattcacacaggagagaagccctatagatgtgacagttgtgggaagggcttcagtcgtagcacagatcttaacattcattgcagagttcacactggagagaaaccttataaatgtgaggtgtgtgggaagggcttcactcagagatcacatcttcaggcccatgaaagaattcacactggagagaaaccatataaatctcaaatcttcatacccatcagagactttaatcttcatagtcatcaacgagtccacacaggagaaaaaccatataaatgtgaagagtgtggtaagggttttagttcagcctcaagtttccagagccatcagagggtccatacaggagagaaaccatttcgatgcaacgtgtgtgggaaaggcttcagtcagagttcatactttcaagcacatcagagagtccacactggagaaaaaccatacaaatgtgaagtgtgtgggaagcgcttcaattggagcttgaatcttcacaatcatcagagagtccacaccggagagaaaccctacaaatgtgaagagtgtggtaagggtttcagtcaggcttcaaatcttcaagcccatcagagcgtccacactggggaaaaaccattcaagtgtgatgcatgtcagaagcgattcagtcaggcctcacaccttcaagcccatcagagagtccacaccggagagaaaccatataaatgtgacacttgtggtaaggccttcagccagaggtcaaatcttcaagtccatcagataattcacactggagagaaaccatttaaatgtgaggaatgtgggaaagaattcagttggagtgctggtctcagtgcccatcagagggtccacacaggagagaaaccctatacgtgtcagcagtgtgggaagggcttcagtcaggcctca

SEQ ID NO: 2858 - DNA, 3087 bp, Homo sapiens
atgggaagaattcaggaggcagtgacattcaaggatgtggctgtggccttcactgaggaggagctggggctgctggactctgcccagaggaagctgtaccgagatgtgatgctggagaactttaggaacctggtttcagtgggacatcagtccttcaaaccagatatgatatcccagttggagagggaagaaaagctttggatgaaggagcttcaaacccaaagaggtaagcattcaggagacaggaatcaaaatgagatggcaactcttcacaaagcaggattaaggtgcttttcactgggagagctttcatgctggcaaatcaagagacacattgcgagcaaattagccagaagtcaagactccatgataaatattgaaggaaagagctctcagttccccaagcaccatgattccccctgtcaagtgggagcaggagaatctattcaagcttctgtggatgacaactgtctagtgaatcacataggggatcattccagtatcattgaaaatcaagaatttccaactgggaaagttccgaattcttggagtaaaatatatctgaatgagacacagaattatcagagaagttgtaagcagactcagatgaaaaacaaactatgtatatttgctccatatgttgacattttcagttgtatttcacaccaccatgatgataatatagtgcacaaaagagataaagttcatagcaatagtgattgtggtaaagataccctaaaggtatcacctcttacccagcgtagtattcacacaggacagaaaacctaccagggtaatgaatgtgaagaagccttcaatgatagctccagtcttgaacttcataaacaggtacacttgggaaagaagtctccagcgtgtagtacacatgagaaggacaccagttatagctcaggtattcctgttcaacaaagtgttcgtactgggaaaaaacgctattggtgtcatgaatgtggtaaaggtttcagtcagagctcaaatctgcaaactcatcagagagtccacacaggggagaaaccctatacatgccacgagtgtggtaagagctttaatcagagctcacatctttatgctcatttgcctattcacacaggagagaagccctatagatgtgacagttgtgggaagggcttcagtcgtagcacagatcttaacattcattgcagagttcacactggagagaaaccttataaatgtgaggtgtgtgggaagggcttcactcagagatcacatcttcaggcccatgaaagaattcacactggagagaaaccatataaatgtggggattgtggtaaacgctttagttgtagctcaaatcttcatacccatcagagagtccacactgaagaaaaaccatacaaatgtgatgagtgtggtaagtgctttagtttgagctttaatcttcatagtcatcaacgagtccacacaggagaaaaaccatataaatgtgaagagtgtggtaagggttttagttcagcctcaagtttccagagccatcagagggtccatacaggagagaaaccatttcgatgcaacgtgtgtgggaaaggcttcagtcagagttcatactttcaagcacatcagagagtccacactggagaaaaaccatacaaatgtgaagtgtgtgggaagcgcttcaattggagcttgaatcttcacaatcatcagagagtccacaccggagagaaaccctacaaatgtgaagagtgtggtaagggtttcagtcaggcttcaaatcttcaagcccatcagagcgtccacactggggaaaaaccattcaagtgtgatgcatgtcagaagcgattcagtcaggcctcacaccttcaagcccatcagagagtccacaccggagagaaaccatataaatgtgacacttgtggtaaggccttcagccagaggtcaaatcttcaagtccatcagataattcacactggagagaaaccatttaaatgtgaggaatgtgggaaagaattcagttggagtgctggtctcagtgcccatcagagggtccacacaggagagaaaccctatacgtgtcagcagtgtgggaagggcttcagtcaggcctcacattttcacacacaccagagagtccacactggagagaggccttacatatgtgatgtctgttgtaagggcttcagtcagaggtcacatctcatctaccatcagagagtccacactggagggaatctgtagaaatgagaggtgtggttcagccttcagttagagctcacatctttgtctccgttgggaagtccatgctgatgattgtgaaaagttcctttaaaactagaagcttcaaagaatcttgacaggaaagaagtctctcaaatgctgtgttttagacttggttaggacatgaattctttacaaacgtcatatttcacagatgcgagaaaactttgttctgtaaatatgatcagtgtttatatcagagtaccaggtgtcccggttctcaagatgtaacacagcagaaaagtcttgtcggagtctgcacaggagagaggccttcctttaacaaaagtatgattgacagaaaaaatggatgtcaactaaaatgtaacctctatgtaaggaggtgtttttcaccactctatctctaccatgtagaattgtgcttggctcataatagggcccagcaattactgaagaaagtgaagaaaatacctataattaggacaaatacttgaaaattctagtctgttttctactctaaatttatattaatttatattcaaaaggaatcctgcaagtagccttaataacgttagtttcagtaagtactgaaaagtatataatactgccatccatactaacacaaatttggaaaaaagacatgaatggctcccatccttcagccttagttctttgtacagtgtatcatcagttgtgtacagtatgatttttagtgtcagtttatagactgaacaatactgtttttatctaatgtgaccctgcaatttacatgattagaatttttggacactaagctgtactgtaactctgaaagtgttaaaagtagttactgatgacaaaaagtttcttagtaaacttgaattgttaata

SEQ ID NO: 2859 - DNA, 546 bp, Homo sapiens
atgggaagaattcaggaggcagtgacattcaaggatgtggctgtggccttcactgaggaggagctggggctgctggactctgcccagaggaagctgtaccgagatgtgatgctggagaactttaggaacctggtttcagtgggacatcagtccttcaaaccagatatgatatcccagttggagagggaagaaaagctttggatgaaggagcttcaaacccaaagaggagacaggaatcaaaatgagatggcaactcttcacaaagcaggattaaggtgcttttcactgggagagctttcatgctggcaaatcaagagacacattgcgagcaaattagccagaagtcaagactccatgataaatattgaaggaaagagctctcagttccccaagcaccatgattccccctgtcaagtgggagcaggagaatctattcaagcttctgtggatgacaactgtctagtgaatcacataggggatcattccagtatcattgaaaatcaagaatttccaactggcaaaaaaaaaaagaaaaagaaacagtaa

SEQ ID NO: 2860 - DNA, 2025 bp, Homo sapiens
gctccaggcgagtccttccctggactccagtcccttgtgggaaacaatccctcgcctccggaggcggcgaggagcggcggaacctaaattggtaataaatcaataagaaatatttacattcactcagtgaaaagtgtcatgtctgagctcagcatatatcggagccacacatggacacctctccttcctccactaagagcggaaaatgaacaaatcccaggaacaagtgtcattcaaggatgtatgtgtggacttcactcaggaagagtggtatctgctggaccctgctcagaagattctatacagagatgtgatcctggaaaattatagcaatcttgtctcagtagggtattgcattactaaaccagaagtgatctttaagatcgagcaaggagaagagccctggatattagaaaaaggattcccaagccagtgccacccagaaaggaaatggaaagttgatgacgtgttagagagcagccaggaaaatgaagatgaccatttttgggagcttctattccacaacaacaaaacagtaagtgtagaaaatggagatagaggaagcaaaactttcaatttgggcacagaccctgtttctttaagaaattatccctataaaatatgtgactcatgtgaaatgaatttgaaaaatatttcgggcttaattattagtaaaaagaactgttccagaaagaagcctgatgagtttaatgtatgtgagaaattgctccttgatattaggcatgagaaaatccctattggagagaagtcttataaatatgatcaaaaaaggaatgccattaattatcaccaggatctcagtcagccaagttttggccaatcttttgagtatagtaaaaatggacaaggcttccatgatgaggcagcattttttacaaataagagatctcagataggagagacagtctgtaaatataacgaatgtggaagaaccttcattgaaagtttaaagctgaatatatctcaaagacctcatttggaaatggagccgtatggatgcagtatttgcgggaagtccttctgcatgaatttaaggtttggacatcagagagctcttacaaaggacaatccttatgaatataatgaatatggggaaatcttctgtgacaattcagctttcattatccatcagggagcttacacaagaaagattctccgtgaatataaagtgagtgacaaaacctgggaaaagtcagctctcttaaaacatcaaatagtacacatggggggaaagtcttatgattacaatgaaaatgggagtaatttcagcaagaagtcacatcttacccagcttcggagagctcacacaggagaaaaaacctttgaatgtggtgaatgtgggaaaaccttctgggagaagtcaaacctcactcaacatcagagaacacacacaggagagaagccctatgaatgtactgaatgtgggaaagccttttgccagaaaccacacctgaccaaccatcagcgaacacatacaggagaaaaaccctatgaatgtaagcaatgtggaaaaacattctgtgtgaagtcaaacctcactgaacatcagagaacacacacaggggagaagccctatgaatgtaatgcatgtgggaaatccttctgccacagatcagccctcactgtgcatcagagaacacacacaggggagaaaccgtttatatgtaatgaatgtggaaaatccttctgtgtgaagtcaaacctcattgtacatcaaagaactcacactggggagaaaccatataagtgtaatgaatgtgggaaaaccttctgtgaaaaatcagctctcactaaacatcagaggactcacacaggggagaagccgtatgagtgtaatgcatgtgggaagacctttagtcagaggtcagtgctcaccaaacatcagagaattcacacaagggtgaaagctctttcaacatcctgaatgttagaagccttcatacacttgtgaaattggttatacagtttcaaaaaaggagatcagagaaagccaaagaatgtcag

SEQ ID NO: 2861 - DNA, 1286 bp, Homo sapiens
caattatccacgggagactcggttttcctctctgtaaattacggatattaggaatacttgccgcctggggttgttttgagcactttcattgtttaggtgctgtatttattgggtgtgcgttccctgggagagcccgagggagacggctcctgcaccggccccaagggcctctctgcccgtggagtgcaggagcgaaggggctggcctagctgaccaccagggcccctgctggctctgaccgccctcctatcccaagtaattatttacacgtttcgcgttcgcttatgtattatgtgtaatcatggcacagtatcctgaagccgtcggagtctgtgtgctggtgcaaggtctgggacaaatttaagaagagagagaacctaaattggtaataaatcaataagaaatatttacattcactcagtgaaaagtgtcatgtctgagctcagcatatatcggagccacacatggacacctctccttcctccactaagagcggaaaatgaacaaatcccaggaacaagtgtcattcaaggatgtatgtgtggacttcactcaggaagagtggtatctgctggaccctgctcagaagattctatacagagatgtgatcctggaaaattatagcaatcttgtctcagtagggtattgcattactaaaccagaagtgatctttaagatcgagcaaggagaagagccctggatattagaaaaaggattcccaagccagtgccacccagaaaggaaatggaaagttgatgacgtgttagagagcagccaggaaaatgaagatgaccatttttgggagcttctattccacaacaacaaaacatggaatctgaagcttataaaagttgaatgacagcagcattaaacatatatgtgaagagtccccgatgtttgtagaccttatgtgagtatgcaaatatataaatttgagtatgcttgatttgtatattggaactcaacatgatcataaggagaagatacgtacccttaattgagtaactactatggtatttgttaatattttctacactaaataccattggtgtctttataggttgacataattatatatgtgtatgtacatatgtttgtgtgtatatgtaaatatatttctacacacatacttaaatatagtgatgtgctagtataacctcatactgacttaaaagttctgattgttaaattttaaggaattttgtgagccagttattaaaagcagtcattatttaaaatatgtaaacttacagttaaaaacaaaggtaataaatactcagcactca

SEQ ID NO: 2862 - DNA, 5141 bp, Homo sapiens
ggggctgcgggggagagcgactgcgccaggtccgcgacaaatgaattagacacaattatccacgggagactcggttttcctctctgtaaattacggatattaggaatacttgccgcctggggttgttttgagcactttcattgtttaggtgctgtatttattgggtgtgcgttccctgggagagcccgagggagacggctcctgcaccggccccaagggcctctctgcccgtggagtgcaggagcgaaggggctggcctagctgaccaccagggcccctgctggctctgaccgccctcctatcccaagtaattatttacacgtttcgcgttcgcttatgtattatgtgtaatcatggcacagtatcctgaagccgtcggagtctgtgtgctggtgcaaggtctgggacaaatttaagaagagagagaacctaaattggtaataaatcaataagaaatatttacattcactcagtgaaaagtgtcatgtctgagctcagcatatatcggagccacacatggacacctctccttcctccactaagagcggaaaatgaacaaatcccaggaacaagtgtcattcaaggatgtatgtgtggacttcactcaggaagagtggtatctgctggaccctgctcagaagattctatacagagatgtgatcctggaaaattatagcaatcttgtctcagtagggtattgcattactaaaccagaagtgatctttaagatcgagcaaggagaagagccctggatattagaaaaaggattcccaagccagtgccacccagaaaggaaatggaaagttgatgacgtgttagagagcagccaggaaaatgaagatgaccatttttgggagcttctattccacaacaacaaaacagtaagtgtagaaaatggagatagaggaagcaaaactttcaatttgggcacagaccctgtttctttaagaaattatccctataaaatatgtgactcatgtgaaatgaatttgaaaaatatttcgggcttaattattagtaaaaagaactgttccagaaagaagcctgatgagtttaatgtatgtgagaaattgctccttgatattaggcatgagaaaatccctattggagagaagtcttataaatatgatcaaaaaaggaatgccattaattatcaccaggatctcagtcagccaagttttggccaatcttttgagtatagtaaaaatggacaaggcttccatgatgaggcagcattttttacaaataagagatctcagataggagagacagtctgtaaatataacgaatgtggaagaaccttcattgaaagtttaaagctgaatatatctcaaagacctcatttggaaatggagccgtatggatgcagtatttgcgggaagtccttctgcatgaatttaaggtttggacatcagagagctcttacaaaggacaatccttatgaatataatgaatatggggaaatcttctgtgacaattcagctttcattatccatcagggagcttacacaagaaagattctccgtgaatataaagtgagtgacaaaacctgggaaaagtcagctctcttaaaacatcaaatagtacacatggggggaaagtcttatgattacaatgaaaatgggagtaatttcagcaagaagtcacatcttacccagcttcggagagctcacacaggagaaaaaacctttgaatgtggtgaatgtgggaaaaccttctgggagaagtcaaacctcactcaacatcagagaacacacacaggagagaagccctatgaatgtactgaatgtgggaaagccttttgccagaaaccacacctgaccaaccatcagcgaacacatacaggagaaaaaccctatgaatgtaagcaatgtggaaaaacattctgtgtgaagtcaaacctcactgaacatcagagaacacacacaggggagaagccctatgaatgtaatgcatgtgggaaatccttctgccacagatcagccctcactgtgcatcagagaacacacacaggggagaaaccgtttatatgtaatgaatgtggaaaatccttctgtgtgaagtcaaacctcattgtacatcaaagaactcacactggggagaaaccatataagtgtaatgaatgtgggaaaaccttctgtgaaaaatcagctctcactaaacatcagaggactcacacaggggagaagccgtatgagtgtaatgcatgtgggaagacctttagtcagaggtcagtgctcaccaaacatcagagaattcacacaagggtgaaagctctttcaacatcctgaatgttagaagccttcatacacttgtgaaattggttatacagtttcaaaaaaggagatcagagaaagccaaagaatgtcagaaatttgtagaaaatgacttcttgtttgaatatgtaaaagctttcaagaaaaattaaaacttttcattagaaaatttgtactgaggggaattctattcatctaagtaatatggtgaaaatatttatctggaatttatgttgtttagtgttatattccagacgtgataccaaaattttgttgcaaatataatggacaatatttatttatacccatattcacagtggaatctgaagcttataaaagttgaatgacagcagcattaaacatatatgtgaagagtccccgatgtttgtagaccttatgtgagtatgcaaatatataaatttgagtatgcttgatttgtatattggaactcaacatgatcataaggagaagatacgtacccttaattgagtaactactatggtatttgttaatattttctacactaaataccattggtgtctttataggttgacataattatatatgtgtatgtacatatgtttgtgtgtatatgtaaatatatttctacacacatacttaaatatagtgatgtgctagtataacctcatactgacttaaaagttctgattgttaaattttaaggaattttgtgagccagttattaaaagcagtcattatttaaaatatgtaaacttacagttaaaaacaaaggtaataaatactcagcactcatcacttcctaattattttgctacatttcactattacctttgctgttttacttatttaatctgtatgatgaaaatactgtataatagtgtgcactgcacatctgtctcttcccagctccacattcagtgctgtcttggtagcttggacttagtgggagtgtttacaccatggaaattgacaaactataaatcagggttttaattttctcagagaacctgctgtcaaatatttacagcacatcactgtgtatatatgaaaacgtatttggcaatacaaaccacataccccttctatttcctgacataaataaatggctatggccatttacagctgaaccacgtcttcaagaaagaagccaaaaatatttccgtgaggtttttaactacctctgaatctgtcctactctaaatactaccggagtctctttgtaggttggccagtatatgtttttagtgaaatattatttcacaaagaactatatcacgtacctttcctctgactgtttcctggcatatatgcatgaatatggccattattgaactatcacttcagtaaagaagttaaacagtacttttctgaggtttttcagctacctctgggtcattctgtaatgtaaatgttgttaataagaatggtttttacataaattatgcaaaggttaacaagcagtaacactgcactcctcaaaaagtggcggtatgtaatgaaaggcccttttgatatccttgatttttcattgtgtatctgtttgggcacggtctatgtaacactagttctgcgtattagtattttagagtatctctgcctcccttgtcctgttgtttcttttgcccccttggaacacattggtcagcagttctaagagacactgcccacatgatggccattccctacttcatccttgctgagctaaattttatatttttgtgcatccttctcccagatgacttaggtggtaagtccagattagtcaaagctaatcatggaagttccattttaatgattctgttggggtgaacttgggagcaatgagatgtttgggaagtattgtgtagtacttctgggaaagatctccttgatacaacattgtcatgacatgagaagagactctgctgggctttttcatgtctgtaacatggtattggcttatcgtttttatctctgaagggcagtagcctgaagataacagtgcacaaggtgggaaaagccagctcagaggtgacgttgccgagctactctgctctctatacctgttctctactgggactttttataaccctcaataactgttttttatttggtcttagggctgtctgatacttagagctgaaggcattccagctgacacagaggaatatttttctaagtgttaatgttctatatggtaattagggggaagaattatttcttttcacaagttaatatagggatggctgtttgtatcagccatggttctttctggtggaaaacagaattctccaactaaaaatattttaatggcagactgattacagtggtgtgggccagaaacaagggacagtgaaacacccagagacttgtatcagcaggaagccattgccattctgagccttgaagggcaaggagggaaacagtgttaccagagcccagtaagaactgctgtcatgaaggaggggccaccttgtaagagacatcattactaccagaactgtggtgccaaattgctggtgtctctctttggagaaaccaaccagatacatctgctggagagcccaggtgggcacagagaagggtggagagagaatctgggaagagaaatggagaataagcagcacagtgttattcatttctgtaaattcctatgtagaaggctcagtgttagaaataaagttattctactagttgcaagttaagtgtttctgtttgttctgctttcctgttagcataagtaaactccctttggaactacacaggtatgtctctccttcaacatgtgtgaagcagacattatattaaattacattattcatacctccctgtggtgtttcttattgtatgtggtgtaaggtaagcagctctgtattcttccaaataaatagccagttgtccctg

SEQ ID NO: 2863 - DNA, 698 bp, Homo sapiens
tccctcgcctccggaggcggcgaggagcggcgggtgagccccggagcactgggcgagggccagggggtccccgcgctgccctgaaggcgggcgggcggcggctagacctcggcggtggggagggacccctggcgcctgcggcgacggtgggacgagggcgtctctgtcagaaggggatgaggtctggcgtgggaacgcgagttccggggctcccgggggtccgtatgcgtccagtccctgcgcctggcgctcagcgaagtcctgtagcacgggaacctaaattggtaataaatcaataagaaatatttacattcactcagtgaaaagtgtcatgtctgagctcagcatatatcggagccacacatggacacctctccttcctccactaagagcggaaaatgaacaaatcccaggaacaagtgtcattcaaggatgtatgtgtggacttcactcaggaagagtggtatctgctggaccctgctcagaagattctatacagagatgtgatcctggaaaattatagcaatcttgtctcagtagggtattgcattactaaaccagaagtgatctttaagatcgagcaaggagaagagccctggatattagaaaaaggattcccaagccagtgccacccagaaaggaaatggaaagttgatgacgtgttagagagcagccaggaaaatgaagatgaccatttt

SEQ ID NO: 2864 - DNA, 436 bp, Homo sapiens
cgcatgtgcatccccgcctcccgctccaggcgagtccttccctggactccagtcccttgtgggaaacaatccctcgcctccggaggcggcgaggagcggcggaacctaaattggtaataaatcaataagaaatatttacattcactcagtgaaaagtgtcatgtctgagctcagcatatatcggagccacacatggacacctctccttcctccactaagagcggaaaatgaacaaatcccaggaacaagtgtcattcaaggatgtatgtgtggacttcactcaggaagagtggtatctgctggaccctgctcagaagattctatacagagatgtgatcctggaaaattatagcaatcttgtctcagtagggtattgcattactaaaccagaagtgatctttaagatcgagcaaggagaagagccctggatattaga

SEQ ID NO: 2865 - DNA, 6364 bp, Homo sapiens
agccctttgtctgaaggtgctgcgggatgccgttccttcgcgcgtgaggctgcggctctgacgccccataggctccttcaatttccgtgatcctcggagtccccaggagaccaggtgatggcagcagccagactcctgccagtgccggcaggaccccagcccctgtcgttccaggccaagctgaccttcgaggatgtggctgtgctcctctcccaggatgaatgggaccgcctgtgccctgctcagaggggtctctacagaaatgtgatgatggaaacctatgggaatgtagtctcattgggacttccaggatccaagcctgacataatctcccagctggagcgaggggaagatccctgggtcctggacaggaagggggctaagaagagccagggcctgtggagtgactactcagacaacctcaaatatgaccacactacagcctgtacacaacaagacagtttatcttgtccatgggaatgtgaaaccaagggagagagtcaaaatacagacttgagtccgaagccattaatttcagagcaaacagtgattctggggaaaacacccttggggaggattgatcaagaaaataatgaaacaaagcaaagcttctgtctgagtccaaactctgttgaccaccgtgaagttcaggtcttaagccaaagcatgccactcactccgcaccaggcagtgcctagtggagagaggccctacatgtgtgttgagtgtgggaagtgctttggccggagttcccacctccttcagcatcagcgtatccacactggagagaagccctatgtgtgcagtgtatgtgggaaggccttcagccagagctcagtccttagtaaacacaggagaattcacacaggtgagaagccctatgagtgtaatgagtgtggaaaagcctttagagtgagctcagatcttgctcagcatcacaagatacatacaggagagaagcctcacgaatgtcttgagtgtcggaaagccttcactcaactctcacatctcattcagcaccagcggatccacacgggagaaaggccatatgtgtgtccgttgtgtgggaaagccttcaaccatagcactgttctgcggagccaccagagggtacacactggggagaagcctcacaggtgcaatgagtgtgggaaaaccttcagtgtgaagaggacactgctgcagcaccagaggatccacaccggggagaagccctacacgtgcagcgagtgtgggaaggccttcagcgaccgctcagtcctcattcagcaccacaacgtgcacaccggggagaagccctatgagtgcagtgagtgtgggaagaccttcagccaccgctccacactgatgaatcacgagcggatccacaccgaggaaaagccctatgcatgctacgaatgtgggaaggccttcgttcagcactcacacctgatccagcaccagagagtccacactggggagaagccctatgtgtgtggtgaatgtgggcacgccttcagtgcacgccggtctctgatccagcatgagagaatccacacaggtgaaaagcccttccagtgcacagaatgtggcaaagccttcagcctgaaagcaactctgattgtgcacctgaggacccacacgggcgagaagccatatgagtgcaatagctgcgggaaggccttcagccagtactcagtgctcatccagcaccagcggatccacacaggcgagaagccctatgagtgcggggagtgtgggcgtgccttcaaccagcatggccacctaatccagcaccagaaagtgcacagaaagttgtgacccatggctgacacaagaatccattctcacagaaactgcatgtggaaccacaagcagccttcagcccaagagaagtctctgttaactctataggaagcttttctttggcgattcagtgtcacaaaataactccagaaagaagcacttagcgtgctgttcctgtggaaaaacttcagagactacctgttttattttcctcaacatcttgaagttatgttggagagtaatcatacaattgtagagaattttggtaaaaaacagccataattctttaacattagtttatttgaactaagggaatttaaggcataagaaccattatcccaataaaatcttacattccaaataaagttctttttctaagaacattacatgcccttcctaaatatcaattaaccatactaattattgcacttaaaatttgaaagtcggactattttcagtattctcttaaaagactaaagtattgtatggataaagtgatataaaaagatattttcatcaagcatcatgtaaaatggttggaaatcctaagtgtgtggatttccatcctaagtgtgtggagtcctgttttgtatgaaacaaggaaaaagcttatatattagtgagaaattacataaatttaaaaaactttttgtatgtgtgtgtggagatagtcttgctctgttgcccaagctgcagtgcagtggcatgatcttggctcactgcagtctccgcccccaccccaggttcaagcttttcttgtgcctcagtctcccaagtaactaggattatagatatgcgccaccacacctggctaatttttgtatttttagtagagacggagtttcaccgtgttggccaggctggtctcgaactcctggcctcaagtgatcctcccacctttgcttccgaaagtgttgggattacaggcgtgaggcaccatgcctggcctagaaaaccctttatctggagcttttaactttattcaagatcagaaaggttatgctaactttttagtaaaaattcaactcaaaaatgggtattttcctcaaaacttgcccttatgacctgcagatcctgtgccccagaaaccgtgagatgtctcaattcccatgcaggcaaaggaggggagcttcacactcagcagacctcatagctgttacaccaagtgggtacctctttacatcttatggtatttcccccaaaacaatgctgaaaatactgttctttggtagatatatttaaaacatacatttctcaaattcagatagctcttttttactatctctagtatttctattcctatatttgaaggggttttttttttcatttttttactcctggttcaagagtccagtatccattgccatattactatgatgaagatgaatctagtttattcataattaaaaatttgtattcagaattatttgttctgttttaagcatacttttttttttttttttgagacaaagtcttgctcttgttccccaggctgaagtgcaatggcacaatctcagctcactgcaatctccacctcccaggttcaagcaattctcctgcctctgcctcccaagtagctggaattacaggcacctgctaccacgcccgactaattttcgtatttttagtagagatgaggtttcaccatgttggccaggctggtctcaaactcctgacctcaggtgatccgcccgcctcggcctcccaaagtgctgggattacaggcgtgtgccaccgcacccggccaaggatacagttcttgaaaccgaatcagaaccatttctagtagcagccagctgcaaacgaaacaaatgtatgaggttcaagccacttgaaattctcaacatgttaagtgcctgagatagagaagggctgtcttcaccccaggcccccgcccccaacatctgtcagtttggtggggaggaaatagtcaccaggatattgatcctttttgtttgttttaaagacggtcttgctctgtcaccaggttggagtgcagtggtgccatcatggctcaccgctgcctcaaactcctgggctgaagcagtcctcccacctcaccttcccaaaaggttaggattacaggcatgagctgctgtgcccatccaggcattgatccttaagtccacagcaaaacaccacgatgtagacaaaagcttgttcccccttctatgtacagacactgacaacagtgaattattaactccagagaggaactggtaactgattggttaacttgagaaaggagctgacatcactggtgttttacttcagagcaactgaaaccactgaagtgaaattccagaggaactaatattactgaggtgttacttcagagggactgagatcactgaagtgaaacctcagatagctcagataaccaaggtgttaaccttagaggtgttgccattctgtgaggtgttgtttcagatagataaaataactaaggtgttagttcagagaagacaagagcttaactgtttctttggagaagagctgagatcactgaggcgtcacttcagaaagaaagtgagacaatttttgttacttcagaggatctgagtacactgaggtgtttcatcagagaggaggtgagatcactgggtgttacttctgaaaggaattgacatcactagtgggtactgcagagtagctctgaccactgaggtttacttcagaggagctgaaataacggaaatgggatcactaaggtattactttagagattagatcattgaggtaattcttcagagaagctgagatcacagaggtgtttcttcagagaagttgaaatcactaatgtgaaactctagaagaatggaggtcactgagtgctatttcataaaggaagtgaaatcactatattgtaccatcggaaagatgagaatgctgagatgttacttaggagctgagatcactgaggttctgcttcagagaaaagctgataccaatgagatgttacttaagggaggagctgaggttactgaggtattattcaggaccaagatggtgtccctcaggtgttagaagctgagatcacagagatgttacttaagagaggctgagactgctgatgtgattcttcagaaaggaaatgagatcactaagctgttaactttagaaaggagatgaaataactgagttgttcactggagttgagatcacacaggtgttaacttcagaggtggctgaaatcactaaggtgattcttcagagaaaggttgagatcactaggggtgatgctttagaaagaggttactttagggaaaagctatgatcactgagaagttacttcagaatggagctgagatcactgaggtaacagtccaaagaggaactgagattactgaggtgttacttcagagccaagagatcacccaggtacctagatgagatcactgagatgaaagtccagaaacctgaggtcacctcaatattaattgagagaaaatgagaacactgtggtgctatcttaaatcttctatgaaaggaagctgccaacctgtgttagctgagtccacagctggcatgtgactcagtggcagctgctcagtgcccactactattcaggccccaatttctaatcattaaagacaaagtcatattccaattaagatgagaataattaaattcaatatacaggaacatttgtttagaaagactgtgtatcacaggacaacgtaagttacacagtacaagttattctggattccaataacctagggttttcagggaaatccttccaaaaagtatagtttttttcctgcattcttaaaatgagcttaatatcattctgcctgttcttgctatgtcaggctgccattgatccactggtgagaatgcaggctcaggtgtccacggagccaggaagtgggcttcaatgcccttctttctgaggaggattcccaggctacattttcttgccactcacctcctcctctccaaggagaaagaggtggcacatgacctactggaacatgtgggctatctacctttttgggatataacatcaaaggccagggccctgaattttcatgctgataacagtcttctcaaccattatcttctgcctgatttgtcagcagcattccacctttattttggatttgttttattcagaagtctgtatattttaggtatttaaatacttctctttggctgggtgcaatggctcacacctgtaatcccagcactttgggaggctgaagtgggtggatcgcttgagcccaggactttgagaccagcatggcgaaaacccgtctctacaaaaaaaaaattagctgggtgttgtggcttgcgcctgtagtcccagatacgtgggaggctaaggtgggaggattgattgggagttcaagactagtgtgctgtgatcatactatctagcctggacaacagagagagaccttgtcacaaaaaatacgtatatatttcttttaaaattgtttcttctaacagctattaagaatttgaaacttggttctcttcaaattttctattattttggaaaacattttagtctgcctggaatttctgtgtataatctgacgctttccaataaaaaagtaatgactggaacaag

SEQ ID NO: 2866 - DNA, 1447 bp, Homo sapiens
gggcagccctttgtctgaaggtgctgcgggatgccgttccttcgcgcgtgaggctgcggctctgacgccccataggctccttcaatttccgtgatcctcggagtccccaggagaccaggtgatggcagcagccagactcctgccagtgccggcaggaccccaggccaagctgaccttcgaggatgtggctgtgctcctctcccaggatgaatgggaccgcctgtgccctgctcagaggggtctctacagaaatgtgatgatggaaacctatgggaatgtagtctcattgggacttccaggatccaagcctgacataatctcccagctggagcgaggggaagatccctgggtcctggacaggaagggggctaagaagagccagggcctgtggagtgactactcagacaacctcaaatatgaccacactacagcctgtacacaacaagacagtttatcttgtccatgggatcctgtgccccagaaaccgtgagatgtctcaattcccatgcaggcaaaggaggggagcttcacactcagcagacctcatagctgttacaccaatggcttctgctgtggctatcccatgtccggtgtgaggagacagtggtatgactcatccctttgtgtccggaattggtgggttcttggtctcactgacgtcaagaatgaagctgcggaccctcgtggcagctccagcaagtatcaatcccattgctggacatcacatccaacacccgtctccaattagtgggtgagtctctctttttttcctctccagattcctctcatatttctgggggttcaccagaaaattccagtaccaggtgagaggtctccctggtcaccaggtgaccgtggcctaccctctcaggggacgccgtcagaatgctcaccactttggccactgcagcctctgggggtctgcaaagagctgtagggacgccctggctctcctaggtcccttctcccaggaggaatcggggtactcactcccctccggggtattcacttccctctggggtacttccatcctctaaatttctcaccctctggccagcagtatggggcaacactcctcaaaacctcaagacaccactcttggatgtttccatccagaacctccaagcccagggcttggcagactccattaaaactgaacgccttgctggccaagtgtgatagttcatgcctgtaatctcagcactttgggaggccaaggtgggcagatcacaagatcaggagttcgagaccagcctggccaatatggtgaaaccctgtctctactaaaaatacaaaaattagccgggtgtggtggcaggtgcctgtaatcccagctacccaggaggctgaggcaggagaattgcttgaaccggggaggcagaggttgcagtgagccaagatcgttccactgcattccagtctgggtgacagagtgagactctgtctc

SEQ ID NO: 2867 - DNA, 1449 bp, Homo sapiens
agccctttgtctgaaggtgctgcgggatgccgttccttcgcgcgtgaggctgcggctctgacgccccataggctccttcaatttccgtgatcctcggagtccccaggagaccaggtgatggcagcagccagactcctgccagtgccggcaggaccccaggccaagctgaccttcgaggatgtggctgtgctcctctcccaggatgaatgggaccgcctgtgccctgctcagaggggtctctacagaaatgtgatgatggaaacctatgggaatgtagtctcattgggacttccaggatccaagcctgacataatctcccagctggagcgaggggaagatccctgggtcctggacaggaagggggctaagaagagccagggcctgtggagtgactactcagacaacctcaaatatgaccacactacagcctgtacacaacaagacagtttatcttgtccatgggaatgtgaaaccaagggagagagtcaaaatacagacttgagtccgaagccattaatttcagagcaaacagtgattctggggaaaacacccttggggaggattgatcaagaaaataatgaaacaaagcaaagcttctgtctgagtccaaactctgttgaccaccgtgaagttcaggtcttaagccaaagcatgccactcactccgcaccaggcagtgcctagtggagagaggccctacatgtgtgttgagtgtgggaagtgctttggccggagttcccacctccttcagcatcagcgtatccacactggagagaagccctatgtgtgcagtgtatgtgggaaggccttcagccagagctcagtccttagtaaacacaggagaattcacacaggtgagaagccctatgagtgtaatgagtgtggaaaagcctttagagtgagctcagatcttgctcagcatcacaagatacatacaggagagaagcctcacgaatgtcttgagtgtcggaaagccttcactcaactctcacatctcattcagcaccagcggatccacacgggagaaaggccatatgtgtgtccgttgtgtgggaaagccttcaaccatagcactgttctgcggagccaccagagggtacacactggggagaagcctcacaggtgcaatgagtgtgggaaaaccttcagtgtgaagaggacactgctgcagcaccagaggatccacaccggtgaaaagcccttccagtgcacagaatgtggcaaagccttcagcctgaaagcaactctgattgtgcacctgaggacccacacgggcgagaagccatatgagtgcaatagctgcgggaaggccttcagccagtactcagtgctcatccagcaccagcggatccacacaggcgagaagccctatgagtgcggggagtgtgggcgtgccttcaaccagcatggccacctaatccagcaccagaaagtgcacagaaagttgtga

SEQ ID NO: 2868 - DNA, 2131 bp, Homo sapiens
cgttccttcgcgcgtgaggctgcggctctgacgccccataggctccttcaatttccgtgatcctcggagtccccaggagaccaggtgatggcagcagccagactcctgccagtgccggcaggaccccaggccaagctgaccttcgaggatgtggctgtgctcctctcccaggatgaatgggaccgcctgtgccctgctcagaggggtctctacagaaatgtgatgatggaaacctatgggaatgtagtctcattgggacttccaggatccaagcctgacataatctcccagctggagcgaggggaagatccctgggtcctggacaggaagggggctaagaagagccagggcctgtggagtgactactcagacaacctcaaatatgaccacactacagcctgtacacaacaagacagtttatcttgtccatgggaatgtgaaaccaagggagagagtcaaaatacagacttgagtccgaagccattaatttcagagcaaacagtgattctggggaaaacacccttggggaggattgatcaagaaaataatgaaacaaagcaaagcttctgtctgagtccaaactctgttgaccaccgtgaagttcaggtcttaagccaaagcatgccactcactccgcaccaggcagtgcctagtggagagaggccctacatgtgtgttgagtgtgggaagtgctttggccggagttcccacctccttcagcatcagcgtatccacactggagagaagccctatgtgtgcagtgtatgtgggaaggccttcagccagagctcagtccttagtaaacacaggagaattcacacaggtgagaagccctatgagtgtaatgagtgtggaaaagcctttagagtgagctcagatcttgctcagcatcacaagatacatacaggagagaagcctcacgaatgtcttgagtgtcggaaagccttcactcaactctcacatctcattcagcaccagcggatccacacgggagaaaggccatatgtgtgtccgttgtgtgggaaagccttcaaccatagcactgttctgcggagccaccagagggtacacactggggagaagcctcacaggtgcaatgagtgtgggaaaaccttcagtgtgaagaggacactgctgcagcaccagaggatccacaccggggagaagccctacacgtgcagcgagtgtgggaaggccttcagcgaccgctcagtcctcattcagcaccacaacgtgcacaccggggagaagccctatgagtgcagtgagtgtgggaagaccttcagccaccgctccacactgatgaatcacgagcggatccacaccgaggaaaagccctatgcatgctacgaatgtgggaaggccttcgttcagcactcacacctgatccagcaccagagagtccacactggggagaagccctatgtgtgtggtgaatgtgggcacgccttcagtgcacgccggtctctgatccagcatgagagaatccacacaggtgaaaagcccttccagtgcacagaatgtggcaaagccttcagcctgaaagcaactctgattgtgcacctgaggacccacacgggcgagaagccatatgagtgcaatagctgcgggaaggccttcagccagtactcagtgctcatccagcaccagcggatccacacaggcgagaagccctatgagtgcggggagtgtgggcgtgccttcaaccagcatggccacctaatccagcaccagaaagtgcacagaaagttgtgacccatggctgacacaagaatccattctcacagaaactgcatgtggaaccacaagcagccttcagcccaagagaagtctctgttaactctataggaagcttttctttggcgattcagtgtcacaaaataactccagaaagaagcacttagcgtgctgttcctgtggaaaaacttcagagactacctgttttattttcctcaacatcttgaagttatgttggagagtaatcatacaattgtagagaattttggtaaaaaacagccataattctttaacattagtttatttgaactaagggaatttaaggcataagaaccattatcccaataaaatcttacattccaaataaagttctttttctaagaacattacatgc

SEQ ID NO: 2869 - DNA, 687 bp, Homo sapiens
gggcagccctttgtctgaaggtgctgcgggatgccgttccttcgcgcgtgaggctgcggctctgacgccccataggctccttcaatttccgtgatcctcggagtccccaggagaccaggtgatggcagcagccagactcctgccagtgccggcaggaccccaggccaagctgaccttcgaggatgtggctgtgctcctctcccaggatgaatgggaccgcctgtgccctgctcagaggggtctctacagaaatgtgatgatggaaacctatgggaatgtagtctcattgggacttccaggatccaagcctgacataatctcccagctggagcgaggggaagatccctgggtcctggacaggaagggggctaagaagagccagggcctgtggagtgactactcagacaacctcaaatatgaccacactacagcctgtacacaacaagacagtttatcttgtccatgggatcctgtgccccagaaaccgtgagatgtctcaattcccatgcaggcaaaggaggggagcttcacactcagcagacctcatagctgttacaccaatggcttctgctgtggctatcccatgtccggtgtgaggagacagtggtatgactcatccctttgtgtccggaattggtgggttcttggtctcactgacgtcaagaatgaagctgcggaccctcgtgg

SEQ ID NO: 2870 - DNA, 1316 bp, Homo sapiens
gcgcgtgaggctgcggctctgacgccccataggctccttcaatttccgtgatcctcggagtccccaggagaccaggtgatggcagcagccagactcctgccagtgccggcaggaccccagcccctgtcgttccaggccaagctgaccttcgaggatgtggctgtgctcctctcccaggatgaatgggaccgcctgtgccctgctcagaggggtctctacagaaatgtgatgatggaaacctatgggaatgtagtctcattgggacttccaggatccaagcctgacataatctcccagctggagcgaggggaagatccctgggtcctggacaggaagggggctaagaagagccagggcctgtggagtgactactcagacaacctcaaatatgaccacactacagcctgtacacaacaagacagtttatcttgtccatgggatcctgtgccccagaaaccgtgagatgtctcaattcccatgcaggcaaaggaggggagcttcacactcagcagacctcatagctgttacaccaatggcttctgctgtggctatcccatgtccggtgtgaggagacagtggtatgactcatccctttgtgtccggaattggtgggttcttggtctcactgacgtcaagaatgaagctgcggaccctcgtggtacagccagctctaatggcttccatttggcgtttccaaccataatagcctttaccagtcaaggagccaatgtgggggttctgccagctgctaagtatgtctatgccaattatgcatcctggcacttggaaaatgaccacaggatgagtctggggacccactggacccgctgcagctccagcaagtatcaatcccattgctggacatcacatccaacacccgtctccaattagtggtacatgttaaataaaatggctcggccattgtttcggaccgagctcctgcgctagggcccaacagagcagcccaaagcggaaccgagtcacgcgcgccggacgccacccgacaggaggggaaacggggcagctctcaaaaccctggaggcgcagaccgtccacacgggacagggacgcccgctcggctccgctccgcgctgatcctcaaggtctcgcggtttccccgccgcccacccggacgccgacgaaagccagcgagctcctcagcctcaggcatctgcatctgggaccgacctcctgggctggctgatcaaagaggaagcagcagcaatgtctgctgtgggggctgcaactccatacctgcatcatcctggtgatagtcacagtggccgagtgagtttcttgggggcccagcttcctcc

SEQ ID NO: 2871 - DNA, 2807 bp, Homo sapiens
gcgttctcggaggcgtactgaggccccgcagggggcggggaagcctgcgtgtgcgcagctcggcccggcccgccctcttcatcctagcccgccccctccccggctctggacccggttctgtgggagggtccgttccgggctcggtgcgactgcgcagctcctcggcgcttcctcggtggcttccccgggtcgagcaaacaggtaagttcggggagacttcaggccagggcagtctcctgtcttctcttggaaaccacagcagcccatgcacacagaatggcagccacattccagcttccagggcaccaggagatgccgctgaccttccaggatgtggccgtgtacttctctcaggcggaggggcggcagctgggcccccagcagcgggcgctctaccgggatgtgatgctggagaactatgggaacgtggcctctctgggattccctgtccctaagccggagttgatctcccagctggagcaggggaaggaactttgggtcctgaatcttctgggagctgaggaaccagatatcttgaaaagctgccagaaagattctgaggttgggaccaagaaggaactatctattttaaaccaaaaattttccgaagaagtaaaaaccccagaatttgtatcaagaagactcttaagggataatgcacaggccgctgagtttcgggaagcatggggccgtgagggcaaactcaaagagcgcgtgggaaattctgccgggcagagtttgaacaaacccaatattcacaagagagttttaacagaagctaccgtgggcagggaaagatctttgggagaaagaacccaagagtgtagtgcatttgatagaaacttgaatctggaccaaaatgttgttagacttcaaagaaataaaacaggagagagggtctttaaatgtgatatatgcagcaaaaccttcaaatataattcagacctaagtagacaccagagaagtcacactggggagaagccgtacgaatgtggccggtgtgggcgagcctttactcacagctcaaatcttgttctgcaccatcacattcacactggaaataaaccatttaaatgtgatgaatgtgggaaaacttttggactcaattctcacctccgtcttcatcggagaattcacactggagaaaaaccctttggctgtggtgagtgtgggaaggctttcagtcgaagctcaactcttattcaacatcggatcattcacacaggagagaaaccctacaagtgtaatgaatgtggaagaggctttagccagagcccccagttaactcagcatcagagaattcacactggagagaagccgcatgaatgcagtcactgtgggaaggccttcagtcgaagctccagccttattcagcatgagagaattcacactggagagaagccccataaatgcaatcagtgtgggaaggccttcagtcagagctcaagccttttcctccatcatcgggttcatactggagagaaaccctatgtatgtaatgaatgcggcagagcctttggttttaactctcatcttactgaacacgtaaggattcacacaggagaaaaaccctatgtttgtaatgagtgcggcaaagcctttcgtcggagttccactcttgttcagcatcgaagagttcacactggggagaagccctaccagtgcgttgaatgtgggaaagctttcagccagagctcccagctcaccctacatcagcgagttcacactggagagaagccctatgactgtggtgactgtgggaaggccttcagccggaggtcaaccctcattcagcatcagaaagttcacagcggagagactcgtaagtgcagaaaacatggtccagcctttgttcatggctccagcctcacagcagatggacagattcccactggagagaagcacggcagagcctttaaccatggtgcaaatctcattctgcgctggacagttcacactggtgagaaatcctttggatgtaatgaatatggaaaagctttcagtcccacctcacgacccactgaagatcagataatgcatgctggggaaaagccctataaatgtcaagaatgtggaaacgccttcagtggaaagtcaacccttattcaacatcaggtaactcacactggtcagaaaccatgtcattgcagtgtgtatgggaaagccttcagccagagttcacagctcacaccacctcagcagactcgtgttggagagaaacctgctttaaatgatggctctaaaagatactttattcatatcaagaagattttccaagaaagacatttttaatgtgataaatgcagaagacagtttagcaactgttcacttgacattagaagataagatggcataatgaaagatatataaggtctaaatattactggcaaagtaaaataaatagttcagatgactactaaagtcaaagtcattaaatctggaagtaaacacgagaattcattctgggaaatcaggctgtctgtgtaaaggttactgctgtgctcaggagttgaaccgtgtggtgctgtatccggatactcatgacgaatggatggagggcgtgaaaagtgagcccagctggtgctctgggtctaccctacctgacatccttccagtcttatcctttgtttcctatccaggcccaggcttgtggctgagaacatccactttcagtcccatatacctgcctccaagtgtggtacagagaacttgggcctgctgggggcgcttagccttactctctccaccacctctcccaccaacccccagatgaactgcaggtagacgtttcttccttgcttggagcc

SEQ ID NO: 2872 - DNA, 3059 bp, Homo sapiens
gcggaggcgcggagctaagcggctcggattatcctgggcagaccagagacttgaccagctaaacacttccgtcggtccggggcgtggacggggccagatcagcctcctgctctcccgagtcagggccacggaaaggcacaaatccatccgtgcgactcctggtacccagaccgggaggttgtctagtcacgcgcggtctgtgttgggcgagagctgaggagccggcgtccctgccaacgactcggccccgggacggtcaggagcctggggccctggtcccgcacctgtcttcgggcggacgcatccctcacggtctctccgcagcccgcgggtcctgcccccgcaggcagcgcgcgaacgtgggcgtggggatggccaccagtttccggacagcttcgtgctggggattattgtcattcaaggatatatctatggagttcacctgggatgaatggcagctactggattctacacagaagtacctgtacagagatgtgatattggaaaactatcataacctgatatcagtggggtatcatggtaccaagcctgacttaatcttcaagttggaacaaggagaagatccatggataataaatgccaaaatttccaggcagagctgtccagatggctgggaagaatggtaccagaacaatcaagatgagcttgagagtattgaaagaagctatgcttgtagtgtgttgggaagacttaatctgagcaaaacccatgattcttcaagacagagactctataacacacgtggaaaaagtttgacacaaaactcagctccaagcagaagttatttaagaaagaatcctgataagtttcatggttatgaagaaccatattttcttaagcatcaaagagctcatagcatagaaaaaaactgtgtgtgtagtgaatgtgggaaagcttttcgttgtaagtcacagctcattgtacatctcagaattcatacaggagagagaccttatgaatgcagtaaatgtgaaagagccttcagtgccaagtcaaaccttaatgctcatcagagagttcatacaggagaaaaaccctactcatgtagtgagtgcgagaaggtcttctctttcaggtcacagctcattgtccatcaggaaattcacacaggagggaaaccctatggctgcagtgaatgtgggaaagcctacagttggaaatcacagcttcttttacaccagagaagtcacacaggagtgaaaccgtatgaatgcagcgaatgtgggaaagcctttagtttgaagtctccattcgttgtacaccagagaactcatacaggagtgaaaccccataaatgcagtgaatgtgggaaagcctttaggagtaagtcctatctccttgttcacatccgaatgcatacaggagaaaaaccctatcaatgcagtgattgtgggaaagccttcaatatgaagacacaactcattgtacatcagggagttcacacaggaaataatccttatcaatgcggtgaatgtgggaaagcctttggtaggaaggaacagctcactgcacatctgagagctcatgcaggagagaagccctatggatgcagtgaatgtgggaaggctttcagcagcaagtcataccttgttatacataggagaacacacaccggagagagaccctatgaatgtagtttgtgtgagagagccttttgtggaaaatcacagctgattatacatcagagaactcattcaactgagaagccctatgaatgcaatgaatgtgaaaaagcctaccctaggaaggcatcacttcagatacaccagaaaactcattcgggagagaaaccttttaaatgcagtgaatgtggaaaagccttcactcagaagtcatctctcagtgaacatcagagagttcacaccggagagaaaccatggaaatgctctgaatgtgggaaatccttctgttggaattcagggcttcgtatacatcggaagactcataaatgagaaatcagaatgatgcaatgtgagaaactgatgttcaggagacttcggataatatagacaggatttacaagcaggaggccctaaaattacactcatgtcaaaaatcagagaggagagagaccaaccatatttgggatgagtgtaaaagctttcagaaataagttacaaatctttgtagatgaaaataatggaaggaatgtggagcaataaatgtatcaaatgttgtagtatcatcatgaagattcagagaatttacactaggaacaccttataagttgaataaattaaggaagcattttcccattgaaagtgtgttccatggaaagtcacattccagatttgaagctgtgtttttgtaaaataaaatcttggtatgaacagttgacttcatggtggagtataaagttgtttttttaaaaatatgtaaataatgttcaggaaaaacgcagggaacagagtcttaaagttaatggatatttaatgtgactttcctgagttaacactgaatagtatttctaaaattttttgtactttattttttaatgtaacttgttctatctatctatatatatatttgatagtttgtggaataatatcccccagtattttccatattaaatgctaattatcttttgatttctttttcataagcagatctggcatttattacagggctgccgcttaagagaactcattataatgaacgtttattatattttgcagttccatgcctgttgtccattgattgacatgagcacccctgttttctctggagaaatacctcccctctctggggtgcttcctgtggtagtgtctttcaggtatccgttccactagctacaggtgagcattttacccattgttggataatggtaatctctttttcagaattttgagtctgtaattcatttgtacatgaaccagaaaatgtgggaactcattcattcttgtcccagaattctgttgagaacatccattcattctggctaattgattacaagaataactgtggatacgatccctttagaacctgcttctctgatctgtgtgtttcctcacttctcaataaaaatgtcttttgctttt

SEQ ID NO: 2873 - DNA, 3325 bp, Homo sapiens
cggaaattggtcacgagcaggcgccgtgggcttgtggacgcctaacttgcgcgctgagatttccggcgtgggagcagaggtctgagtcttgcgtgggtcctctatatagggtgagaagcgtggcgctcggttcctgcctcggggaagtcctggcgcagatgggccacggggccggcgtggcggcgcctgggaccgactgaggcctaggcgccggagccggccgcgcctgggctggagcggggctcctcggcctggactgggagcccccggccccgggctcctgctggcgccgtccaaccttacatgggttcagggcgccttcgtaggcgggcacggctggtttcgggctaaggcgctctggagacctgacgatggcgtcgggcccgggctcccaggaacgggaagggctcctgatagtgaagctggaggaggactgcgcctggagccaggagctgcccccacctgacccaggaccgagccccgaggcctcccacttgcgcttcagacggttccgcttccaagaggcagctggtccccgggaagccctcagccggctccaagagctttgccatgggtggcttcggcctgagatgcgcacgaaggagcagatcttggagctgctggtgttagagcagttcctgaccatcctgccccaggagatccagagcagggtgcaggagctgcatccggagagcggcgaagaagcggtgacccttgtggaggatatgcagagagagcttgggagactgagacaacaggtcacaaaccatgggcggggaacagaagtgcttttggaggagcctttgcctctggaaacagcacgagagtcaccgagcttcaagctggagccaatggagactgagcgaagccctggccccaggctgcaggagctgctaggccccagcccccaaagggacccccaggctgtaaaggagagggcattatctgctccctggctttctctttttcctcctgaagggaacatggaagacaaggagatgactgggccccagttgcctgagagcttagaggacgtggcaatgtacatctcccaggaggagtgggggcatcaggatcctagtaagagggccctctccagggacacggtgcaggagagttatgagaatgtggactcactggagtctcacattcccagtcaggaggtcccaggcacccaggtgggacaaggaggaaagctatgggatcccagtgtccagagctgcaaggagggcctgagccccagaggcccagctccaggagaagagaaatttgagaacctggaaggtgttccgtctgtatgctctgagaacatccaccctcaggtgctgcttcctgaccaggcccgaggggaggtgccctggagtcctgagctgggaagacctcatgaccggtcgcaaggggattgggcgcctcccccagagggtggaatggagcaggccttggcaggagcctcaagtggcagagaactggggcgaccgaaggaactgcagccaaagaaactccatttatgtcccttgtgtggcaaaaatttctctaacaactcaaacctaattaggcaccagagaatacatgcagctgaaagactgtgtatgggtgtggactgcactgaaatctttggtgggaacccacgtttcctgtcactacacagagcacacctgggagaggaggcccacaagtgccttgaatgtgggaaatgcttcagtcagaacacccatctgactcgccaccaacgcacccacacgggtgagaagccctatcagtgcaacatttgcggaaaatgtttctcctgcaactccaacctccacaggcaccagagaacgcacactggggagaagccctacaagtgccctgagtgtggggagatctttgctcacagttccaacctccttcggcaccagagaattcacactggagagcgaccttataagtgtcccgagtgtgggaaaagtttctctcggagttcacacctcgtcattcacgaaagaactcatgagagagagagactttaccccttctctgagtgtggggaagctgtgagtgacagcaccccctttcttacaaaccatggagcccataaggcagagaagaagctctttgaatgtttgacttgtgggaaaagcttccggcagggcatgcacctcaccagacatcagagaacacacacaggagagaaaccgtataaatgtaccctttgtggggaaaacttctctcatagatccaatttaatcaggcaccagagaatccacacaggagaaaaaccctatacctgtcatgagtgcggagacagcttctctcacagctccaatcggattcgccacctgagaacgcatacgggagagagaccctataaatgttctgaatgtggagaaagcttctctcggagttcccgtcttatgagtcatcagagaactcacacaggttagtaacagtggggtttctctttgccccaggtgaggtggcatattcagaggagcctgttggcaagagctggtattccctgcccagccgaccaaatgacctctgcattcttcaggtaatgggggctcattgtgagggaggtgcagaggcagcagaggattggcataaaactgaaaaggagttctgtctgcatgagaaaggatggcaagtctctgaggtgacctcagggtggaattctctgttaagtccaccctgccccagggtgctcctaccctcttggtctttttaaagccaaggtgcgatttgggcacctgactgtccagtttaccttaacaagtttgggaatccatgtgatgtttttgatacttcttcctcatttgggacattcagtaggagcatttgggcttccggggcccctgagaccaaagaagaggggccaagtaccctgggaaatcagctgaaggtcaacaaaagactggttgtgagttgcagctgtcccgaaggccccagttgggaagccatgggcagtccagatcaagccaccacgtgccctacgatggcctaacaggagtgcccattggcagattacacatgtaaatatgacctcagacaaaaaggaaccagaggcccaagggcaataataaggtggaatttgcaggtcagcccaggaattggcagaggaagtaggtgtctgataaccctttgtggagaatgagattccccccacctgtgtgagaaaaataaacagctctggagtcttgttcctgactccagaggaacgagagcattccaggaaagagagattccctggaaaattgaaaatgtgaatcctagggggaaattggggattgtgtctttccctgttgaaaatgtttggatgggaataaatatcttcaggaaacataaa

SEQ ID NO: 2874 - DNA, 1721 bp, Homo sapiens
ctgttttgcaacttcttgtttatgagcctggaagccacgaagtggtgggaaatacgagattcaaatatctggtggccgtgtgacgagaagagaaatttgagaacctggaaggtgttccgtctgtatgctctgagaacatccaccctcaggtgctgcttcctgaccaggcccgaggggaggtgccctggagtcctgagctgggaagacctcatgaccggtcgcaaggggattgggcgcctcccccagagggtggaatggagcaggccttggcaggagcctcaagtggcagagaactggggcgaccgaaggaactgcagccaaagaaactccatttatgtcccttgtgtggcaaaaatttctctaacaactcaaacctaattaggcaccagagaatacatgcagctgaaagactgtgtatgggtgtggactgcactgaaatctttggtgggaacccacgtttcctgtcactacacagagcacacctgggagaggaggcccacaagtgccttgaatgtgggaaatgcttcagtcagaacacccatctgactcgccaccaacgcacccacacgggtgagaagccctatcagtgcaacatttgcggaaaatgtttctcctgcaactccaacctccacaggcaccagagaacgcacactggggagaagccctacaagtgccctgagtgtggggagatctttgctcacagttccaacctccttcggcaccagagaattcacactggagagcgaccttataagtgtcccgagtgtgggaaaagtttctctcggagttcacacctcgtcattcacgaaagaactcatgagagagagagactttaccccttctctgagtgtggggaagctgtgagtgacagcaccccctttcttacaaaccatggagcccataaggcagagaagaagctctttgaatgtttgacttgtgggaaaagcttccggcagggcatgcacctcaccagacatcagagaacacacacaggagagaaaccgtataaatgtaccctttgtggggaaaacttctctcatagatccaatttaatcaggcaccagagaatccacacaggagaaaaaccctatacctgtcatgagtgcggagacagcttctctcacagctccaatcggattcgccacctgagaacgcatacgggagagagaccctataaatgttctgaatgtggagaaagcttctctcggagttcccgtcttatgagtcatcagagaactcacacaggttagtaacagtggggtttctctttgccccaggtgaggtggcatattcagaggagcctgttggcaagagctggtattccctgcccagccgaccaaatgacctctgcattcttcaggtaatgggggctcattgtgagggaggtgcagaggcagcagaggattggcataaaactgaaaaggagttctgtctgcatgagaaaggatggcaagtctctgaggtgacctcagggtggaattctctgttaagtccaccctgccccagggtgctcctaccctcttggtctttttaaagccaaggtgcgatttgggcacctgactgtccagtttaccttaacaagtttgggaatccatgtgatgtttttgatacttcttcctcatttgggacattcagtaggagcatttgggcttccggggcccctgagaccaaagaagaggggccaagtaccctgggaaatcagctgaaggtcaacaaaagac

SEQ ID NO: 2875 - DNA, 1811 bp, Homo sapiens
cgggatttggcggggcctttgtctctcgctgcagtcgcagctccaggtctcgtcttcactgctctatgtcctctgctcctagaggtccaccttctgtggccccgttacctgcaggccagaaaaactgggaaaatcacaggctcttccacttactggatgtttgacaaaatattcttcttgggccaaaaacattggcattactgggaccactgacatttagggatgtggccatagaattctctctggaggagtggcaatgcctggacacttcacagcagaatttgtataggaatgtgatgttagataactacagaaacctggtcttcctgggtattgctgtctctaagccagacctgatcacttgtctggagcaaggaaaagagccctgcaatatgaagagacatgcgatggtagccaaacccccagttgtgtgttctcattttgcccaagacctttggccaaagcagggcttaaaagattcttttcaaaaagtgatactgagaagatatggaaaatatggacatgagaatttacaattaagaaaaggctgtaaaagtgcggatgagcataaggtgcacaaaagaggttataatggacttaaccaatgtttgacaactacccagagcaaaatatttcaatgtgataaatatgttaaagtccttcataaattctcaaattcaaatatacataagaaaagacaaactggaaagaaacctttcaaatgtaaagaatgtggcaaatcatgttgcatactttcacaactaactcagcataagaaaactgctactagagtgaatttctacaaatgtaagacatgtggaaaagcctttaaccagttctcaaatcttactaaacataagataattcatcctgaagtgaatccctacaaatgtgaagaatgtggcaaagcctttaaccagtccttaactcttactaaacataaaaaaattcatactgaagagaaaccttacaaatgtgaagattgtggcaaagtctttagtgtattttcagtccttactaaacataagataattcatacaggaacaaaaccctacaattgtgaagaatgtggcaaaggctttagtatattctcaacccttactaaacataagataattcatactggagagaaaccctacaaatgcaatgaatgtggtaaagcctttaactggtcctcaactcttactaaacataagagaattcatactggagagaaaccctacaaatgtgaagaatgtggcaaagcttttaaccagtcctcaacccttactagacataagatagttcatactggagagaaaccctacaaatgtgaagaatgtggtaaagcctttaaacggtccacaactcttactaaacataagagaatttatactaaagagaaaccatacaaatgtgaagaatgtggaaaagcctttagtgtattctcaacccttactaaacataagataattcatactggagcaaaaccttacaaatgtgaagaatgtggcagtgcctttagggcattctcaacccttactgaacataagagagttcatactggagagaaaccttacaaatgcaatgaatgtggtaaagcctttaactggtcctcaactcttactaaacataagagaattcatactggagagaagccctacaaatgtgaagaatgtggcaaagcttttaaccggtcctcaaaccttactcgacataagaaaattcatactggagagaaaccatacaaacctaaaagatgtgacagtgcttttgacaacaccccaaacttttctagacataaaagaaatcatatgggtgagaaatcctag

SEQ ID NO: 2876 - DNA, 2000 bp, Homo sapiens
ggcttccgggatttggcggggcctttgtctctcgctgcagtcgcagctccaggtctcgtcttcactgctctatgtcctctgctcctagaggtccaccttctgtggccccgttacctgcaggtattgggagatccacagctaagacgccaggactccctggaagcctagaaatgggaccactgacatttagggatgtggccatagaattctctctggaggagtggcaatgcctggacacttcacagcagaatttgtataggaatgtgatgttagataactacagaaacctggtcttcctgggtattgctgtctctaagccagacctgatcacttgtctggagcaaggaaaagagccctgcaatatgaagagacatgcgatggtagccaaacccccagttgtgtgttctcattttgcccaagacctttggccaaagcagggcttaaaagattcttttcaaaaagtgatactgagaagatatggaaaatatggacatgagaatttacaattaagaaaaggctgtaaaagtgcggatgagcataaggtgcacaaaagaggttataatggacttaaccaatgtttgacaactacccagagcaaaatatttcaatgtgataaatatgttaaagtccttcataaattctcaaattcaaatatacataagaaaagacaaactggaaagaaacctttcaaatgtaaagaatgtggcaaatcatgttgcatactttcacaactaactcagcataagaaaactgctactagagtgaatttctacaaatgtaagacatgtggaaaagcctttaaccagttctcaaatcttactaaacataagataattcatcctgaagtgaatccctacaaatgtgaagaatgtggcaaagcctttaaccagtccttaactcttactaaacataaaaaaattcatactgaagagaaaccttacaaatgtgaagattgtggcaaagtctttagtgtattttcagtccttactaaacataagataattcatacaggaacaaaaccctacaattgtgaagaatgtggcaaaggctttagtatattctcaacccttactaaacataagataattcatactggagagaaaccctacaaatgcaatgaatgtggtaaagcctttaactggtcctcaactcttactaaacataagagaattcatactggagagaaaccctacaaatgtgaagaatgtggcaaagcttttaaccagtcctcaacccttactagacataagatagttcatactggagagaaaccctacaaatgtgaagaatgtggtaaagcctttaaacggtccacaactcttactaaacataagagaatttatactaaagagaaaccatacaaatgtgaagaatgtggaaaagcctttagtgtattctcaacccttactaaacataagataattcatactggagcaaaaccttacaaatgtgaagaatgtggcagtgcctttagggcattctcaacccttactgaacataagagagttcatactggagagaaaccttacaaatgcaatgaatgtggtaaagcctttaactggtcctcaactcttactaaacataagagaattcatactggagagaagccctacaaatgtgaagaatgtggcaaagcttttaaccggtcctcaaaccttactcgacataagaaaattcatactggagagaaaccatacaaacctaaaagatgtgacagtgcttttgacaacaccccaaacttttctagacataaaagaaatcatatgggtgagaaatcctagaaatgtgaagaatgtgacaaagcctttaagcggttgtcacacttgattgtatataagataattcatactggagaaaactcccagaagtggagttttccttattgcacaggaaagcatttatacttgagaaaaattgtataaagaatggaaaagtcattaatatctgctcatatcttaacatcagcgagttggtatttaataaaagcattatcaatgaaa

SEQ ID NO: 2877 - DNA, 1219 bp, Homo sapiens
gatttggcggggcctttgtctctcgctgcagtcgcagctccaggtctcgtcttcactgctctatgtcctctgctcctagaggtccaccttctgtggccccgttacctgcaggtattgggagatccacagctaagacgccaggactccctggaagcctagaaatgggaccactgacatttagggatgtggccatagaattctctctggaggagtggcaatgcctggacacttcacagcagaatttgtataggaatgtgatgttagataactacagaaacctggtcttcctgggtattgctgtctctaagccagacctgatcacttgtctggagcaaggaaaagagccctgcaatatgaagagacatgcgatggtagccaaacccccaggttggagtgcagtggcgtgatcttgggttactgcaacctctgcccctcgggattcaagtgattctactgcctcagcctcccgagtagctgggattataggcgagtgccatcatgcccggctaatttttgtatttttagtagagtgagggtttcaccatgttggccaggctggtctcgaacgcctgacctcgtgtgatccgccctcctcagcctcccaaagtgctgggattacaggcatgagccacagtgcccggccaagtatttttatatttcagatcatatctactgaatgatttggtgacagaaatttgcattgcttttacctattggctttcagtaacaatggtataataattatgggtatgaaaatgactcttcatatgaccacatatgtgaaagtatatatatgtgctgcattctattttactagtctcctttttttttttacctttatacttgtagcaaattgttttaattctgtagctttgtaatatgttttaaaatcagaaactataatgcttccaacattgttcctttttttgaagattgttaggtactttattgtctcttgagattccatatactttaggggttgctgtttttatgtcttcaaaaatgcaatgagaaattgagaaaacattgcattaaatcttgtagattacattgagcagtatagacatcttcccaatatttcaacttttgaacaaaagcatgctaaagaatgtggtttaatttactatatatttgtaaacttgttagcttttaatattgttttatattgtcattccatttttgttatagaaagtaatccataaaatttcagttctaaaat

SEQ ID NO: 2878 - DNA, 5920 bp, Homo sapiens
ctctgtctcttgccccagcatgacacacggcagagtatgaaccccagctgctgccttcctaccctccctctgcttctcttctggaggctgccaaggattggatgtccactgggcttggagttccaatcatccaggtggggaagctgagtttccatccaggaaagtgattgaatggaggtcccttggaaagacgagaggccaggtccatggcccagggatcctagtgcttgatcaggttctcttttcaggacttcttggagctgtggttaggcctccatgttagcaacagacacccactccagaccctcacctcttgaccctggcattactggcgctgcccctgcctcattctaaaatagatggaaagactgatgagccctgggaattctttcaggatttggtgacatttgatgatgtggcatggtacctcaccacaagggagtggtttaagctggaccctgaacagagggcactggaatattatgggaacgtgacctctgtgggtaaggatgtcccagcccttcctcaaattcaccaccttcttggagtggggcaggggacacatggctacccccacagaagctcaccttctccctgggttgtggggaaacacaatgggtctgccacacctgatatgtcagagtagtatgagctcccccaactcctcttggcatggaaagaacccctctcagtcttttactgggaaagaaattagaacactgccactgtaatgtagaatgcccttttcattttaatgcacaaattatgcaaattgcatggccatttggtttgagtttatttgtgagaaaggttgacgtgatcaagatcttgttcacccattaggggtctgcatgtgtgcagtggggaggaggttttaggaggagagacgttgggagtcagatttgggagctgtcgaagtccacgtgtctgggaagagcatgaagttaaatgtgtgagctctgagtgggtggacagagagaagacagggtgaagatcacctcctcagggtggccacttgatactccacagagcctccccaaggtgggcccagaggctgccttcctcaagctcctggaaggagcctgaccttgggaaacacctttgaactgaatgaatgacttgcctaaagcctggtctttgaagattgaagggggttccccttcaaaggccttgcctatgttcctccactattctcatgtcatctctggctgttgccataaccaatctcctttcccatgagcaggcgttcctgttttaaatcctgccttggtccctcacctggcacaaggacaagtgctactggtgtcagacccatcgcccaacactgatcctgctaagtactctgaaagcacctccgcgacccgacaccagatgaagggggaagatgcccagccacaggagatggcgtccacaagcttcccaagggccagtggtcccagtcctgaattcagacagcacggggactctgacgggaagagagggagcccacagaatctgcccatagaacatcattttgcttgtaaagagtgtggggacacctttcggcttaaagtcctgcttgtccagcaccagagagtccacagtgaggagaagggctgggaatgtggcgactgcgggaaggtctttaggggggtggcggagtttaatgagcacaggaaaagccacgtagctgcggagccccagcccggccccagtagggccctggagaatgccgcggagaagagggagcagatggagagggaggcaaagcccttcgagtgcgaggagtgcggaaaacggtttaagaagaatgcaggcctgagtcagcatctgagggtccacagcagagagaagccctttgattgcgaggaatgcgggcggtcgttcaaagtcaacacccacctcttccgacatcagaaacttcacacttcggaaaagcctttcgcctgcaaggcgtgcagcagggatttcctggatcgccaggagcttctcaagcaccagcgcatgcacactggccacctgcccttcgactgcgacgactgcggcaagtccttccgaggggtcaacgggctggccgagcaccagcgcatccacagtggggccaagccatacgggtgtccccactgcggcaagctcttccgaaggagctcggagctcaccaagcaccggcggatccacacgggcgagaagccctacgcctgcggccagtgcggcaaggccttccgccagagctccagcctcctggagcacgcacgcatccacagtggcgagcggccctacgcatgcggcgagtgtggcaaggccttccgtgggccctctgacctcatcaagcaccggcgcatccacagcggactgaaaccctatgagtgcgacaaatgcggcaaggccttccgccggagctccggcctcagtcgccaccggcggatccacagtggggcgcggcgctgcgaatgcagccagtgtggccgcgtgttcaagaggcgctcggcactgcagaagcatcagccaacccaccacgagtagaaacgccctgtggtcccgcgggacagggacggagtccccagaggggatggcagagtcaaaggagatgaacagttttgtagcgcttatatattttgtcttccaaaaggttgagaccgatttatactgccaccagcaatttataagtgttacgttatgcccatcaagagtagcttgtaccatttaacttagtttggctagtttaactggtaggaagtaccatcaaggtatttcagtccacatgccttgaatccaagaatgagagaggacaaatctggatgtggggtagggaggggcttagaggtcatcaactccaagctccccccgccccagagaaacacacagagctgttccacgatggcgtcctcataatgtgatcccagctttcctgaagagaacgttgccctcatgatttttggcctacttgaatttataaatttttagggatgtaaatagaacactcaaatgtcttaaaatatttaatttattaatttagttatacatacatactgtaaatcacatattatataaaataatatattaatttagaaaataccccatttttgccaccctccctttcacgaaatcattttactctgactcctcaccgtcttcaccaacatgggaaccctgtttgagtcatcagacagtttcaagacacacccagtcacttccatccgagctctgcacggtcgctcagtgacgatcccttcatgaggctctcattagaaattttctcccaagccataagaccatatttgcagaacattaggacgatttctcttgtcgttttttaatctgtcctgtgactgtacaatataaccacttaaggtcatactttttcaaacaacctttaaacgtcttttcttttaaagcacccaaaatgtcattgtgaggccaaacgcctagtaacagttactgaatctgggttaaatgtcggtatctttttttcttaaaccatttcaatttggtgtcccctatacatatccaaaactagcatcgattggggttgttttgaactaatgggtcttgtcctcaagcagcactattttgttcaaaataaaatagttgagagcatgcccctaagaagagatacatctcaaggactcaagtgcagggtgacgcctccttttggaaatgagcctctcctggtatcaggcctagatggtacttctccagccttccgtttcttgttctataaaacaggggtgatcacagcacctacctccgaaggttatcacgaggactgccatcgtggctgcagagtgccaggaccaccggcctggtatggaggtacacactcagtgaaggccatctgctgtcattgtcattgtcatagttattgccgtcattctgtggcttgtcaattccagaactggggatagaccccaggcctcctgaccaccagtctcatctttctcttatgcgatgacttaaatggtgtttctgttttttgcatgcaaatggtccgttcatctcctttgactagttatcaacttaccttcggatatattaactttatgtagcagttctttctatattgatggtgatgttctcttttccaattttattgctttgctttttgtagcagttttattacgtttttgttgtgaaagcttttaatttttacatatccaagcattcattttttgtccactcagtcataactttcattgcttctgtagctagatatgatgacattttctctagaattttaattacaaacaaaaagctgcaaccccagcccatcagaaggtgagtacaccaggtgggcaggctggatggaaatgggccagagaagcaggctctttcctcatccgagatgcggactccctgtctatctgtgggcaccacttgactatccaacctgaccactgcggcacactggagatgctcccatcatagattagccagaactctgtgactgctcatcattatagaccccgccagcagcagtggggcttggcctcacctagatcaatggagtggtccaaacttggtctgggagcaagcagcccagccatcctttgagctcctgggagccttggcaatgctccgagtggattcagtgactgagcagcagattcacccaagaaacatctccttggacacaagaagacttgcctagaccacatcctcctttcagccggtgactctagaactagaaagagattggttcataggcttctgctgtgggcagctaggggaaaattcacccatgtgttctggcatcacttcctatagccacacctaagtgagggcaacagagcagaggctcggagaggaaccctgcccctccgatggcttgtgcgttatgctgatagaagctggcagcactgccctgggctatgatttgcaacagccatgcccaggaggagcactaaagcaaaggtttggagggcagtggaacccttctgaaagcctgtgtggcatagaagtagaagctggtcctcctgggtctgagctaccatttccagtgggctcccccaagaggaacagcagcaagggctagcgaggaacctgcccctccagtggcccacagaagccacagatagaagccagccccaccagggctgtgctgtgacttcccagcagctgtggctggggacagggacactaggagggcctggcaaggaagtgtgcccttctcgtgggcccaccaaggctgaggcagagcttcctagcagacacaacttggaagggcttctcaggcacccatcctgacccccaggctggagaggagccaaaagcacttgttacatagtgattccttttgccctgtgggcctcagttcttgcagtagttgtgaatctgtgtctgaaatcactactttcttctcggatcctttttctcttttcgagttgttaggatgtgttttgtacagctgtcatttgataaagaaggttgacctctaccaggggcaagtctggcacctttacctagaagtactctgccatgtcttgcccgttcatttatcgtttgttgggtttcatgagggatcccattgaagtagatcccttttatgaagggatcccattgaatgcagcattaactcagaacgtagcataaagtcgtcactgctcccagctgggacgtggtgtcttggcatcccttcctgccgtccttgactctttcccatcttcagttctataattttctcccaaacaaatgctcttttagagttaacactaaagatctggtctttgccgtcaaggttgacagaacagctgttcatggtgtttgcggtgaaacccgtgttctctttcaatgcagtctgtggctttaacgtgtgtcctgtaatttcgccaagatcatttcttgcctctggtaacttgggggtggatttccttgggctctctaggtgtactgctatgtcagatgcaaaatgtcacccagcttcctgtcacatatccttgtctgt

SEQ ID NO: 2879 - DNA, 4973 bp, Homo sapiens
aaacgcgccgcggggctgttagctcggctgggcacgggcggctccgtggcgcttcctgccacgccaggcctgcctgggccgcgccagcgccgctccaccgagggccgcgcgtcggccgccgccgggcctggatggggccttacctgccaggctgatcccttggagtagttctgaggcatgatgagtcatccgtgtgtgtctcttttgggcgttcctgttttaaatcctgccttggtccctcacctggcacaaggacaagtgctactggtgtcagacccatcgcccaacactgatcctgctaagtactctgaaagcacctccgcgacccgacaccagatgaagggggaagatgcccagccacaggagatggcgtccacaagcttcccaagggccagtggtcccagtcctgaattcagacagcacggggactctgacgggaagagagggagcccacagaatctgcccatagaacatcattttgcttgtaaagagtgtggggacacctttcggcttaaagtcctgcttgtccagcaccagagagtccacagtgaggagaagggctgggaatgtggcgactgcgggaaggtctttaggggggtggcggagtttaatgagcacaggaaaagccacgtagctgcggagccccagcccggccccagtagggccctggagaatgccgcggagaagagggagcagatggagagggaggcaaagcccttcgagtgcgaggagtgcggaaaacggtttaagaagaatgcaggcctgagtcagcatctgagggtccacagcagagagaagccctttgattgcgaggaatgcgggcggtcgttcaaagtcaacacccacctcttccgacatcagaaacttcacacttcggaaaagcctttcgcctgcaaggcgtgcagcagggatttcctggatcgccaggagcttctcaagcaccagcgcatgcacactggccacctgcccttcgactgcgacgactgcggcaagtccttccgaggggtcaacgggctggccgagcaccagcgcatccacagtggggccaagccatacgggtgtccccactgcggcaagctcttccgaaggagctcggagctcaccaagcaccggcggatccacacgggcgagaagccctacgcctgcggccttccgtgggccctctgacctcatcaagcaccggcgcatccacagcggactgaaaccctatgagtgcgacaaatgcggcaaggccttccgccggagctccggcctcagtcgccaccggcggatccacagtggggcgcggcgctgcgaatgcagccagtgtggccgcgtgttcaagaggcgctcggcactgcagaagcatcagccaacccaccacgagtagaaacgccctgtggtcccgcgggacagggacggagtccccagaggggatggcagagtcaaaggagatgaacagttttgtagcgcttatatattttgtcttccaaaaggttgagaccgatttatactgccaccagcaatttataagtgttacgttatgcccatcaagagtagcttgtaccatttaacttagtttggctagtttaactggtaggaagtaccatcaaggtatttcagtccacatgccttgaatccaagaatgagagaggacaaatctggatgtggggtagggaggggcttagaggtcatcaactccaagctccccccgccccagagaaacacacagagctgttccacgatggcgtcctcataatgtgatcccagctttcctgaagagaacgttgccctcatgatttttggcctacttgaatttataaatttttagggatgtaaatagaacactcaaatgtcttaaaatatttaatttattaatttagttatacatacatactgtaaatcacatattatataaaataatatattaatttagaaaataccccatttttgccaccctccctttcacgaaatcattttactctgactcctcaccgtcttcaccaacatgggaaccctgtttgagtcatcagacagtttcaagacacacccagtcacttccatccgagctctgcacggtcgctcagtgacgatcccttcatgaggctctcattagaaattttctcccaagccataagaccatatttgcagaacattaggacgatttctcttgtcgttttttaatctgtcctgtgactgtacaatataaccacttaaggtcatactttttcaaacaacctttaaacgtcttttcttttaaagcacccaaaatgtcattgtgaggccaaacgcctagtaacagttactgaatctgggttaaatgtcggtatctttttttcttaaaccatttcaatttggtgtcccctatacatatccaaaactagcatcgattggggttgttttgaactaatgggtcttgtcctcaagcagcactattttgttcaaaataaaatagttgagagcatgcccctaagaagagatacatctcaaggactcaagtgcagggtgacgcctccttttggaaatgagcctctcctggtatcaggcctagatggtacttctccagccttccgtttcttgttctataaaacaggggtgatcacagcacctacctccgaaggttatcacgaggactgccatcgtggctgcagagtgccaggaccaccggcctggtatggaggtacacactcagtgaaggccatctgctgtcattgtcattgtcatagttattgccgtcattctgtggcttgtcaattccagaactggggatagaccccaggcctcctgaccaccagtctcatctttctcttatgcgatgacttaaatggtgtttctgttttttgcatgcaaatggtccgttcatctcctttgactagttatcaacttaccttcggatatattaactttatgtagcagttctttctatattgatggtgatgttctcttttccaattttattgctttgctttttgtagcagttttattacgtttttgttgtgaaagcttttaatttttacatatccaagcattcattttttgtccactcagtcataactttcattgcttctgtagctagatatgatgacattttctctagaattttaattacaaacaaaaagctgcaaccccagcccatcagaaggtgagtacaccaggtgggcaggctggatggaaatgggccagagaagcaggctctttcctcatccgagatgcggactccctgtctatctgtgggcaccacttgactatccaacctgaccactgcggcacactggagatgctcccatcatagattagccagaactctgtgactgctcatcattatagaccccgccagcagcagtggggcttggcctcacctagatcaatggagtggtccaaacttggtctgggagcaagcagcccagccatcctttgagctcctgggagccttggcaatgctccgagtggattcagtgactgagcagcagattcacccaagaaacatctccttggacacaagaagacttgcctagaccacatcctcctttcagccggtgactctagaactagaaagagattggttcataggcttctgctgtgggcagctaggggaaaattcacccatgtgttctggcatcacttcctatagccacacctaagtgagggcaacagagcagaggctcggagaggaaccctgcccctccgatggcttgtgcgttatgctgatagaagctggcagcactgccctgggctatgatttgcaacagccatgcccaggaggagcactaaagcaaaggtttggagggcagtggaacccttctgaaagcctgtgtggcatagaagtagaagctggtcctcctgggtctgagctaccatttccagtgggctcccccaagaggaacagcagcaagggctagcgaggaacctgcccctccagtggcccacagaagccacagatagaagccagccccaccagggctgtgctgtgacttcccagcagctgtggctggggacagggacactaggagggcctggcaaggaagtgtgcccttctcgtgggcccaccaaggctgaggcagagcttcctagcagacacaacttggaagggcttctcaggcacccatcctgacccccaggctggagaggagccaaaagcacttgttacatagtgattccttttgccctgtgggcctcagttcttgcagtagttgtgaatctgtgtctgaaatcactactttcttctcggatcctttttctcttttcgagttgttaggatgtgttttgtacagctgtcatttgataaagaaggttgacctctaccaggggcaagtctggcacctttacctagaagtactctgccatgtcttgcccgttcatttatcgtttgttgggtttcatgagggatcccattgaagtagatcccttttatgaagggatcccattgaatgcagcattaactcagaacgtagcataaagtcgtcactgctcccagctgggacgtggtgtcttggcatcccttcctgccgtccttgactctttcccatcttcagttctataattttctcccaaacaaatgctcttttagagttaacactaaagatctggtctttgccgtcaaggttgacagaacagctgttcatggtgtttgcggtgaaacccgtgttctctttcaatgcagtctgtggctttaacgtgtgtcctgtaatttcgccaagatcatttcttgcctctggtaacttgggggtggatttccttgggctctctaggtgtactgctatgtcagatgcaaaatgtcacccagcttcctgtcacatatccttgtctgtgcattcatgcatctacctcattccggttttctttctaatctcatgtattcctgttgtgaggaaatgtgttcttttcccgatccttttgtagttcatacacatgacaattgggtttccacgcacgtgcatgagatgttcctccttcaaaccttgttactatgtcagcacattaactgcctggcatgg

SEQ ID NO: 2880 - DNA, 6418 bp, Homo sapiens
aaacgcgccgcggggctgttagctcggctgggcacgggcggctccgtggcgcttcctgccacgccaggcctgcctgggccgcgccagcgccgctccaccgagggccgcgcgtcggccgccgccgggcctggatggggccttacctgccaggctgatcccttggagtagttctgaggcatgatgagtcatccgtgtgtgtctcttttgggcgttcctgttttaaatcctgccttggtccctcacctggcacaaggacaagtgctactggtgtcagacccatcgcccaacactgatcctgctaagtactctgaaagcacctccgcgacccgacaccagatgaagggggaagatgcccagccacaggagatggcgtccacaagcttcccaagggccagtggtcccagtcctgaattcagacagcacggggactctgacgggaagagagggagcccacagaatctgcccatagaacatcattttgcttgtaaagagtgtggggacacctttcggcttaaagtcctgcttgtccagcaccagagagtccacagtgaggagaagggctgggaatgtggcgactgcgggaaggtctttaggggggtggcggagtttaatgagcacaggaaaagccacgtagctgcggagccccagcccggccccagtagggccctggagaatgccgcggagaagagggagcagatggagagggaggcaaagcccttcgagtgcgaggagtgcggaaaacggtttaagaagaatgcaggcctgagtcagcatctgagggtccacagcagagagaagccctttgattgcgaggaatgcgggcggtcgttcaaagtcaacacccacctcttccgacatcagaaacttcacacttcggaaaagcctttcgcctgcaaggcgtgcagcagggatttcctggatcgccaggagcttctcaagcaccagcgcatgcacactggccacctgcccttcgactgcgacgactgcggcaagtccttccgaggggtcaacgggctggccgagcaccagcgcatccacagtggggccaagccatacgggtgtccccactgcggcaagctcttccgaaggagctcggagctcaccaagcaccggcggatccacacgggcgagaagccctacgcctgcggccagtgcggcaaggccttccgccagagctccagcctcctggagcacgcacgcatccacagtggcgagcggccctacgcatgcggcgagtgtggcaaggccttccgtgggccctctgacctcatcaagcaccggcgcatccacagcggactgaaaccctatgagtgcgacaaatgcggcaaggccttccgccggagctccggcctcagtcgccaccggcggatccacagtggggcgcggcgctgcgaatgcagccagtgtggccgcgtgttcaagaggcgctcggcactgcagaagcatcagccaacccaccacgagtagaaacgccctgtggtcccgcgggacagggacggagtccccagaggggatggcagagtcaaaggagatgaacagttttgtagcgcttatatattttgtcttccaaaaggttgagaccgatttatactgccaccagcaatttataagtgttacgttatgcccatcaagagtagcttgtaccatttaacttagtttggctagtttaactggtaggaagtaccatcaaggtatttcagtccacatgccttgaatccaagaatgagagaggacaaatctggatgtggggtagggaggggcttagaggtcatcaactccaagctccccccgccccagagaaacacacagagctgttccacgatggcgtcctcataatgtgatcccagctttcctgaagagaacgttgccctcatgatttttggcctacttgaatttataaatttttagggatgtaaatagaacactcaaatgtcttaaaatatttaatttattaatttagttatacatacatactgtaaatcacatattatataaaataatatattaatttagaaaataccccatttttgccaccctccctttcacgaaatcattttactctgactcctcaccgtcttcaccaacatgggaaccctgtttgagtcatcagacagtttcaagacacacccagtcacttccatccgagctctgcacggtcgctcagtgacgatcccttcatgaggctctcattagaaattttctcccaagccataagaccatatttgcagaacattaggacgatttctcttgtcgttttttaatctgtcctgtgactgtacaatataaccacttaaggtcatactttttcaaacaacctttaaacgtcttttcttttaaagcacccaaaatgtcattgtgaggccaaacgcctagtaacagttactgaatctgggttaaatgtcggtatctttttttcttaaaccatttcaatttggtgtcccctatacatatccaaaactagcatcgattggggttgttttgaactaatgggtcttgtcctcaagcagcactattttgttcaaaataaaatagttgagagcatgcccctaagaagagatacatctcaaggactcaagtgcagggtgacgcctccttttggaaatgagcctctcctggtatcaggcctagatggtacttctccagccttccgtttcttgttctataaaacaggggtgatcacagcacctacctccgaaggttatcacgaggactgccatcgtggctgcagagtgccaggaccaccggcctggtatggaggtacacactcagtgaaggccatctgctgtcattgtcattgtcatagttattgccgtcattctgtggcttgtcaattccagaactggggatagaccccaggcctcctgaccaccagtctcatctttctcttatgcgatgacttaaatggtgtttctgttttttgcatgcaaatggtccgttcatctcctttgactagttatcaacttaccttcggatatattaactttatgtagcagttctttctatattgatggtgatgttctcttttccaattttattgctttgctttttgtagcagttttattacgtttttgttgtgaaagcttttaatttttacatatccaagcattcattttttgtccactcagtcataactttcattgcttctgtagctagatatgatgacattttctctagaattttaattacaaacaaaaagctgcaaccccagcccatcagaaggtgagtacaccaggtgggcaggctggatggaaatgggccagagaagcaggctctttcctcatccgagatgcggactccctgtctatctgtgggcaccacttgactatccaacctgaccactgcggcacactggagatgctcccatcatagattagccagaactctgtgactgctcatcattatagaccccgccagcagcagtggggcttggcctcacctagatcaatggagtggtccaaacttggtctgggagcaagcagcccagccatcctttgagctcctgggagccttggcaatgctccgagtggattcagtgactgagcagcagattcacccaagaaacatctccttggacacaagaagacttgcctagaccacatcctcctttcagccggtgactctagaactagaaagagattggttcataggcttctgctgtgggcagctaggggaaaattcacccatgtgttctggcatcacttcctatagccacacctaagtgagggcaacagagcagaggctcggagaggaaccctgcccctccgatggcttgtgcgttatgctgatagaagctggcagcactgccctgggctatgatttgcaacagccatgcccaggaggagcactaaagcaaaggtttggagggcagtggaacccttctgaaagcctgtgtggcatagaagtagaagctggtcctcctgggtctgagctaccatttccagtgggctcccccaagaggaacagcagcaagggctagcgaggaacctgcccctccagtggcccacagaagccacagatagaagccagccccaccagggctgtgctgtgacttcccagcagctgtggctggggacagggacactaggagggcctggcaaggaagtgtgcccttctcgtgggcccaccaaggctgaggcagagcttcctagcagacacaacttggaagggcttctcaggcacccatcctgacccccaggctggagaggagccaaaagcacttgttacatagtgattccttttgccctgtgggcctcagttcttgcagtagttgtgaatctgtgtctgaaatcactactttcttctcggatcctttttctcttttcgagttgttaggatgtgttttgtacagctgtcatttgataaagaaggttgacctctaccaggggcaagtctggcacctttacctagaagtactctgccatgtcttgcccgttcatttatcgtttgttgggtttcatgagggatcccattgaagtagatcccttttatgaagggatcccattgaatgcagcattaactcagaacgtagcataaagtcgtcactgctcccagctgggacgtggtgtcttggcatcccttcctgccgtccttgactctttcccatcttcagttctataattttctcccaaacaaatgctcttttagagttaacactaaagatctggtctttgccgtcaaggttgacagaacagctgttcatggtgtttgcggtgaaacccgtgttctctttcaatgcagtctgtggctttaacgtgtgtcctgtaatttcgccaagatcatttcttgcctctggtaacttgggggtggatttccttgggctctctaggtgtactgctatgtcagatgcaaaatgtcacccagcttcctgtcacatatccttgtctgtgcattcatgcatctacctcattccggttttctttctaatctcatgtattcctgttgtgaggaaatgtgttcttttcccgatccttttgtagttcatacacatgacaattgggtttccacgcacgtgcatgagatgttcctccttcaaaccttgttactatgtcagcacattaactgcctggcatggaaaaagaaaaaaaaaaaagaaatatgttcttttcctaccatttgaaaaaaatcctccattgcttttattagagttttgaatacttgtgaaaattttcaaaagaaagtaattgattaccatttttgctgcttattacgatgagctgtgtccattagctgtgtcaccccactcttgcatttccagaatagtccctacccaattgcagcgggcatgtttttgagtggtgttgcattccatgtgcttgattttgtcctagaactggcacagcgcctgccctacctgcagccctgggttgtggccctgttgcgtaccatgtgatttgccaccccgcttctaggccatattaattcagccagaactgaacacctgacccaagggcagcaagcaatcatcagagcatagagctgacagaacatgatggaccacggacaccaccaggccttccagatctgaaatgcaaacaaggaaacagaagcttctaggcatcagaaggtgtggggagcagcacagtactcagaggagtgaggagcgtggcgcctgctgggaggaaggcctggccatggtatgttcttggatttctggcagcagccctcattggtccacgtgcgtccccactacagactccttgacttgagccagcttgagtgggtctctactcttttctattgtgttttgccacttggctgcttcctggccaagtcgcacctgactgcatgaacacctgttcaaacgtgtgttctctgttctctaagatgggtgaaagtcgatgccttctagtctcagtgaatttaacctgtgattttatgtctacgtatattgttcctttactgaacccaccacatgcgggccataaaatgagtgaaatcacagtgcaccctgttctcttatttttgaagtgtttcacgatttccagcatgtccatcagatggggggattgctaacttctctcttactcatgtacttacattctgtagttctcattgcatcactttggatgtttactttgaaaagcagaaactgtctctttaaacttggccctcaatgtcatttgcgtatctctgagaacaatagctatgtcccaccccagtttgtatttccgttggttgttggcacttttttctcattcccccatctcattaccttgtctgttttctggcactcactataatcagccttgcactagagctgtttgtggacttggcttcaccccctcctcctcagccctcccccacccattaaattgtgagctcttagaagacaggggtggcctttcatgtctgatcccctaccaaatctagcacagtgccttgcatcaagtagatttcaataaatatatgttaaatggca

SEQ ID NO: 2881 - DNA, 6331 bp, Homo sapiens
atgccagaggatttggtgacatttgatgatgtggcatggtacctcaccacaagggagtggtttaagctggaccctgaacagagggcactggaatattatgggaacgtgacctctgtggcaggcgttcctgttttaaatcctgccttggtccctcacctggcacaaggacaagtgctactggtgtcagacccatcgcccaacactgatcctgctaagtactctgaaagcacctccgcgacccgacaccagatgaagggggaagatgcccagccacaggagatggcgtccacaagcttcccaagggccagtggtcccagtcctgaattcagacagcacggggactctgacgggaagagagggagcccacagaatctgcccatagaacatcattttgcttgtaaagagtgtggggacacctttcggcttaaagtcctgcttgtccagcaccagagagtccacagtgaggagaagggctgggaatgtggcgactgcgggaaggtctttaggggggtggcggagtttaatgagcacaggaaaagccacgtagctgcggagccccagcccggccccagtagggccctggagaatgccgcggagaagagggagcagatggagagggaggcaaagcccttcgagtgcgaggagtgcggaaaacggtttaagaagaatgcaggcctgagtcagcatctgagggtccacagcagagagaagccctttgattgcgaggaatgcgggcggtcgttcaaagtcaacacccacctcttccgacatcagaaacttcacacttcggaaaagcctttcgcctgcaaggcgtgcagcagggatttcctggatcgccaggagcttctcaagcaccagcgcatgcacactggccacctgcccttcgactgcgacgactgcggcaagtccttccgaggggtcaacgggctggccgagcaccagcgcatccacagtggggccaagccatacgggtgtccccactgcggcaagctcttccgaaggagctcggagctcaccaagcaccggcggatccacacgggcgagaagccctacgcctgcggccagtgcggcaaggccttccgccagagctccagcctcctggagcacgcacgcatccacagtggcgagcggccctacgcatgcggcgagtgtggcaaggccttccgtgggccctctgacctcatcaagcaccggcgcatccacagcggactgaaaccctatgagtgcgacaaatgcggcaaggccttccgccggagctccggcctcagtcgccaccggcggatccacagtggggcgcggcgctgcgaatgcagccagtgtggccgcgtgttcaagaggcgctcggcactgcagaagcatcagccaacccaccacgagtagaaacgccctgtggtcccgcgggacagggacggagtccccagaggggatggcagagtcaaaggagatgaacagttttgtagcgcttatatattttgtcttccaaaaggttgagaccgatttatactgccaccagcaatttataagtgttacgttatgcccatcaagagtagcttgtaccatttaacttagtttggctagtttaactggtaggaagtaccatcaaggtatttcagtccacatgccttgaatccaagaatgagagaggacaaatctggatgtggggtagggaggggcttagaggtcatcaactccaagctccccccgccccagagaaacacacagagctgttccacgatggcgtcctcataatgtgatcccagctttcctgaagagaacgttgccctcatgatttttggcctacttgaatttataaatttttagggatgtaaatagaacactcaaatgtcttaaaatatttaatttattaatttagttatacatacatactgtaaatcacatattatataaaataatatattaatttagaaaataccccatttttgccaccctccctttcacgaaatcattttactctgactcctcaccgtcttcaccaacatgggaaccctgtttgagtcatcagacagtttcaagacacacccagtcacttccatccgagctctgcacggtcgctcagtgacgatcccttcatgaggctctcattagaaattttctcccaagccataagaccatatttgcagaacattaggacgatttctcttgtcgttttttaatctgtcctgtgactgtacaatataaccacttaaggtcatactttttcaaacaacctttaaacgtcttttcttttaaagcacccaaaatgtcattgtgaggccaaacgcctagtaacagttactgaatctgggttaaatgtcggtatctttttttcttaaaccatttcaatttggtgtcccctatacatatccaaaactagcatcgattggggttgttttgaactaatgggtcttgtcctcaagcagcactattttgttcaaaataaaatagttgagagcatgcccctaagaagagatacatctcaaggactcaagtgcagggtgacgcctccttttggaaatgagcctctcctggtatcaggcctagatggtacttctccagccttccgtttcttgttctataaaacaggggtgatcacagcacctacctccgaaggttatcacgaggactgccatcgtggctgcagagtgccaggaccaccggcctggtatggaggtacacactcagtgaaggccatctgctgtcattgtcattgtcatagttattgccgtcattctgtggcttgtcaattccagaactggggatagaccccaggcctcctgaccaccagtctcatctttctcttatgcgatgacttaaatggtgtttctgttttttgcatgcaaatggtccgttcatctcctttgactagttatcaacttaccttcggatatattaactttatgtagcagttctttctatattgatggtgatgttctcttttccaattttattgctttgctttttgtagcagttttattacgtttttgttgtgaaagcttttaatttttacatatccaagcattcattttttgtccactcagtcataactttcattgcttctgtagctagatatgatgacattttctctagaattttaattacaaacaaaaagctgcaaccccagcccatcagaaggtgagtacaccaggtgggcaggctggatggaaatgggccagagaagcaggctctttcctcatccgagatgcggactccctgtctatctgtgggcaccacttgactatccaacctgaccactgcggcacactggagatgctcccatcatagattagccagaactctgtgactgctcatcattatagaccccgccagcagcagtggggcttggcctcacctagatcaatggagtggtccaaacttggtctgggagcaagcagcccagccatcctttgagctcctgggagccttggcaatgctccgagtggattcagtgactgagcagcagattcacccaagaaacatctccttggacacaagaagacttgcctagaccacatcctcctttcagccggtgactctagaactagaaagagattggttcataggcttctgctgtgggcagctaggggaaaattcacccatgtgttctggcatcacttcctatagccacacctaagtgagggcaacagagcagaggctcggagaggaaccctgcccctccgatggcttgtgcgttatgctgatagaagctggcagcactgccctgggctatgatttgcaacagccatgcccaggaggagcactaaagcaaaggtttggagggcagtggaacccttctgaaagcctgtgtggcatagaagtagaagctggtcctcctgggtctgagctaccatttccagtgggctcccccaagaggaacagcagcaagggctagcgaggaacctgcccctccagtggcccacagaagccacagatagaagccagccccaccagggctgtgctgtgacttcccagcagctgtggctggggacagggacactaggagggcctggcaaggaagtgtgcccttctcgtgggcccaccaaggctgaggcagagcttcctagcagacacaacttggaagggcttctcaggcacccatcctgacccccaggctggagaggagccaaaagcacttgttacatagtgattccttttgccctgtgggcctcagttcttgcagtagttgtgaatctgtgtctgaaatcactactttcttctcggatcctttttctcttttcgagttgttaggatgtgttttgtacagctgtcatttgataaagaaggttgacctctaccaggggcaagtctggcacctttacctagaagtactctgccatgtcttgcccgttcatttatcgtttgttgggtttcatgagggatcccattgaagtagatcccttttatgaagggatcccattgaatgcagcattaactcagaacgtagcataaagtcgtcactgctcccagctgggacgtggtgtcttggcatcccttcctgccgtccttgactctttcccatcttcagttctataattttctcccaaacaaatgctcttttagagttaacactaaagatctggtctttgccgtcaaggttgacagaacagctgttcatggtgtttgcggtgaaacccgtgttctctttcaatgcagtctgtggctttaacgtgtgtcctgtaatttcgccaagatcatttcttgcctctggtaacttgggggtggatttccttgggctctctaggtgtactgctatgtcagatgcaaaatgtcacccagcttcctgtcacatatccttgtctgtgcattcatgcatctacctcattccggttttctttctaatctcatgtattcctgttgtgaggaaatgtgttcttttcccgatccttttgtagttcatacacatgacaattgggtttccacgcacgtgcatgagatgttcctccttcaaaccttgttactatgtcagcacattaactgcctggcatggaaaaagaaaaaaaaaaaagaaatatgttcttttcctaccatttgaaaaaaatcctccattgcttttattagagttttgaatacttgtgaaaattttcaaaagaaagtaattgattaccatttttgctgcttattacgatgagctgtgtccattagctgtgtcaccccactcttgcatttccagaatagtccctacccaattgcagcgggcatgtttttgagtggtgttgcattccatgtgcttgattttgtcctagaactggcacagcgcctgccctacctgcagccctgggttgtggccctgttgcgtaccatgtgatttgccaccccgcttctaggccatattaattcagccagaactgaacacctgacccaagggcagcaagcaatcatcagagcatagagctgacagaacatgatggaccacggacaccaccaggccttccagatctgaaatgcaaacaaggaaacagaagcttctaggcatcagaaggtgtggggagcagcacagtactcagaggagtgaggagcgtggcgcctgctgggaggaaggcctggccatggtatgttcttggatttctggcagcagccctcattggtccacgtgcgtccccactacagactccttgacttgagccagcttgagtgggtctctactcttttctattgtgttttgccacttggctgcttcctggccaagtcgcacctgactgcatgaacacctgttcaaacgtgtgttctctgttctctaagatgggtgaaagtcgatgccttctagtctcagtgaatttaacctgtgattttatgtctacgtatattgttcctttactgaacccaccacatgcgggccataaaatgagtgaaatcacagtgcaccctgttctcttatttttgaagtgtttcacgatttccagcatgtccatcagatggggggattgctaacttctctcttactcatgtacttacattctgtagttctcattgcatcactttggatgtttactttgaaaagcagaaactgtctctttaaacttggccctcaatgtcatttgcgtatctctgagaacaatagctatgtcccaccccagtttgtatttccgttggttgttggcacttttttctcattcccccatctcattaccttgtctgttttctggcactcactataatcagccttgcactagagctgtttgtggacttggcttcaccccctcctcctcagccctcccccacccattaaattgtgagctcttagaagacaggggtggcctttcatgtctgatcccctaccaaatctagcacagtgccttgcatcaagtagatttcaataaatatatgttaaatggca

SEQ ID NO: 2882 - DNA, 4589 bp, Homo sapiens
gcacttccggcgacgggccccctccgcgcgtactgcgggccccacgggtgttagtggcgggggcggcagagtccgggtgggttgtcgcgacggagccgggcctcttcgccgtcttgagacggggctggcgagaagggcccctcacggagttgccatgggcgtctaaccgcggcagccaggcccctctctacgtgagaccccggcccccctcccctttctgcagcccgcccgccacctgcgcgccgcgtggcctccgccggcgcctgcccgccccgcgcctccgtctcccacggagcaggccgggctctcgccatgggtcactgtcgcctctgccacgggaagttttcctcgagaagcctgcgcagcatctccgagagggcgcctggagcgagcatggagaggccatccgcagaggagcgcgtgctcgtacgggacttccagcgcctgcttggtgtggctgtccgccaggaccccaccttgtctccgtttgtctgcaagagctgccacgcccagttctaccagtgccacagccttctcaagtccttcctgcagagggtcaacgcctccccggctggtcgccggaagccttgtgcaaaggtcggtgcccagcccccaacaggggcagaggagggagcgtgtctggtggatctgatcacatccagcccccagtgcctgcacggcttggtggggtgggtgcatggacatgcggccagctgcggggccctgccccaccttcagaggacactgtcctccgagtactgcggcgtcatccaggtcgtgtggggctgcgaccagggccacgactacaccatggataccagctccagctgcaaggccttcttgctggacagtgcgctggcagtcaagtggccatgggacaaagagacggcgccacggctgccccagcaccgagggtggaaccctggggatgcccctcagacctcccagggtagagggacagggaccccagttggggctgagaccaagaccctgcccagcacggatgtggcccagcctccttcggacagcgacgcggtggggcccaggtcgggcttcccacctcagccaagcctgcccctttgcagggccccagggcagttgggtgagaagcagcttccatcttcaacctcggatgatcgggtaaaagacgagttcagtgacctttctgagggagacgtcttgagtgaagatgaaaatgacaagaagcaaaatgcccagtcttcggacgagtcctttgagccttacccagaaaggaaagtctctggtaagaagagtgaaagcaaagaagccaagaagtctgaagaaccaagaattcggaagaagccgggacccaagcccggatggaagaagaagcttcgttgtgagagggaggagcttcccaccatctacaagtgtccttaccagggctgcacggccgtgtaccgaggcgctgacggcatgaagaagcacatcaaggagcaccacgaggaggtccgggagcggccctgcccccaccctggctgcaacaaggttttcatgatcgaccgctacctgcagcgccacgtgaagctcatccacacagaggtgcggaactatatctgtgacgaatgtggacaaaccttcaagcagcggaagcaccttctcgtccaccaaatgcgacattcgggagccaagcctttgcagtgtgaggtctgtgggttccagtgcaggcagcgggcatccctcaagtaccacatgaccaaacacaaggctgagactgagctggactttgcctgtgaccagtgtggccggcggtttgagaaggcccacaacctcaatgtacacatgtccatggtgcacccgctgacacagacccaggacaaggccctgcccctggaggcggaaccaccacctgggccaccgagcccctctgtgaccacagagggccaggcggtgaagcccgaacccacctgaggacggcagtgaggatgagcacctctagcagcctggactccgcagtggctgtgtcagcctcacccttcgtgtgcacccgcatgggagggtcggagggtgctgcccgcccttggtgctggaggcgggcttggtgtccggctcaagtagccttcctctgctctgggaccagtggtttattttcccgcaaacgctgagtgactcggggccggacagttcataaataattgattcctttccccactaaagcagtcgaggagatttgtaatccactttttagtgcaacaagagctccatgttatgcttgtaataaattatttacacgggagctgggctggtgtgcagtggcaggtcccgtcagaagagatgaggctcctgggacaggtcagcgtcaggggcagcctgctgtctgctctggagggcggcgctcacctctgggtcgcagtccccacgatcagccagcagctgtgagagaggagcaggtcctcagcccatgccgcccactaggcctcagaccacaggggaggggctctggcagaaatagtcgagttgtattgccagccaggcaggcacatggcccaggcagctgtcaattctcatgtcccccacatggcccaaggtgggcatcttgacgttacctctgccacgtgtgagaagctctttttcgggcaccgaggtattaactgcagcagaaaaagacgagcttttgttatcagttccacggggttgccctagagagaaaacaggcaaactcacaggttagaagacatacagaaacagggctggtgtgtcccccatagtctgcatgctgtgccggaacattctttggcagaaggagcctccggctggggggagctcccctggaggtgggactggcccttgcacctgcctgacccttgagctccaggctcctgccagctggaggtgaaactgtgcttgtatccccagccacgaagagctggaccagcttcaagtacatgtccacagcaacatgcaggaaggcctcttccctgatggccgcgtcttcatggaagtaggagagaagactagaggtaaagacatagtgacaaatggctacagactgctggaaaggtagcaggtgatgccaagggatactgctcatctgtggagcagaggcacagacaacccttcccatctggcgggacccagaggtgctgagatgggggtctgggaaacactgcccagccctgaccagccctgtgggtggaggtacctgtaaaaagcgaaaggcagcagcctggtgtgctgatccggggccacacggaggaggagccgccccagcctgaggtctgcaacaccaagaagtggctcaggcaactctggacatctctgcctattatcagtgctggggacacccctgggggtcgggacgtgtaccctgggaggcctggctgtggggatagtgtggggcgaacagcctgagctgaggatacccaggtacctgtcagcagctgggagaggatgggggggtcgacctcttgcaggagggtgggtgtggtgcagagagaggcagtccccatgataggcccattggtcctggggttgaccagtgagccagtaaattatcttattgctttaaacaagtttgtgcttaatctgtcccaactaaaatggagcttataaacttacttagcaaggaacctcaaggagggctcgttcttaaccatttgcaagatgcctctgaaaagagcggccctccgcatttgtgcctcagcagcgtgtttcttaccactctctgtcaactgaaagagtgccagccaggatatcttcctcttctctaaacactcgaggattgctgcacaaacgtggaaagcctttggcaggtctgtggtgctctgtaaaccgcaggagaccaaccctgagaatggccgacctggtgctcccatgggtaggagggtacagccctcagcacagaagagggcatttcctctttgcttattgtaagtcttaaaactggtgacagttttacctatagaaggtaatactgggcctctggacagaagaggctcaggtaggaggccagggacttcgagcacccacaccaaggctgctgcaccacgtcctcaaataagacattaaaagaaaggcccacaggccggatgcagtggctcatgcctgtaatcccaacactttgggaggccgaggtcggcggatcactgaggccagttcaagaccagcctggcaatatggtgaaaccccgtctctactaaaaatacaaaaattagccgggtgtgacagactcacgcctgtaatcccagctactcgggaggctgatgcaggagaattgcttgaacccaggaggctgaggttgcagtgagctgagatcacaccactgcactccagcctgggtgacagagtgagacccccatctcaaaaaaaaaaaaaaaaaacccacggcctgggagttctcactcacacttccgcaaacacaaggagctcctgagctagtctggaaaccctgacttggaagctggctgcctggtgcccctgcctggcccacagtgggagaggacaccttggctggtaaggtctgacttacatttgaggtcagatgtgacgacagcaggcccatcaaggagaagaagaaaaggaaaaccaatagctgtaaataaaaacgtgcacttattattacattaaaa

SEQ ID NO: 2883 - DNA, 4621 bp, Homo sapiens
ctcgcttccagcgcgccgagcggagcctaacgccgggtcctctaggaacctcgggccgggcagcacccgcgggattctgctggcgtcctccgctgccatgaagcgggaccggctgggccgcttcctgtctcctgggtcgtcccgacagtgcggggcctcggacggcggcggcggcgtcagccggactcggggccgcccttcccttagcggtgggccgagggtggacggggcgacggcgcggcgcgcctggggcccggtggggtcctgcggggacgcgggcgaggacggcgcggacgaggcaggagcaggccgggctctcgccatgggtcactgtcgcctctgccacgggaagttttcctcgagaagcctgcgcagcatctccgagagggcgcctggagcgagcatggagaggccatccgcagaggagcgcgtgctcgtacgggacttccagcgcctgcttggtgtggctgtccgccaggaccccaccttgtctccgtttgtctgcaagagctgccacgcccagttctaccagtgccacagccttctcaagtccttcctgcagagggtcaacgcctccccggctggtcgccggaagccttgtgcaaaggtcggtgcccagcccccaacaggggcagaggagggagcgtgtctggtggatctgatcacatccagcccccagtgcctgcacggcttggtggggtgggtgcatggacatgcggccagctgcggggccctgccccaccttcagaggacactgtcctccgagtactgcggcgtcatccaggtcgtgtggggctgcgaccagggccacgactacaccatggataccagctccagctgcaaggccttcttgctggacagtgcgctggcagtcaagtggccatgggacaaagagacggcgccacggctgccccagcaccgagggtggaaccctggggatgcccctcagacctcccagggtagagggacagggaccccagttggggctgagaccaagaccctgcccagcacggatgtggcccagcctccttcggacagcgacgcggtggggcccaggtcgggcttcccacctcagccaagcctgcccctttgcagggccccagggcagttgggtgagaagcagcttccatcttcaacctcggatgatcgggtaaaagacgagttcagtgacctttctgagggagacgtcttgagtgaagatgaaaatgacaagaagcaaaatgcccagtcttcggacgagtcctttgagccttacccagaaaggaaagtctctggtaagaagagtgaaagcaaagaagccaagaagtctgaagaaccaagaattcggaagaagccgggacccaagcccggatggaagaagaagcttcgttgtgagagggaggagcttcccaccatctacaagtgtccttaccagggctgcacggccgtgtaccgaggcgctgacggcatgaagaagcacatcaaggagcaccacgaggaggtccgggagcggccctgcccccaccctggctgcaacaaggttttcatgatcgaccgctacctgcagcgccacgtgaagctcatccacacagaggtgcggaactatatctgtgacgaatgtggacaaaccttcaagcagcggaagcaccttctcgtccaccaaatgcgacattcgggagccaagcctttgcagtgtgaggtctgtgggttccagtgcaggcagcgggcatccctcaagtaccacatgaccaaacacaaggctgagactgagctggactttgcctgtgaccagtgtggccggcggtttgagaaggcccacaacctcaatgtacacatgtccatggtgcacccgctgacacagacccaggacaaggccctgcccctggaggcggaaccaccacctgggccaccgagcccctctgtgaccacagagggccaggcggtgaagcccgaacccacctgaggacggcagtgaggatgagcacctctagcagcctggactccgcagtggctgtgtcagcctcacccttcgtgtgcacccgcatgggagggtcggagggtgctgcccgcccttggtgctggaggcgggcttggtgtccggctcaagtagccttcctctgctctgggaccagtggtttattttcccgcaaacgctgagtgactcggggccggacagttcataaataattgattcctttccccactaaagcagtcgaggagatttgtaatccactttttagtgcaacaagagctccatgttatgcttgtaataaattatttacacgggagctgggctggtgtgcagtggcaggtcccgtcagaagagatgaggctcctgggacaggtcagcgtcaggggcagcctgctgtctgctctggagggcggcgctcacctctgggtcgcagtccccacgatcagccagcagctgtgagagaggagcaggtcctcagcccatgccgcccactaggcctcagaccacaggggaggggctctggcagaaatagtcgagttgtattgccagccaggcaggcacatggcccaggcagctgtcaattctcatgtcccccacatggcccaaggtgggcatcttgacgttacctctgccacgtgtgagaagctctttttcgggcaccgaggtattaactgcagcagaaaaagacgagcttttgttatcagttccacggggttgccctagagagaaaacaggcaaactcacaggttagaagacatacagaaacagggctggtgtgtcccccatagtctgcatgctgtgccggaacattctttggcagaaggagcctccggctggggggagctcccctggaggtgggactggcccttgcacctgcctgacccttgagctccaggctcctgccagctggaggtgaaactgtgcttgtatccccagccacgaagagctggaccagcttcaagtacatgtccacagcaacatgcaggaaggcctcttccctgatggccgcgtcttcatggaagtaggagagaagactagaggtaaagacatagtgacaaatggctacagactgctggaaaggtagcaggtgatgccaagggatactgctcatctgtggagcagaggcacagacaacccttcccatctggcgggacccagaggtgctgagatgggggtctgggaaacactgcccagccctgaccagccctgtgggtggaggtacctgtaaaaagcgaaaggcagcagcctggtgtgctgatccggggccacacggaggaggagccgccccagcctgaggtctgcaacaccaagaagtggctcaggcaactctggacatctctgcctattatcagtgctggggacacccctgggggtcgggacgtgtaccctgggaggcctggctgtggggatagtgtggggcgaacagcctgagctgaggatacccaggtacctgtcagcagctgggagaggatgggggggtcgacctcttgcaggagggtgggtgtggtgcagagagaggcagtccccatgataggcccattggtcctggggttgaccagtgagccagtaaattatcttattgctttaaacaagtttgtgcttaatctgtcccaactaaaatggagcttataaacttacttagcaaggaacctcaaggagggctcgttcttaaccatttgcaagatgcctctgaaaagagcggccctccgcatttgtgcctcagcagcgtgtttcttaccactctctgtcaactgaaagagtgccagccaggatatcttcctcttctctaaacactcgaggattgctgcacaaacgtggaaagcctttggcaggtctgtggtgctctgtaaaccgcaggagaccaaccctgagaatggccgacctggtgctcccatgggtaggagggtacagccctcagcacagaagagggcatttcctctttgcttattgtaagtcttaaaactggtgacagttttacctatagaaggtaatactgggcctctggacagaagaggctcaggtaggaggccagggacttcgagcacccacaccaaggctgctgcaccacgtcctcaaataagacattaaaagaaaggcccacaggccggatgcagtggctcatgcctgtaatcccaacactttgggaggccgaggtcggcggatcactgaggccagttcaagaccagcctggcaatatggtgaaaccccgtctctactaaaaatacaaaaattagccgggtgtgacagactcacgcctgtaatcccagctactcgggaggctgatgcaggagaattgcttgaacccaggaggctgaggttgcagtgagctgagatcacaccactgcactccagcctgggtgacagagtgagacccccatctcaaaaaaaaaaaaaaaaaacccacggcctgggagttctcactcacacttccgcaaacacaaggagctcctgagctagtctggaaaccctgacttggaagctggctgcctggtgcccctgcctggcccacagtgggagaggacaccttggctggtaaggtctgacttacatttgaggtcagatgtgacgacagcaggcccatcaaggagaagaagaaaaggaaaaccaatagctgtaaataaaaacgtgcacttattattacattaaaattacctgtgctgtcattctaaa

SEQ ID NO: 2884 - DNA, 1826 bp, Homo sapiens
aaatctaccatctctgcccagaaaaatgcacgaacgcacggacctgcccgtcactcggattttggaaggtggcctggcggaccctcctgctacatctcctctacaggtggagcccaggctgtgatgcaccggctcagcgagcggagtggaaagccaaggtccgcaggatctgagctgtccaaggagcaggccgggctctcgccatgggtcactgtcgcctctgccacgggaagttttcctcgagaagcctgcgcagcatctccgagagggcgcctggagcgagcatggagaggccatccgcagaggagcgcgtgctcgtacgggacttccagcgcctgcttggtgtggctgtccgccaggaccccaccttgtctccgtttgtctgcaagagctgccacgcccagttctaccagtgccacagccttctcaagtccttcctgcagagggtcaacgcctccccggctggtcgccggaagccttgtgcaaaggtcggtgcccagcccccaacaggggcagaggagggagcgtgtctggtggatctgatcacatccagcccccagtgcctgcacggcttggtggggtgggtgcatggacatgcggccagctgcggggccctgccccaccttcagaggacactgtcctccgagtactgcggcgtcatccaggtcgtgtggggctgcgaccagggccacgactacaccatggataccagctccagctgcaaggccttcttgctggacagtgcgctggcagtcaagtggccatgggacaaagagacggcgccacggctgccccagcaccgagggtggaaccctggggatgcccctcagacctcccagggtagagggacagggaccccagttggggctgagaccaagaccctgcccagcacggatgtggcccagcctccttcggacagcgacgcggtggggcccaggtcgggcttcccacctcagccaagcctgcccctttgcagggccccagggcagttgggtgagaagcagcttccatcttcaacctcggatgatcggagacgtcttgagtgaagatgaaaatgacaagaagcaaaatgcccagtcttcggacgagtcctttgagccttacccagaaaggaaagtctctggtaagaagagtgaaagcaaagaagccaagaagtctgaagaaccaagaattcggaagaagccgggacccaagcccggatggaagaagaagcttcgttgtgagagggaggagcttcccaccatctacaagtgtccttaccagggctgcacggccgtgtaccgaggcgctgacggcatgaagaagcacatcaaggagcaccacgaggaggtccgggagcggccctgcccccaccctggctgcaacaaggttttcatgatcgaccgctacctgcagcgccacgtgaagctcatccacacagaggtgcggaactatatctgtgacgaatgtggacaaaccttcaagcagcggaagcaccttctcgtccaccaaatgcgacattcgggagccaagcctttgcagtgtgaggtctgtgggttccagtgcaggcagcgggcatccctcaagtaccacatgaccaaacacaaggctgagactgagctggactttgcctgtgaccagtgtggccggcggtttgagaaggcccacaacctcaatgtacacatgtccatggtgcacccgctgacacagacccaggacaaggccctgcccctggaggcggaaccaccacctgggccaccgagcccctctgtgaccacagagggccaggcggtgaagcccgaacccacctgaggacggcagtgaggatgagcacctctagcagcctg

SEQ ID NO: 2885 - DNA, 3980 bp, Homo sapiens
gagtggaaatgcctggaccctgctcagaggactctttacagggatgtgatgctggagaattataggaacctggtctccctggattttcggtctgtcacccaggctaaagtgcagtggtgtcacctcggctcactgcaacctccacttcccaggttcaagcaattctcctgcctcagccttccaagtagctgggactacagatatctcttccaaatgcatgatgaagacattcttctcaacagggcaaggcaatacagaagcgttccacacagggacattgcaaagacaagcaagtcatcacattggagatttttgcttccagaaaattgagaaagacattcatggcttccagtttcagtggaaagaagatgaaacaaatgaccatgcagcacccatgacagaaatcaaagagttgactggtagtacaggccaacatgatcaaaggcatgctggaaacaagcatattaaagatcagcttggattaagctttcattcgcatctgcctgaactgcacatatttcagcctgaagggaaaattggtaatcaagttgagaagtctatcaacaatgcttcctcagtttcaacatcccaaagaatttgttgtaggcccaaaacccatatttctaataagtatggaaataattccctccattcttcattactcacacaaaaacggaatgtacacatgagagaaaaatctttccaatgtattgagagtggcaaatcctttaattgtagctcacttttaaaaaaacatcagataacccacttagaagagaaacaatgtaaatgtgatgtatatggcaaggtatttaatcagaagcgataccttgcatgccatcgtagatctcacattgatgagaaaccttacaagtgtaatgagtgtggcaagatctttggtcacaatacatccctcttccttcacaaggcgcttcatactgcagacaaaccttatgaatgtgaagaatgtgacaaagttttcagtcgcaaatcacaccttgaaacacataagataatttatactggagggaaaccatacaaatgtaaggtttgtgacaaagctttcacatgtaattcatacctagcaaaacatactataattcacactggagagaaaccttacaagtgtaatgaatgtggcaaggtttttaatcgactgtcaacccttgcacgccatcgtaggcttcatactggagagaaaccttatgaatgtgaagaatgtgaaaaagttttcagtcgcaaatcacatcttgaaagacataagaggattcatactggagagaaaccatacaaatgtaaggtttgtgacaaggcttttgcatataattcatacctggcaaaacatagtataattcacactggagagaagccttacaagtgtaatgaatgtggcaaggtttttaatcaacaatcaactcttgcacgccatcatagacttcatactgcagagaaaccatacaaatgtgaagaatgtgacaaagttttcaggtgcaaatcacaccttgaaagacataggaggattcatactggagagaaaccatacaaatgtaaggtttgtgacaaggctttccggagtgattcatgccttacagaacatcagagagttcatactggagagaaaccatacatgtgtaatgaatgtggcaaggtttttagtacaaaagcaaaccttgcatgtcatcataaacttcatactgcagagaaaccgtacaaatgtgaagaatgtgagaaagttttcagtcgcaaatcacacatggaaagacataggaggattcatactggagagaaaccgtacaaatgtaaggtttgtgacaaggctttccggagggattcacacctggcacaacatcagagagttcatactggagagaaaccttacaagtgtaatgagtgtggcaagaccttccgtcagacatcatcgcttataatccatcgtaggcttcatactggagagaaaccttacaagtgtaatgagtgtggcaagaccttcagtcagatgtcatccctcgtataccatcataggcttcatagtggagagaaaccttacaagtgtaatgaatgtggcaaggtttttaatcaacaagcacaccttgcacagcatcagagagttcatactggagagaaaccttacaagtgtaatgagtgtggcaagaccttcagtcagatgtcaaaccttgtataccatcatagacttcatagtggagagaaaccttgaaagtgtaatgagtgtggcaagaccttcagtcagatgtcaaaccttgtataccatcatagacttcatagtggagagaaaccttaaaagtgtaatgagtgtggcaacaccttccatcacaattcaacccttgtaagtcacaaagccattcatactggagagaaactttacaagtgtaatgaatgtggcaaggtttttaatcaaaaaacaacccttgcacgtcatcatagaattcatactgcagagaaactttacaaataggaagaatgtgacaaagttttcggttgcaaatcaaaccttgaaacacataagaaaatgcatgctgaagagaaaccacacagatgtaaggtttatgacaagatttttgaatataattcatacctggcaaaacatattagaattcaaactggagagaaaccttacaaatgtgatgagtgtggcaacacctttggtcaaaattcataccttgtaattcaaaaggcaattcgtattggagagaaaccctacaagtgtaatgaatgtggcatagtttttaatcaacagtcacaccttgcaagtcatcatagtcttcatactgcagagaaatcttacaaatgtgaagactgtgacaaagttgtcagtcacaaatcacagcttgaaagacaggagaattcatactggagaaaaaacatacaaatgtaaggtttgtaacaaggcttttgggagtgattcacacctggcacaccatactagaattcacactggagagaaaccttacaagtgcaatgagtgtggcaaagcctttagtgggcagtcaccacttattcaccatcaagcaatccatagtatagggaaacttgactaatataatgattgtcacaaagttttcagtaatgctacaaccattgcaaatcattggagaatccataatgagagatcttacaagtgtaataaatgtgacagatttttcagatatcgttcatatattgctattcatcatcgaactcatgctggagagaaaccttataaatgtcatgattgtggcaaggtcttcagtcaagtttcatcctatgcaaaacataggaggattcatacaggagagaaactcacaagtgtgatgattgtggcaaagcgtttacttcacattcacacctcaatagacatcagagaatccatgctggacagaaatcttacaaatgtcatcagtgtggtaaggtcttcagtccgagatcactccttgcagaccatcagacaattccttttggagacagttgtttcaaatgccattagtatagcaagccatcaagcattaattgacattacagttaaatgagcactgacctgagtttgagttgacttaacattgagtttaagcattaattgacattaaactgtttatgttaagaggactgggctgggcactgtggctcacgcctgcaatgccagcactttgagaggccaagactggtaggtcactggaggttaagagtttgagaacagcctggccaacagacgggagccacttttcccagcctgtgttttcatttctattctttctttcttttttcttttttttgtttttgtttttgagatggagtctcttgctctgtcatccaggttggagtgcagtggcatgatcttgactcactacaacctccgcctcccaggttcaagcgatcctcctgcctcagtctcctgactagctgggactacaggtgcatgccaccacacctggataattttttgtatttttagtagagactgggtttcgctgtgttagcctggatgg

SEQ ID NO: 2886 - DNA, 2256 bp, Homo sapiens
aggcctggtttctgtcctgcgcgcgcagattcgcgcagaccaggaagcggatcccgtggaatgacggtgacgccgcggcgggcggattgacttctaaagaatcttggtacgtgaggaagaaacccagaagaggaagaggaaagcaaaggagtcagggatggctcttcctcagatatctcttccaaatgcatgatgaagacattcttctcaacagggcaaggcaatacagaagcgttccacacagggacattgcaaagacaagcaagtcatcacattggagatttttgcttccagaaaattgagaaagacattcatggcttccagtttcagtggaaagaagatgaaacaaatgaccatgcagcacccatgacagaaatcaaagagttgactggtagtacaggccaacatgatcaaaggcatgctggaaacaagcatattaaagatcagcttggattaagctttcattcgcatctgcctgaactgcacatatttcagcctgaagggaaaattggtaatcaagttgagaagtctatcaacaatgcttcctcagtttcaacatcccaaagaatttgttgtaggcccaaaacccatatttctaataagtatggaaataattccctccattcttcattactcacacaaaaacggaatgtacacatgagagaaaaatctttccaatgtattgagagtggcaaatcctttaattgtagctcacttttaaaaaaacatcagataacccacttagaagagaaacaatgtaaatgtgatgtatatggcaaggtatttaatcagaagcgataccttgcatgccatcgtagatctcacattgatgagaaaccttacaagtgtaatgagtgtggcaagatctttggtcacaatacatccctcttccttcacaaggcgcttcatactgcagacaaaccttatgaatgtgaagaatgtgacaaagttttcagtcgcaaatcacaccttgaaacacataagataatttatactggagggaaaccatacaaatgtaaggtttgtgacaaagctttcacatgtaattcatacctagcaaaacatactataattcacactggagagaaaccttacaagtgtaatgaatgtggcaaggtttttaatcgactgtcaacccttgcacgccatcgtaggcttcatactggagagaaaccttatgaatgtgaagaatgtgaaaaagttttcagtcgcaaatcacatcttgaaagacataagaggattcatactggagagaaaccatacaaatgtaaggtttgtgacaaggcttttgcatataattcatacctggcaaaacatagtataattcacactggagagaagccttacaagtgtaatgaatgtggcaaggtttttaatcaacaatcaactcttgcacgccatcatagacttcatactgcagagaaaccatacaaatgtgaagaatgtgacaaagttttcaggtgcaaatcacaccttgaaagacataggaggattcatactggagagaaaccatacaaatgtaaggtttgtgacaaggctttccggagtgattcatgccttacagaacatcagagagttcatactggagagaaaccatacatgtgtaatgaatgtggcaaggtttttagtacaaaagcaaaccttgcatgtcatcataaacttcatactgcagagaaaccgtacaaatgtgaagaatgtgagaaagttttcagtcgcaaatcacacatggaaagacataggaggattcatactggagagaaaccgtacaaatgtaaggtttgtgacaaggctttccggagggattcacacctggcacaacatcagagagttcatactggagagaaaccttacaagtgtaatgagtgtggcaagaccttccgtcagacatcatcgcttataatccatcgtaggcttcatactggagagaaaccttacaagtgtaatgagtgtggcaagaccttcagtcagatgtcatccctcgtataccatcataggcttcatagtggagagaaaccttacaagtgtaatgaatgtggcaaggtttttaatcaacaagcacaccttgcacagcatcagagagttcatactggagagaaaccttacaagtgtaatgagtgtggcaagaccttcagtcagatgtcaaaccttgtataccatcatagacttcatagtggagagaaaccttgaaagtgtaatgagtgtggcaagaccttcagtcagatgtcaaaccttgtataccatcatagacttcatagt

SEQ ID NO: 2887 - DNA, 4556 bp, Homo sapiens
gaccaggaagcggatcccgtggaatgacggtgacgccgcggcgggcggattgacttctaaagaatcttggtacgtgaggaagaaacccagaagaggaagaggaaagcaaaggagtcagggatggctcttcctcagggtctattgacattcagggacgtggccatagaattctctcaggaggagtggaaatgcctggaccctgctcagaggactctttacagggatgtgatgctggagaattataggaacctggtctccctggatatctcttccaaatgcatgatgaagacattcttctcaacagggcaaggcaatacagaagcgttccacacagggacattgcaaagacaagcaagtcatcacattggagatttttgcttccagaaaattgagaaagacattcatggcttccagtttcagtggaaagaagatgaaacaaatgaccatgcagcacccatgacagaaatcaaagagttgactggtagtacaggccaacatgatcaaaggcatgctggaaacaagcatattaaagatcagcttggattaagctttcattcgcatctgcctgaactgcacatatttcagcctgaagggaaaattggtaatcaagttgagaagtctatcaacaatgcttcctcagtttcaacatcccaaagaatttgttgtaggcccaaaacccatatttctaataagtatggaaataattccctccattcttcattactcacacaaaaacggaatgtacacatgagagaaaaatctttccaatgtattgagagtggcaaatcctttaattgtagctcacttttaaaaaaacatcagataacccacttagaagagaaacaatgtaaatgtgatgtatatggcaaggtatttaatcagaagcgataccttgcatgccatcgtagatctcacattgatgagaaaccttacaagtgtaatgagtgtggcaagatctttggtcacaatacatccctcttccttcacaaggcgcttcatactgcagacaaaccttatgaatgtgaagaatgtgacaaagttttcagtcgcaaatcacaccttgaaacacataagataatttatactggagggaaaccatacaaatgtaaggtttgtgacaaagctttcacatgtaattcatacctagcaaaacatactataattcacactggagagaaaccttacaagtgtaatgaatgtggcaaggtttttaatcgactgtcaacccttgcacgccatcgtaggcttcatactggagagaaaccttatgaatgtgaagaatgtgaaaaagttttcagtcgcaaatcacatcttgaaagacataagaggattcatactggagagaaaccatacaaatgtaaggtttgtgacaaggcttttgcatataattcatacctggcaaaacatagtataattcacactggagagaagccttacaagtgtaatgaatgtggcaaggtttttaatcaacaatcaactcttgcacgccatcatagacttcatactgcagagaaaccatacaaatgtgaagaatgtgacaaagttttcaggtgcaaatcacaccttgaaagacataggaggattcatactggagagaaaccatacaaatgtaaggtttgtgacaaggctttccggagtgattcatgccttacagaacatcagagagttcatactggagagaaaccatacatgtgtaatgaatgtggcaaggtttttagtacaaaagcaaaccttgcatgtcatcataaacttcatactgcagagaaaccgtacaaatgtgaagaatgtgagaaagttttcagtcgcaaatcacacatggaaagacataggaggattcatactggagagaaaccgtacaaatgtaaggtttgtgacaaggctttccggagggattcacacctggcacaacatcagagagttcatactggagagaaaccttacaagtgtaatgagtgtggcaagaccttccgtcagacatcatcgcttataatccatcgtaggcttcatactggagagaaaccttacaagtgtaatgagtgtggcaagaccttcagtcagatgtcatccctcgtataccatcataggcttcatagtggagagaaaccttacaagtgtaatgaatgtggcaaggtttttaatcaacaagcacaccttgcacagcatcagagagttcatactggagagaaaccttacaagtgtaatgagtgtggcaagaccttcagtcagatgtcaaaccttgtataccatcatagacttcatagtggagagaaaccttgaaagtgtaatgagtgtggcaagaccttcagtcagatgtcaaaccttgtataccatcatagacttcatagtggagagaaaccttaaaagtgtaatgagtgtggcaacaccttccatcacaattcaacccttgtaagtcacaaagccattcatactggagagaaactttacaagtgtaatgaatgtggcaaggtttttaatcaaaaaacaacccttgcacgtcatcatagaattcatactgcagagaaactttacaaataggaagaatgtgacaaagttttcggttgcaaatcaaaccttgaaacacataagaaaatgcatgctgaagagaaaccacacagatgtaaggtttatgacaagatttttgaatataattcatacctggcaaaacatattagaattcaaactggagagaaaccttacaaatgtgatgagtgtggcaacacctttggtcaaaattcataccttgtaattcaaaaggcaattcgtattggagagaaaccctacaagtgtaatgaatgtggcatagtttttaatcaacagtcacaccttgcaagtcatcatagtcttcatactgcagagaaatcttacaaatgtgaagactgtgacaaagttgtcagtcacaaatcacagcttgaaagacaggagaattcatactggagaaaaaacatacaaatgtaaggtttgtaacaaggcttttgggagtgattcacacctggcacaccatactagaattcacactggagagaaaccttacaagtgcaatgagtgtggcaaagcctttagtgggcagtcaccacttattcaccatcaagcaatccatagtatagggaaacttgactaatataatgattgtcacaaagttttcagtaatgctacaaccattgcaaatcattggagaatccataatgagagatcttacaagtgtaataaatgtgacagatttttcagatatcgttcatatattgctattcatcatcgaactcatgctggagagaaaccttataaatgtcatgattgtggcaaggtcttcagtcaagtttcatcctatgcaaaacataggaggattcatacaggagagaaactcacaagtgtgatgattgtggcaaagcgtttacttcacattcacacctcaatagacatcagagaatccatgctggacagaaatcttacaaatgtcatcagtgtggtaaggtcttcagtccgagatcactccttgcagaccatcagacaattccttttggagacagttgtttcaaatgccattagtatagcaagccatcaagcattaattgacattacagttaaatgagcactgacctgagtttgagttgacttaacattgagtttaagcattaattgacattaaactgtttatgttaagaggactgggctgggcactgtggctcacgcctgcaatgccagcactttgagaggccaagactggtaggtcactggaggttaagagtttgagaacagcctggccaacagacgggagccacttttcccagcctgtgttttcatttctattctttctttcttttttcttttttttgtttttgtttttgagatggagtctcttgctctgtcatccaggttggagtgcagtggcatgatcttgactcactacaacctccgcctcccaggttcaagcgatcctcctgcctcagtctcctgactagctgggactacaggtgcatgccaccacacctggataattttttgtatttttagtagagactgggtttcgctgtgttagcctggatggtctcgattttctgatcttatgattcacccacctctacctcccgaagtgctgagattatgggcgtgagccaccgtgactggcctgttttttgtttctttaacaaaaagttatggggatttctatgagtattgtgttgaatctaaatcacattcggttatataatcattgagcaatactaatttttccaatcagtatggattgtatgtgtatttatatgtttttaatcattttgatcaatgtttgtagatttcaaggtacaaacttctcacctttatatgtttattcctaaatatttcttactttaagctctttagcaaatggaagtggtttttaattttattttaaaattatttaatgttaatgtatggaaattcaactaatttttggtgctattattctattctgcaaatacactgaatatgtttattagttccagttgtattttggttgactgtgattttcttcacagatcatgtcatctacaaacaaataaaatttgacttctttctttctg

SEQ ID NO: 2888 - DNA, 4086 bp, Homo sapiens
cgggcgggtgtggccaggggtgtgggtctgtgagggaccggtcggaagggcgtcgcgcggcctcgggtgacatgcggggggcggcgagcgcgagtgtccgcgagccgacgccgctcccgggtagaggcgccccccgcacaaagccccgggcgggccgaggcccgactgtagggactccagccaccttggccctccctgcccggggaaggccgcgctcaaggaatggcctcgcatccaaaggccagcgaggagcggcccctacggggcctgggcacagagctctgccttccagggacactgctcttccccaggagagaaacaagaagctggaggctgtggggacaggaattgaacctaaagccatgtcccagggcttggtgacatttggggatgtggctgtagatttctcccaagaggagtgggagtggctgaaccccattcagaggaacttgtacaggaaggtgatgttggagaactacaggaacctggcatcgctgggactttgtgtttctaagcccgatgtgatctcctcgttggaacaaggaaaagagccttggacagtgaagcgaaagatgacaagagcctggtgcccagacttgaaggctgtgtggaagatcaaggagttacctctcaagaaggacttctgcgaaggaaagctatcccaggcagtgataacagagagactcacaagctataatctggagtactctctgttaggggaacactgggattatgatgctctgtttgagacacagccgggcttggtgactatcaaaaacctggctgttgacttccgccagcagctacacccagctcagaagaatttctgtaagaatgggatatgggagaacaacagtgacctgggatcagcaggacattgtgtggctaagccagatttagtctctttactagagcaagagaaggagccctggatggtgaagcgagagctgacaggaagcctgttctcaggccagcgatctgtacatgagacccaggaattatttccaaagcaagattcatatgctgaaggggtaacagacagaacctcaaacactaaacttgattgttccagtttcagagaaaattgggattctgactatgtgtttggaaggaagcttgcagtaggtcaagagacacaattcaggcaagagccaattactcataacaaaaccctctctaaggaaagagaacgtacatataacaaatctggaagatggttctatttggacgattcagaagagaaagttcataatcgtgattcaattaaaaattttcaaaaaagttcagtggtaataaaacaaacaggcatctatgcaggaaaaaagcttttcaagtgtaatgaatgtaagaaaacttttacccagagctcatctcttactgttcatcagagaattcacactggagagaaaccttataaatgtaatgaatgtgggaaggcctttagtgacggctcatcctttgcccgacaccagagatgtcacactggcaagaagccctatgagtgcattgagtgtgggaaagctttcatacagaacacatcccttatccgtcactggagatactatcatactggggagaaaccctttgattgcatcgattgtgggaaagccttcagtgaccacatagggcttaatcaacacaggagaattcatactggagagaaaccttacaaatgtgatgtatgtcacaaatccttcaggtatggttcctcccttactgtacatcaaaggattcataccggagaaaaaccatatgaatgtgatgtttgcagaaaagccttcagccatcatgcatcactcactcaacatcaaagagtacattctggagaaaagccttttaagtgtaaagagtgcggaaaagcttttaggcagaatatacaccttgccagtcatttaaggattcatactggggagaagccttttgaatgtgcggagtgtggaaaatccttcagcatcagttctcagcttgccactcatcagagaatccatactggagagaagccctatgaatgtaaggtttgtagtaaagcgttcacccagaaggctcaccttgcacagcatcagaaaacccatacaggagagaaaccatatgagtgcaaggaatgcggtaaagccttcagccagaccacacacctcattcaacatcagagagttcacactggtgagaaaccctataaatgtatggaatgtgggaaggcctttggtgataactcatcctgtactcaacatcaaagactgcacactggccaaagaccttatgaatgtattgagtgtggaaaggcattcaagacaaaatcctcccttatttgtcatcgcagaagtcatactggagaaaaaccttatgaatgcagtgtgtgtggcaaagcctttagtcatcgtcaatcccttagtgtacatcagagaatccattctggaaagaaaccatatgaatgtaaggaatgtaggaaaaccttcatccaaattggacaccttaatcaacataagagagttcatactggagagagatcttataactataagaaaagcagaaaagtcttcaggcaaactgctcacttagctcatcatcagcgaattcatactggagagtcgtcaacatgcccctctttaccttccacgtcaaatcctgtggatctgtttcccaaatttctctggaatccatcctccctcccatcaccatagcctcgagacgtcatttctgtttgactactccagcagtttaaaaccccatctccctgcccttttgttttctttttgtcccttattagttagttcttcacataagtgtaaatgtaacttattcactcctcttgtaaaacttatagtttctttaaattggttaatgtgtgagatgtgctcagcacagtgcctggtccatagtaagtgctcagtaaacttagctgttttaaaaactttgtatttgaacattgaaaagttacagtagtcagctctgataaaaaaatgatgcagtagggtgagggtaggaaaaagcacattttctatcaggaacagaattctccagtagtgggtgaggttttgcctttgttggttttaaaacttgattctataatgccaagttagttttgtggctttccatctgaccctatgtgaatgtaaggtgatgtgaccttgttggtgagaaaattaaactttacatttgacttgatttgttttagaaagtctagggaccatgaatgaataggccagctgggacaaatgaatttaaaaaatcagaaaaatgcaagatttatatgcatgaagttaaaacaactgacgttactcaagaattagaaaactttgcaagatttgacttgtttaaaaatcacatttataagtgaaccgtattaaaacttttaaggaaccattcattgtgaggtaaactgatccagaataggggtcagcaaactatgactcatggccacagtctcactgactgtttttgtatggtccatgatctagaatttaaaaaaattttaaagggttgaaaaaagtgaaaagaatattttcaacatgaaaattatatgaaatttaagttttggtgtctgtaaataaagttttgttggcttcagccacacagtgatttacaccttgattgtgctgcttccaggctgtagcagcagagttgagcagttgtgacaggagaccatgtggcctgcagagcccaaatatctactgtctgatcctacacagaaaatgtgtgtgatccctgctatggagcagaggttatcaaactaaagcccatggaccaaatcctatctgctgcttgtttttgtaaatagagttttatcaaaccacagccatgcttacttgtttagctattgactatggctgctttagacaactgtgacagactatatggctcgcaaaactgcaaatatttcctatcctttaacagaaagtttgccaacctctgctctagagtagagaaaaatgtataaaagattttaattttatgagggcaatacaactgtcacatcagaaacaagaaaacaaatgataaaggaactcatttatcaatagaggtgaaaggaaattattaaactatattgaaaaataaagatgtcaataaaaggagaaatgatatttttct

SEQ ID NO: 2889 - DNA, 2148 bp, Homo sapiens
agaaaggactttgaagagcaagcggcgttgttcgcctgcggaagcagtgctgccggtctctggacaaatttctcccggaggtggagacaaggaagctccagcttcgctttcccttgtggcccagagtggaacatactgagctgcactgaatcatctggatgcactcgcaactttaggaactggtggcaatttgtaaaaagacagctctggaagttgaagagaccagtggcttcaagcaaaaagtaaattgaaaatgggagatatctttttgtgtaagaaagtggaatcaccaaagaagaatttgagagaatccaaacaaagggaggaggatgatgaagatccagatctgatctatgttggggtggagcatgtacatagagatgctgaagttctctttgtcgggatgatttcaaattcaaaaccagtcgtttcaaacattttgaacagagtcaccccaggctcaaagtcaagaagaaagaaaggccacttccgtcaatatcctgctcacgtgtcgcagcctgcaaatcatgtgacctctatggcaaaagccatcatgcccgtttctctgtctgaggggcgatcgacagatagtcctgtcactatgaagtcttcatctgaacctggttataaaatgagctcaccacaagttgtttctcccaattactcagattcgctccccccagggactcagtgtctagttggagctatggtctctggaggaggcagaaatgagagttctcctgattcaaagcgactttccacttcagatataaacagcagagattccaaaagggttaaactcagggatggaatcccaggggtaccttctttagctgtggtcccttcagatatgtcttctacaataagcacaaatacaccctcacaggggatctgcaactcatcaaaccatgttcagaatggagtaacatttccttggcctgatgctaatggaaaggcacatttcaatcttacagatccagagagagcaaatgagtctggcctggcaatgacagacatttcaagtctagcaagtcaaaacaagacctttgatcccaagaaagaaaatcccatcgtgttacttagcaacttttactatggacagcataaaggagatgggcagccggaacagaagactcacaccacctttaaatgcctcagctgcgtgaaagttctaaaaaatattaagtttatgaatcacatgaagcatcatttggaatttgagaagcagaggaacgacagctgggaagaccacaccacctgccagcactgccaccggcagtttcccactcccttccagctacagtgtcacattgatagtgtacacatcgccatggggccctctgctgtctgtaaaatctgtgaattgtcatttgaaacagatcaggtcctcttacaacacatgaaggaccatcataagcctggcgaaatgccctacgtgtgccaggtttgccattacagatcgtcggtctttgctgatgtggaaacacattttagaacgtgccatgaaaacacaaagaatttgctttgtctgttttgtctcaaacttttcaaaactgcaataccatacatgaatcattgttggaggcacagcagaaggagggtccttcagtgttccaagtgccggctacagtttttgacgttgaaggaggaaatagagcacaaaaccaaggaccatcaaacatttaaaaagccggagcaactgcaagggttccctcgtgaaacaaaagttattattcaaacttcagttcagccaggatcaagtggtatggcttccgttattgttagcaacactgaccctcagtcttctcctgtaaaaactaaaaagaagacggctatgaacactagagattccagactcccttgcagcaaggattctagctgaaaatatgttcgactgacttccaggagttccgaaaggcagaagtgaggctaggccatatgtgcattgtggctgtagatgctagcaagcaatgtcatcaactgtcaggttgtttttcacagtgacatctcatcagctccctattgtcaagaagtagctccaaagtctttgagccctttcccagtcaaatgctcccaacaaggcatcccttattctgacctcagaggtttttcttgtttatgaactttaaataaatggaatcacacaaa

SEQ ID NO: 2890 - DNA, 5726 bp, Homo sapiens
aattataacagctggccttctggtgggcaaaccatcccctgatggactggaagcctaccccccaccccaagccctggctgcgacagctctggaaccctgactgcctgggtgcccctcagctctggaaccctgactgcctggatgctcctcagctctggaaccctgactgcttggataccccctcagctctggaaccctgactgcctggaaccgtgatccggaacccaagatcctttcaaggcctcaggggtattgctgctgccctcctccttctcaatttaaccccgcgtccagccgtcgccaccaggggcgtcagagcgcgcgcatgctcctagctcggagccgcgccgatctcgcgccggcacctggcagccaatcgcaggtctccactggacgcgcgcgtgtggaggcgtgcgcgtcggcggcgccgggggcctgaggaggcgtagtcgccgccggctgtgccccgggagcgcctccggggctggtgcgtggccggcagctcgcgaacagcagctgatccggactggatgtgaccttctgcctggaatagctcaagttcttaaaagttgcgttgtaataaacctgaggctgggaagttcaagatcaagatgctggacgatttggttccttagtgaaggctctcttcctggctggtggatgacagccttcttgctgtgttctcacatgacagaaagaggaagcaaggtggcagtttatataaaggaagcattgggacttgtggccccaccattcaggaataaaaaaattagaaaatggaacaatcatgtgaggaagagaaagagcctgaaccacagaagaacatacaagaaaccaaacaagtagatgacgaagatgctgagctcatctttgttggtgtggaacatgtaaatgaagatgctgagctaatctttgttggggtgacttcaaattcaaaaccagtcgtttcaaacattttgaacagagtcaccccgggttcatggtcaaggagaaaaaagtatgatcaccttagaaaagatactgctcgcaaattgcagcctaaaagtcatgagaccgttacatcagaagcagtgaccgtcctgccagcttcccaacttgaatcgagatcaacagatagtcctattattattgagcctttgtctaaacctgattatagaaatagttcaccacaagttgtgcctaataactcttcagaattaccttctcctttgattacattcacagattcattgcatcatccagtaagtacagcactttcagtaggaggtataaatgaaagtcctcgtgtatcaaagcaactttccactttcgaagtaaacagcataaatcccaaaagggctaaactcagggatggaattatagaaggaaattcttcagcttcgttcccttcagatacctttcatacaatgaatactcagcaaagtacaccctcaaataatgttcatacctcattaagccatgttcagaatggagcaccttttccagcagcttttccaaaggacaatatccatttcaagcctataaatacaaatcttgatagggaaaatgaattggcaaaaacagacattttgagtctaacaagtcaaaacaagacctttgatcccaagaaagaaaatcccattgtgttacttagtgacttttactatggacagcataaaggagaagggcagccggaacagaagactcacaccacctttaaatgcctcagctgcgtgaaagttctaaaaaatgttaagtttatgaatcacgtgaagcatcatttggaatttgagaagcagaggaacgacagctgggaaaaccacaccacctgccagcactgccaccggcagtttcccactcccttccagctacagtgtcacatcgaaaatgtccacactgcccaggagccctctactgtctgtaaaatctgtgaattgtcatttgaaacagatcaggtcctcttacaacacatgaaggaccatcataagcctggcgaaatgccctatgtgtgccaggtttgccattatagatcgtcggtctttgctgatgtagaaacacattttagaacgtgccatgaaaacacaaagaatttgctttgtcccttttgtctcaaaattttcaaaacagcaacaccatacatgtgtcattataggggccactggggaaagagtgcacaccagtgttccaagtgccggctacagtttttaactttcaaggagaaaatggagcacaagacccagtgtcatcaaatgtttaagaagcctaagcaactagaaggattacctcctgaaacaaaagttactattcaagtgtcactggaacctcttcagccaggatcagtggatgtagcatccataactgtgagcacatctgactctgaaccatcactccccaggtctaaaagcaaaatttcaaaaaagtcccattaattctagtttcagtaaatctaaagcaagtatttcaaaccaaattaaaaaacctcataaaacaaaaaatacaaaccatacattattcagtagcaccaaaaatagtgaaactagtggattatatatgactttttaaacaagattcaggatatatattatttgatctgaattttgaggtattattttaaaacatctggttttcatgttaactgtatctggcttaacacataaaaggtgtttgtgtgtgtgtgtgtgagagagaaaggtattaatttatttttttaattttaattttttttttttttactttagagacagggtctcactgttacccaggctggagtgcagtggcgtgatcctagctcactgcaaccttgaacttccaggctcaagcattcctccgcctcagcctttggagagtagctaggactacaggcgcagccaccacacccagctagttttttattttaattttttgtagcgatggaatcttgttatgtcgcccagggtggtctcgaactcctgaccttaggggagcctcctgcctcagcctccccaagtgctgggttgtgtgagtcactgcccctggcacctatttattgttttggtatttcatgttactcctaagcttgaaagctcttttttctatatacagaattcatagaatttttgaaatacttagttttctttacagctttttccatgcattcagcatttcatggttaactctagtcagactggaatggctttgttatgccctggcccacttgctgccgaattcccagaagtgcctctgctgtgctggcataaaataacctgaaaagattctgaaaagccaggatgtggaattgaaagagaagctgctgcgtgagcagagaccaagaaggcggaggttagttgagggagagcagtggttctttgttctagttgaaggataggcacacattcattctagtcttggggccaggtcaaaaggaacactgcttcagagtatctttacctacctgaaaacatccaaggaagccaaaccattcaaagtaaaatggttttgtttggtgaagggcccctgcagacatcaaacagccgtcatgtatcattggtttgaggtgaaatagcaataaaattaatagaatggtgcctggtactagctgacttcctgttctgtgatctaaaggtgaatttgattcattccctctcctctcccttctggctagccgttagtggagaatgaactggccatattctcagccacagctgtaaagcaagtttcccaaggggaagaagccctaatatctataatttgaactgtactggacccatagttttaactgaaaagggccaaacaagtggtgtctgtccagttcctggactgggctaaatttagttttcccactgttaagctggaatgaggactgtcccaacaacagtaggtacagtggacaaaaatagcccagggtgactgactgaatttaaacccataatggctttatatttttctgtgcatatatatcttaccctaattgaacatgtgaagcttgcaactttatgtcttgctttggacatgaatgtattacagcttgcagctattctgttaaatgtatagtttcccagttttttgacactaatgctgtttgggtcttacctgacacacaccagtgtgcaagaaatgtctctctaattcaataagttttaagacttagagttaatgtccttcatctgatctatcctatctaatctgtactatgggtgaatctttttcccttgctctccccaggggctgtttcacagtattctggagtaccttttgagtattggttcctgaacatcagcagtcttggctgcctctgtggactcccggagttgtctccctgcttgtgttctggtgccatcctttgttcctccacccctgaccaaggtgcccagcagcctgtcttcaccagtcaaggaatccgccatcttggctgtagacataggtctggagaaatctctccctttttccttgatttctttttaaaggtaccttatctctccccactcctttcttccctcctcaatctagttaaatttcctaagctttcacaaaaatccgggaagagataattaagagcttagcatccctcttagagtagaaggcagtacagataacaaagaagttgtgagtatattatctacattttagaaaattttctgactctagatccatagattctgttgtatttatttgccggacactcatttgattgatttgcaccttgaacactatactaggtcttttcagttacgttgcttgggttaagacactttgctaaaattacagcctgaatcctttctttagttgaagaaagggtatgtgtgtgcaagtgggtgtgtgtgtgccagtttttcttgtctcaggtagatactcccactgtgtataaatagatctacagacttttcatacttacctcccgtattctgtttctgtggtaaaaatatgaagtgttttagttgtatgttgagtgattggttggtattatcaacactgttgtttgcagtttcattaaagcatgctcttaaggagtacatatggtcattaattgccaactgtagattccagtgatctggcccctgcctacctccttcctctctttttcattctctgtcatgcttctccactgttttccccaatgacgcactattttgacacactggccttgctattccttaagcaaatcacattcttcccaatccaaagactttgcacatgctgttgtctttcttagaatgcccttcccctaggcctgcatggcttgctacctcacttaattgtttgacacttcctttggttcattgagcttcaaggctcttaaaatgccactgacaatgagatctccctttaaaaaaaaaaaaaaacttctacttttcctcttaaaggcactttactctctccccactcttttcttcctcttcaaagtatttaaatttcctaggttttcatgaaaaagctggaaagcgatcagcatcaagggctttgcttctgtcttagaattgagctagcttgagtcaatttctgtgcctgcaaccaaatgaaaattaatatagtgagttctttcaggagctttctctgtttttctattgatacctctatatatttttaaggcaatgtcactttgttttgtttacaaatatattgaatatgtcaagattactattttgttattgccctttgtgaatttccttgtctattttgctcgcttgttctttcaggtgaaatttattattttattaatgttgccaaaaattataagtaaaatatcaattatagtaataaaatgttttgtg

SEQ ID NO: 2891 - DNA, 4818 bp, Homo sapiens
atcccctgatggactggaagcctaccccccaccccaagccctggctgcgacagctctggaaccctgactgcctgggtgcccctcagctctggaaccctgactgcctggatgctcctcagctctggaaccctgactgcttggataccccctcagctctggaaccctgactgcctggaaccgtgatccggaacccaagatcctttcaaggcctcaggggtattgctgctgccctcctccttctcaatttaaccccgcgtccagccgtcgccaccaggggcgtcagagcgcgcgcatgctcctagctcggagccgcgccgatctcgcgccggcacctggcagccaatcgcaggtctccactggacgcgcgcgtgtggaggcgtgcgcgtcggcggcgccgggggcctgaggaggcgtagtcgccgccggctgtgccccgggagcgcctccggggctggtgcgtggccggcagctcgcgaacagcagctgatccggactggatgtgaccttctgcctggaatagctcaagttcttaaaagttgcgttgtaataaacctgaggctgggaagttcaagatcaagatgctggacgatttggttccttagtgaaggctctcttcctggctggtggatgacagccttcttgctgtgttctcacatgacagaaagaggaagcaaggtggcagtttatataaaggaagcattgggacttgtggccccaccattcaggaataaaaaaattagaaaatggaacaatcatgtgaggaagagaaagagcctgaaccacagaagaacatacaagaaaccaaacaagtagatgacgaagatgctgagctcatctttgttggtgtggaacatgtaaatgaagatgctgagctaatctttgttggggtgacttcaaattcaaaaccagtcgtttcaaacattttgaacagagtcaccccgggttcatggtcaaggagaaaaaagtatgatcaccttagaaaagatactgctcgcaaattgcagcctaaaagtcatgagaccgttacatcagaagcagtgaccgtcctgccagcttcccaacttgaatcgagatcaacagatagtcctattattattgagcctttgtctaaacctgattatagaaatagttcaccacaagttgtgcctaataactcttcagaattaccttctcctttgattacattcacagattcattgcatcatccagtaagtacagcactttcagtaggaggtataaatgaaagtcctcgtgtatcaaagcaactttccactttcgaagtaaacagcataaatcccaaaagggctaaactcagggatggaattatagaaggaaattcttcagcttcgttcccttcagatacctttcatacaatgaatactcagcaaagtacaccctcaaataatgttcatacctcattaagccatgttcagaatggagcaccttttccagcagcttttccaaaggacaatatccatttcaagcctataaatacaaatcttgatagggaaaatgaattggcaaaaacagacattttgagtctaacaagtcaaaacaagacctttgatcccaagaaagaaaatcccattgtgttacttagtgacttttactatggacagcataaaggagaagggcagccggaacagaagactcacaccacctttaaatgcctcagctgcgtgaaagttctaaaaaatgttaagtttatgaatcacgtgaagcatcatttggaatttgagaagcagaggaacgacagctgggaaaaccacaccacctgccagcactgccaccggcagtttcccactcccttccagctacagtgtcacatcgaaaatgtccacactgcccaggagccctctactgtctgtaaaatctgtgaattgtcatttgaaacagatcaggtcctcttacaacacatgaaggaccatcataagcctggcgaaatgccctatgtgtgccaggtttgccattatagatcgtcggtctttgctgatgtagaaacacattttagaacgtgccatgaaaacacaaagaatttgctttgtcccttttgtctcaaaattttcaaaacagcaacaccatacatgtgtcattataggggccactggggaaagagtgcacaccagtgttccaagtgccggctacagtttttaactttcaaggagaaaatggagcacaagacccagtgtcatcaaatgtttaagaagcctaagcaactagaaggattacctcctgaaacaaaagttactattcaagtgtcactggaacctcttcagccaggatcagtggatgtagcatccataactgtgagcacatctgactctgaaccatcactccccaggtctaaaagcaaaatttcaaaaaagtcccattaattctagtttcagtaaatctaaagcaagtatttcaaaccaaattaaaaaacctcataaaacaaaaaatacaaaccatacattattcagtagcaccaaaaatagtgaaactagtggattatatatgactttttaaacaagattcaggatatatattatttgatctgaattttgaggtattattttaaaacatctggttttcatgttaactgtatctggcttaacacataaaaggtgtttgtgtgtgtgtgtgtgagagagaaaggtattaatttatttttttaattttaattttttttttttttactttagagacagggtctcactgttacccaggctggagtgcagtggcgtgatcctagctcactgcaaccttgaacttccaggctcaagcattcctccgcctcagcctttggagagtagctaggactacaggcgcagccaccacacccagctagttttttattttaattttttgtagcgatggaatcttgttatgtcgcccagggtggtctcgaactcctgaccttaggggagcctcctgcctcagcctccccaagtgctgggttgtgtgagtcactgcccctggcacctatttattgttttggtatttcatgttactcctaagcttgaaagctcttttttctatatacagaattcatagaatttttgaaatacttagttttctttacagctttttccatgcattcagcatttcatggttaactctagtcagactggaatggctttgttatgccctggcccacttgctgccgaattcccagaagtgcctctgctgtgctggcataaaataacctgaaaagattctgaaaagccaggatgtggaattgaaagagaagctgctgcgtgagcagagaccaagaaggcggaggggctgtttcacagtattctggagtaccttttgagtattggttcctgaacatcagcagtcttggctgcctctgtggactcccggagttgtctccctgcttgtgttctggtgccatcctttgttcctccacccctgaccaaggtgcccagcagcctgtcttcaccagtcaaggaatccgccatcttggctgtagacataggtctggagaaatctctccctttttccttgatttctttttaaaggtaccttatctctccccactcctttcttccctcctcaatctagttaaatttcctaagctttcacaaaaatccgggaagagataattaagagcttagcatccctcttagagtagaaggcagtacagataacaaagaagttgtgagtatattatctacattttagaaaattttctgactctagatccatagattctgttgtatttatttgccggacactcatttgattgatttgcaccttgaacactatactaggtcttttcagttacgttgcttgggttaagacactttgctaaaattacagcctgaatcctttctttagttgaagaaagggtatgtgtgtgcaagtgggtgtgtgtgtgccagtttttcttgtctcaggtagatactcccactgtgtataaatagatctacagacttttcatacttacctcccgtattctgtttctgtggtaaaaatatgaagtgttttagttgtatgttgagtgattggttggtattatcaacactgttgtttgcagtttcattaaagcatgctcttaaggagtacatatggtcattaattgccaactgtagattccagtgatctggcccctgcctacctccttcctctctttttcattctctgtcatgcttctccactgttttccccaatgacgcactattttgacacactggccttgctattccttaagcaaatcacattcttcccaatccaaagactttgcacatgctgttgtctttcttagaatgcccttcccctaggcctgcatggcttgctacctcacttaattgtttgacacttcctttggttcattgagcttcaaggctcttaaaatgccactgacaatgagatctccctttaaaaaaaaaaaaaaacttctacttttcctcttaaaggcactttactctctccccactcttttcttcctcttcaaagtatttaaatttcctaggttttcatgaaaaagctggaaagcgatcagcatcaagggctttgcttctgtcttagaattgagctagcttgagtcaatttctgtgcctgcaaccaaatgaaaattaatatagtgagttctttcaggagctttctctgtttttctattgatacctctatatatttttaaggcaatgtcactttgttttgtttacaaatatattgaatatgtcaagattactattttgttattgccctttgtgaatttccttgtctattttgctcgcttgttctttcaggtgaaatttattattttattaatgttgccaaaaattataagtaaaatatcaattatagtaataaaatgttttgtgaaaaaaa

SEQ ID NO: 2892 - DNA, 4490 bp, Homo sapiens
ggttccgcgctggaagtctccgggggagtcgctgttgctgaggctgtcgcctgaggtttttcgcgctcctccctttcctcctcctctttctcctcctccttatccgaaccccagtcagaccgatctgctctgctctcggtgaccttgcaacttcatggatgacgacaaaccttttcaaccaaaaaacatttcaaaaatggcagaactctttatggaatgtgaagaagaagagctagagccatggcagaagaaagtagaagaaactcaggatgaggatgacgatgaactgatctttgttggagagatatcaagttcaaaaccagccatttcaaatattttgaacagaggccactccagctcatcttcaaaaggaataaagagtgagccacacagtccaggtattcctgaaatattcaggactgcaagtcaacgctgcagagacccaccatcaaatccagtggctgcctcgcctagatttcatcttgtatctaaatcttcacaaagctctgttactgttgagaatgcgtctaaacctgattttacaaagaattcacaagttggatcggataattcttcaattttactgtttgactcgacccaggaatcactaccaccatcccaagacataccagcaatttttagagaaggtatgaaaaatacttcatatgtgttgaaacatccttctacttctaaagtaaacagtgttactccaaaaaaaccaaagaccagtgaagatgttcctcagataaatccctccacttcattgcctttaattggctctcctccagtgacatcctcccaagttatgctgtcaaaaggtacaaatacctcatctccatatgatgctggagcagattacctaagagcttgtccaaagtgcaatgttcagttcaatcttttggatcctttgaaataccacatgaagcattgttgtccagacatgataactaaatttttgggagtaattgttaaatcagaacgtccatgtgatgaagacaagactgattcagagacaggaaagttgatcatgttagtcaatgagttttattatggaaggcatgaaggagtcactgagaaagagccaaagacttacacaacctttaaatgcttcagttgctcgaaagttcttaaaaataatattaggtttatgaaccacatgaaacatcacttggaacttgagaagcagaacaatgaaagctgggaaaaccacaccacctgccagcactgttaccggcaatatcccacacccttccaactgcagtgccacattgagagtacacacactccccatgagttttctactatttgcaaaatctgtgaattatcatttgaaacagagcatattcttttacaacatatgaaggacacccataaacctggtgaaatgccatatgtttgccagaaaaaaggagttcatcgttgcccaaaatgcagactacaatttttgaccagcaaggagaaagctgaacataaggcgcagcatcgtacatttataaagcctaaagaactagaaggattgcctcctggagcaaaagttactattcgagcttcacttggacctctccagtcaaaattaccaactgcacctttcggttgcgctccaggcacttcttttcttcaggtcacacctccgacatctcaaaatacaactgctagaaatcctagaaaatctaatgccagtagatctaagacaagtaagcttcatgcaactacatccactgcaagtaaagttaatacaagtaagccaaggggacgtatagctaagtccaaagcaaaaccctcttacaagcaaaagcgacagcgcaacagaaaaaataaaatgagccttgctttgaagaacataaggtgtcgtcggggaattcacaagtgcattgaatgtcattccaaaataaaagattttgcaagccacttttctatatacatccactgcagtttttgcaagtacaatactaactgtaacaaagcctttgtaaatcatatgatgagctctcatagcaaccatccaggtaaacggttttgtattttcaagaagcattcaggaactctcaggggcattactctagtgtgccttaaatgtgatttcctagctgattcttccggcttagatcgtatggctaaacacttaagtcaacgtaaaactcatacttgccaagttataatagagaatgtttccaaaagtacctcaacttctgaacccactactggctgctcattgaaatagattcctgctccatggagttcatgcaacctggtgcaagacaagttggaagttcctaagttcaaagttctgaagtattttctcacacaaagggcagttaaacagccaagtttatgacactagctctcattattcagctcttttcagctttcagatgccactacattgttattccaccttatctttgcgtcaggttaacatatcttaacatatttttttctccagttggctctctccaaaaatgccttttgtttttctctgctatacttgacttgccttcagaatattacattccagataatatgactgttcatctttttctgtctgttttgtctgctttcttaatttcttataagtcttacatgtttaggtcagataaccattttttcttcattccttgttcattactgttctatttttcatatttttcaaatgaagaagcaacacataagtttcaaaaaatatccagggtactcctggacagtgtccccttttgatggacacaactgatacctgttctttctttccaagaaatgtgaattatttgactgtgagacgtcctctagtttgtggccttcagaaatcagatcttggggagagtcccttcctacctgactgacctcccataaggctgatgctgatttggccagagatgacctcaaggcccaccaaatagagcacaacttcccattgggagctttggcttttgatcttaagcttatgggtcgattctaaccaagaaaagtccatgagatcagtgcttcaacatccaggttgacgtttaaccattttggctgctgctctttaattttcctctagcaggcatgcagtccaaggaatatcaaaattctgattgtatgggaaccaaggttactttcttgttcttggataaagaaaatttctacaattacagttcccaaagacacagttgttcatgttatttaaagttttatccagtattctaggaattttcagcaatactaatattctcatttttaaacattttttacattttattttgttttattttggtagcttggttttatattgtttttagatcagtgcttcaacatccaggctgacgtttagccattttggctgctgttctttaatcttcctctagcaggcatgcagtccaaggaatatcaaaattctggttgtattgggaaccaaggttactttcttgtttttggaaaaacaaaatttctacaattacagttcccaaagtcagttattcatgttttcatttaaagttttatccaatattctaggaattttcagcaatactgatattcactttattttttttctttttttaagacagagtcttgctctgtcacccaggctggagtgcagtggcgcgatcttggctcactgcaagctccgcctcctgggttcacgccattctcctgcctcagtctcccaagtacctgggatgacaggcgcctgccaccacgcccggctaatttttaattttttgtatttttagtagagacagggtttcaccatgttagccaggatggtctcgatctcctgacgtcgtgatcagtccgcctcgtcctcccaaagtgctgggattacaggtgtgagccactgcacccgaccgatactcacatttttaaactttttttttaattttattttggtagctaggttttatattgttcttaaatttattttactctattttatttttccatcacttctttgtcccagattcatgaaatttgctgatgtccattttatgtctacttttgaactcttctctttgtgtttgttttgttcttattacaaactccaagacatttcttagaattgtctacagatttcgtgtagctacttattggtagcttcttaatttcatacttgtccagaccattagacattattacatgctctgtcttgggcctatcattaacattagcttagggattctgatttcaaagacataaagaattggcaaaactcttcttacagaacttaaaacaagttttaaagttacatttctatacatctaatacataataccttcttagccattaatgtaattcctctggataaagataatatattcaaaaaatattgggaccaaaaaatgcacttgtttcttgctcatatatatatagatgtatattttttttaatttcttgtttgtttattttggttacattgaatacagatttgctgaacagttttgatgttatttttttaataaaatttgtattgttaaagtgccttggaaatttctaataaataacttcatataaaagct

SEQ ID NO: 2893 - DNA, 4634 bp, Homo sapiens
ggttccgcgctggaagtctccgggggagtcgctgttgctgaggctgtcgcctgaggtttttcgcgctcctccctttcctcctcctctttctcctcctccttatccgaaccccagtcagaccgatctgctctgctctcggtgaccttgcaacttcatggatgacgacaaaccttttcaaccaaaaaacatttcaaaaatggcagaactctttatggaatgtgaagaagaagagctagagccatggcagaagaaagtagaagaaactcaggatgaggatgacgatgaactgatctttgttggagagatatcaagttcaaaaccagccatttcaaatattttgaacagaggccactccagctcatcttcaaaaggaataaagagtgagccacacagtccaggtattcctgaaatattcaggactgcaagtcaacgctgcagagacccaccatcaaatccagtggctgcctcgcctagatttcatcttgtatctaaatcttcacaaagctctgttactgttgagaatgcgtctaaacctgattttacaaagaattcacaagttggatcggataattcttcaattttactgtttgactcgacccaggaatcactaccaccatcccaagacataccagcaatttttagagaaggtatgaaaaatacttcatatgtgttgaaacatccttctacttctaaagtaaacagtgttactccaaaaaaaccaaagaccagtgaagatgttcctcagataaatccctccacttcattgcctttaattggctctcctccagtgacatcctcccaagttatgctgtcaaaaggtacaaatacctcatctccatatgatgctggagcagattacctaagagcttgtccaaagtgcaatgttcagttcaatcttttggatcctttgaaataccacatgaagcattgttgtccagacatgataactaaatttttgggagtaattgttaaatcagaacgtccatgtgatgaagacaagactgattcagagacaggaaagttgatcatgttagtcaatgagttttattatggaaggcatgaaggagtcactgagaaagagccaaagacttacacaacctttaaatgcttcagttgctcgaaagttcttaaaaataatattaggtttatgaaccacatgaaacatcacttggaacttgagaagcagaacaatgaaagctgggaaaaccacaccacctgccagcactgttaccggcaatatcccacacccttccaactgcagtgccacattgagagtacacacactccccatgagttttctactatttgcaaaatctgtgaattatcatttgaaacagagcatattcttttacaacatatgaaggacacccataaacctggtgaaatgccatatgtttgccaggtttgccagtttagatcatcaacattttctgatgtagaagctcattttagagcagcccatgaaaacactaagaacttgctatgtccattttgcctcaaagttagtaaaatggcaaccccctacatgaatcattacatgaagcatcagaaaaaaggagttcatcgttgcccaaaatgcagactacaatttttgaccagcaaggagaaagctgaacataaggcgcagcatcgtacatttataaagcctaaagaactagaaggattgcctcctggagcaaaagttactattcgagcttcacttggacctctccagtcaaaattaccaactgcacctttcggttgcgctccaggcacttcttttcttcaggtcacacctccgacatctcaaaatacaactgctagaaatcctagaaaatctaatgccagtagatctaagacaagtaagcttcatgcaactacatccactgcaagtaaagttaatacaagtaagccaaggggacgtatagctaagtccaaagcaaaaccctcttacaagcaaaagcgacagcgcaacagaaaaaataaaatgagccttgctttgaagaacataaggtgtcgtcggggaattcacaagtgcattgaatgtcattccaaaataaaagattttgcaagccacttttctatatacatccactgcagtttttgcaagtacaatactaactgtaacaaagcctttgtaaatcatatgatgagctctcatagcaaccatccaggtaaacggttttgtattttcaagaagcattcaggaactctcaggggcattactctagtgtgccttaaatgtgatttcctagctgattcttccggcttagatcgtatggctaaacacttaagtcaacgtaaaactcatacttgccaagttataatagagaatgtttccaaaagtacctcaacttctgaacccactactggctgctcattgaaatagattcctgctccatggagttcatgcaacctggtgcaagacaagttggaagttcctaagttcaaagttctgaagtattttctcacacaaagggcagttaaacagccaagtttatgacactagctctcattattcagctcttttcagctttcagatgccactacattgttattccaccttatctttgcgtcaggttaacatatcttaacatatttttttctccagttggctctctccaaaaatgccttttgtttttctctgctatacttgacttgccttcagaatattacattccagataatatgactgttcatctttttctgtctgttttgtctgctttcttaatttcttataagtcttacatgtttaggtcagataaccattttttcttcattccttgttcattactgttctatttttcatatttttcaaatgaagaagcaacacataagtttcaaaaaatatccagggtactcctggacagtgtccccttttgatggacacaactgatacctgttctttctttccaagaaatgtgaattatttgactgtgagacgtcctctagtttgtggccttcagaaatcagatcttggggagagtcccttcctacctgactgacctcccataaggctgatgctgatttggccagagatgacctcaaggcccaccaaatagagcacaacttcccattgggagctttggcttttgatcttaagcttatgggtcgattctaaccaagaaaagtccatgagatcagtgcttcaacatccaggttgacgtttaaccattttggctgctgctctttaattttcctctagcaggcatgcagtccaaggaatatcaaaattctgattgtatgggaaccaaggttactttcttgttcttggataaagaaaatttctacaattacagttcccaaagacacagttgttcatgttatttaaagttttatccagtattctaggaattttcagcaatactaatattctcatttttaaacattttttacattttattttgttttattttggtagcttggttttatattgtttttagatcagtgcttcaacatccaggctgacgtttagccattttggctgctgttctttaatcttcctctagcaggcatgcagtccaaggaatatcaaaattctggttgtattgggaaccaaggttactttcttgtttttggaaaaacaaaatttctacaattacagttcccaaagtcagttattcatgttttcatttaaagttttatccaatattctaggaattttcagcaatactgatattcactttattttttttctttttttaagacagagtcttgctctgtcacccaggctggagtgcagtggcgcgatcttggctcactgcaagctccgcctcctgggttcacgccattctcctgcctcagtctcccaagtacctgggatgacaggcgcctgccaccacgcccggctaatttttaattttttgtatttttagtagagacagggtttcaccatgttagccaggatggtctcgatctcctgacgtcgtgatcagtccgcctcgtcctcccaaagtgctgggattacaggtgtgagccactgcacccgaccgatactcacatttttaaactttttttttaattttattttggtagctaggttttatattgttcttaaatttattttactctattttatttttccatcacttctttgtcccagattcatgaaatttgctgatgtccattttatgtctacttttgaactcttctctttgtgtttgttttgttcttattacaaactccaagacatttcttagaattgtctacagatttcgtgtagctacttattggtagcttcttaatttcatacttgtccagaccattagacattattacatgctctgtcttgggcctatcattaacattagcttagggattctgatttcaaagacataaagaattggcaaaactcttcttacagaacttaaaacaagttttaaagttacatttctatacatctaatacataataccttcttagccattaatgtaattcctctggataaagataatatattcaaaaaatattgggaccaaaaaatgcacttgtttcttgctcatatatatatagatgtatattttttttaatttcttgtttgtttattttggttacattgaatacagatttgctgaacagttttgatgttatttttttaataaaatttgtattgttaaagtgccttggaaatttctaataaataacttcatataaaa

SEQ ID NO: 2894 - DNA, 1970 bp, Homo sapiens
tctccgggggagtcgctgttgctgaggctgtcgcctgaggtttttcgcgctcctccctttcctcctcctctttctcctcctccttatccgaaccccagtcagaccgatctgctctgctctcggtgaccttgcaacttcatggatgacgacaaaccttttcaaccaaaaaacatttcaaaaatggcagaactctttatggaatgtgaagaagaagagctagagccatggcagaagaaagtagaagaaactcaggatgaggatgacgatgaactgatctttgttggagagatatcaagttcaaaaccagccatttcaaatattttgaacagaggccactccagctcatcttcaaaaggaataaagagtgagccacacagtccaggtattcctgaaatattcaggactgcaagtcaacgctgcagagacccaccatcaaatccagtggctgcctcgcctagatttcatcttgtatctaaatcttcacaaagctctgttactgttgagaatgcgtctaaacctgattttacaaagaattcacaagttggatcggataattcttcaattttactgtttgactcgacccaggaatcactaccaccatcccaagacataccagcaatttttagagaaggtatgaaaaatacttcatatgtgttgaaacatccttctacttctaaagtaaacagtgttactccaaaaaaaccaaagaccagtgaagatgttcctcagataaatccctccacttcattgcctttaattggctctcctccagtgacatcctcccaagttatgctgtcaaaaggtacaaatacctcatctccatatgatgctggagcagattacctaagagcttgtccaaagtgcaatgttcagttcaatcttttggatcctttgaaataccacatgaagcattgttgtccagacatgataactaaatttttgggagtaattgttaaatcagaacgtccatgtgatgaagacaagactgattcagagacaggaaagttgatcatgttagtcaatgagttttattatggaaggcatgaaggagtcactgagaaagagccaaagacttacacaacctttaaatgcttcagttgctcgaaagttcttaaaaataatattaggtttatgaaccacatgaaacatcacttggaacttgagaagcagaacaatgaaagctgggaaaaccacaccacctgccagcactgttaccggcaatatcccacacccttccaactgcagtgccacattgagagtacacacactccccatgagttttctactatttgcaaaatctgtgaattatcatttgaaacagagcatattcttttacaacatatgaaggacacccataaacctggtgaaatgccatatgtttgccagaaaaaaggagttcatcgttgcccaaaatgcagactacaatttttgaccagcaaggagaaagctgaacataaggcgcagcatcgtacatttataaagcctaaagaactagaaggattgcctcctggagcaaaagttactattcgagcttcacttggacctctccagtcaaaattaccaactgcacctttcggttgcgctccaggcacttcttttcttcaggtcacacctccgacatctcaaaatacaactgctagaaatcctagaaaatctaatgccagtagatctaagacaagtaagcttcatgcaactacatccactgcaagtaaagttaatacaagtaagccaaggggacgtatagctaagtccaaagcaaaaccctcttacaagcaaaagcgacagcgcaacagaaaaaataaaatgagccttgctttgaagaacataaggtgtcgtcggggaattcacaagtgcattgaatgtcattccaaaataaaagattttgcaagccacttttctatatacatccactgcagtttttgcaagtacaatactaactgtaacaaagcctttgtaaatcatatgatgag

SEQ ID NO: 2895 - DNA, 2068 bp, Homo sapiens
taaattttcatcctgagtctagatcttcagatagttctgttattgttcagcctttttctaaacctggttatataacaaactcatcacgagttgtgtctaataagtcatcagagttactgtttgacttgacccaggatacaggattatcacattaccaagggggaccaacactttctatggcaggtatgagtgaaagttcatttttatcaaaacgtccttctacttctgaagtaaataatgttaatccaaagaagcctaaacccagcgaaagtgtttctggagcaaattcctcagctgtattaccttcagttaaatctccttcagtgacttcttcccaggctatgctagcaaaaggtacaaatacctcatcaaatcagtctaaaaatggaacaccttttccaagagcttgtccaaagtgcaacattcatttcaatcttttggatcctttgaaaaatcacatgaagtattgttgtccagacatgataaataactttttgggactggctaaaacagaattttcaagtacagtaaataaaaacacaactattgattcagagaaaggaaaattgatcatgttagttaatgacttttattatggaaaacatgaaggagatgtccaggaggaacagaagactcacacaacctttaaatgcttcagttgcttgaaaattctaaaaaataacattaggtttatgaaccacatgaaacaccatttggaacttgagaagcagagcagtgagagctgggaaaaccataccacctgccagcactgctaccgtcagtttcccacaccatttcagttgcagtgtcacatcgaaagtacacatacgccccatgaattttctactatttgtaaaatctgtgaattgtcatttgaaacagaacatgttcttttacaacatatgaaggacaatcataaacctggtgaaatgccatatgtctgccaggtttgtaattatagatcatcatcattttctgatgtagaaactcattttagaacatcccatgaaaacactaagacttgctatgcccgttttgcctcaaagttattaaaattgcaacaccatatatgcatcattatatgaagcatcagaaaaaaggaatacatcgttgtacaaaatgcaggctgcagtttttgacatgcaaggagaaaatggatcataagactcaacaccatcgaacatttataaaacctaaacaactagaaggattgcctcctggaacaaaagttactattcgagcttcagttggacctctgcaatcaggagcttcacctacaccttccattagtgcaagtgcttctacccttcagctctcacctccaaggactaaaaatataactgctaaaaatcctgcaaaatctaatacaagtaaacctaatacagtcaaatccaacgcaagtaaacctaatacaagtaagcctaatggaagtaaatctaaatacaaaccaaaaatctctaatatgcaaaagaaacaaagcacattggctagtagcaataaaaaaagtaaagtcaatacagcattgaggaatttaaggtatcgtcggggcattcacaaatgcattgagtgttgttccgaaataaaagattttgcaaaccactttcctacgtacgtccactgtagtttttgcagatacaacactagctgtagcaaagcctatgtaaatcatatgatgagctttcatagtaaccgtccaagcaaaaggttttgtatttttaagaagcattcagaaaatctccgggggcattactctagtgtgccttaattgtgatttcctaagtgatgtttctggcttagataatatggctacacacttaagtcaacataaaactcatacttgccaagttgtaatgcagaaagtttctgtttgtatcccaacttctgagcacctttctgaattaaaaaaagaagctcccgcaaaggaacaagaacctgtgtctaaggaaattgcaagacctaacatggctgaaagagaaacagaaacatcaaattctgaaagtaaacaagataaagctgcttcttcaaaagaaaaaaatggatgtaatgcaaattcatttgaaggctcatc

SEQ ID NO: 2896 - DNA, 4328 bp, Homo sapiens
acggctcggctgccagctccgcaatgggagccgccgccgtcgccgcagtgtagtttttcgtgctcctccttttcctcctcctctttctcctcctcctcagggctccagtcaggccgatccgctccgctcacggaaggaaaacagaaataacttgctggcttgtctggagtcacatgtacttaggtgacaatttacagaaagtcatctctgcagcttgatgggcgacaacccttttcaaccaaaaagtaattcaaaaatggcagaactgtttatggaatgtgaagaagaggagctggaaccatggcagaagaaagtaaaagaagttgaggatgacgatgatgatgagccaatctttgttggcgagatatcaagttcaaaaccagcaatttcaaatattttgaacagagttaaccccagctcatattcaaggggactaaagaatggtgcactcagtcgaggtattactgctgcattcaagcctacaagtcaacactacacgaatccaacatcaaatccagtgcctgcctcaccaataaattttcatcctgagtctagatcttcagatagttctgttattgttcagcctttttctaaacctggttatataacaaactcatcacgagttgtgtctaataagtcatcagagttactgtttgacttgacccaggatacaggattatcacattaccaagggggaccaacactttctatggcaggtatgagtgaaagttcatttttatcaaaacgtccttctacttctgaagtaaataatgttaatccaaagaagcctaaacccagcgaaagtgtttctggagcaaattcctcagctgtattaccttcagttaaatctccttcagtgacttcttcccaggctatgctagcaaaaggtacaaatacctcatcaaatcagtctaaaaatggaacaccttttccaagagcttgtccaaagtgcaacattcatttcaatcttttggatcctttgaaaaatcacatgaagtattgttgtccagacatgataaataactttttgggactggctaaaacagaattttcaagtacagtaaataaaaacacaactattgattcagagaaaggaaaattgatcatgttagttaatgacttttattatggaaaacatgaaggagatgtccaggaggaacagaagactcacacaacctttaaatgcttcagttgcttgaaaattctaaaaaataacattaggtttatgaaccacatgaaacaccatttggaacttgagaagcagagcagtgagagctgggaaaaccataccacctgccagcactgctaccgtcagtttcccacaccatttcagttgcagtgtcacatcgaaagtacacatacgccccatgaattttctactatttgtaaaatctgtgaattgtcatttgaaacagaacatgttcttttacaacatatgaaggacaatcataaacctggtgaaatgccatatgtctgccaggtttgtaattatagatcatcatcattttctgatgtagaaactcattttagaacatcccatgaaaacactaagaacttgctatgcccgttttgcctcaaagttattaaaattgcaacaccatatatgcatcattatatgaagcatcagaaaaaaggaatacatcgttgtacaaaatgcaggctgcagtttttgacatgcaaggagaaaatggatcataagactcaacaccatcgaacatttataaaacctaaacaactagaaggattgcctcctggaacaaaagttactattcgagcttcagttggacctctgcaatcaggagcttcacctacaccttccattagtgcaagtgcttctacccttcagctctcacctccaaggactaaaaatataactgctaaaaatcctgcaaaatctaatacaagtaaacctaatacagtcaaatccaacgcaagtaaacctaatacaagtaagcctaatggaagtaaatctaaatacaaaccaaaaatctctaatatgcaaaagaaacaaagcacattggctagtagcaataaaaaaagtaaagtcaatacagcattgaggaatttaaggtatcgtcggggcattcacaaatgcattgagtgttgttccgaaataaaagattttgcaaaccactttcctacgtacgtccactgtagtttttgcagatacaacactagctgtagcaaagcctatgtaaatcatatgatgagctttcatagtaaccgtccaagcaaaaggttttgtatttttaagaagcattcagaaaatctccggggcattactctagtgtgccttaattgtgatttcctaagtgatgtttctggcttagataatatggctacacacttaagtcaacataaaactcatacttgccaagttgtaatgcagaaagtttctgtttgtatcccaacttctgagcacctttctgaattaaaaaaagaagctcccgcaaaggaacaagaacctgtgtctaaggaaattgcaagacctaacatggctgaaagagaaacagaaacatcaaattctgaaagtaaacaagataaagctgcttcttcaaaagaaaaaaatggatgtaatgcaaattcatttgaaggctcatcaacaacaaaaagtgaagaaagcataacagtttcagataaggaaaatgaaacctgtcttgcagaccaggaaactggctcaaaaaacatcgtcagttgtgattcaaatattggtgcagataaagtggaaaagaaaaaacaaatacaacacgtttgtcaggaaatggagttgaagatgtgccaaagttcagaaaacataatcttatctgatcagattaaagatcacaactccagtgaagccagattttcttcaaagaatattaaggatttgcgattagcatcagataatgtaagcattgatcagtttttgagaaaaagacatgaacctgaatctgttagttctgatgttagcgagcaaggcagtattcatttggaacctctgactccatccgaggtacttgagtatgaagccacagagattcttcagaaaggtagtggtgatccttcagccaagactgatgaagtagtgtctgatcaaacagatgacattcctggaggaaataaccctagcacaacagaggcaacagtagacctggaagacgaaaaagaaagaagttgaaattagtcattttaagtttcagtgtaccaacgataagggcatttggaacagtgctatcaggtgagctcagtggtgctgttgtaggttcagaaatggaaatatgtaagggaggtcacacatacactttacctgtatgttcaacctatgttatcaaacaaatcaattcaccaataatagcatgattagtagggattcccaaaaagtttttaaaaacacgaacaggattttaatgataattaaatttgcagtggaaaggtctcatttaatggttttcaaggaaatgggatttggttgctgacatgaattgatgatattagtaatatttataaagcctttcaaacttccatcaatcctaagctaaaaatctttattacctgtatatccttttcagttaactgagaggaagggatttggaaaccatgtacttttggggagtaattgattaaaaacaatggctgattggcattgttaatgaaggctttatttgtgaggatgatgctggtaaatggagcatgcttagagtactaaattgatctaatgagaatttggatgaacataaacttaattttggatttaatataacattccagtcagacgcatgtaaacagaatatttgaatctttgtacctccatacaagtgttagcctgccaggctgtaagcttaccttaattaaactttcagtgaaagtggaattattaagatataaatttatatttgtgctttttgtcagtgtgtaagctgtgtagaaattctttgatgtattagttgtattaatgtaaagtagaaacccattgttgaaactcctgtagctattatgcttttaatattgttttaatgatcttccttagaaataggcccataaaaatggtctggaagccaaaccaaagtatggtataatgtagatattgtaaagcagtaaactgaaaacatgtcctggcatgtattcagccatgtttaagtgacttttctgtaattgtaaaataaaaacttcaaatgggacctaaaacagtgatgtaaaagaactggttttggaaatttagcctaatttatctataagatggctgctaaattgatttttcagttctttttatcatctagaatataatagatatagaaatgaataatatgaagaacagtagtttgctttgaaatactaataaacttttattt

SEQ ID NO: 2897 - DNA, 2799 bp, Homo sapiens
gacctcgacagggaacgcaagcaaaaccacacatttaaaacagacttggtaaaatcagctcgttatttaaagaaacggacgattcctttttctctcctggtttagtcttcgacccacaggccccttgcttctttcgaacggcggctgtatcccatgaccttttcactttccaagccaacggactgggggtcgttacacacgcggagggcccggaacgcacggctcctcgcctgcaaattccgagcagtccggattttggggctgcctcccggccacaccagccagcagctcgcacccacatggaggcagggccctggccctcgccccggaccggcgcgtggcggggcgcgtgggtcttcgagggcccgcgacgcggcgcacatgccggtgcccgcctcccgcgtcggcgagaagacagggagctcggacacggggaggctgacccggagcctacccatgaggcagcgcgccggctgcacgagagcccccccctttccacggctcggctgccagctccgcaatgggagccgccgccgtcgccgcagtgtagtttttcgtgctcctccttttcctcctcctctttctcctcctcctcagggctccagtcaggccgatccgctccgctcacggaaggaaaacagaaataacttgctggcttgtctggagtcacatggtaattcaaaaatggcagaactgtttatggaatgtgaagaagaggagctggaaccatggcagaagaaagtaaaagaagttgaggatgacgatgatgatgagccaatctttgttggcgagatatcaagttcaaaaccagcaatttcaaatattttgaacagagttaaccccagctcatattcaaggggactaaagaatggtgcactcagtcgaggtattactgctgcattcaagcctacaagtcaacactacacgaatccaacatcaaatccagtgcctgcctcaccaataaattttcatcctgagtctagatcttcagatagttctgttattgttcagcctttttctaaacctggttatataacaaactcatcacgagttgtgtctaataagtcatcagagttactgtttgacttgacccaggatacaggattatcacattaccaagggggaccaacactttctatggcaggtatgagtgaaagttcatttttatcaaaacgtccttctacttctgaagtaaataatgttaatccaaagaagcctaaacccagcgaaagtgtttctggagcaaattcctcagctgtattaccttcagttaaatctccttcagtgacttcttcccaggctatgctagcaaaaggtacaaatacctcatcaaatcagtctaaaaatggaacaccttttccaagagcttgtccaaagtgcaacattcatttcaatcttttggatcctttgaaaaatcacatgaagtattgttgtccagacatgataaataactttttgggactggctaaaacagaattttcaagtacagtaaataaaaacacaactattgattcagagaaaggaaaattgatcatgttagttaatgacttttattatggaaaacatgaaggagatgtccaggaggaacagaagactcacacaacctttaaatgcttcagttgcttgaaaattctaaaaaataacattaggtttatgaaccacatgaaacaccatttggaacttgagaagcagagcagtgagagctgggaaaaccataccacctgccagcactgctaccgtcagtttcccacaccatttcagttgcagtgtcacatcgaaagtacacatacgccccatgaattttctactatttgtaaaatctgtgaattgtcatttgaaacagaacatgttcttttacaacatatgaaggacaatcataaacctggtgaaatgccatatgtctgccaggtttgtaattatagatcatcatcattttctgatgtagaaactcattttagaacatcccatgaaaacactaagaacttgctatgcccgttttgcctcaaagttattaaaattgcaacaccatatatgcatcattatatgaagcatcagaaaaaaggaatacatcgttgtacaaaatgcaggctgcagtttttgacatgcaaggagaaaatggatcataagactcaacaccatcgaacatttataaaacctaaacaactagaaggattgcctcctggaacaaaagttactattcgagcttcagttggacctctgcaatcaggagcttcacctacaccttccattagtgcaagtgcttctacccttcagctctcacctccaaggactaaaaatataactgctaaaaatcctgcaaaatctaatacaagtaaacctaatacagtcaaatccaacgcaagtaaacctaatacaagtaagcctaatggaagtaaatctaaatacaaaccaaaaatctctaatatgcaaaagaaacaaagcacattggctagtagcaataaaaaaagtaaagtcaatacagcattgaggaatttaaggtatcgtcggggcattcacaaatgcattgagtgttgttccgaaataaaagattttgcaaaccactttcctacgtacgtccactgtagtttttgcagatacaacactagctgtagcaaagcctatgtaaatcatatgatgagctttcatagtaaccgtccaagcaaaaggttttgtatttttaagaagcattcagaaaatctccgatgcgtgggaggacaaatagaatgtgacttgcctaagttacacaagttggttgtggagccaagactgactctaggtcttctgactcctaacttttaa

SEQ ID NO: 2898 - DNA, 4405 bp, Homo sapiens
acggctcggctgccagctccgcaatgggagccgccgccgtcgccgcagtgtagtttttcgtgctcctccttttcctcctcctctttctcctcctcctcagggctccagtcaggccgatccgctccgctcacggaaggaaaacagaaataacttgctggcttgtctggagtcacatggtaattcaaaaatggcagaactgtttatggaatgtgaagaagaggagctggaaccatggcagaagaaagtaaaagaagttgaggatgacgatgatgatgagccaatctttgttggcgagatatcaagttcaaaaccagcaatttcaaatattttgaacagagttaaccccagctcatattcaaggggactaaagaatggtgcactcagtcgaggtattactgctgcattcaagcctacaagtcaacactacacgaatccaacatcaaatccagtgcctgcctcaccaataaattttcatcctgagtctagatcttcagatagttctgttattgttcagcctttttctaaacctggttatataacaaactcatcacgagttgtgtctaataagtcatcagagttactgtttgacttgacccaggatacaggattatcacattaccaagggggaccaacactttctatggcaggtatgagtgaaagttcatttttatcaaaacgtccttctacttctgaagtaaataatgttaatccaaagaagcctaaacccagcgaaagtgtttctggagcaaattcctcagctgtattaccttcagttaaatctccttcagtgacttcttcccaggctatgctagcaaaaggtacaaatacctcatcaaatcagtctaaaaatggaacaccttttccaagagcttgtccaaagtgcaacattcatttcaatcttttggatcctttgaaaaatcacatgaagtattgttgtccagacatgataaataactttttgggactggctaaaacagaattttcaagtacagtaaataaaaacacaactattgattcagagaaaggaaaattgatcatgttagttaatgacttttattatggaaaacatgaaggagatgtccaggaggaacagaagactcacacaacctttaaatgcttcagttgcttgaaaattctaaaaaataacattaggtttatgaaccacatgaaacaccatttggaacttgagaagcagagcagtgagagctgggaaaaccataccacctgccagcactgctaccgtcagtttcccacaccatttcagttgcagtgtcacatcgaaagtacacatacgccccatgaattttctactatttgtaaaatctgtgaattgtcatttgaaacagaacatgttcttttacaacatatgaaggacaatcataaacctggtgaaatgccatatgtctgccaggtttgtaattatagatcatcatcattttctgatgtagaaactcattttagaacatcccatgaaaacactaagaacttgctatgcccgttttgcctcaaagttattaaaattgcaacaccatatatgcatcattatatgaagcatcagaaaaaaggaatacatcgttgtacaaaatgcaggctgcagtttttgacatgcaaggagaaaatggatcataagactcaacaccatcgaacatttataaaacctaaacaactagaaggattgcctcctggaacaaaagttactattcgagcttcagttggacctctgcaatcaggagcttcacctacaccttccattagtgcaagtgcttctacccttcagctctcacctccaaggactaaaaatataactgctaaaaatcctgcaaaatctaatacaagtaaacctaatacagtcaaatccaacgcaagtaaacctaatacaagtaagcctaatggaagtaaatctaaatacaaaccaaaaatctctaatatgcaaaagaaacaaagcacattggctagtagcaataaaaaaagtaaagtcaatacagcattgaggaatttaaggtatcgtcggggcattcacaaatgcattgagtgttgttccgaaataaaagattttgcaaaccactttcctacgtacgtccactgtagtttttgcagatacaacactagctgtagcaaagcctatgtaaatcatatgatgagctttcatagtaaccgtccaagcaaaaggttttgtatttttaagaagcattcagaaaatctccggggcattactctagtgtgccttaattgtgatttcctaagtgatgtttctggcttagataatatggctacacacttaagtcaacataaaactcatacttgccaagttgtaatgcagaaagtttctgtttgtatcccaacttctgagcacctttctgaattaaaaaaagaagctcccgcaaaggaacaagaacctgtgtctaaggaaattgcaagacctaacatggctgaaagagaaacagaaacatcaaattctgaaagtaaacaagataaagctgcttcttcaaaagaaaaaaatggatgtaatgcaaattcatttgaaggctcatcaacaacaaaaagtgaagaaagcataacagtttcagataaggaaaatgaaacctgtcttgcagaccaggaaactggctcaaaaaacatcgtcagttgtgattcaaatattggtgcagataaagtggaaaagaaaaaacaaatacaacacgtttgtcaggaaatggagttgaagatgtgccaaagttcagaaaacataatcttatctgatcagattaaagatcacaactccagtgaagccagattttcttcaaagaatattaaggatttgcgattagcatcagataatgtaagcattgatcagtttttgagaaaaagacatgaacctgaatctgttagttctgatgttagcgagcaaggcagtattcatttggaacctctgactccatccgaggtacttgagtatgaagccacagagattcttcagaaaggtagtggtgatccttcagccaagactgatgaagtagtgtctgatcaaacagatgacattcctggaggaaataaccctagcacaacagaggcaacagtagacctggaagacgaaaaagaaagaagttgaaattagtcattttaagtttcagtgtaccaacgataagggcatttggaacagtgctatcaggtgagctcagtggtgctgttgtaggttcagaaatggaaatatgtaagggaggtcacacatacactttacctgtatgttcaacctatgttatcaaacaaatcaattcaccaataatagcatgattagtagggattcccaaaaagtttttaaaaacacgaacaggattttaatgataattaaatttgcagtggaaaggtctcatttaatggttttcaaggaaatgggatttggttgctgacatgaattgatgatattagtaatatttataaagcctttcaaacttccatcaatcctaagctaaaaatctttattacctgtatatccttttcagttaactgagaggaagggatttggaaaccatgtacttttggggagtaattgattaaaaacaatggctgattggcattgttaatgaaggctttatttgtgaggatgatgctggtaaatggagcatgcttagagtactaaattgatctaatgagaatttggatgaacataaacttaattttggatttaatataacattccagtcagacgcatgtaaacagaatatttgaatctttgtacctccatacaagtgttagcctgccaggctgtaagcttaccttaattaaactttcagtgaaagtggaattattaagatataaatttatatttgtgctttttgtcagtgtgtaagctgtgtagaaattctttgatgtattagttgtattaatgtaaagtagaaacccattgttgaaactcctgtagctattatgcttttaatattgttttaatgatcttccttagaaataggcccataaaaatggtctggaagccaaaccaaagtatggtataatgtagatattgtaaagcagtaaactgaaaacatgtcctggcatgtattcagccatgtttaagtgacttttctgtaattgtaaaataaaaacttcaaatgggacctaaaacagtgatgtaaaagaactggttttggaaatttagcctaatttatctataagatggctgctaaattgatttttcagttctttttatcatctagaatataatagatatagaaatgaataatatgaagaacagtagtttgctttgaaatactaataaacttttatttaaaatgcttcatttttacttcttaaaatgtgctttggattcttaaattttgtttcactgaatgttcaatgttttaaatggcgattaaaatactctgctgtatatagtagtttttgagtaaatatttgcaataaaaatctgcccccg

SEQ ID NO: 2899 - DNA, 4726 bp, Homo sapiens
gaagtggggccggcagagggggcggggaggagctgtcggggactgggaggagccgcaccgcggcgggtggacaaagcccgcggtcgggtgaggcgggacggagttggggccggtggggaggggcatgaggcgctcgcaggcacctcgagaagcaggccccgaccgctcgccgacgaagcctcgtccgggcctcctgggagcggggtggcaggtaccgtggcgcctcctcgcgttggtcttgctggttctcggcccccgaagcggagcgacggagacacagctgtggaagcatctggatccgctgcccaggtccccgagcttcccggaacccgaggccgcaggacactgaaggctgccattcccgagtaggtcacgctggacgccaccctaagctgggcccagaggctcccgtccaggagggctgcagtcggcgcagacaccgcgcgtgtggagacgggagacccatcctcctcggccgttccgagagtaggcgcggccggtcagattcgatgcagagccgaatgcgggagaaagggcaaaacgtacctcaaaccagacaaagccttgtgagcttcaggttctcaaataccccactcacccagaccccacatctccagtcagcccctcgcacccaaatcccattcggagcaaccgaactgcacgtgggactagttcttgggaatggatcaagccagtctcttcatctaacggagacagccctgggtggctctgtcacacagccactgtcttgtgcacaagttctgaacttggcctcagagaagccccagagtagaaagaagacaaaataagccccagttcttcgattctgggctgaagtgagattttcttgaatggcagccattgttttgcctcttaggtaagtgagtgcagtaaagaccggtaaggcccacgcagaagaaacactgaggaaagaagacacttccaaagtaacaaatgggaggaagcagccaacgcccgaggacaacatggcaagaaggagcctttggattccggactgggatggaaagagagttgattgaatcccggaatttggaaaccccagatacggagggcggacggtacaaccggagctgtcagaatcttgctctgtcacccaggctggagtgcaatggtgcaatctcaagctcactgcaacctctgtgcaggttcaagtggagaatctgaatcttgatgatataattggaactcttcagccaagccatatctaacagaactatcttcaacttttcaggtgttggtgaggatgcagagaaaagggaaactcatacactgctgatgggaatgcaaaccagtacaacttctatggaaaacgatatggagactctcaaagaactaaaagcagaaccatcattccgtccagcaatcccaccactggtcatctacccaaagtttgggtatcaaaaatatacttacaaaagaagtaaagagagctcacctatttttgtcttcactgaatgaaaaagtctgttcaatacaggaaataaactttgaagatttggtaaaactcacctctttgggtgatttggagtacagatagtatagtccttgagttgtcaattggaagtcactgataccacacggtttaagattatctgactctcagctatacaggattgctgactgctgctagaaaggccttcataaccaaaatgcaacatggaaatagctttcttacattccatgagaaaaaaaatagatctgacaacgttattgaatagaaaaaggaaggaaaacagaaataacttgctggcttgtctggagtcacatggtaattcaaaaatggcagaactgtttatggaatgtgaagaagaggagctggaaccatggcagaagaaagtaaaagaagttgaggatgacgatgatgatgagccaatctttgttggcgagatatcaagttcaaaaccagcaatttcaaatattttgaacagagttaaccccagctcatattcaaggggactaaagaatggtgcactcagtcgaggtattactgctgcattcaagcctacaagtcaacactacacgaatccaacatcaaatccagtgcctgcctcaccaataaattttcatcctgagtctagatcttcagatagttctgttattgttcagcctttttctaaacctggttatataacaaactcatcacgagttgtgtctaataagtcatcagagttactgtttgacttgacccaggatacaggattatcacattaccaagggggaccaacactttctatggcaggtatgagtgaaagttcatttttatcaaaacgtccttctacttctgaagtaaataatgttaatccaaagaagcctaaacccagcgaaagtgtttctggagcaaattcctcagctgtattaccttcagttaaatctccttcagtgacttcttcccaggctatgctagcaaaaggtacaaatacctcatcaaatcagtctaaaaatggaacaccttttccaagagcttgtccaaagtgcaacattcatttcaatcttttggatcctttgaaaaatcacatgaagtattgttgtccagacatgataaataactttttgggactggctaaaacagaattttcaagtacagtaaataaaaacacaactattgattcagagaaaggaaaattgatcatgttagttaatgacttttattatggaaaacatgaaggagatgtccaggaggaacagaagactcacacaacctttaaatgcttcagttgcttgaaaattctaaaaaataacattaggtttatgaaccacatgaaacaccatttggaacttgagaagcagagcagtgagagctgggaaaaccataccacctgccagcactgctaccgtcagtttcccacaccatttcagttgcagtgtcacatcgaaagtacacatacgccccatgaattttctactatttgtaaaatctgtgaattgtcatttgaaacagaacatgttcttttacaacatatgaaggacaatcataaacctggtgaaatgccatatgtctgccaggtttgtaattatagatcatcatcattttctgatgtagaaactcattttagaacatcccatgaaaacactaagaacttgctatgcccgttttgcctcaaagttattaaaattgcaacaccatatatgcatcattatatgaagcatcagaaaaaaggaatacatcgttgtacaaaatgcaggctgcagtttttgacatgcaaggagaaaatggatcataagactcaacaccatcgaacatttataaaacctaaacaactagaaggattgcctcctggaacaaaagttactattcgagcttcagttggacctctgcaatcaggagcttcacctacaccttccattagtgcaagtgcttctacccttcagctctcacctccaaggactaaaaatataactgctaaaaatcctgcaaaatctaatacaagtaaacctaatacagtcaaatccaacgcaagtaaacctaatacaagtaagcctaatggaagtaaatctaaatacaaaccaaaaatctctaatatgcaaaagaaacaaagcacattggctagtagcaataaaaaaagtaaagtcaatacagcattgaggaatttaaggtatcgtcggggcattcacaaatgcattgagtgttgttccgaaataaaagattttgcaaaccactttcctacgtacgtccactgtagtttttgcagatacaacactagctgtagcaaagcctatgtaaatcatatgatgagctttcatagtaaccgtccaagcaaaaggttttgtatttttaagaagcattcagaaaatctccggggcattactctagtgtgccttaattgtgatttcctaagtgatgtttctggcttagataatatggctacacacttaagtcaacataaaactcatacttgccaagttgtaatgcagaaagatgcagaagcagcccagagatttcaaaaaatatccagggtatacctggacagtgtcccccttcgatggacacaactgatgcctgttctctctttccaaggaatgtgaataatttgactgtgggacctgctcttaggttgtggcctcaagaaatcagatcttggggagactccctttctacatggctggcctcccataaggctgatgttgtttggccagagatggctttaaggcccaccaaattgagcatacttcccactgggggctttggcttatgatcttaagcttatgagtcagttatgaccaagaaaagcccatcaaaccactgcttcagcatccaagttgaagtttagtcattttggctgctgcctttaaatctttctctagcatgaatgcagtccaaggaatataaaaactctagttgttaggaaaccatggctactttcatatccttggaacaacaggtctccacaattaagttccaaaattgcagttatttttactgacatataaaatctattaaccagtattaattctgtaattttttaacaataccgattcttgcattttgattttttaaaaattaatttaatagcttggttttatgttctcaaaatttattaatgtctattttatgatgtctatttttatattatattatttaaaatttgtttagtgtttgttttaagaactccaagagatttcttagaattctctacagattttgtgtagctgcctatttgtagattttaaatttggctgttactaagcccattaaacattattagat

SEQ ID NO: 2900 - DNA, 428 bp, Homo sapiens
gtgctcctccttttcctcctcctctttctcctcctcctcagggctccagtcaggccgatccgctccgctcacgatctgtgcagaaatcattgtggttagagggaaggaaaacagaaataacttgctggcttgtctggagtcacatgtacttaggtgacaatttacagaaagtcatctctgcagcttgatgggcgacaacccttttcaaccaaaaagtaattcaaaaatggcagaactgtttatggaatgtgaagaagaggagctggaaccatggcagaagaaagtaaaagaagttgaggatgacgatgatgatgagccaatctttgttggcgagatatcaagttcaaaaccagcaatttcaaatattttgaacagagttaaccccagctcatattcaaggggactaaagaatggtgcactcagtcgag

SEQ ID NO: 2901 - DNA, 3666 bp, Homo sapiens
ctcagggctccagtcaggccgatccgctccgctcacggaaggaaaacagaaataacttgctggcttgtctggagtcacatggtgacaatttacagaaagtcatctctgcagcttgatgggcgacaacccttttcaaccaaaaagtaattcaaaaatggcagaactgtttatggaatgtgaagaagaggagctggaaccatggcagaagaaagtaaaagaagttgaggatgacgatgatgatgagccaatctttgttggcgagatatcaagttcaaaaccagcaatttcaaatattttgaacagagttaaccccagctcatattcaaggggactaaagaatggtgcactcagtcgaggtattactgctgcattcaagcctacaagtcaacactacacgaatccaacatcaaatccagtgcctgcctcaccaataaattttcatcctgagtctagatcttcagatagttctgttattgttcagcctttttctaaacctgtaagtgtttctaaaactatacggccagctcagggatccattggatgttgtttatcaatatcaacagtacccagttacaattctggactgtcataagtagtcatccagtagaagcatagttagcatcagaaaatgtcaccatattttcgctagctcaagcagtaccccaagtaataactgaaggagctaactacccaacctgttaataacaggcagtatgcctaaataggtacagtaatgaaaactatactatcaaaatgtgaataaaattatagtcagccataaatattgcataatgacaaatatttaagattgcagacgggaccaggtattcttaattgggaaaacagtcaagtgaccatcatagctttttattctgaaaacattccttcatagttcagttagttaaaaaaaaacaaacattttttcctattacaaaaaactcccactttttttgttacaaaaagtaatagaaaatggtaatagttaacattcattgagctgttaatatgtataagtgtttgtgctaaatgctataggtaaattcatttcatttagttcttaaacatccccatgaagtaaacactattattatcctcattttttagttgaggaaactgaggctcatagaggttgaaagatttattcaagatcccaaagctggcagttgatggatctgggatttcaatccagcctaacccatagtttatatgtatatgcacacatacatacatatatgttgtgtataaatgtacacttttttagacatgaaagaattgccttagttgaacagttctcagattgtagtttgcaatcccctggggttccccaagaccctttcagaggtttgagggtcaacagtgttgtcattataatcaaagactgttttccttttccactgtgttggcatttgcactggtgatgctaaagtaatggtggataagctgctggtgccttagtgtgaatcaaggtagtgccaccaaagtgtacttgtagtttctgtattagtcacctgccgtgcactcacagtaaactacattactcaactgagtattacccagttatacccaatccctgatgaagtattaaaatgttattagttttattaactctctacacttgaatgtgtgttttttaaaatattctgtgtgatgacatgggtagtgtgcataaagtacctctgtgtctgaagtatgatagttgtcttgaggaaaagcacttgtgtgattgaattgtgaggtaaactacctgatttttttttgttgttacatgaaagaatgagtgacaaatctttaaagtatttacaatatcactccagaaaagaaaacaaatcaaataaatattgactcaaaactctccaagtacatatcaaaatctcaggaagggaaaaaagagtctaaagaacaaaatataacactattttatttcagtcatgttagttcagtttccacagtttgaactgggtatagattaatatctaaaaccaaaaaatgaacatgtgtatagtgatgctgaaaaatgtgcattattttttatttatattttaggaataataaagttagttattaaagaatttagtgattttgattgagtgagaggtgtgagctatatttgcttctttcctgtatgatatacatacattgtttccaatctcatttctattaaataactataggagagcccacagccttgttattttacatatcactatttagatatttgttatttatttatttgtgttggcctgaagtaaatgttacttttgtacgatatttgaaggatagatttattttataaattaatagtttaaataagattttgccagcatttgaaatgatatttatttctgtgtatcaatattaccacaaacttacacagcttaaaacaacatacactctttatctcatgatctcacaatttctgtgggtcaggaatcaggtcatggcttaggtgggttttctgcttaaggatctcacaaggctgcattcaagatgtggtgcctgaagttgcagtttcatctgaaattctgttggggaagtatttgcttccaagttcacatggttgttggtagcattcagttccttaagggatgttggactgagaatctctgtatcttgttggcttttggctggctccttgccacgtaggtcttcccaataaggctgcttgcttcctcaaagctagcaggtgagagtgagtccttagcaagatgcccttacagtcttaggtaacataatcacgtacacaaaaatcatatatatcctgtcacctttgttgtgttctattggttaaaagcaagtcagaggtcctgcccacactcaatgggagggaattacacaggacctgaataccaggacctggggattatgggtaatgacatttacatggaggccactttagagtctgtctgccacacacgcttagtcaatcttgattgtttggcaaacatttcctcaaatctgtcacttcagcaaaaataattgatagtaatatttcttaccaatggtaaaatttgaacttttaagcaaaaattagaattttggaaaactcatttgccaccgtgatcttggcagcttttgaataagagttttctgatgggtggtggtgttcataaataatgatttttaaaatattgtgtaatgaactatgtcaccatttggaagacctgtgtaattcagtgaaactagtattttccacataactagtatatatactacaaaagtatgcatgggtaaaacatacatttaaaagctaagatagaccaatgattttaatggaacgggtgttctgggatacggtttcagatttcacactgcaacaaacctttaagaaagtaccaactgttcagttttggtatagtatcaaagtagtatatccacagttaattaaaaccctattaaaacactcccttttccagttatatattcctgtgaggcagaatttaataatactcctcaaccaaaacaacatgtcatagtagactgaaggcagaagcagataagagactaaaacaatttttgattaagctagatatttaagagctttgcaaagatgtgaaacaatgccacttttcactagttttttttgcgtttgcaagtcatttttcattaaaatgttatttatgttaatttgtaatgagtttgttattttaaaatgaataaataaatatt

SEQ ID NO: 2902 - DNA, 4902 bp, Homo sapiens
gacctcgacagggaacgcaagcaaaaccacacatttaaaacagacttggtaaaatcagctcgttatttaaagaaacggacgattcctttttctctcctggtttagtcttcgacccacaggccccttgcttctttcgaacggcggctgtatcccatgaccttttcactttccaagccaacggactgggggtcgttacacacgcggagggcccggaacgcacggctcctcgcctgcaaattccgagcagtccggattttggggctgcctcccggccacaccagccagcagctcgcacccacatggaggcagggccctggccctcgccccggaccggcgcgtggcggggcgcgtgggtcttcgagggcccgcgacgcggcgcacatgccggtgcccgcctcccgcgtcggcgagaagacagggagctcggacacggggaggctgacccggagcctacccatgaggcagcgcgccggctgcacgagagcccccccctttccacggctcggctgccagctccgcaatgggagccgccgccgtcgccgcagtgtagtttttcgtgctcctccttttcctcctcctctttctcctcctcctcagggctccagtcaggccgatccgctccgctcacggaaggaaaacagaaataacttgctggcttgtctggagtcacatggtaattcaaaaatggcagaactgtttatggaatgtgaagaagaggagctggaaccatggcagaagaaagtaaaagaagttgaggatgacgatgatgatgagccaatctttgttggcgagatatcaagttcaaaaccagcaatttcaaatattttgaacagagttaaccccagctcatattcaaggggactaaagaatggtgcactcagtcgaggtattactgctgcattcaagcctacaagtcaacactacacgaatccaacatcaaatccagtgcctgcctcaccaataaattttcatcctgagtctagatcttcagatagttctgttattgttcagcctttttctaaacctggttatataacaaactcatcacgagttgtgtctaataagtcatcagagttactgtttgacttgacccaggatacaggattatcacattaccaagggggaccaacactttctatggcaggtatgagtgaaagttcatttttatcaaaacgtccttctacttctgaagtaaataatgttaatccaaagaagcctaaacccagcgaaagtgtttctggagcaaattcctcagctgtattaccttcagttaaatctccttcagtgacttcttcccaggctatgctagcaaaaggtacaaatacctcatcaaatcagtctaaaaatggaacaccttttccaagagcttgtccaaagtgcaacattcatttcaatcttttggatcctttgaaaaatcacatgaagtattgttgtccagacatgataaataactttttgggactggctaaaacagaattttcaagtacagtaaataaaaacacaactattgattcagagaaaggaaaattgatcatgttagttaatgacttttattatggaaaacatgaaggagatgtccaggaggaacagaagactcacacaacctttaaatgcttcagttgcttgaaaattctaaaaaataacattaggtttatgaaccacatgaaacaccatttggaacttgagaagcagagcagtgagagctgggaaaaccataccacctgccagcactgctaccgtcagtttcccacaccatttcagttgcagtgtcacatcgaaagtacacatacgccccatgaattttctactatttgtaaaatctgtgaattgtcatttgaaacagaacatgttcttttacaacatatgaaggacaatcataaacctggtgaaatgccatatgtctgccaggtttgtaattatagatcatcatcattttctgatgtagaaactcattttagaacatcccatgaaaacactaagaacttgctatgcccgttttgcctcaaagttattaaaattgcaacaccatatatgcatcattatatgaagcatcagaaaaaaggaatacatcgttgtacaaaatgcaggctgcagtttttgacatgcaaggagaaaatggatcataagactcaacaccatcgaacatttataaaacctaaacaactagaaggattgcctcctggaacaaaagttactattcgagcttcagttggacctctgcaatcaggagcttcacctacaccttccattagtgcaagtgcttctacccttcagctctcacctccaaggactaaaaatataactgctaaaaatcctgcaaaatctaatacaagtaaacctaatacagtcaaatccaacgcaagtaaacctaatacaagtaagcctaatggaagtaaatctaaatacaaaccaaaaatctctaatatgcaaaagaaacaaagcacattggctagtagcaataaaaaaagtaaagtcaatacagcattgaggaatttaaggtatcgtcggggcattcacaaatgcattgagtgttgttccgaaataaaagattttgcaaaccactttcctacgtacgtccactgtagtttttgcagatacaacactagctgtagcaaagcctatgtaaatcatatgatgagctttcatagtaaccgtccaagcaaaaggttttgtatttttaagaagcattcagaaaatctccggggcattactctagtgtgccttaattgtgatttcctaagtgatgtttctggcttagataatatggctacacacttaagtcaacataaaactcatacttgccaagttgtaatgcagaaagtttctgtttgtatcccaacttctgagcacctttctgaattaaaaaaagaagctcccgcaaaggaacaagaacctgtgtctaaggaaattgcaagacctaacatggctgaaagagaaacagaaacatcaaattctgaaagtaaacaagataaagctgcttcttcaaaagaaaaaaatggatgtaatgcaaattcatttgaaggctcatcaacaacaaaaagtgaagaaagcataacagtttcagataaggaaaatgaaacctgtcttgcagaccaggaaactggctcaaaaaacatcgtcagttgtgattcaaatattggtgcagataaagtggaaaagaaaaaacaaatacaacacgtttgtcaggaaatggagttgaagatgtgccaaagttcagaaaacataatcttatctgatcagattaaagatcacaactccagtgaagccagattttcttcaaagaatattaaggatttgcgattagcatcagataatgtaagcattgatcagtttttgagaaaaagacatgaacctgaatctgttagttctgatgttagcgagcaaggcagtattcatttggaacctctgactccatccgaggtacttgagtatgaagccacagagattcttcagaaaggtagtggtgatccttcagccaagactgatgaagtagtgtctgatcaaacagatgacattcctggaggaaataaccctagcacaacagaggcaacagtagacctggaagacgaaaaagaaagaagttgaaattagtcattttaagtttcagtgtaccaacgataagggcatttggaacagtgctatcaggtgagctcagtggtgctgttgtaggttcagaaatggaaatatgtaagggaggtcacacatacactttacctgtatgttcaacctatgttatcaaacaaatcaattcaccaataatagcatgattagtagggattcccaaaaagtttttaaaaacacgaacaggattttaatgataattaaatttgcagtggaaaggtctcatttaatggttttcaaggaaatgggatttggttgctgacatgaattgatgatattagtaatatttataaagcctttcaaacttccatcaatcctaagctaaaaatctttattacctgtatatccttttcagttaactgagaggaagggatttggaaaccatgtacttttggggagtaattgattaaaaacaatggctgattggcattgttaatgaaggctttatttgtgaggatgatgctggtaaatggagcatgcttagagtactaaattgatctaatgagaatttggatgaacataaacttaattttggatttaatataacattccagtcagacgcatgtaaacagaatatttgaatctttgtacctccatacaagtgttagcctgccaggctgtaagcttaccttaattaaactttcagtgaaagtggaattattaagatataaatttatatttgtgctttttgtcagtgtgtaagctgtgtagaaattctttgatgtattagttgtattaatgtaaagtagaaacccattgttgaaactcctgtagctattatgcttttaatattgttttaatgatcttccttagaaataggcccataaaaatggtctggaagccaaaccaaagtatggtataatgtagatattgtaaagcagtaaactgaaaacatgtcctggcatgtattcagccatgtttaagtgacttttctgtaattgtaaaataaaaacttcaaatgggacctaaaacagtgatgtaaaagaactggttttggaaatttagcctaatttatctataagatggctgctaaattgatttttcagttctttttatcatctagaatataatagatatagaaatgaataatatgaagaacagtagtttgctttgaaatactaataaacttttatttaaaatgcttcatttttacttcttaaaatgtgctttggattcttaaattttgtttcactgaatgttcaatgttttaaatggcgattaaaatactctgctgtatatagtagtttttgagtaaatatttgcaataaaaatctgcccccg

SEQ ID NO: 2903 - DNA, 3132 bp, Homo sapiens
acactgcgccgcggctgcgcagtacacgggaggcttttaattccattgtggagaggacggcgttatttttattaactggaggcgacggcggctgcggcggcggcgggacccgcctcctccggggtatgaaaatcggcagtgggttcctgagtggcggcggaggtaccggcagtagcggtggtagcggctccggcggcggtggtagtggcggcggcggcggcggcggcagcagcggcaggagggcagagatggaacccacctttccccagggtatggttatgttcaaccaccgtcttcccccggtcaccagcttcacccggccggcggggtcggccgcccctcccccgcaatgcgtgttatcctcctctacctccgcagccccggccgctgagcccccccctccgccagccccggacatgactttcaagaaggagccggcggcgtcagccgcggccttcccctcgcagaggacctcctgggggttcttgcagtctttggttagcatcaaacaggagaaacccgcggatcctgaggagcagcagtcccaccaccaccatcaccaccaccactatggggggctgttcgctggagctgaagagaggtctccaggcctaggaggcggtgaaggggggagtcacggcgtcatccaggacctcagtattctccaccagcatgtccagcagcaaccagcccagcaccaccgtgacgtattactcagcagcagtagcaggactgatgaccaccatggcactgaggagccaaagcaggacactaatgtcaaaaaggcaaaaaggccaaagccagaatctcagggaatcaaagccaagaggaagccaagtgcatcttccaaaccttctttggttggagatggagaaggtgccatcctctccccaagtcagaaacctcatatctgtgatcactgtagtgctgctttccgaagctcctatcacctgcggagacatgtcctcattcatacaggagaaagacctttccagtgcagccagtgtagtatgggtttcattcagaaatacctactacagagacatgagaaaattcatagtagagagaagccatttggatgtgatcagtgcagcatgaagtttattcagaagtaccatatggagagacacaagaggacacatagtggagaaaagccatataagtgtgacacttgccaacagtatttttcaaggactgatagattgttgaagcacaggcgcacatgtggtgaagtcatagttaaaggagccactagtgcagaacctgggtcatcaaaccataccaatatgggtaatctggctgtgttgtctcagggaaatacaagttcttcaaggagaaaaacaaagtcaaaaagcatagctattgaaaataaggaacagaagaccggtaaaacaaatgaatcgcaaatttcaaataatataaacatgcagagttactcagtagaaatgcctaccgtgtcttccagtggaggcataattggcactggaatagatgaactgcagaagagggtgccaaaattgatctttaagaaaggaagcagaaagaatacagataaaaactaccttaactttgtgtcaccattaccagacatagtaggacagaaatccttgtctggaaaaccaagtggctcacttggcatagtatcaaataatagtgtggagaccattggtcttctccaaagtacaagtggcaaacaaggtcagataagtagtaattatgatgatgccatgcagttttcaaagaaaagaagatatttaccaactgccagcagcaacagtgccttttctataaacgtaggacacatggtctcccaacagtctgtcattcagtctgcaggtgtcagtgttttggacaatgaggcaccattgtcacttattgactcctcagctctaaatgctgaaattaaatcttgtcatgacaagtctggaattcctgatgaggttttacaaagtattttggatcaatactccaacaaatcagaaagccagaaagaggatcctttcaatattgcagaaccacgagtggatttacacacctcaggagaacactcagaattggttcaagaagaaaatttgagcccaggcacccaaacaccttcaaatgataaagcaagtatgttgcaagaatactccaaatacctccaacaggcttttgaaaaatccactaatgcaagttttactcttggacacggtttccaatttgtcagtttgtcttcacctctccacaaccacactttgtttccagaaaaacaaatatacactacgtctcctttggagtgtggtttcggccaatctgttacctcagtgttgccatcttcattgccaaagcctccttttgggatgttgtttggatctcagccaggtctttatttgtctgctttggatgctacacatcagcagttgacaccttcccaggagctggatgatctgatagattctcagaagaacttagagacttcatcagccttccagtcctcatctcagaaattgactagccagaaggaacagaaaaacttagagtcttcaacaggctttcagattccatctcaggagttagctagccagatagatcctcagaaagacatagagcctagaacaacgtatcagattgagaactttgcacaagcgtttggttctcagtttaagtcgggcagcagggtgccaatgacctttatcactaactctaatggagaagtggaccatagagtaaggacttcagtgtcagatttctcagggtatacaaatatgatgtctgatgtaagtgagccatgtagtacaagagtaaagacacccaccagccagagttacaggtaaggtcccaaaagtggccaggctggaggtcttctaatgtaattttgttttattttgagaacactgccattggaatgtttctacacgatcctattaagaataatgtgatgccctttcaatgcaacttttcatatttagtttattttgttagcgtgattttagctctgtttgtattatgatttttaatcaaaatcaatagattaaaaatagtttgacattcaaagtgacaatgtttagcaatcaaatttacatgtatagatcgtcagggaatagcccaaatgttttaaacgcaaaaaaaaagacaaaaaaaaaccaaaaaaaa

SEQ ID NO: 2904 - DNA, 2933 bp, Homo sapiens
atttttattaactggaggcgacggcggctgcggcggcggcgggacccccaggcctcctccggggtatgaaaatcggcagtgggttcctgagtggcggcggaggtaccggcagtagcggtggtagcggctccggcggcggtggtagtggcggcggcggcggcggcggcagcagcggcaggagggcagagatggaacccacctttccccaggccccggccgctgagcccccccctccgccagccccggacatgactttcaagaaggagccggcggcgtcagccgcggccttcccctcgcagaggacctcctgggggttcttgcagtctttggttagcatcaaacaggagaaacccgcggatcctgaggagcagcagtcccaccaccaccatcaccaccaccactatggggggctgttcgctggagctgaagagaggtctccaggcctaggaggcggtgaaggggggagtcacggcgtcatccaggacctcagtattctccaccagcatgtccagcagcaaccagcccagcaccaccgtgacgtattactcagcagcagtagcaggactgatgaccaccatggcactgaggagccaaagcaggacactaatgtcaaaaaggcaaaaaggccaaagccagaatctcagggaatcaaagccaagaggaagccaagtgcatcttccaaaccttctttggttggagatggagaaggtgccatcctctccccaagtcagaaacctcatatctgtgatcactgtagtgctgctttccgaagctcctatcacctgcggagacatgtcctcattcatacaggagaaagacctttccagtgcagccagtgtagtatgggtttcattcagaaatacctactacagagacatgagaaaattcatagtagagagaagccatttggatgtgatcagtgcagcatgaagtttattcagaagtaccatatggagagacacaagaggacacatagtggagaaaagccatataagtgtgacacttgccaacagtatttttcaaggactgatagattgttgaagcacaggcgcacatgtggtgaagtcatagttaaaggagccactagtgcagaacctgggtcatcaaaccataccaatatgggtaatctggctgtgttgtctcagggaaatacaagttcttcaaggagaaaaacaaagtcaaaaagcatagctattgaaaataaggaacagaagaccggtaaaacaaatgaatcgcaaatttcaaataatataaacatgcagagttactcagtagaaatgcctaccgtgtcttccagtggaggcataattggcactggaatagatgaactgcagaagagggtgccaaaattgatctttaagaaaggaagcagaaagaatacagataaaaactaccttaactttgtgtcaccattaccagacatagtaggacagaaatccttgtctggaaaaccaagtggctcacttggcatagtatcaaataatagtgtggagaccattggtcttctccaaagtacaagtggcaaacaaggtcagataagtagtaattatgatgatgccatgcagttttcaaagaaaagaagatatttaccaactgccagcagcaacagtgccttttctataaacgtaggacacatggtctcccaacagtctgtcattcagtctgcaggtgtcagtgttttggacaatgaggcaccattgtcacttattgactcctcagctctaaatgctgaaattaaatcttgtcatgacaagtctggaattcctgatgaggttttacaaagtattttggatcaatactccaacaaatcagaaagccagaaagaggatcctttcaatattgcagaaccacgagtggatttacacacctcaggagaacactcagaattggttcaagaagaaaatttgagcccaggcacccaaacaccttcaaatgataaagcaagtatgttgcaagaatactccaaatacctccaacaggcttttgaaaaatccactaatgcaagttttactcttggacacggtttccaatttgtcagtttgtcttcacctctccacaaccacactttgtttccagaaaaacaaatatacactacgtctcctttggagtgtggtttcggccaatctgttacctcagtgttgccatcttcattgccaaagcctccttttgggatgttgtttggatctcagccaggtctttatttgtctgctttggatgctacacatcagcagttgacaccttcccaggagctggatgatctgatagattctcagaagaacttagagacttcatcagccttccagtcctcatctcagaaattgactagccagaaggaacagaaaaacttagagtcttcaacaggctttcagattccatctcaggagttagctagccagatagatcctcagaaagacatagagcctagaacaacgtatcagattgagaactttgcacaagcgtttggttctcagtttaagtcgggcagcagggtgccaatgacctttatcactaactctaatggagaagtggaccatagagtaaggacttcagtgtcagatttctcagggtatacaaatatgatgtctgatgtaagtgagccatgtagtacaagagtaaagacacccaccagccagagttacaggtaaggtcccaaaagtggccaggctggaggtcttctaatgtaattttgttttattttgagaacactgccattggaatgtttctacacgatcctattaagaataatgtgatgccctttcaatgcaacttttcatatttagtttattttgttagcgtgattttagctctgtttgtattatgatttttaatcaaaatcaatagattaaaaatagtttgacattcaaagtgacaatgtttagcaatcaaatttacatgtatagatcgtcagggaatagcccaaatgttttaaacgc

SEQ ID NO: 2905 - DNA, 3080 bp, Homo sapiens
gtggagaggacggcgttatttttattaactggaggcgacggcggctgcggcggcggcgggacccccaggcctcctccggggtatgaaaatcggcagtgggttcctgagtggcggcggaggtaccggcagtagcggtggtagcggctccggcggcggtggtagtggcggcggcggcggcggcggcagcagcggcaggagggcagagatggaacccacctttccccagggtatggttatgttcaaccaccgtcttcccccggtcaccagcttcacccggccggcggggtcggccgcccctcccccgcaatgcgtgttatcctcctctacctccgcagccccggccgctgagcccccccctccgccagccccggacatgactttcaagaaggagccggcggcgtcagccgcggccttcccctcgcagaggacctcctgggggttcttgcagtctttggttagcatcaaacaggagaaacccgcggatcctgaggagcagcagtcccaccaccaccatcaccaccaccactatggggggctgttcgctggagctgaagagaggtctccaggcctaggaggcggtgaaggggggagtcacggcgtcatccaggacctcagtattctccaccagcatgtccagcagcaaccagcccagcaccaccgtgacgtattactcagcagcagtagcaggactgatgaccaccatggcactgaggagccaaagcaggacactaatgtcaaaaaggcaaaaaggccaaagccagaatctcagggaatcaaagccaagaggaagccaagtgcatcttccaaaccttctttggttggagatggagaaggtgccatcctctccccaagtcagaaacctcatatctgtgatcactgtagtgctgctttccgaagctcctatcacctgcggagacatgtcctcattcatacaggagaaagacctttccagtgcagccagtgtagtatgggtttcattcagaaatacctactacagagacatgagaaaattcatagtagagagaagccatttggatgtgatcagtgcagcatgaagtttattcagaagtaccatatggagagacacaagaggacacatagtggagaaaagccatataagtgtgacacttgccaacagtatttttcaaggactgatagattgttgaagcacaggcgcacatgtggtgaagtcatagttaaaggagccactagtgcagaacctgggtcatcaaaccataccaatatgggtaatctggctgtgttgtctcagggaaatacaagttcttcaaggagaaaaacaaagtcaaaaagcatagctattgaaaataaggaacagaagaccggtaaaacaaatgaatcgcaaatttcaaataatataaacatgcagagttactcagtagaaatgcctaccgtgtcttccagtggaggcataattggcactggaatagatgaactgcagaagagggtgccaaaattgatctttaagaaaggaagcagaaagaatacagataaaaactaccttaactttgtgtcaccattaccagacatagtaggacagaaatccttgtctggaaaaccaagtggctcacttggcatagtatcaaataatagtgtggagaccattggtcttctccaaagtacaagtggcaaacaaggtcagataagtagtaattatgatgatgccatgcagttttcaaagaaaagaagatatttaccaactgccagcagcaacagtgccttttctataaacgtaggacacatggtctcccaacagtctgtcattcagtctgcaggtgtcagtgttttggacaatgaggcaccattgtcacttattgactcctcagctctaaatgctgaaattaaatcttgtcatgacaagtctggaattcctgatgaggttttacaaagtattttggatcaatactccaacaaatcagaaagccagaaagaggatcctttcaatattgcagaaccacgagtggatttacacacctcaggagaacactcagaattggttcaagaagaaaatttgagcccaggcacccaaacaccttcaaatgataaagcaagtatgttgcaagaatactccaaatacctccaacaggcttttgaaaaatccactaatgcaagttttactcttggacacggtttccaatttgtcagtttgtcttcacctctccacaaccacactttgtttccagaaaaacaaatatacactacgtctcctttggagtgtggtttcggccaatctgttacctcagtgttgccatcttcattgccaaagcctccttttgggatgttgtttggatctcagccaggtctttatttgtctgctttggatgctacacatcagcagttgacaccttcccaggagctggatgatctgatagattctcagaagaacttagagacttcatcagccttccagtcctcatctcagaaattgactagccagaaggaacagaaaaacttagagtcttcaacaggctttcagattccatctcaggagttagctagccagatagatcctcagaaagacatagagcctagaacaacgtatcagattgagaactttgcacaagcgtttggttctcagtttaagtcgggcagcagggtgccaatgacctttatcactaactctaatggagaagtggaccatagagtaaggacttcagtgtcagatttctcagggtatacaaatatgatgtctgatgtaagtgagccatgtagtacaagagtaaagacacccaccagccagagttacaggtaaggtcccaaaagtggccaggctggaggtcttctaatgtaattttgttttattttgagaacactgccattggaatgtttctacacgatcctattaagaataatgtgatgccctttcaatgcaacttttcatatttagtttattttgttagcgtgattttagctctgtttgtattatgatttttaatcaaaatcaatagattaaaaatagtttgacattcaaagtgacaatgtttagcaatcaaatttacatgtatagatcgtcagggaatagcccaaatgttttaaacgcaaaaaaaaagacaaaaaaaaac

SEQ ID NO: 2906 - DNA, 2957 bp, Homo sapiens
ttattaactggaggcgacggcggctgcggcggcggcgggacccgcctcctccggggtatgaaaatcggcagtgggttcctgagtggcggcggaggtaccggcagtagcggtggtagcggctccggcggcggtggtagtggcggcggcggcggcggcggcagcagcggcaggagggcagagatggaacccacctttccccagggtatggttatgttcaaccaccgtcttcccccggtcaccagcttcacccggccggcggggtcggccgcccctcccccgcaatgcgtgttatcctcctctacctccgcagccccggccgctgagcccccccctccgccagccccggacatgactttcaagaaggagccggcggcgtcagccgcggccttcccctcgcagaggacctcctgggggttcttgcagtctttggttagcatcaaacaggagctgaagagaggtctccaggcctaggaggcggtgaaggggggagtcacggcgtcatccaggacctcagtattctccaccagcatgtccagcagcaaccagcccagcaccaccgtgacgtattactcagcagcagtagcaggactgatgaccaccatggcactgaggagccaaagcaggacactaatgtcaaaaaggcaaaaaggccaaagccagaatctcagggaatcaaagccaagaggaagccaagtgcatcttccaaaccttctttggttggagatggagaaggtgccatcctctccccaagtcagaaacctcatatctgtgatcactgtagtgctgctttccgaagctcctatcacctgcggagacatgtcctcattcatacaggagaaagacctttccagtgcagccagtgtagtatgggtttcattcagaaatacctactacagagacatgagaaaattcatagtagagagaagccatttggatgtgatcagtgcagcatgaagtttattcagaagtaccatatggagagacacaagaggacacatagtggagaaaagccatataagtgtgacacttgccaacagtatttttcaaggactgatagattgttgaagcacaggcgcacatgtggtgaagtcatagttaaaggagccactagtgcagaacctgggtcatcaaaccataccaatatgggtaatctggctgtgttgtctcagggaaatacaagttcttcaaggagaaaaacaaagtcaaaaagcatagctattgaaaataaggaacagaagaccggtaaaacaaatgaatcgcaaatttcaaataatataaacatgcagagttactcagtagaaatgcctaccgtgtcttccagtggaggcataattggcactggaatagatgaactgcagaagagggtgccaaaattgatctttaagaaaggaagcagaaagaatacagataaaaactaccttaactttgtgtcaccattaccagacatagtaggacagaaatccttgtctggaaaaccaagtggctcacttggcatagtatcaaataatagtgtggagaccattggtcttctccaaagtacaagtggcaaacaaggtcagataagtagtaattatgatgatgccatgcagttttcaaagaaaagaagatatttaccaactgccagcagcaacagtgccttttctataaacgtaggacacatggtctcccaacagtctgtcattcagtctgcaggtgtcagtgttttggacaatgaggcaccattgtcacttattgactcctcagctctaaatgctgaaattaaatcttgtcatgacaagtctggaattcctgatgaggttttacaaagtattttggatcaatactccaacaaatcagaaagccagaaagaggatcctttcaatattgcagaaccacgagtggatttacacacctcaggagaacactcagaattggttcaagaagaaaatttgagcccaggcacccaaacaccttcaaatgataaagcaagtatgttgcaagaatactccaaatacctccaacaggcttttgaaaaatccactaatgcaagttttactcttggacacggtttccaatttgtcagtttgtcttcacctctccacaaccacactttgtttccagaaaaacaaatatacactacgtctcctttggagtgtggtttcggccaatctgttacctcagtgttgccatcttcattgccaaagcctccttttgggatgttgtttggatctcagccaggtctttatttgtctgctttggatgctacacatcagcagttgacaccttcccaggagctggatgatctgatagattctcagaagaacttagagacttcatcagccttccagtcctcatctcagaaattgactagccagaaggaacagaaaaacttagagtcttcaacaggctttcagattccatctcaggagttagctagccagatagatcctcagaaagacatagagcctagaacaacgtatcagattgagaactttgcacaagcgtttggttctcagtttaagtcgggcagcagggtgccaatgacctttatcactaactctaatggagaagtggaccatagagtaaggacttcagtgtcagatttctcagggtatacaaatatgatgtctgatgtaagtgagccatgtagtacaagagtaaagacacccaccagccagagttacaggtaaggtcccaaaagtggccaggctggaggtcttctaatgtaattttgttttattttgagaacactgccattggaatgtttctacacgatcctattaagaataatgtgatgccctttcaatgcaacttttcatatttagtttattttgttagcgtgattttagctctgtttgtattatgatttttaatcaaaatcaatagattaaaaatagtttgacattcaaagtgacaatgtttagcaatcaaatttacatgtatagatcgtcagggaatagcccaaatgttttaaacgc

SEQ ID NO: 2907 - DNA, 3721 bp, Homo sapiens
cctacgggctgtagatggagctgtccggccccggagagggggaaggcgcctggaaaacgttcttcttctccctggccgacccgagcggggaacagcactcccaggatgcagtttgtgtcaacacggccgcagcctcagcagctgggcatccagggcctggggctggacagcgggagctggagctgggcccaggctctgcccccggaggaggtctgccaccaggagccggcgctgcgcggggaaatggccgagggaatgccgcccatgcaggctcaagaatgggacatggacgcccggcggccaatgccttttcagttcccaccctttccagatagggcacctgtcttccccgaccgcatgatgcgagagccccagttgcccacagcagagatctcactctggactgtggtggctgccattcaggctgtggagaggaaggtggatgcccaggccagccagctgctgaacctggaggggcgcacggggacagccgagaagaagctggccgactgtgaaaagacggccgtggaatttgggaaccacatggagagcaagtgggccgtgctggggaccctgctgcaggagtacgggctgctgcagaggcggctggagaacttggagaacttgctgcgcaacaggaacttctgggtcctgcggctgcccccgggcagcaagggggaggcccccaaggttccagtgacttttgtcgacattgctgtgtacttctccgaagacgagtggaagaacttggacgaatggcagaaggagctttataacaaccttgttaaggagaactacaaaaccctcatgtccctggacgcggagggctcagtccccaagccagatgctccagtccaggctgagcccagggaagaaccttgtgtgtgggagcagcgccaccccgaagagagagaaatcccaatggatcccgaagcaggagcagagcccctggtgcctgcgcaggatgcgtcctcccaggtgaagcgtgaggacaccctgtgtgtccggggtcagcggggcctggaggaaagagccatccctacggaatccattaccgactccccaatttctgcccaggacctcttgtcccggattaaacaggaggagcatcagtgcgtgtgggatcagcaggatttggcagacagagatattcccacggatcccaattcagagtctctcatctcagcacatgacattttgtcatggatcaagcaggaggagcagccatacccatggggaccacgcgactcaatggacggagagcttggattagactctggccctagtgacagcctgctgatggtgaagaacccacccccggccccgccacagccccagccccagccccagccaccgcagccgcagctgcagtcgcagccccagccccagagcctgccccccatcgcggtggccgagaacccgggcggccccccgagccgagggctgctggacgacggtttccaggtgctgcccggggagcgtggctccggcgaggcgccgccgggtggggaccgcagcaccgggggcggcgggggcgatgggggcggtgggggcggcggcgcggaggcggggacgggggcaggcggcggctgtggcagctgctgccctggcgggctgcggcggagcctcctcctgcacggcgcccgcagcaagccctactcgtgccccgagtgcggcaagagcttcggcgtgcgcaagagcctcatcatccaccaccgcagccacaccaaggagcggccctacgagtgcgctgagtgcgagaagagcttcaactgccactcgggcctcatccgccaccagatgacgcaccgcggcgagcggccctacaagtgctcggagtgcgagaagacctacagccgtaaggagcacctgcagaaccaccagcggctgcacacgggcgagcggcctttccaatgtgcactgtgcggcaagagcttcatccgcaagcagaacctgctcaagcaccagcgcatccacacgggcgagcgcccctacacgtgcggcgagtgcggcaagagcttccgctacaaggagtcgctcaaggaccacctgcgcgtgcacagcggcggcccgggccccggcgccccacggcagctcccgccgcctcctgagcgagactagggctgggctgggggagggcagggccggacggagtggatcgggggcggcctgagcaccaaccaccttgccgggtgtcctcagccaccgtctggaaatcggcaacaggcattgcactccggttgggggtccccagggtggggcagggatcccccagatctgtctggtctgaatggacgcccagctcatctagggtggacccagctgctggggaagagccagggggaccgcgaggagccgagcgtcctcgggcaccgccctcacacctcctcgagtgccctgggaccactgggccacagatggtcatcaggggaagccaccagggagtcccgaagcccttctgagatcaggaaatcaggtcccaaggttaggagacgccctgaaaaaaagcgaaggccgagggatgtgctaagggtaacaccttcatgatgacaacactgcctcgcgtttcaatagcgctttatacttttttaagtgttttctatccgttatccatttcacccttggcctatccctctcagataggtggggtaggattttcctggtgaccgagtaaagtgagaggcaggtgagacggttcacccaatcacacgggaaggggcgcgcgctgcccaaccgcgctctccgcctacctccgctgctcgggaagctgctggcctggccctcctggtctctcttcctttcctggtctctcttcctttccttgctctcacccacggataaaaccagaagcgacaggaggccagctcctggggttcctgggagccgggaacagattggctacggaacgccccaggttgtacattcagagggctctttctccatgggagctcctggtgccgcctcggccccagcctgtccccagcccctcaatctggtgcagcagcatcttgtcactgcacaacagtggcctggtcccccacaggcagttagggccccaggtcagacctcaccatgatgatttgttccagttctcccagggcagaggggcgagggagaggcttttgctgtgagagtagccgtcacgtgtctcttcccagcagcgccgggcaagtgggtgctagagtctgagcctcaggctctcctgccctgggcctcccaattggtgctatctgttactgcccgtgctcacggacatggatacagaccctgctgtgctccacaccctgcaggcgcctcgggaagcgcccaaaggattccccttcacgttggtgcacctgctccatagctccgggcgctgcgtcccgaggggccacagtctccatttcagcgtcttgcatggcctggcaccgggtggggtggtatgccccaggacccttgtttgtgtcaaaaatgactttccctgcccttgccgtgggtccggcgttcctcccagccgggatcacagtgggcagccggcacccggcaccactttggcgagcgtcctgcttccgccctcgccctcatctacgctgctccgctttcctcagacccctttttgccgtgcaaagggaattcttgacattaaataaaaggtatccagattgcagactgcatgttcacagagctgggggttctccagcttgcctacagtaaagcctcaatgaactggaatccaattcaa

SEQ ID NO: 2908 - DNA, 1358 bp, Homo sapiens
gccgccgaaggggactgtttgctcctacgggctgtagatggagctgtccggccccggagagggggaaggcgcctggaaaacgttcttcttctccctggccgacccgagcggggaacagcactcccaggatgcagtttgtgtcaacacggccgcagcctcagcagctgggcatccagggcctggggctggacagcgggagctggagctgggcccaggctctgcccccggaggaggtctgccaccaggagccggcgctgcgcggggaaatggccgagggaatgccgcccatgcaggctcaagaatgggacatggacgcccggcggccaatgccttttcagttcccaccctttccagatagggcacctgtcttccccgaccgcatgatgcgagagccccagttgcccacagcagagatctcactctggactgtggtggctgccattcaggctgtggagaggaaggtggatgcccaggccagccagctgctgaacctggaggggcgcacggggacagccgagaagaagctggccgactgtgaaaagacggccgtggaatttgggaaccacatggagagcaagtgggccgtgctggggaccctgctgcaggagtacgggctgctgcagaggcggctggagaacttggagaacttgctgcgcaacaggaacttctgggtcctgcggctgcccccgggcagcaagggggaggcccccaaggttccagtgacttttgtcgacattgctgtgtacttctccgaagacgagtggaagaacttggacgaatggcagaaggagctttataacaaccttgttaaggagaactacaaaaccctcatgtccctggacgcggagggctcagtccccaagccagatgctccagtccaggctgagcccagctactcgtgccccgagtgcggcaagagcttcggcgtgcgcaagagcctcatcatccaccaccgcagccacaccaaggagcggccctacgagtgcgctgagtgcgagaagagcttcaactgccactcgggcctcatccgccaccagatgacgcaccgcggcgagcggccctacaagtgctcggagtgcgagaagacctacagccgtaaggagcacctgcagaaccaccagcggctgcacacgggcgagcggcctttccaatgtgcactgtgcggcaagagcttcatccgcaagcagaacctgctcaagcaccagcgcatccacacgggcgagcgcccctacacgtgcggcgagtgcggcaagagcttccgctacaaggagtcgctcaaggaccacctgcgcgtgcacagcggcggcccgggccccggcgccccacggcagctcccgccgcctcctgagcgagactag

SEQ ID NO: 2909 - DNA, 1815 bp, Homo sapiens
ttctccctggccgacccgagcggggaacagcactcccaggatgcagtttgtgtcaacacggccgcagcctcagcagctgggcatccagggcctggggctggacagcgggagctggagctgggcccaggctctgcccccggaggaggtctgccaccaggagccggcgctgcgcggggaaatggccgagggaatgccgcccatgcaggctcaagaatgggacatggacgcccggcggccaatgccttttcagttcccaccctttccagatagggcacctgtcttccccgaccgcatgatgcgagagccccagttgcccacagcagagatctcactctggactgtggtggctgccattcaggctgtggagaggaaggtggatgcccaggccagccagctgctgaacctggaggggcgcacggggacagccgagaagaagctggccgactgtgaaaagacggccgtggaatttgggaaccacatggagagcaagtgggccgtgctggggaccctgctgcaggagtacgggctgctgcagaggcggctggagaacttggagaacttgctgcgcaacaggaacttctgggtcctgcggctgcccccgggcagcaagggggaggcccccaaggttccagtgacttttgtcgacattgctgtgtacttctccgaagacgagtggaagaacttggacgaatggcagaaggagctttataacaaccttgttaaggagaactacaaaaccctcatgtccctggacgcggagggctcagtccccaagccagatgctccagtccaggctgagcccagggaagaaccttgtgtgtgggagcagcgccaccccgaagagagagaaatcccaatggatcccgaagcaggagcagagcccctggtgcctgcgcaggatgcgtcctcccaggtgaagcgtgaggacaccctgtgtgtccggggtcagcggggcctggaggaaagagccatccctacggaatccattaccgactccccaatttctgcccaggacctcttgtcccggattaaacaggaggagcatcagtgcgtgtgggatcagcaggatttggcagacagagatattcccacggatcccaattcagagtctctcatctcagcacatgacattttgtcatggatcaagcaggaggagcagccatacccatggggaccacgcgactcaatggacggagagcttggattagactctggccctagtgacagcctgctgatggtgaagaacccacccccggccccgccacagccccagccccagccccagccaccgcagccgcagctgcagtcgcagccccagccccagagcctgccccccatcgcggtggccgagaacccgggcggccccccgagccgagggctgctggacgacggtttccagccacaccaaggagcggccctacgagtgcgctgagtgcgagaagagcttcaactgccactcgggcctcatccgccaccagatgacgcaccgcggcgagcggccctacaagtgctcggagtgcgagaagacctacagccgtaaggagcacctgcagaaccaccagcggctgcacacgggcgagcggcctttccaatgtgcactgtgcggcaagagcttcatccgcaagcagaacctgctcaagcaccagcgcatccacacgggcgagcgcccctacacgtgcggcgagtgcggcaagagcttccgctacaaggagtcgctcaaggaccacctgcgcgtgcacagcggcggcccgggccccggcgccccacggcagctcccgccgcctcctgagcgagactagggctgggctgggggag

SEQ ID NO: 2910 - DNA, 1260 bp, Homo sapiens
tgctgccaggttgccagatttctaagaaggagtttgaagaggagaaaaggatttttgcatgtttagaaatcaaggttcaggagaatcttgacagtgaatgtgtctcattacattgaataacagctacaggatgttcgagagctgttctggcttttctggattctgtgcttcaccaatagaggaatcccatggagcattaattagttcttgcaattccagaaccatgactgatgggttggtgacattcagggatgtggccatcgacttctctcaggaggagtgggaatgcctggaccctgctcagagggacttgtacgtggatgtaatgttggagaactatagtaacttggtgtcactgggtaaggtcatctgcctgaaataatttagagtctcctctttgcatcatcagttttctgcactggaaattacagggctatctttgaagaaaccaggtgaatttcttctcccccttcccaagggcatgcttttatacttgctgggttagaaatgggtttgttaaacacgttgatcttccccatccctcagtgagctttacaccattctcgggccctccctgcaatcacctctctcctttaatggccaaggggctggatttgcattatagaacatttatttcataactatggcaaagaaaccagatttcataaattctgcaaatattatattgaatatctactcctggccagccttgtgctgagcactgtcaattgaatcatgaacaagctttgataacttgcccattttcgtgcagtttactttgtagtaaagcagaaacatcaaataagtaaatttataaatagataaatagtatgtaatgaagcaaattctttggaaaaggtaaacagcataagggaatagaaaatgatgaggactgacagggctaatttaggtaagacagtcggggaacgctttcttgaacagagatgtggagcctgggatctctatgtgaatatctggcggaggaacagatcagtcacagtgaacagcaaatgcaaagaccctgttgttggaaaggaactttaccagaactctagagtagagttattaaaggaacatgtactaagaaattaggccagggagataggaaggggccagataatacattgttttgttgttcttgtttgtggaatttggattgtttagtctctttcagtctgaaacagttcacatgtctttccttgacttgcgtatatgtctgtgatgcttttgaagattacaggccagctattttgtatagtg

SEQ ID NO: 2911 - DNA, 2851 bp, Homo sapiens
cttttaggggcggggcgagcttgcctgccagaagctcctctcccagcctgcgagcatttccaggctcttgtttcccatcagcctctgggtccaaactaaccacaggtctctgggtccttttccggtgtccttaaggttcttggactctgcatgtgctgccaggttgccagatttctaagaaggagtttgaagaggagaaaaggatttttgcatgtttagaaatcaaggttcaggagaatcttgacagtgaatgtgtctcattacattgaataacagctacaggatgttcgagagctgatggagtctcgctctgtcgcccaggctggagtgcagtggtgcgatcttggctcactgcaagctccgcctcctgggttcacgctattctcctgcctcagcctcctgagtagctgggactacagttctggcttttctggattctgtgcttcaccaatagaggaatcccatggagcattaattagttcttgcaattccagaaccatgactgatgggttggtgacattcagggatgtggccatcgacttctctcaggaggagtgggaatgcctggaccctgctcagagggacttgtacgtggatgtaatgttggagaactatagtaacttggtgtcactggatttggagtcaaaaacgtatgagaccaaaaaaatattttcagaaaatgatatttttgaaataaatttttcccagtgggagatgaaggacaaaagtaaaacccttggccttgaggcatccatcttcagaaataattggaagtgcaaaagcatattcgagggactaaaaggacatcaagagggatacttcagtcaaatgataatcagctatgaaaaaataccttcttacagaaaaagtaaatctcttactccacatcaaagaattcataatacagagaaatcctatgtttgtaaggaatgtgggaaggcttgcagtcatggctcaaaacttgttcaacatgagagaactcatacagctgaaaaacactttgaatgtaaagaatgtgggaagaattatttaagtgcctatcaactcaatgtgcatcagagatttcatactggtgagaaaccctatgagtgtaaggaatgtgggaagacctttagctggggatcaagccttgttaaacatgagagaattcacactggtgagaaaccctatgaatgtaaagaatgtgggaaggcctttagtcgtggctatcaccttacccaacatcagaaaattcatactggtgtgaaatcttataaatgtaaggaatgtgggaaggcctttttttggggctcaagccttgctaaacatgagataattcatacaggtgagaaaccttataaatgtaaagaatgtgggaaggccttcagtcgtggctatcagcttactcagcatcagaaaatccatactggtaagaaaccttatgaatgtaaaatatgtggaaaggctttttgttggggctatcaacttactcgacatcagatatttcatactggtgagaaaccctatgaatgcaaggaatgtgggaaggcttttaattgcggatcaagtcttattcaacatgaaagaattcatactggtgagaaaccttatgaatgtaaagaatgtggaaaggcctttagtcgtggctatcacctttctcaacatcagaaaatccatactggtgagaaaccttttgaatgtaaggaatgtgggaaggcctttagttggggttcaagccttgttaaacatgagagagttcatactggtgagaaatcccatgaatgtaaagaatgcggaaagaccttttgtagtgggtatcaacttactcgacatcaggtatttcacactggtgagaaaccctatgaatgtaaggaatgtgggaaggcttttaattgtggatcaagccttgttcaacatgaaagaatccatacaggggagaaaccctatgaatgtaaagaatgtgggaaggcttttagtcgtggctatcaccttactcaacatcagaaaattcataccggtgagaaacctttcaaatgtaaggaatgtgggaaggccttcagttggggttcaagcctagttaagcatgagagagtccatactaatgagaagtcttatgaatgtaaagactgtgggaaggcctttggtagtggctatcaacttagtgttcatcagagatttcatactggtgagaagctttatcaacgtaaggaattcgggaagacctttacttgtggctcaaaacttgttcatgagagaactcatagtaatgataaaccctacaaatataacgaatgtggggaagcctttctgtggacaacttactcaaatgagaaaattgatactgatgaaaccttatgattgaaagttgtaaaagaatattttgtgtgtgtgtatagacaacttatcataataagaactcttactcttgagaaaccttgtgaatgtaagggttgtgcaaaagccattcatttctgtttatgggcaattatcttgctatccagcaattcatactagtgagaaatattttgaatataattaatatgaaaaggcctttagacttctgtacagtcttattggatatcaatttatactgatgtaaaatcatttaaatgtaaggaatgtgtgaagatcttcattcatgacataaggtctgattaacatcaaataattggtatttgttaaaaagagtttaaataggaggaatgtgggaaggacctaaacttaattcagttcttgctgcacatcagagaattcatactgctgtgtaatcctatgcacataaggaatttgggaaggcttatagacacagtaaatatcttagagtacatcagagaattcatccaaatgagaaatcatttgaattagaattata

SEQ ID NO: 2912 - DNA, 2208 bp, Homo sapiens
gggggcgaggttgctgcagtgcattcggtggtagtttggtgtcagtcctgtgtcttgtcggtccttctaaacgtgtccccttacgatgctggctcgcaaccacctggaagttgactaaggggagaaggagtctcgttggaaaacggaggcacaattctgtcttctcttgaactgcataactgagaactctgcaaattccccaaagaaggaggaaaaatgaccatgttcaaggaggcagtgaccttcaaggatgtggctgtggtcttcaccgaggaggagctggggctgctggacgtttcccagaggaagctgtatcgagatgtcatgctggagaacttcagaaacctgctatcagtggggcatcaactttcccaccgagatacttttcacttccaaagagaagaaaagttttggatcatggagacagcaacccaaagagaagggaattcaggaggcaagatccaaactgagttggagtctgttccagaaacaggaccacatgaagagtggtcttgccagcaaatctgggaacaaactgcaagtgagttaactagacctcaagactccataagtagctctcagttctccacacaaggtgatgtcccctcccaggttgacgcaggactatctataattcacataggagagacaccttctgagcatgggaagtgtaaaaaattcttcagtgatgtctccatccttgatcttcatcaacaattacactcaggaaagatatcccatacatgtaatgagtacaggaagagattctgttatagctcagctctttgtcttcatcagaaagttcacatgggagagaaacgctataagtgtgatgtgtgtagtaaggcatttagtcagaactcacaactgcaaactcatcagagaatccacactggagagaaaccattcaaatgtgagcagtgtgggaaaagtttcagccgtagatcaggaatgtatgttcattgcaaattacacacaggagaaaaacctcatatttgtgaggaatgtgggaaggccttcattcacaattcccagcttcgggaacatcaaagaatccatactggggagaagccattcaaatgttatatatgtggtaagagcttccatagtagatcaaatcttaataggcattccatggtccacatgcaagagaaatcatttagatgtgatacctgtagtaatagctttggtcagagatcagcacttaatagtcattgcatggaccacacaaaagagaaactatacaaatgtgaagaatgtggaaggagcttcacttgtaggcaagatctttgtaagcatcagatggaccatacaggagacaaaccatataattgtaatgtatgtgggaagggcttcaggtggtcctcatgtctttcaagacatcagcgggtccacaatggagaaacaacattcaagtgcgacggatgtgggaagagattttatatgaattcacagggccattcacatcagagagcctatagagaagaagaactgtataaatgtcagaagtgtgggaagggctacattagtaagtttaatcttgacttgcaccagagggtccacacgggagagagaccttataattgtaaggaatgtggaaagagcttcaggtgggcctcaggtattttgagacataagagactccatactggagaaaaaccattcaaatgtgaagagtgtgggaagaggtttactgagaattcaaaacttcgtttccatcaaagaattcacactggagaaaagccttacaaatgtgaggagtgtggaaagggattcagatgggcctcaactcatctaacccatcaaagactccacagcagagaaaaactattccaatgtgaggattgtgggaagagcagtgagcacagttcatgccttcaagaccaacaaagcgaccacagtggagaaaaaacatccaaatgtgaggactgtgggaagcgctacgagaggcgcttgaatctagatatgattttatcattatttttaaatgatatataattattgtccatatttatgggttacagcatatttcaatacatgtatacaatgtataatgatcaaatcagtgttattagcatatccatcacctcctttatcatttatttgtggatcatttatcatttctttgtgctttgaacgttcaaaaactgctgttctagttatttgaaaataagttattattaattatagtcacctttagtgctgtgg

SEQ ID NO: 2913 - DNA, 2843 bp, Homo sapiens
actggacgcacgctgcgggcgacattgtttgggacgctgggttctgcttttccagaatcctgccctttccaaaaggaagacggtatgattaagttccagatggtgacattcaaggatgttgctgtggtcttcactgaggaggagctggggctgctggactctgtccagaggaagctgtaccgagatgtgatgctggagaacttcaggaacctgctcttagtagcacatcagcccttcaagccagacctaatatcccagctggagagagaagaaaagcttttgatggtggagacagaaaccccaagagatggatgttcaggaaggaagaatcaacaaaagatggagagtattcaggaagtaacagtaagctacttttcccccaaagagctttcctcccgtcagacctggcaacaaagtgcaggtgggttaatcaggtgtcaagatttcctgaaagtttttcaagggaagaattctcagttgcaagaacaaggtaattccctcggccaggtttgggcaggaataccagttcagatttctgaagataagaactatatattcactcatatagggaatggctccaattatataaaaagtcaagggtatccatcttggagggcacatcattcttggaggaaaatgtatctgaaagagtcacataattatcagtgtagatgtcagcaaatttccatgaaaaatcatttctgtaagtgtgacagtgtcagttggctctcacatcacaatgataaactggaagtacacagaaaagaaaactacagctgccatgactgtggagaagatatcatgaaggtatcattacttaatcaggagtcaattcaaacagaggagaagccctatccatgtactgggtatagaaaagccttcagtaatgactccagctctgaggttcatcagcagttccacttggaagggaagccctatacatacagttcatgtggaaagggctgtaattatagttcacttcttcatattcatcaaaatattgagagagaagatgatattgagaattcacatctgaaatcctatcagagagtgcatacagaggagaaaccatgcaaatgtggtgaatatggtgagaacttcaatcactgttcccctcttaacacttatgaacttatccacacaggtgagatgtcctataggcacaacatttatgagaaagccttcagtcatagcttagaccttaatagtatttttagggtccatactagggatgaaccccatgaatatgaggaaaatgagaatgtctttaatcagagttcatgtcttcaagtccatcaaaaaatccacactgaagagaaactatacacagatatagagtatggaaagagtttcatttgtagttcaaatcttgacattcagcatagggttcatatggaagagaattcatataattctgaggagtgtggtaatggcttcagtctggcctcacattttcaggaccttcagatagtccacactaaggaacaaccatataaacgctatgtgtgtagtaacagcttcagccataatttatatcttcaaggtcatccaaaaattcacattggagagaaaccacgtaaggagcatgggaatggcttcaactggagctcaaaacttaaagatcatcagagagtccacactggacagaagccatacaaatgcaatatatgcggcaaaggtttcaatcatagatcagttctgaatgttcatcagagagtccacacaggagagaaaccttataaatgcgaggaatgtgataagggattcagtcggagttcatatcttcaagcccatcagagagtccacactggagaaaaaccttataaatgtgaggaatgtgggaaggggttcagtcgaaattcataccttcaaggccatcagagagttcacactggagaaaaaccatacaagtgtgaggagtgtgggaagggcttcagtcggagttcacaccttcaaggccatcagagagtccacactggagaaaaaccattcaaatgtgaggaatgtgggaaggggttcagttggagctttaatcttcaaattcatcagagggttcacacaggagaaaaaccctataaatgtgaagaatgtggtaaaggcttcagtaaggcctcaacacttttggcccatcagagggtccacacgggagagaagccataccaatgtgatgagtgtggtaagagtttcagtcagagatcataccttcagagtcatcagagtgtccattctggagaaagaccatatatatgtgaggtatgtggaaagggcttcagtcagagagcatatcttcaaggtcatcagagagtccacactagagtgaaaccgtataaatgtgagatgtgtgggaagggctttagtcagagttcgcgccttgaagcacatcggagggttcacacaggagggaaaccatacaaatgtgaggtgtgtacaaagggtttcagtgagagttcacgccttcaagcacaccaaagggttcatgtggaagggagaccctataaatgtgaacagtgtggtaagggtttcagtgggtattcaagtcttcaagcccatcacagagtccacacaggagagaaaccatacaaatgtgaggtatgtggaaagggcttcagtcagagatcaaatcttcaggctcaccagagagtccacacaggagagaaaccatacaaatgtgatgcatgtggtaagggtttccgttggagctcaggtcttctcattcatcaaagagtccatagtagtgataaattctataaaagcgaagactatggtaaggactacccttcatcagagaatctacacagaaatgaagattctgttttgttttgaagtcctcaaatgggagctga

SEQ ID NO: 2914 - DNA, 5993 bp, Homo sapiens
cgacattgtttgggacgctgggttctgcttttccagaatcctgccctttccaaaaggaagacggtatgattaagttccaggaaagggtgacattcaaggatgtggctgttgtcttcaccaaggaagagctggcactattggataaagcccagataaacctgtaccaagatgtgatgctggaaaacttcaggaacctcatgttagtgagagacgggattaaaaacaacattttgaatcttcaggcaaaggggttaagttacctttcgcaagaagtgcttcattgctggcagatttggaaacaaaggatccgggatttaactgtgagtcaggattatatcgtgaaccttcaagaagagtgttccccacatttagaagatgtttccctcagtgaagagtgggcaggcatttctcttcagatttctgaaaatgaaaactatgtagtaaatgccattatcaaaaatcaagatatcacagcatggcaaagcctgacacaggttcttaccccagaatcgtggaggaaagccaacataatgaccgagccccagaactctcagggaagatataagggaatttacatggaagagaaattgtacagacgtgctcagcatgatgacagcctcagttggacctcatgtgatcatcatgagtcccaagaatgtaaaggagaggaccctggtagacatcccaactgtgggaaaaacttgggtatgaaatcaacggttgaaaaacgtaatgcggcccatgtattaccacagcctttcccatgtaataactgtggggtggcctttgcagatgatacagatcctcatgtccatcacagcactcacctaggagaaaaatcttataaatgtgaccagtatggaaagaactttagtcagagccaagatcttatcgttcattgtaaaactcactctggcaagactccctatgaattccacgaatggcctatgggctgcaaacagagctcagaccttcccagatatcagaaagtctcctcaggagacaaaccctacaaatgtaaagaatgtggcaagggcttcaggcgcagctcttcccttcacaaccatcatcgagtccacacaggggagatgccctacaaatgcgatgaatgtgggaaagggtttggatttaggtcacttctttgtattcatcagggagtacacacagggaaaaagccctataaatgtgaagagtgtgggaagggctttgatcagagctccaaccttcttgtccatcagagagtccacactggagagaagccctacaaatgcagtgagtgtggcaagtgctttagttcaagctccgttcttcaagtccactggaggtttcacacaggggagaaaccatataggtgtggtgagtgtggaaagggcttcagccaatgtacacaccttcacattcaccagagagtccacacaggggagaaaccatacaaatgcaatgtgtgtggaaaggattttgcgtatagctctgttcttcacactcatcagagagttcacactggagaaaaaccatataaatgtgaagtgtgtggaaagtgcttcagttacagttcatattttcacttacatcaaagagatcacatcagagagaaaccatataaatgtgatgagtgtggtaaaggcttcagccggaattcagatcttaatgttcacctcagagtccacacaagagagaggccctataagtgtaaggcatgtggtaagggcttcagtcgtaattcatacctccttgcccatcagagagtgcatatagatgagacacagtacacacattgtgagcgtggaaaggaccttctgactcatcaaagactacatgagcagagagaaacattataaatgtagtaagtcagggttcaattagtaaaacagaagccacactgtattccagatgatagaggcttactcagcctgtgggagggctaggggagcaaaagacagggacactgccatcgataatgtcagcctgcagcactgaagtgtgccaggcaaggactgtggatttcaagaacttctgtgaagctcccatcaactgctgtatgctacaatggcaaagaggttacttttgacaaatgggtggtttgtggtagtggttgtagttagtggtcaaatttccattaaagggtgtgtccaggaaggaaattctaattgggatgatcatggtaaggtcttcagttcagccaacgtctttagatttttttttagtccccagtagaaaaatactctctgtatgaagaacattcaaaagtgtgctcaaaaatgaaacccatgctcttactatgaaagaacgttagtacccaggttttccatgagattctctacacaggcaagaagctccatagaagtggcatttgaagggtgtggcagaggcagtgctgtgtttatcacactggttccatttccttgcaaataagaagtctatttcccagtaacccttgcagttaagagtgtgcccatgtgattgagttctagccaatggagtgtgagcaaaagtgatataagccactttcaggtctagcctttacaaacatcctcaggcttctctatccctgccaaggtgaccttggaggctgcttattccagactgggttgatagaaggtcactacttcatctgtgttggatttctttttagagtaagaaataaaagttcattgtgtctcaccactgagatttttggtggtttatttattactgcagcattgcctaggctatcctgactagcatggagggattttatagcaatatgtttcattgtcattggagtccacatacagaagtaacataattcagagttcaaaacttttaaatcttcaaggcttgatgtggcagtgcaaccatctaaaatggtatggatgggacttcttcagtgataaccttcattcattggtgagtacaccaaagagaaatgttccagatgatatagctgtggtaaaactttactgaaaagtataacccaccgacgtaagaaatctcatataatagagaaactctataatgtgggatgctgaataggtttgtcagctcacaccttaaatgcgattaaaaattaactagaataggtgttctgtggttagtcttaataaaattaattgaataaaatcaacatttactaaagtgaccaacaacatgtaaaaaaccaacagtgttcattgcagactgatgcagtcttcttctcagcagacctgtataataatgggtttttaaaggatgctctttctgtcagtttccccccaaatttgtcatttaattggggataatagatgaattcgagaggagatctctttgctttttttttttttttttttttttggaaacagggtcttgctgtgtcacccaggtggctggagtgcagtggcctgatcattgctcgctgaagccttgaactcctggcttcagtgatcctcctgcctcagcctcctgagtagctgggactacagacatacaccaccgtgttcagctgatgttttctttaaaaattgtacttgtagagatggggtcttactttgttgcccaggttagtctcaaacttctggtttcaagcgatcctcctacctcagcttcccaaagtgcagggattacaggtttgggccactgcactcatcccacaaggtgttttttttttccttcaaaaacagtgtccttttttgttttaattgacttataggtttcttcatttggatcatggtttattcctagtttttcttgcattacagtttcctgctagttatagtttgtaaacagaacagccattcaagtgcaaataaaaccatccctgaagtgtcattttcttactgatcaggtggataatagtgaaatattttaaaaattctatgtcagtagaaatgaggaaatgagtgttcttacataagttggtgggggaaagaaaaacaggtacaaagttgctggagaggatcttgtctatatgtatcatatgtacaatgtgcattgtctttgagccaatgatcctgcttctcagaatgtatttttaggatgtaattacatgagtggggaaaatatggtttcagaaagaaatatgttctaagaattttgcaatgagaagactgtaaacaacctgaaggttcatgtataagagattgagtaaattagggcatcccatataatggaataacatggctccatcaacaatgatctagacctataaaaatgtccacatgttattgtccatgtccaccacatactccagtactcctacttgcaaacattaagttagagaaaaaatccgggatacacattatcctaggaagcttttggggtttagaatgggtgcaacattccttcatgacagaatcagccctcagtgttggtggaggtgtcccaggcaatcctctagtttggccgggagcagcgcttgcatatcacattaagctttttaaatatatgatgctaacaggaatgtctccctacttcacaaaattgtttgcttttcctcttgtagcaaagtagcatggaaaaagcagaaattagtctagctcccaatcagtgggagccaatctcatttacaaatgaagatgcagagatcctaaataaatatgagcatgtcaaatccaatgatttgataaaagcgtaacagactcgctcatgtataatttatcctaaatatgcttatcagcttctgcctcataacacacacaagaactgagtagctctaaatacatatttatttagctcatgatgtgtgagctggcaagttcaactgggcttagctgggcagttctggtgtgggacatgctagattatcttaactgggctttgtacatgcatctgcagtcagctgatggttcatctgggcctggctgttttatgatggtcatagatgagacaacgaagttctctctgtcatcatggtctctcaccctccagaagaccaatcgagggttggtcccatagtgccagggtttcaagggcaaaagctgtgatctcttaaggcctcatcagggaacaggctcaatgatactttcaccacattttaatgattaaagcaagtcacaacactggcccagattcatggggtgagattaagacaaaataaaaaatgttgagacataatcattggaaggaaaaggaagatactatttttatgctagagaataatgttatttacttataaaattcaaatccacctgtaaaatttgaccaattgaaggctgttttaaaattatcgggtcaacaaattggtttcacacgaaattggcatgtgaaaattcatagcattactatgtaagagtcttttataaaatgtagccaaaatgtttcattcacaataacaattgtgtgcaatgaccagaattgtccaaaggtaattctgggagttccctttgggatgcctaggtgaggagctatctggggcctcagactcccacattcttcagtgggaagggctttacatgaactcaacttcccagcggctttctcttcctgatgggaggtgttagaacctggctttctcatgcaacttctgtgaagctctgacaactaaagccagattgtctgctttagttaagtagtccagattacctgcatagtcaatttgttccctcaccaacatggatgccttcacaattgctctttaagaaggataaaaacatagcggtgaggtgtggtctatttcctgcttcacccaggccctggtgcttcttcaagtggtatgagaaattgtggtcctgtgccttctcttccagacccttagcttacatgttttccctataaaacttagtcctaatcccagcactttgggaggccaaggtggctgaatcacaagatcaggagtttgagaccagcctggccaacatagtgaaaccccgtctctactaaaaatacacaaaattagctgggcatagtggcaggcacctgtaatcccagctactcaggaggctgaggcaggagaatcgcttgagcacaggaggtggaggttgcaatgagccaagatcgcaccactgcactccagcccaggcgacagggcaagactctgtctc

SEQ ID NO: 2915 - DNA, 3735 bp, Homo sapiens
gtagtccaggaggtctcggtaggcagagccacttccgccccaggtacgctaggccgcggccttcgttcctcccagaaaggtctctgcctttctctagaaaaagaaagagaaaaatgaccaaattccaggagatggtgacattcaaggatgttgctgtggtcttcactgaggaggagctggggctgctggactctgtccagaggaagctgtaccgagatgtgatgctggagaacttcaggaacctgctcttagtagcacatcagcccttcaagccagacctaatatcccagctggagagagaagaaaagcttttgatggtggagacagaaaccccaagagatggatgttcaggaaggaagaatcaacaaaagatggagagtattcaggaagtaacagtaagctacttttcccccaaagagctttcctcccgtcagacctggcaacaaagtgcaggtgggttaatcaggtgtcaagatttcctgaaagtttttcaagggaagaattctcagttgcaagaacaaggtaattccctcggccaggtttgggcaggaataccagttcagatttctgaagataagaactatatattcactcatatagggaatggctccaattatataaaaagtcaagggtatccatcttggagggcacatcattcttggaggaaaatgtatctgaaagagtcacataattatcagtgtagatgtcagcaaatttccatgaaaaatcatttctgtaagtgtgacagtgtcagttggctctcacatcacaatgataaactggaagtacacagaaaagaaaactacagctgccatgactgtggagaagatatcatgaaggtatcattacttaatcaggagtcaattcaaacagaggagaagccctatccatgtactgggtatagaaaagccttcagtaatgactccagctctgaggttcatcagcagttccacttggaagggaagccctatacatacagttcatgtggaaagggctgtaattatagttcacttcttcatattcatcaaaatattgagagagaagatgatattgagaattcacatctgaaatcctatcagagagtgcatacagaggagaaaccatgcaaatgtggtgaatatggtgagaacttcaatcactgttcccctcttaacacttatgaacttatccacacaggtgagatgtcctataggcacaacatttatgagaaagccttcagtcatagcttagaccttaatagtatttttagggtccatactagggatgaaccccatgaatatgaggaaaatgagaatgtctttaatcagagttcatgtcttcaagtccatcaaaaaatccacactgaagagaaactatacacagatatagagtatggaaagagtttcatttgtagttcaaatcttgacattcagcatagggttcatatggaagagaattcatataattctgaggagtgtggtaatggcttcagtctggcctcacattttcaggaccttcagatagtccacactaaggaacaaccatataaacgctatgtgtgtagtaacagcttcagccataatttatatcttcaaggtcatccaaaaattcacattggagagaaaccacgtaaggagcatgggaatggcttcaactggagctcaaaacttaaagatcatcagagagtccacactggacagaagccatacaaatgcaatatatgcggcaaaggtttcaatcatagatcagttctgaatgttcatcagagagtccacacaggagagaaaccttataaatgcgaggaatgtgataagggattcagtcggagttcatatcttcaagcccatcagagagtccacactggagaaaaaccttataaatgtgaggaatgtgggaaggggttcagtcgaaattcataccttcaaggccatcagagagttcacactggagaaaaaccatacaagtgtgaggagtgtgggaagggcttcagtcggagttcacaccttcaaggccatcagagagtccacactggagaaaaaccattcaaatgtgaggaatgtgggaaggggttcagttggagctttaatcttcaaattcatcagagggttcacacaggagaaaaaccctataaatgtgaagaatgtggtaaaggcttcagtaaggcctcaacacttttggcccatcagagggtccacacgggagagaagccataccaatgtgatgagtgtggtaagagtttcagtcagagatcataccttcagagtcatcagagtgtccattctggagaaagaccatatatatgtgaggtatgtggaaagggcttcagtcagagagcatatcttcaaggtcatcagagagtccacactagagtgaaaccgtataaatgtgagatgtgtgggaagggctttagtcagagttcgcgccttgaagcacatcggagggttcacacaggagggaaaccatacaaatgtgaggtgtgtacaaagggtttcagtgagagttcacgccttcaagcacaccaaagggttcatgtggaagggagaccctataaatgtgaacagtgtggtaagggtttcagtgggtattcaagtcttcaagcccatcacagagtccacacaggagagaaaccatacaaatgtgaggtatgtggaaagggcttcagtcagagatcaaatcttcaggctcaccagagagtccacacaggagagaaaccatacaaatgtgatgcatgtggtaagggtttccgttggagctcaggtcttctcattcatcaaagagtccatagtagtgataaattctataaaagcgaagactatggtaaggactacccttcatcagagaatctacacagaaatgaagattctgttttgttttgaagtcctcaaatgggagctgaaattttccagtcactagagttctttcagtagaaaaagaatttttaaaaattaaaatgtaatgttgctgcccaacttcaacattcataatggccaggagaccacacaacagagacatttaatgagaggggtttcacgagggattttgttagaactttaacatcagtcattgcacaggagctaaggcttataaaatatgagtatggtcaggaatttaataaaagtacagtgatgagcatgcctaaatccatgttctctagaatgtaagcttggtgaaagaagggactttgttcattgctagtctacaaaactaggacatttcataacgcaatgtaggtgctcagtactttttgctaaataactaaaagtatgtaaaggtaaaaggtttgaaatttttaagcgcattttttaaaacttaaaatgtatttggaggagaaatcctgcaagtaatcttaataaaatcatttcaagtaaatatttgaaatgtagaacaataagcattatgatgatctgaaataacattaatttgattgtaaccctattggggttagttcccaccctttgttccatcttgagcagagatgtgctgcatttcttaacgtttggtctctatacattataccatctgctgaagtttagctttgtgtgtgtgtatatgtacccatgtgtgcacttgaaatatcagtacaaactgataaacaatgtttctggttaatgttgcaaaaatggaacactgtattttacataattgattttctactcctgccctgtgaattaaggcagagttttactgtaatatttgcaagtatccaaaatggttactgatgacaaatactttttaataaatgtcaaaatcacaata

SEQ ID NO: 2916 - DNA, 3686 bp, Homo sapiens
gtagtccaggaggtctcggtaggcagagccacttccgccccaggtacgctaggccgcggccttcgttcctcccagaaaggagatggtgacattcaaggatgttgctgtggtcttcactgaggaggagctggggctgctggactctgtccagaggaagctgtaccgagatgtgatgctggagaacttcaggaacctgctcttagtagcacatcagcccttcaagccagacctaatatcccagctggagagagaagaaaagcttttgatggtggagacagaaaccccaagagatggatgttcaggaaggaagaatcaacaaaagatggagagtattcaggaagtaacagtaagctacttttcccccaaagagctttcctcccgtcagacctggcaacaaagtgcaggtgggttaatcaggtgtcaagatttcctgaaagtttttcaagggaagaattctcagttgcaagaacaaggtaattccctcggccaggtttgggcaggaataccagttcagatttctgaagataagaactatatattcactcatatagggaatggctccaattatataaaaagtcaagggtatccatcttggagggcacatcattcttggaggaaaatgtatctgaaagagtcacataattatcagtgtagatgtcagcaaatttccatgaaaaatcatttctgtaagtgtgacagtgtcagttggctctcacatcacaatgataaactggaagtacacagaaaagaaaactacagctgccatgactgtggagaagatatcatgaaggtatcattacttaatcaggagtcaattcaaacagaggagaagccctatccatgtactgggtatagaaaagccttcagtaatgactccagctctgaggttcatcagcagttccacttggaagggaagccctatacatacagttcatgtggaaagggctgtaattatagttcacttcttcatattcatcaaaatattgagagagaagatgatattgagaattcacatctgaaatcctatcagagagtgcatacagaggagaaaccatgcaaatgtggtgaatatggtgagaacttcaatcactgttcccctcttaacacttatgaacttatccacacaggtgagatgtcctataggcacaacatttatgagaaagccttcagtcatagcttagaccttaatagtatttttagggtccatactagggatgaaccccatgaatatgaggaaaatgagaatgtctttaatcagagttcatgtcttcaagtccatcaaaaaatccacactgaagagaaactatacacagatatagagtatggaaagagtttcatttgtagttcaaatcttgacattcagcatagggttcatatggaagagaattcatataattctgaggagtgtggtaatggcttcagtctggcctcacattttcaggaccttcagatagtccacactaaggaacaaccatataaacgctatgtgtgtagtaacagcttcagccataatttatatcttcaaggtcatccaaaaattcacattggagagaaaccacgtaaggagcatgggaatggcttcaactggagctcaaaacttaaagatcatcagagagtccacactggacagaagccatacaaatgcaatatatgcggcaaaggtttcaatcatagatcagttctgaatgttcatcagagagtccacacaggagagaaaccttataaatgcgaggaatgtgataagggattcagtcggagttcatatcttcaagcccatcagagagtccacactggagaaaaaccttataaatgtgaggaatgtgggaaggggttcagtcgaaattcataccttcaaggccatcagagagttcacactggagaaaaaccatacaagtgtgaggagtgtgggaagggcttcagtcggagttcacaccttcaaggccatcagagagtccacactggagaaaaaccattcaaatgtgaggaatgtgggaaggggttcagttggagctttaatcttcaaattcatcagagggttcacacaggagaaaaaccctataaatgtgaagaatgtggtaaaggcttcagtaaggcctcaacacttttggcccatcagagggtccacacgggagagaagccataccaatgtgatgagtgtggtaagagtttcagtcagagatcataccttcagagtcatcagagtgtccattctggagaaagaccatatatatgtgaggtatgtggaaagggcttcagtcagagagcatatcttcaaggtcatcagagagtccacactagagtgaaaccgtataaatgtgagatgtgtgggaagggctttagtcagagttcgcgccttgaagcacatcggagggttcacacaggagggaaaccatacaaatgtgaggtgtgtacaaagggtttcagtgagagttcacgccttcaagcacaccaaagggttcatgtggaagggagaccctataaatgtgaacagtgtggtaagggtttcagtgggtattcaagtcttcaagcccatcacagagtccacacaggagagaaaccatacaaatgtgaggtatgtggaaagggcttcagtcagagatcaaatcttcaggctcaccagagagtccacacaggagagaaaccatacaaatgtgatgcatgtggtaagggtttccgttggagctcaggtcttctcattcatcaaagagtccatagtagtgataaattctataaaagcgaagactatggtaaggactacccttcatcagagaatctacacagaaatgaagattctgttttgttttgaagtcctcaaatgggagctgaaattttccagtcactagagttctttcagtagaaaaagaatttttaaaaattaaaatgtaatgttgctgcccaacttcaacattcataatggccaggagaccacacaacagagacatttaatgagaggggtttcacgagggattttgttagaactttaacatcagtcattgcacaggagctaaggcttataaaatatgagtatggtcaggaatttaataaaagtacagtgatgagcatgcctaaatccatgttctctagaatgtaagcttggtgaaagaagggactttgttcattgctagtctacaaaactaggacatttcataacgcaatgtaggtgctcagtactttttgctaaataactaaaagtatgtaaaggtaaaaggtttgaaatttttaagcgcattttttaaaacttaaaatgtatttggaggagaaatcctgcaagtaatcttaataaaatcatttcaagtaaatatttgaaatgtagaacaataagcattatgatgatctgaaataacattaatttgattgtaaccctattggggttagttcccaccctttgttccatcttgagcagagatgtgctgcatttcttaacgtttggtctctatacattataccatctgctgaagtttagctttgtgtgtgtgtatatgtacccatgtgtgcacttgaaatatcagtacaaactgataaacaatgtttctggttaatgttgcaaaaatggaacactgtattttacataattgattttctactcctgccctgtgaattaaggcagagttttactgtaatatttgcaagtatccaaaatggttactgatgacaaatactttttaataaatgtcaaaatcacaata

SEQ ID NO: 2917 - DNA, 3622 bp, Homo sapiens
cttactgtgtgccaggagatggtgacattcaaggatgttgctgtggtcttcactgaggaggagctggggctgctggactctgtccagaggaagctgtaccgagatgtgatgctggagaacttcaggaacctgctcttagtagcacatcagcccttcaagccagacctaatatcccagctggagagagaagaaaagcttttgatggtggagacagaaaccccaagagatggatgttcaggaaggaagaatcaacaaaagatggagagtattcaggaagtaacagtaagctacttttcccccaaagagctttcctcccgtcagacctggcaacaaagtgcaggtgggttaatcaggtgtcaagatttcctgaaagtttttcaagggaagaattctcagttgcaagaacaaggtaattccctcggccaggtttgggcaggaataccagttcagatttctgaagataagaactatatattcactcatatagggaatggctccaattatataaaaagtcaagggtatccatcttggagggcacatcattcttggaggaaaatgtatctgaaagagtcacataattatcagtgtagatgtcagcaaatttccatgaaaaatcatttctgtaagtgtgacagtgtcagttggctctcacatcacaatgataaactggaagtacacagaaaagaaaactacagctgccatgactgtggagaagatatcatgaaggtatcattacttaatcaggagtcaattcaaacagaggagaagccctatccatgtactgggtatagaaaagccttcagtaatgactccagctctgaggttcatcagcagttccacttggaagggaagccctatacatacagttcatgtggaaagggctgtaattatagttcacttcttcatattcatcaaaatattgagagagaagatgatattgagaattcacatctgaaatcctatcagagagtgcatacagaggagaaaccatgcaaatgtggtgaatatggtgagaacttcaatcactgttcccctcttaacacttatgaacttatccacacaggtgagatgtcctataggcacaacatttatgagaaagccttcagtcatagcttagaccttaatagtatttttagggtccatactagggatgaaccccatgaatatgaggaaaatgagaatgtctttaatcagagttcatgtcttcaagtccatcaaaaaatccacactgaagagaaactatacacagatatagagtatggaaagagtttcatttgtagttcaaatcttgacattcagcatagggttcatatggaagagaattcatataattctgaggagtgtggtaatggcttcagtctggcctcacattttcaggaccttcagatagtccacactaaggaacaaccatataaacgctatgtgtgtagtaacagcttcagccataatttatatcttcaaggtcatccaaaaattcacattggagagaaaccacgtaaggagcatgggaatggcttcaactggagctcaaaacttaaagatcatcagagagtccacactggacagaagccatacaaatgcaatatatgcggcaaaggtttcaatcatagatcagttctgaatgttcatcagagagtccacacaggagagaaaccttataaatgcgaggaatgtgataagggattcagtcggagttcatatcttcaagcccatcagagagtccacactggagaaaaaccttataaatgtgaggaatgtgggaaggggttcagtcgaaattcataccttcaaggccatcagagagttcacactggagaaaaaccatacaagtgtgaggagtgtgggaagggcttcagtcggagttcacaccttcaaggccatcagagagtccacactggagaaaaaccattcaaatgtgaggaatgtgggaaggggttcagttggagctttaatcttcaaattcatcagagggttcacacaggagaaaaaccctataaatgtgaagaatgtggtaaaggcttcagtaaggcctcaacacttttggcccatcagagggtccacacgggagagaagccataccaatgtgatgagtgtggtaagagtttcagtcagagatcataccttcagagtcatcagagtgtccattctggagaaagaccatatatatgtgaggtatgtggaaagggcttcagtcagagagcatatcttcaaggtcatcagagagtccacactagagtgaaaccgtataaatgtgagatgtgtgggaagggctttagtcagagttcgcgccttgaagcacatcggagggttcacacaggagggaaaccatacaaatgtgaggtgtgtacaaagggtttcagtgagagttcacgccttcaagcacaccaaagggttcatgtggaagggagaccctataaatgtgaacagtgtggtaagggtttcagtgggtattcaagtcttcaagcccatcacagagtccacacaggagagaaaccatacaaatgtgaggtatgtggaaagggcttcagtcagagatcaaatcttcaggctcaccagagagtccacacaggagagaaaccatacaaatgtgatgcatgtggtaagggtttccgttggagctcaggtcttctcattcatcaaagagtccatagtagtgataaattctataaaagcgaagactatggtaaggactacccttcatcagagaatctacacagaaatgaagattctgttttgttttgaagtcctcaaatgggagctgaaattttccagtcactagagttctttcagtagaaaaagaatttttaaaaattaaaatgtaatgttgctgcccaacttcaacattcataatggccaggagaccacacaacagagacatttaatgagaggggtttcacgagggattttgttagaactttaacatcagtcattgcacaggagctaaggcttataaaatatgagtatggtcaggaatttaataaaagtacagtgatgagcatgcctaaatccatgttctctagaatgtaagcttggtgaaagaagggactttgttcattgctagtctacaaaactaggacatttcataacgcaatgtaggtgctcagtactttttgctaaataactaaaagtatgtaaaggtaaaaggtttgaaatttttaagcgcattttttaaaacttaaaatgtatttggaggagaaatcctgcaagtaatcttaataaaatcatttcaagtaaatatttgaaatgtagaacaataagcattatgatgatctgaaataacattaatttgattgtaaccctattggggttagttcccaccctttgttccatcttgagcagagatgtgctgcatttcttaacgtttggtctctatacattataccatctgctgaagtttagctttgtgtgtgtgtatatgtacccatgtgtgcacttgaaatatcagtacaaactgataaacaatgtttctggttaatgttgcaaaaatggaacactgtattttacataattgattttctactcctgccctgtgaattaaggcagagttttactgtaatatttgcaagtatccaaaatggttactgatgacaaatactttttaataaatgtcaaaatcacaata

SEQ ID NO: 2918 - DNA, 3174 bp, Homo sapiens
gaaagtgaggtcatcattcctttcaggaagttgagtgaggcctgagacagcaatgtttcgtttagcctggcggcggccctccttatcttcaagaagagcatccgcggctagcagtggaagatggggttgggccccaggtctctgcctttctctagaaaaagaaagagaaaaatgaccaaattccaggagatggtgacattcaaggatgttgctgtggtcttcactgaggaggagctggggctgctggactctgtccagaggaagctgtaccgagatgtgatgctggagaacttcaggaacctgctcttagtagcacatcagcccttcaagccagacctaatatcccagctggagagagaagaaaagcttttgatggtggagacagaaaccccaagagatggatgttcaggaaggaagaatcaacaaaagatggagagtattcaggaagtaacagtaagctacttttcccccaaagagctttcctcccgtcagacctggcaacaaagtgcaggtgggttaatcaggtgtcaagatttcctgaaagtttttcaagggaagaattctcagttgcaagaacaaggtaattccctcggccaggtttgggcaggaataccagttcagatttctgaagataagaactatatattcactcatatagggaatggctccaattatataaaaagtcaagggtatccatcttggagggcacatcattcttggaggaaaatgtatctgaaagagtcacataattatcagtgtagatgtcagcaaatttccatgaaaaatcatttctgtaagtgtgacagtgtcagttggctctcacatcacaatgataaactggaagtacacagaaaagaaaactacagctgccatgactgtggagaagatatcatgaaggtatcattacttaatcaggagtcaattcaaacagaggagaagccctatccatgtactgggtatagaaaagccttcagtaatgactccagctctgaggttcatcagcagttccacttggaagggaagccctatacatacagttcatgtggaaagggctgtaattatagttcacttcttcatattcatcaaaatattgagagagaagatgatattgagaattcacatctgaaatcctatcagagagtgcatacagaggagaaaccatgcaaatgtggtgaatatggtgagaacttcaatcactgttcccctcttaacacttatgaacttatccacacaggtgagatgtcctataggcacaacatttatgagaaagccttcagtcatagcttagaccttaatagtatttttagggtccatactagggatgaaccccatgaatatgaggaaaatgagaatgtctttaatcagagttcatgtcttcaagtccatcaaaaaatccacactgaagagaaactatacacagatatagagtatggaaagagtttcatttgtagttcaaatcttgacattcagcatagggttcatatggaagagaattcatataattctgaggagtgtggtaatggcttcagtctggcctcacattttcaggaccttcagatagtccacactaaggaacaaccatataaacgctatgtgtgtagtaacagcttcagccataatttatatcttcaaggtcatccaaaaattcacattggagagaaaccacgtaaggagcatgggaatggcttcaactggagctcaaaacttaaagatcatcagagagtccacactggacagaagccatacaaatgcaatatatgcggcaaaggtttcaatcatagatcagttctgaatgttcatcagagagtccacacaggagagaaaccttataaatgcgaggaatgtgataagggattcagtcggagttcatatcttcaagcccatcagagagtccacactggagaaaaaccttataaatgtgaggaatgtgggaaggggttcagtcgaaattcataccttcaaggccatcagagagttcacactggagaaaaaccatacaagtgtgaggagtgtgggaagggcttcagtcggagttcacaccttcaaggccatcagagagtccacactggagaaaaaccattcaaatgtgaggaatgtgggaaggggttcagttggagctttaatcttcaaattcatcagagggttcacacaggagaaaaaccctataaatgtgaagaatgtggtaaaggcttcagtaaggcctcaacacttttggcccatcagagggtccacacgggagagaagccataccaatgtgatgagtgtggtaagagtttcagtcagagatcataccttcagagtcatcagagtgtccattctggagaaagaccatatatatgtgaggtatgtggaaagggcttcagtcagagagcatatcttcaaggtcatcagagagtccacactagagtgaaaccgtataaatgtgagatgtgtgggaagggctttagtcagagttcgcgccttgaagcacatcggagggttcacacaggagggaaaccatacaaatgtgaggtgtgtacaaagggtttcagtgagagttcacgccttcaagcacaccaaagggttcatgtggaagggagaccctataaatgtgaacagtgtggtaagggtttcagtgggtattcaagtcttcaagcccatcacagagtccacacaggagagaaaccatacaaatgtgaggtatgtggaaagggcttcagtcagagatcaaatcttcaggctcaccagagagtccacacaggagagaaaccatacaaatgtgatgcatgtggtaagggtttccgttggagctcaggtcttctcattcatcaaagagtccatagtagtgataaattctataaaagcgaagactatggtaaggactacccttcatcagagaatctacacagaaatgaagattctgttttgttttgaagtcctcaaatgggagctgaaattttccagtcactagagttctttcagtagaaaaagaatttttaaaaattaaaatgtaatgttgctgcccaacttcaacattcataatggccaggagaccacacaacagagacatttaatgagaggggtttcacgagggattttgttagaactttaacatcagtcattgcacaggagctaaggcttataaaatatgagtatggtcaggaatttaataaaagtacagtgatgagcatgcct

SEQ ID NO: 2919 - DNA, 5997 bp, Homo sapiens
tgcagttctgcttttccagaatcctgccctttccaaaaggaagacggtatgattaagttccaggtaagactttccaacctccaggaaagggtgacattcaaggatgtggctgttgtcttcaccaaggaagagctggcactattggataaagcccagataaacctgtaccaagatgtgatgctggaaaacttcaggaacctcatgttagtgagagacgggattaaaaacaacattttgaatcttcaggcaaaggggttaagttacctttcgcaagaagtgcttcattgctggcagatttggaaacaaaggatccgggatttaactgtgagtcaggattatatcgtgaaccttcaagaagagtgttccccacatttagaagatgtttccctcagtgaagagtgggcaggcatttctcttcagatttctgaaaatgaaaactatgtagtaaatgccattatcaaaaatcaagatatcacagcatggcaaagcctgacacaggttcttaccccagaatcgtggaggaaagccaacataatgaccgagccccagaactctcagggaagatataagggaatttacatggaagagaaattgtacagacgtgctcagcatgatgacagcctcagttggacctcatgtgatcatcatgagtcccaagaatgtaaaggagaggaccctggtagacatcccaactgtgggaaaaacttgggtatgaaatcaacggttgaaaaacgtaatgcggcccatgtattaccacagcctttcccatgtaataactgtggggtggcctttgcagatgatacagatcctcatgtccatcacagcactcacctaggagaaaaatcttataaatgtgaccagtatggaaagaactttagtcagagccaagatcttatcgttcattgtaaaactcactctggcaagactccctatgaattccacgaatggcctatgggctgcaaacagagctcagaccttcccagatatcagaaagtctcctcaggagacaaaccctacaaatgtaaagaatgtggcaagggcttcaggcgcagctcttcccttcacaaccatcatcgagtccacacaggggagatgccctacaaatgcgatgaatgtgggaaagggtttggatttaggtcacttctttgtattcatcagggagtacacacagggaaaaagccctataaatgtgaagagtgtgggaagggctttgatcagagctccaaccttcttgtccatcagagagtccacactggagagaagccctacaaatgcagtgagtgtggcaagtgctttagttcaagctccgttcttcaagtccactggaggtttcacacaggggagaaaccatataggtgtggtgagtgtggaaagggcttcagccaatgtacacaccttcacattcaccagagagtccacacaggggagaaaccatacaaatgcaatgtgtgtggaaaggattttgcgtatagctctgttcttcacactcatcagagagttcacactggagaaaaaccatataaatgtgaagtgtgtggaaagtgcttcagttacagttcatattttcacttacatcaaagagatcacatcagagagaaaccatataaatgtgatgagtgtggtaaaggcttcagccggaattcagatcttaatgttcacctcagagtccacacaagagagaggccctataagtgtaaggcatgtggtaagggcttcagtcgtaattcatacctccttgcccatcagagagtgcatatagatgagacacagtacacacattgtgagcgtggaaaggaccttctgactcatcaaagactacatgagcagagagaaacattataaatgtagtaagtcagggttcaattagtaaaacagaagccacactgtattccagatgatagaggcttactcagcctgtgggagggctaggggagcaaaagacagggacactgccatcgataatgtcagcctgcagcactgaagtgtgccaggcaaggactgtggatttcaagaacttctgtgaagctcccatcaactgctgtatgctacaatggcaaagaggttacttttgacaaatgggtggtttgtggtagtggttgtagttagtggtcaaatttccattaaagggtgtgtccaggaaggaaattctaattgggatgatcatggtaaggtcttcagttcagccaacgtctttagatttttttttagtccccagtagaaaaatactctctgtatgaagaacattcaaaagtgtgctcaaaaatgaaacccatgctcttactatgaaagaacgttagtacccaggttttccatgagattctctacacaggcaagaagctccatagaagtggcatttgaagggtgtggcagaggcagtgctgtgtttatcacactggttccatttccttgcaaataagaagtctatttcccagtaacccttgcagttaagagtgtgcccatgtgattgagttctagccaatggagtgtgagcaaaagtgatataagccactttcaggtctagcctttacaaacatcctcaggcttctctatccctgccaaggtgaccttggaggctgcttattccagactgggttgatagaaggtcactacttcatctgtgttggatttctttttagagtaagaaataaaagttcattgtgtctcaccactgagatttttggtggtttatttattactgcagcattgcctaggctatcctgactagcatggagggattttatagcaatatgtttcattgtcattggagtccacatacagaagtaacataattcagagttcaaaacttttaaatcttcaaggcttgatgtggcagtgcaaccatctaaaatggtatggatgggacttcttcagtgataaccttcattcattggtgagtacaccaaagagaaatgttccagatgatatagctgtggtaaaactttactgaaaagtataacccaccgacgtaagaaatctcatataatagagaaactctataatgtgggatgctgaataggtttgtcagctcacaccttaaatgcgattaaaaattaactagaataggtgttctgtggttagtcttaataaaattaattgaataaaatcaacatttactaaagtgaccaacaacatgtaaaaaaccaacagtgttcattgcagactgatgcagtcttcttctcagcagacctgtataataatgggtttttaaaggatgctctttctgtcagtttccccccaaatttgtcatttaattggggataatagatgaattcgagaggagatctctttgctttttttttttttttttttttttggaaacagggtcttgctgtgtcacccaggtggctggagtgcagtggcctgatcattgctcgctgaagccttgaactcctggcttcagtgatcctcctgcctcagcctcctgagtagctgggactacagacatacaccaccgtgttcagctgatgttttctttaaaaattgtacttgtagagatggggtcttactttgttgcccaggttagtctcaaacttctggtttcaagcgatcctcctacctcagcttcccaaagtgcagggattacaggtttgggccactgcactcatcccacaaggtgttttttttttccttcaaaaacagtgtccttttttgttttaattgacttataggtttcttcatttggatcatggtttattcctagtttttcttgcattacagtttcctgctagttatagtttgtaaacagaacagccattcaagtgcaaataaaaccatccctgaagtgtcattttcttactgatcaggtggataatagtgaaatattttaaaaattctatgtcagtagaaatgaggaaatgagtgttcttacataagttggtgggggaaagaaaaacaggtacaaagttgctggagaggatcttgtctatatgtatcatatgtacaatgtgcattgtctttgagccaatgatcctgcttctcagaatgtatttttaggatgtaattacatgagtggggaaaatatggtttcagaaagaaatatgttctaagaattttgcaatgagaagactgtaaacaacctgaaggttcatgtataagagattgagtaaattagggcatcccatataatggaataacatggctccatcaacaatgatctagacctataaaaatgtccacatgttattgtccatgtccaccacatactccagtactcctacttgcaaacattaagttagagaaaaaatccgggatacacattatcctaggaagcttttggggtttagaatgggtgcaacattccttcatgacagaatcagccctcagtgttggtggaggtgtcccaggcaatcctctagtttggccgggagcagcgcttgcatatcacattaagctttttaaatatatgatgctaacaggaatgtctccctacttcacaaaattgtttgcttttcctcttgtagcaaagtagcatggaaaaagcagaaattagtctagctcccaatcagtgggagccaatctcatttacaaatgaagatgcagagatcctaaataaatatgagcatgtcaaatccaatgatttgataaaagcgtaacagactcgctcatgtataatttatcctaaatatgcttatcagcttctgcctcataacacacacaagaactgagtagctctaaatacatatttatttagctcatgatgtgtgagctggcaagttcaactgggcttagctgggcagttctggtgtgggacatgctagattatcttaactgggctttgtacatgcatctgcagtcagctgatggttcatctgggcctggctgttttatgatggtcatagatgagacaacgaagttctctctgtcatcatggtctctcaccctccagaagaccaatcgagggttggtcccatagtgccagggtttcaagggcaaaagctgtgatctcttaaggcctcatcagggaacaggctcaatgatactttcaccacattttaatgattaaagcaagtcacaacactggcccagattcatggggtgagattaagacaaaataaaaaatgttgagacataatcattggaaggaaaaggaagatactatttttatgctagagaataatgttatttacttataaaattcaaatccacctgtaaaatttgaccaattgaaggctgttttaaaattatcgggtcaacaaattggtttcacacgaaattggcatgtgaaaattcatagcattactatgtaagagtcttttataaaatgtagccaaaatgtttcattcacaataacaattgtgtgcaatgaccagaattgtccaaaggtaattctgggagttccctttgggatgcctaggtgaggagctatctggggcctcagactcccacattcttcagtgggaagggctttacatgaactcaacttcccagcggctttctcttcctgatgggaggtgttagaacctggctttctcatgcaacttctgtgaagctctgacaactaaagccagattgtctgctttagttaagtagtccagattacctgcatagtcaatttgttccctcaccaacatggatgccttcacaattgctctttaagaaggataaaaacatagcggtgaggtgtggtctatttcctgcttcacccaggccctggtgcttcttcaagtggtatgagaaattgtggtcctgtgccttctcttccagacccttagcttacatgttttccctataaaacttagtcctaatcccagcactttgggaggccaaggtggctgaatcacaagatcaggagtttgagaccagcctggccaacatagtgaaaccccgtctctactaaaaatacacaaaattagctgggcatagtggcaggcacctgtaatcccagctactcaggaggctgaggcaggagaatcgcttgagcacaggaggtggaggttgcaatgagccaagatcgcaccactgcactccagcccaggcgacagggcaagactctgtctc

SEQ ID NO: 2920 - DNA, 652 bp, Homo sapiens
gctccagcgccgtaggactgaggcagactccacggtgagaaagagacccgatctaacccaggcctttcatcagagcccaggagggaaggcaggaagtgggaccacgaggcccggggggcttctaactcgtctggccagggagatctgaattggggtgaagagcagaatctccagaacaaggaggaggtggtgatcatggagacagatttggctgaaatgcctgagaaaggagctctgtcttcccaggattctccccatttccaagagaagagcacagaagagggagaagtggctgctctgcgcctcacggccagatcccaggaaacagtgacattcaaggatgtggccatggactttacaccagaggagtgggggaagctggatcctgcacaaagggatgtgatgctggagaactataggaacctagtctcactttggcttccagtttccaaacctgagagctacaacttggagaatggaaaagaaccattgaagcttgagagaaaagcccccaaaagcagctattcagcagttgcagtgatcatcctttttttgattccttatgttcatcttgagagctggtttagggagataactggaagaagaattagtaggtcttaaatcatcacatgtttagctttactaggaactg

SEQ ID NO: 2921 - DNA, 5378 bp, Homo sapiens
aaactcctgatgccccagcgtcacctcttccaggtgcccggttcccccagggacagcttcaagcggtagggacagacatctgaggacccagcctcagggatgctgtccccgggcttccaggctccagcgccgtaggactgaggcagactccacggtgagaaagagacccgatctaacccaggcctttcatcagagcccaggagggaaggcaggaagtgggaccacgaggcccggggggcttctaactcgtctggccagggagatctgaattggggtgaagagcagaatctccagaacaaggaggaggtggtgatcatggagacagatttggctgaaatgcctgagaaaggagctctgtcttcccaggattctccccatttccaagagaagagcacagaagagggagaagtggctgctctgcgcctcacggccagatcccaggaaacagtgacattcaaggatgtggccatggactttacaccagaggagtgggggaagctggatcctgcacaaagggatgtgatgctggagaactataggaacctagtctcactttggcttccagtttccaaacctgagagctacaacttggagaatggaaaagaaccattgaagcttgagagaaaagcccccaaaagcagctattcagacatggagactagaccacagagcaaggattcaacttcagtgcaagatttttccaaagcagaatcatgcaaagttgcaataatagacagactgacacggaatagtgtctatgactctaacttggaagcagcccttgaatgtgaaaattggttagagaatcagcaaggaaatcaggagagacatttgagagaaatgttcactcacatgaattcactctctgaggaaacagaccataagcatgatgtatactggaaaagcttcaatcagaaatctgtccttatcactgaagacagagttcccaaaggatcttatgccttccatacacttgaaaaaagcttgaaacaaaaatcaaacttaatgaaaaagcagagaacttataaagagaaaaaacctcataaatgtaatgattgtggtgaactcttcacctaccattcagtgcttattcgacaccagagagtccatactggagagaaaccctatacctgcaatgaatgtgggaaatcttttagccacagagctaatttaactaaacaccagagaactcatactagaattctctttgaatgcagtgaatgcaagaaaaccttcacagaaagctcatcccttgcaacacatcagagaattcacgttggagagagaccttatgaatgcaatgaatgtgggaaaggttttaatcgaagtacacatcttgtgcagcatcagttgattcatactggagtgaagccttatgaatgtaatgaatgtgataaagcttttattcattcatcagcactcattaaacatcaaagaactcatactggagagaaaccttataaatgtcaagaatgtgggaaagcctttagccattgctcatccctaactaagcatcagagagttcatactggagaaaagccatatgaatgcagtgaatgtggaaaaacttttagtcagagcacacatcttgttcaacatcagagaattcacactggagagaaaccctatgagtgtaatgaatgtgggaaaaccttcagccggagctccaattttgctaaacatcaaagaattcatattggaaagaaaccgtacaaatgtagcgagtgtggaaaagccttcattcattcatcagctctcattcaacatcagagaactcataccggagagaaaccctttagatgtaatgagtgtgggaaaagctttaagtgcagttcatctctcatcagacatcaaagagttcacactgaagagcaaccctgaaaaattactgaatgtgaagaaatgtaagttggttttatcactgtattaaatacttgagtgtttaggtggaaggcgcatccataatatgcatgtgaggaccaattctgtatgcatctaatttcatttgcgtaatacatagttttgagccataagcaggttctttatgtccgttaatttgataattatgaaatctagccagcgatttcaaaattttaatctccaacgtcccaaatagctatctgtggaaattcaagaagtccctgagagtaggtagcagtacgaacattgtgaaatccagttttcccctctcttgtttatgtcagagctttgttgtaagcctctcactttgtaaggaaattcttattgggtaggttaggctgagggcttacatccttatcatcaggaagacacaatgttgttatttattactccttgagatctagatacacatatggtataattcatctagagtgtaatttcttttatattagccttaaaaaccaaaaatgctgggttcaaagtccttagaattcccttcctccctcaacaagctgctgtctatgttgatgaccataactgggatgtataatatttacagacaactctaagttacgttcacatggattatgtacatcattgatttttttttttttttttttttgagacagagtcttgctctgttgcccgggctggagtgcagtggcgcgatctcggctcactgcaacctccacctcccaggttcatgccattctcttgtctcagcctcccaagtagctgggactacaggcacctgccagtacgcctggctaattttttttgtatttttagtagagatggggtttcaccatgttagccaggatggtcttgatctcctgacctcgtgatctgcctgcctcggcctcccaaagtgctgggattacaggcatgagccaccatgcctggcatcatcattgatttatgtcattgttatccctctaccgcggagaccttctttcattttccatttccctgggagttcacgtgaagtagtgaatgggtcaaaatcttaacagtggttgttgatcaagtccttcctttcttatccttggcactgaataaatctttggttttccataatcaaagggtgagggagacttcttttgtctacattattcagctttctgaaagctatgctgtgtccatttgagaaaaagccccagggatattgaaggtctgagaagttgagtggttcagtgtgttattatatttagggtcccagtaaagaagaactgaagcaactgtgagacaccagggcatacttccctgtatgagtggaaaacaaggcacggaaaatagctcacaggatagtcctcaactgacttgcttgaggataagcagcttcccttcgtgaagaagttgccatttctctggccttcatatttatctactttttgttattgttgtctgtatcggttcaatctcacactgctataaagaaatgcctgagactgggtaacttataaagaaaaaaggtttaattggctcatggttccatgggctgtacaggaagtatgactggggaggtctcagggagcttttactcatggcaaaaggcaaagccagagcaggtatcttcacagggctagagcaagaggaaaagagagaggggaggtgctacacactttttatgcaaccaaatctcatgagaactctatcacgagacagcagtagggggacagtgctaaatcattcatgagaaactacctgcgtggtccagtcaccttgcaccaggccccacctcccacattggggattacaattaaacatgagatttgggtggggatacagatctaaactgtatcattactcaaaaaaaaaaaaaaaaagaaagaaaagaaaacacaggaaaaggaactcacctcttttatcatcttagtatttagtactaatggtttagagcaggaattgacaaactgtggcctggactcatggaccaactctggcccaccacctgtttctcagaagaaaattttattggaactcagccacacttactcatttacatgttgtccttgactgcctttgtgtccagtgtcagaactgagtagctgcagcggaggttgtgcctctgggctttaatatcacaaacagagcagcttataagcaacagaaacttacttctcacagttttggaggctgggaagtccaagatcaaggtgtcaacatatttagggtctagggaaggtctgcttcttggttaatagaaagcacctttcactgtgtcttcacatggtagaaggggagagctctggtatcttcagccccttataagggcactaatcccattcatgagagctccaccctcacgacctaatcacctccaaaaggccccatttcgtaataccgtcagttaagtttcattatatgactttgatggggatatagcccatagtaggttgtatgtccctgaaagcctaaaatatttactgtttggctctttacagaaaatattttcttggcccctgttccagagcattcatcaagtcagataaagggtttaaaccagtcagagaaactaggtggaatggaaaagtactgagagataattggggacagaaaaataaaagagatgggaaatgctgcatcaaaatactcctacctctaggatgttactatatattgttaggagaattcaagttattgaaacttgccaaattcttgagtgaagaggaattcatttgagagccaaaatttgactaaggaaagaagaccaacatgggctttccaaagttgagtttgaattctgccatccccactaagcagtcatgtgaccttggaaaaactccctactctgagtctcagtttctttatctgtattaggtttcaacaaagggaataaatcattggcttctcatgaggttgtcataaggattaaataagacaatgcatataaaagaactggcagacaataaatatagagtcccccactcctgcttggtgctctctttctctctccttctctacatagagaagtgccagagcatccgtcagtagaagttacttaaggttggctgtgtcttccacatcttttgtttacccatgaagaactgtgaccatcttgttctgtgtcttgtcataaagatgggacgtgacttctttctgctcttgcttccatctggtgctgttttctgcacagcctccttgagaccttccagaaccttcttttttcctacttcatatcacttaaccagtagctatctgggatggttccagaggctgaagtttgcagttgaataacattttaaatagtgttaagcgacttgggatctctggccctttgcgtttcagtatttgtcctttttatgcctgatgtttaacctgccacatgtttgtactgcaacatgaatcttggaaattttaatgttatgcatttcaaatgtttttggttatctgtaaactaaatgtgcccttattggctcacttgtcaataaagatgtttgtatatgtattgtcagaaa

SEQ ID NO: 2922 - DNA, 2015 bp, Homo sapiens
cacgcctggctccgctccttcttacgcatgcgcgactccgagctggccaaagaagttcgtcccctttgtgaggcccgggatgggagctctgtcttcccaggattctccccatttccaagagaagagcacagaagagggagaagtggctgctctgcgcctcacggccagatcccaggaaacagtgacattcaaggatgtggccatggactttacaccagaggagtgggggaagctggatcctgcacaaagggatgtgatgctggagaactataggaacctagtctcactttggcttccagtttccaaacctgagagctacaacttggagaatggaaaagaaccattgaagcttgagagaaaagcccccaaaagcagctattcagacatggagactagaccacagagcaaggattcaacttcagtgcaagatttttccaaagcagaatcatgcaaagttgcaataatagacagactgacacggaatagtgtctatgactctaacttggaagcagcccttgaatgtgaaaattggttagagaatcagcaaggaaatcaggagagacatttgagagaaatgttcactcacatgaattcactctctgaggaaacagaccataagcatgatgtatactggaaaagcttcaatcagaaatctgtccttatcactgaagacagagttcccaaaggatcttatgccttccatacacttgaaaaaagcttgaaacaaaaatcaaacttaatgaaaaagcagagaacttataaagagaaaaaacctcataaatgtaatgattgtggtgaactcttcacctaccattcagtgcttattcgacaccagagagtccatactggagagaaaccctatacctgcaatgaatgtgggaaatcttttagccacagagctaatttaactaaacaccagagaactcatactagaattctctttgaatgcagtgaatgcaagaaaaccttcacagaaagctcatcccttgcaacacatcagagaattcacgttggagagagaccttatgaatgcaatgaatgtgggaaaggttttaatcgaagtacacatcttgtgcagcatcagttgattcatactggagtgaagccttatgaatgtaatgaatgtgataaagcttttattcattcatcagcactcattaaacatcaaagaactcatactggagagaaaccttataaatgtcaagaatgtgggaaagcctttagccattgctcatccctaactaagcatcagagagttcatactggagaaaagccatatgaatgcagtgaatgtggaaaaacttttagtcagagcacacatcttgttcaacatcagagaattcacactggagagaaaccctatgagtgtaatgaatgtgggaaaaccttcagccggagctccaattttgctaaacatcaaagaattcatattggaaagaaaccgtacaaatgtagcgagtgtggaaaagccttcattcattcatcagctctcattcaacatcagagaactcataccggagagaaaccctttagatgtaatgagtgtgggaaaagctttaagtgcagttcatctctcatcagacatcaaagagttcacactgaagagcaaccctgaaaaattactgaatgtgaagaaataaaactgattatattcctggtccctgaacgatcctatagagacatccagtccctgactccacctgcctccaggtgcccagaacagcccatcgtggggacttcaccctcagcaagtggacgccgtttgtcctgccagggcaggatggagatggatggggacccgtataacctgcctgcccaggggcaaggcaatatcatcattactaagtatgagcagggacaccgagctggggcagcagtggacttggggcatgagcaggttgatgtcagaaaatacaccaataacctcgggattgtgcatgagatggagctgccccacgtcagtgccctggaggtgaaggtaagagcctgtgcctgctgcgtgggaggctgcttca
